United States Patent 10,563,263 (GENETIC POLYMORPHISMS ASSOCIATED WITH STATIN RESPONSE AND CARDIOVASCULAR DISEASES, METHODS OF DETECTION AND USES THEREOF) - sequence listing, part 17

SEQ ID NO: 422 - DNA, 20001 bp, Homo sapiens
ttaagacttgttgtacacagctaacatggtactttgaaggaaatttatggcattaaatgtgtacattagaaaataagaaaggttgtaaattaattaactgaaaatttaactaaagaattaagaaaaagatagcatgtgatgacagttcagcttttattttctctcctaaatttagctttgaaggggaaatgggttctcaatgttctacacaatttctaactgttgagggttcccaggtcttagacttgagccttttctctcccaggtaatcttatccattcctacagttttaaaacaccatctgtgctgatgagtctcagtctcgagactagagctcacctctaagctacaggcatccttttctgactgctccgttaccctcaccctatggcatctcacacgtaacacgttcgaaacatatgctccaatctgtcccaagcttgtttctcctctccatgccaataaatgttgccacccacgttaactttaagcaaaagatgtaggggtcattcttgagtttatctgatgacttattctgtaagccttgtagtcacttctatttccaagatacaacccaagtccatccttttttctctctttccactattaccaccctagatgtgccactgccattcttgcttggcctcattcaagagcctctgcactggcttctatgcatgctctattgtccccaggccattctccatgcagcagtaaaatgtaaattggggcatgccatttccctgcataaacacctcaatggcttctcatcatgttgagcctcaagtccaaacttcctgctggatcttagaaggccctccctgagaggtccttgcctgtttctctagtttatcttggtcctgttcatgctcaatccccctaccctgccactgccaccttgttggcatttatgctttcagcatactggccactcaactcctttcttgccccagggcttttgtacctgcttcccacttcttgaaatgctccccacttcttgaaatgctcccccacacttcttcagtaaacacttcttcttttttttttttttctttttctagacggagtctcactctgttccccaggctggagtgcaggggcgtgatttccgctcactgcaagctctgcctcctgggttcacgccattctcctgcctcagcctcccaagtagctgggactacaggcgcccaccaccacgcccggctaattttttgtatttttagtagagacggagtttcactgtgttatccaggatggtctcgatctcctgacctcgagatccgcccgccttggcctcccaaaatgctgggattacaggtgtgagccaccgcgcccggtccagtaaacacttcttagtttgttgaatgaacaaatacatactaacctgttagcacagggatttttatccttatttcatagctgaggactgcaaggcccagaggggctgactgtaatttttcaagacatttttggttaaaaaaaaaaaaaacctaatggttttagcaaaacccttgagatgacctctgaatggaccatcatggatcatgtgcacagacctgaacccatcgttgcagctggggcagggaacagtctcatatggtgggccttggtcatgcatccatcccactgctgagggtggaatcagttccaaccaacacacatggtgtgaggatgagtgaggggaggcttctaaagcagctttatttgtaatagcctcaaactggaaacagtcaagatggttaaacaggtgaatggttaaacaccctgtgcacagccatgccatggattctatctagcaatgaaaaggaaaggactatgaatgcttgcagccacttgggtggatctcaaggacattacgtttagcgaaaaaagccagtcccaaaaggacataggctgcattatttcatgtatataacattctctaaatgagttggagagcagatgagaggtggccaggggttagggacaaatggggcagaaggcaggtgtgactacaagggacagcatgagggatagcttacagccacaggatagttctgcaccctggtggttacataaatctgcatgtaatacaactggagtgatagacattgcatcaatgccagttccctggttttgatattgtactaagttatgtaagatagaatcactgagagacactgagtcaaggggatctgggacctctttgattatttttgcaacttcctgtgaatctgcaaaagagtaggtactcactagtggcaacaatatacattaccagtctaacatgtgtacacatagataggtcttgttaggatgttgaaactgtgccaatgcatgttattattactacagttttaaagatttctctaaaaaatcaaaaagcaaaatgtatatgataattaaagaatacaaaaaattaaaaaacattatttgataaaattaaattcttattgtgattttaaaaataaaaaataaatctaaaaattaaactgttagcatttctggtgtttgttttgcatctagtgggtgctatgaagaatctatgtcatacttcacgcaagtgacattatacatccagaacaacacatatgcatctaagagggagtgagctgtttaatagcatgaaatatttccaggctgcaatgaagaaccattgtgaattttgcaatgatatataagtacctatgaaactatgaatttgaactcaaagagcagaaaaaaaaatacatgtctggcactattcagagatgagatttcttatggagaacctactacatttaggtgatctgagaggaagcctctggaagtttagatttttttcctattgcttccacgttcaattcctcctagacatggaagcaatgttcctgctggcaatggcacaacccataaacctaagctgatcctgcaagccaaatccataacatttggatccaatcacattttcttttgaggacatacatagggcaagagatgaggtgctggacaatgccagtccagtgagcaggtgtgcagggtcagggccatgggtcatgcagggcagcactgggcacacctctcgaggaacagaggtgcccattccatacatccatgaatagatgtgtgctgtttgggttctcatgggccctcaaagtgtagagtccaagatagggccctccttggtttcctggacaggtagcatcttagttcttatgtgggtatgaagtcactgctgactccatggccatgtgtcaccaggtttacaccttaccctccagcaggctgagctgtcagagcatatggaggctgccttgctcaccttggtctttccactcaggaatagcacacagatgctggggctcagaagcttttggggaaatgagctgcacaggattctctgtgggtccactgggagcccagctctgtggtctctccctgtgaagtagagcacaacctcgctgcagggagacttctgggtttgctgctcctgggccagggatctgctactgcagttatgccttggactccgtgccactctgaaatgcaagggcaaagacttcaaccaatgctgcttccagaccagcttatcctagtgttacttttggaaaatgctttcttcttgttttttaaaaaatttatcaagcattagtttctttagagatggccctccaaatcccttccctgtcagtgtgctcatgcccttcctcctgccaagaggtggaaatgatgctacagtagttctgcatgtagaccctaagaagcctggaagcttcactgtctttctctctggaagccaagctgtcatattttataagatttgcactgtctaacgaatgatgagagggcatggagggaaagagagtctgcaaaggaagagcactgaggcaccagtcttgtgaataaagcttcccttggatattcgagctcccagccccctagtgaatgcagccaggtggctctcagtccatgctgtgtggagcagaagaaccccccagccaagccctgcctgcttcctgtcccacagaattgtgagaaataataagtagttgttatttcaaaccaccatattttgttatgtagcagcagatatctgaaacactcctcaataaagcttgggaaaacttgactgttaaatgtttgattgagcacctactatttcttaggtctgtactaggggctatggctatggagataaacaagaaaaattccctgactcaagagctcactaatcaaaatggcaaggaggaaattataacagagcaatttgcagaatggatgagcaataggaaaagtgtaggggactgtagaggactaggagggagggagaatcctatcccacaaaggcaggatcaaggactgaaatctcccccagtgccaccacccagcaacaactactgggggcagtttttttttttttttcagttgcaagatttaatagagtgaaatagagtgaaaacagagctcccatacaaagggaagggacccaaaggcggttgccgttgctggctcgaatgcctgggtttatattgcaatccttgtccctcccactgtgctctcaggcaatagatgattggctatttctttacctcctgtttttgcctaattagcattttagtgagctctctgattggttgggtgtgagctaagttgcaagccccgtgtttaaaggtggatgcggtcaccttcccagctaggtttagggattcttaatcggcctaggaaatccagctagtcctgtctctcagtcccctctctcaacaggaaaacccaagtgctgttggtgaggttggctgatgaccactctaactgcttcctgctgaactggggcatagtaggggttgtgcagttgagatttcctcaggaggagtgacttcgatgtcattaacaccagagcatgggctagcaggccagtctaggggtccgcgggagatcttagacatggactgcatctggggttccatttgaagaacgatttgtagttttacagttttaattctggaagacacaaacttaacaaggcggttaaagatacagggattgaaatgtatggcctgcagtgcaggggattacttctttggcacacttcacaggccctgactatctgcttgatagttttgaaaaggcctggttcagtaaataataatttggccatctgatgggtgctatcgatgcctaagtggaaggtttggtgaaggcttttaagtaattttattggttagctccaggcaaaagtatttttccttcttcagtggctagccatctggaggggaggaaagtatgtccttgtgaggttccttattctatttttcctgctgaatactggggcttggtttcccggaggggattaccctgtactaggggcccttccataagcatttctaatggagggtcctgccttgcggctcttttgactttaagatccgcttggcggttcctttctatttccctttcctttcctttctggtgaccccaacagtgtaagactgccacctctttaggtttctgtatagccaatagtaatctcctaatggcttcctgatgttctataggtgttccctcggaaattaggaattccctttctctccatattgctgcatgggcatggaggactaggtaagcagacttagagtctgtatatatatttacccttttcccttctcctaattctagtgcccgagtgagggttattagttctgccagctgagcactagttcctggagtgaggggattactttcaagtattcctttattactgaccactgcaacccctgcttttcaaagtcctttttctacaaagggacttccaccagtatacaagttgaggttgggatcagtcaagggaacctctaaaaggtcccctcaagtggcataggtttgagcgattacttgttgacagttatgttctatcttttcttcattgtctgggacatatgtggctggattaagagttgcacaagtgcgcagttgcagcactggcccttcaagtaatagagcctgatatttaagtaaatggttagctgacagccacaagtctcctttagcagtgagtatgctgttcatttcatgagatttccacacagtaagatctcttccctgtattattttaactgcttcagatactaagactgggcagtttgtagcatttctctccagcgttttgtcagtggattgatttgccatggatgcagtgacaaagctggttataaataatgttgaagactcactatgtgctgggtgctgggagccattccactgcttcccttgaaaccactcagaaagaaggctactgctgtagtacccattggatagatgaggaagccgaggcttacagaactgaaggtcaggcagccagtaaggcacagaggcaggactcccacccaggcacttcaaccccagagccggtgcctgcagccagactgctcacctgctttctaacttaacattataaattaagcatatccttacggtattaaaaatgatgtctgaaacagcatattactcactgtataccatgttactttaaagtctaagattgaacacttcagattatttccaatatgcagagagcacttttccacatgaggagttacttttgtgtttatttatgggcccatattcttctatcatttaaaaaatggtttgaaggccgggtgtggtggctcactcatgtaatcccagcactttgggagaccgaggcgggcagatggccaggtcaggagatcaagaccgtcctggctaacaccgtgaaaccccgtctctactaaaaatacaaaaaattaaccaggcggggaggtgggtacctgtagtcccagctacttgggaggctgaggcaggagaatggcatgaaccctggaggcagagcttgcagtaagccgagatcgcgccctgcactccagcctgggcgacagagcaagactccgcctcaaaaaaaaaaaaaaaaaaaggtttgaagcaaatgtataagaagccttctcaatgttggatcattttcttaggataaattcacagaagggtaaataacaaatattttaattttggggtttttcacaagaaatttctggaagcaaaaggcaattgatcttggtgggtgacaaagttacgcccatcaatatttacagcaattatccccacatttcacagtttctccggaagcacagagaggcacttctgcagaggacccagccagttataatgaaactgcccgtgaatttcttctcaaaacttgaagtgaatctgcggctaaggtttgagaattcaaatgtgccccctgggctggtccttcagcagacgagggcaaaaagcagaagtggcttcacctccctgcccttccccatacctcagaattgggctagcttttggtaggccctgctgcgggtgggtggcatgggtcatttgagccacacgtcttcttggtatttggtggtggggatggggactcctccttaagaagcaaatattgccactgttttgccttccctgggcctgatgtcatcccaaatgtcgcaactgctcatgagggcaggcagggagggtcctacaacccctatttatagatgcagaggctctggaaataacctgccctaccagctgcttctcaccctgcttctctggtgatgagtccttcttatgttaccaatgagtctgaaaacccctgggaccctattggccccagagccagggaggaagaagcattcctcttcatttcctcctactctcttatgtgaggtagtggtaagatcagacaaacctctgatatagtggtgtgctggtaaatgcttaacccacccctaaaaaaaagaatataaatatatatatatatatacatatttatgattgttataaattttactgctataaaggatgtgtaatgaacactttacaaataataataataaaacaggcaatactctatgttgtaaattccttatagttgattgattctaacagaatgctttcactgatttttgccaaacattggtatccctagccaatctatggtctcaatttaaccattatttgacaaatggagttgcattccaatccacagcactttatctaatacatttatagtcatgaaatctgatgtgtaatctgctgctaagtgatgtctccttcccatacaaactatattgattatcctgcagccactttcagattcagcactagcttatattggaacttcactcatttgtcaacgggtgtgagtgactttgtttacttggataatagttttcaaatatgggaaaaatattatctcaatctttgcactattcacaatgcaagggctatagacatagcacaatttaagtttaatctacattattaacctcccttttctgaagtctaacgaacaaaacaataaaccaagcccttgtttgtagggttttccaatttccatggtgtaaattctccctctgtggacaattggaagctaccaacatgacatccctacatgcagagttgggaaggaacatgcagtagccaccaggatagagggtttccaccactcagaactacaggcgtgcctcgcctatttaggtaacagcaaaatgtaatagagtggtgcattttgagtattaattacctttgtataataacataagttattaaattatatgtttatataatttaattttagttttaatggcacagaagtatctttcttctttctggatcaaccacatagaatttcaattctactgtgaatattatctttgaaatcacaatattgtcaatgctatatatttgctttctagtttttagagttgacctataaacaaagcaagtaagacacttttagttagctaatacaaatattttaaaccatgatgatataaaaataataatatagaaaacaaaagatggggaggagcaagggaggaagaataactacatcagtacagattgaatgtcctttatccaaaacgcttgggtttgtaacacaaaggataaatgcttgaggggatgggtaccccattctccatgatgtgattatttcacattgcattcctgtatcaaaacatctcgtgtaccccataagtatatatacctactatgtacacccaaaaattaaaaacaaagaaaattaaacaaaacaaaatgcttggaacgagaaatgttttggatttttgattgttttagatttggggatatttgcaccatgcttactggttgagcatccctaatctgagaatctgaaatctgacacagcccaatgagcttttcatgtgaatattatctcagggctcaaaaagtttcagattttggagcatttcagattttcattttggattagggatactcaacctctattcttgtctttcatagttgtgaatgccatcttaatttgatacataaaaaagtgaatatactatttaaggtcatgaaggaaattattgaaaggtatgtaaaatataatgaacagagttgaaaaggcaacatttagaaggataaaataaaaatataattacaaatcaggagtagaagagagtaagaaggagatagtgtaagcactctaattttcttattttttatgtctgaaggcccaaagatattgtcaaaaattcataaatcctaaagaagtttattagttgaagttataatgaagatcagaatatctaaaaacaactactcttggtgattatttgggcaaatggaaaatggtcaggggcaaaagggaaacttctttttatgttcttataaactgacttttgttttccaggtgcaagtattattttataagtaaaaagaaaccaatatctactattaaaaatgcaacttctgcttcctccagcctggaccttatttactttgcagtaatcccttttacagtatattttgatttccactatatgtagaaacatcccagaaggcctgaagtcacacttaattcctgtgtccagttctcatggcccttcaccttcccctccaccagcggggggtgggggtggggtgggggggttggggggggagcagaattctcctgttacactggagagctgccacattttgtgcctgtctacatcacagtaattcacaaagtgctaaacattgcactttgccatatggtacattcttatttttcaattctcattacctcacatgtataaacaaacaaacaaacaaaaaaggcttcaggaagttcagtgccctgctcagagtcctgcagtttagtggcttacactggcaggttccttctctcctgcagcagagaatcaagacagagaatccaatatccccagtgtatcctcccccagaaaatgtggtgttcccccgacaaaaagaagtcaatgtctaatgttcccatcttgtctcataatccctttcaaaaaggaggaattgctgtctgagagggtattttgttccccagtgactgagggcagggcaggggcagggaaggcttcccctctcttctggccctagaggccctgtaaatgcactgtgcagtcactgacgtgccctcaggcagggccctggcgggaagggggctgttccaggtctaccagcttcacacccttattctattgaattctcatgaaaacaaaatctgtgaaacagctgtgatcttcattttctgatgagggaacagagcctccgtgcccccgagatcactggtatgactccaaagattttccctcttgcccccgctccagcaacgggtggcgggaccaggacctgtcccttccgcctgggaacggtgccctggggcagggtccccaaggctcctctccaccgtggaggctgaggccaagcccacggcacagggcacaggctctggcggggcgtgttcgaggttgggcgtcagcggaggccgcaggggctcgggcgaggcagccactggagcgcggagccggccccacctgcagggcccgggcttcccctctgacaaaagctgctgtcgggaggggctgtaaagcagcagagaagaccaggcgagggatctgcaccagaggaagggaggcaggcctttcctgtatttatctctgcaggagccgggagggaagctcctccacggaaaagtgtcaaaccttgcccaagctcgcaggtccacgagcgaagcccccaccccctcttcccgcgctgctcccagggggctgccaacctcgacctcacgcagcactctgtccccaccagccccagcctcccaggcccagagagcgtggcccatagtccccttggcgtcttctcactcagcgtgccccctcctgtgtgtccctgggcagtctctcaatgacccgctgtaaggggccctcttaggggcaggagcgtctggctcctgtccctggctgagacccgtctaggctgccccgcgcagggcctctcccaggtgcctccctggttgtggcgggaacagccaggtttgttcactgggagctggagtcctggccttgggcgattgctctgactagggggctgacccccactgacccagtcacctgatcaccatcaccggccagatcccaccccacggcacttgggtggtgcaggtgttcactgggccaaactgaggtgcatgagcagaaagcatctctctccgcagggctggggtggatgccaacactggcccctggggttgttggtgagaaacctcgatcagcaagaggccagggagtgctggaggctgctctggggcttccgcccgctggccgctgaggtgagatattcaaatatcggtgggcgggtttttcccaggttaatcctctcttaactgactgcacagcccagagggaaatagaagaatctccaggccaccttcagaaatgaagatggattcctcgcagagtgctagcaggaagatacctgatgggccgtctagttcaacagattcctccccattccacagacagcccagagaggagaggcacaaaggataataatgacaaagaatagacatgactgtgatccagcagctacatttgccgtgtgcccacttgcgtgccaggctttgggccagctgctctgtgcacttgcttttcatgattctgccaggtatggatcgatgtacccactttacagatgataaaaccgaactccaaggagagaatgatatgaacagaagctatctcagagctggaggcttggttatgctccttactcaccccaccacattgaatccctcaacaagctgtcagcagcgacgtcattagtttcatttcacagatacacctctgaaatgaactcgtgttttactttggtctcccctggttttccaggcctccaagcagcctctggggccaccttccctgctggccagctgtgtcctttcctgctggaaccacccagacccaggctccccatgctcatcagccttgagcctagcatctccttgggactgacctgctgggtggccactcccccagagccacctactcactattacctgctagatgccttgtaaattctctttatttatttatctttgggggtttgtatgattttgtttgttacttgtaaacagtggattcatttgacttttatcaagtcatgtaaatggatctaattttattttttggtatatgtctacctggttatcccaacatcatttattaacagtccatctttccccactgatttgagatgccacctttctgtatgatacattttcacagttgaggctatttctggattttctattctgttttgttgttctctgtttattcctgtgacacactgtttccatgataaaagacttagggccaggcatggtggctcacacctgtaatcccagcactttgggaggctgaggcgggcggatcatgaggtcaggagttcgagaccagcctggccaacatggtgaaaacctgtctctactaagaacacaaaaattagccgagcgtggtgatgggtgcctgtaatcccagctacttgggaggctgaggcaggagaaacacttgaaaccagaaggcggtttcaagtgagcccagatcgtgccactgtactccagcctgggcaacaagagtgaaactctgtctcaaaaaaaaaaaaaaaaaaaagtagagcatgttttaatttctgagaaacccagccttccctccttgctcgcattctctctctcttttctttcttttttttttttatttttgagatggagcctcaccctgctgcccaggctggcgatttcggctcactgcaactttcgactgctggattcaagtgattctcctgcctcagcctcctgagtaactggaattacaggtgcatgccaccatgcccagctaattttttgtatatttagtagagacggggtttcaccaatttggccacgctggcttcgaactcctaatctcaagtaacccactcgcctcagcctcccaaagtgttgggattacaggcatgagccaccgtgcccagcctctctctcttttttcaaagtaacttttattatggaaaaaaattgaacatctataaactgagtatagtaatataatgaacatccagcctcaaccttgattaacattttgccatttttgtttcatttatgcccactccttcccccacttaattattttcatagtttttcaatgtacaattttatgcatgttgacatgcacaaaccttatctgtatggttctgacaaatttgttccacaattgtaacacacattcctatgaaaatattaaatattttcatcacctcacaaagtttatgcttttatccaatcaatagtcccttcccagggcaactgctgttctgattttttttttcaccataggttaattttgcccgctggagaatttcatatgaatggaatcacagtatggacttttttgtgtacaaccacctatagtcaagcttaatgcctgtgagaggaatccatgttgaacagtgtatcaatagttggatttttttttttactatagagtagaatttcactgtatgaatataccatggttcatttattcattacccattaatgaatctgtgggttgtttctggtttttagttagtatgaataaagtcattgtgaatatttatgcataatctttgtgtggacatgtgttttcatttttcttggctgtgtctggtggtgaaatttgtgggtcacatgataagtatatattttactttataagaaactgttaaattgtttatgaaaatggttgcatcattatacattcctgtaagcaatgtaggagcattctagttgctccagttgcaacatttaatgttgacagtctttaaaattttagccatctaaacgaatgtgctgaggtatctcagtgtggttttagtttgcacttccttattaattaataatgttgagcacattttcatgtgctttttagccatttggagaaatataccatacatatgatatataagtgtatatataccatacatatgatatataagtgtgtatataccatacatatgatatataagtgtgtatatgccatacatatgatatataagtgtatatatgccatacatatgatatataagtgtatatataccatacatatgatatataagtgtatatataccatacatatgatatataagtgtatatatctcatatatatgatatataggtgtatatatctcatatatatgatatacaggtgtctatattcatatatatgatatataggtgtctatatctcatatatgatatataggtgtctatatctcatatgtatgatatataagtgtctatatctcatatatatgatatataggtgtctatatctcatatacgatatataggtgtacatatctcatatatatgatatataggtgtacatatctcatatatatgatatataggcgtatatatctcatatatatgatatataggtgtacatatctcatatatatgatatataggtgtacatatctcatatatatgatatataagtgtatatatctcatatatatgatatataagtgtatatatctcatatatgatatataggtgtatatatctcatatatatgatatataagtgtatgcatcatatatatgatatataagtgtatgcatcatatatatgatatataagtgtatgcatcatgtatatgatatataagtgtatgtatcatgtatatgatatataagtgtatgtatcatgtatatgatatataagtgtatgtatcatgtatatgatatataagtgtatgtatcatgtatatgatatataagtgtatgtatcatgtatatgatatataagtgtatgtatcatgtatatgatatataagtgtatgtatcatgtatatgatatataagtgtatgtatcatctagatgatatatatataagaatatatataagtatatatatatcatctagatgatatataagtatatatatatcatcgatgatatataagtatatatatatcatcgatgatatataagtatatatatatcattgatgatatataagtatatatatatcatcgatgatatataagtataagtatatatatatcatcgatgatatataagtatatatatatcatcgatgatatataagtatatatatatcatcgatgatatataagtatatatatatcatcgatgatatataagtatatatatatcatcgatgatatataagtatatatatatcatcgatgatatataagtatatatatatcatcgatgatatataagtatatatatatcatcgatgatatataagtaaatatatcatcgatgatatataagtatatatatcatagatgatatataagtgtatatataatcatctagatgatatgtaagtgtatatatcatctagacgatatataagtgtgtatatatcatctagacgatatataagtgtgtatatatcacctatacgatatataagtgtatatatcatttatacgatatataagtgtatatatcatctatataagtatatatatcatctatataagtatatataatatatatgatacatatgatatagatgatatataagtatatatgatatatatgatatataagtatatatgatatatatgatatataagtatatatgatatatatgatatataagtatatatgatacataagcttatccatatacatatgatatatatacatatatatcatatatacatatatatcatatatacatatatatcatatatatcatatatatgagatacgtatatatgatatatgtatcatatatatcaataacaggatcgaggctggcccatggctggtctacacttcccagtcttccttgcagctcgatatgacatataagtatatatatcgtatatatgacatataaatatatatatcgtatatatgacatataagtatatatatcgtatatatgacatataagtatatatatcgtatatatgacatatgagtatatatatgatatatagacatatctatatatgatatatatgtatatatgatatatagacatatatatgatatgcatatggatatatatatatgagataaagtgtctcttcaggtctttttttcagcttttattgggctgttcatcttttgattattgatttgttagagttgtttatgtactctggatacttccttggtcagtaatattttctccctgtccatgacttgcctttcatttactaacagtgtcttttattagaagaagttttaaatttagatgaagtctaatttatcagtcttttcttttatggttattgctttctgtaacctgtccaagaaaaactttgtctcctctcaaattgcacagatattgtcctatgttttctcctaggagcatggtaactttagtttttaacatttgtgtctaagaaataatgtaatccctaccaaaattctaaagtcattcttgatagaaatggaaaaaatttctaaaattcatatggagccagaaaatacaccaaatcttgagctaaaagaacagaacaaggctggaggcatcaccatctggtttcaaaatatattacaaagctatagtaatcagaacagcatggtactgccaaaaaaacacatcgaccaatggaacagtacagataatgcagaaataaaaccatgcatttatggtcaattgattctgaacaaaagtgacttgatttgttttcattatggataaccatgtcgtttcagccacacttgttggaaaggcttttgtttcccatgaatctcttttcaaaacattccctcaccttccatactgccattccccttccctttccaagcctgctgctcactgacatcctccctctggtcccacaggaccttcctcaaagtggagactctgtagatagaacctcatttctggcaaagctgcatcactgatgtgaagaaataaagcactcagagttaaactgaagtttcaactctttattcttacttccccaaaattaaaccattttggcatgacaggtgtgagtctgtgcatggtggctgagacctgtatggtgtgtgtggtgtctatgaacttccccaaagacagactggaactcgccacactaggcatcttgtatagcaccaggcatatggtagtgtggagatggtagaggaatacatggatacataaatcatgagaggccttatccagcaccttattggagctcatacccaaagtgatgccagcactcttgatctcacacaccaaagataaatgtgcttagcctcaaggacttgttcttagcttgaaagctccttggggaaagcattcttatttattatttgtgcctccaaaacacaccttaggacttggtcctggaaaatcctagtgccaactgaaatgggttgaatggcctgtgttcacctggtgatggctcatggttcttcatcttctcagtgggctccttttgagttttatgttaactctaccaatatggagttggatcttcaggccagctttgaaaattatgacagaattcgctcatttgtagttttccaatcctccctccttcctccaagtctcatgggatgtcaacagtggtattgatcatttcttctgcaggctccaggtgtcctgtgggtttatcttccatttgcaccagtactcacatctccctgaaagtacaatctgatggtgggatcctctctctttttctggagttaattactatccccttggggaatatggaaatgcaaccagcacacaggaagctgctttctctccaggtttgttaaacatgtcctgttgctgtgtaaatagttttctttttttctcccaagatggtatagaaaatacattgtaataatgaagtagggaagtgcttgcaatgaattaagtgaaagaaaaacccaaccaattatgaaggggaatatatggcatgattcccatttgttaagaacaaaaaataagaccaaagaaatatactttggtaaacatggaaaaaaagactgaaatgctattgctcagcatagggtattagtgagttttattttattccttcttctttttatttttacatactatttagaattaacatgcttcattttaaaagtcagaaaaatatttatttttaaaagtattaactttttagtatatggccctgataagtgatggtaagtgctctgaagagatcatagtggagaccgacagcctaccaaaatgcattctctctaataacaggatcgaggctggcccatggctggtctacacttcccagtcttccttgcagctcgatatggccatgtggttacaatagcatgtgagccaaagcgatgtagaccactcagaggctgggcctttatgggcagaggtatgtcttgtcttgtccactccctttccttttttacaggctggatgcagacgacaaggctatatgggacaatggagcaatattcctaaattgctatatgggggagaaccacctgccaacttgaacaactggtgtagactgctctgcagcaaggaagtaaactccatagcagctctgctctgttcatcattgtttcttcagggcctacctgggacctggcacagaggagatgctctgtgtgtgtttgttgattggaactaaacttttacttttctgacatctttgtcacaaagccatgaagaaattacatatccttatgacaatttacttagagtaaataaaatactatttttgtgtaaaatgtgagattgcaacaatatgcttccattgatttctcagtctttggtgctgtagttgtgaaatacattctatccacgtatgctatcaactccaaagtacagcactgcaattttcactttaagcagtcatagtcttttaaagaagttaaaataatgaaaagtacatggtttgtttttatttactcacacatttgctattaatagtgcttttctttttttcctatagatccaagtttccatctggcatcttttcccttcagcttcaaaaactgcctttagaatttcttatattgcaaggatgctggagatgaatgatctcagcttttattcacctgaaatgaatgtattttattctcatttttacagagacattcattggctattgaattattggttaacaatttttgttgttttcctttagcatattaaagatgtctttctattctcttatggcattcactgcttctgataaaacatcagccttaaatagtatttttgtttctctttgggtaatatttttttctttctgactgctttcttgctctctgactgttttaagataatacatttgtttctgatgtttgactatgatgtgctaagtgtgttttttctttgcacttggtgatgcttgagttttactaaatttatcatgtctgcaatttgccgtttttcaataaacctgggaaatttcaaacatcatttctgcaaatgtgcttttctgccctcctctctctctgagaccccatttacacatatattataccatttcatattgtcccaagagcagctgagtttgttttttttcatcaatattttccccctctgtccttcaaattgtataatttttattaataagtctttaagttcattaaccctttttttcctgtggccaccaatttgctgttggtctatcagtaaaatttttacttcagatatacttttcagttctagaatttacatttgaatcttcttgtattttcgattttttttt

SEQ ID NO: 423 - DNA, 53102 bp, Homo sapiens
agaaccctggggcaaatcaagaataaaatatacaaaggagactactggtactctatagataatcagaaacaacaaatataaataggctcacactacaaaaatagacttaattacctgtaaaatttggcttaccgaagcttactatgcttagtacttggttaacagtaaagcaactagctttaaagttatcagttagtgaagggtgcagcagctacaaagaggatcaataatactatgcttcatgccatgttaacaaccaggcagcattcagggattccctcatatagtgctatagaccactctgaggaatatgcatagtggataattgggtggaatcataaaagggcaaatagaattttcatcccatataaatatataaatcaagtatgcacatttaagaactgctaggatatcactactgtctgctttctccctctaatcaattctctttacatcaatgtaaataagttagtgtatcagtgatagttgctttacctcctctaccagttagtttcattcaaggtgtggttctcagattgcaagatgaagtaattcacacccctgacatacttaagagtttaattgaacttgttgtgacattaacagcctcctgctataaagcaactatttttagttcttgcaaccatcacaaggggacaagactgcttctggcagtacagagagaagagatggaatgtcaacctatagatgtagttaggtataatagtatagataccacattattgcaataaggattttaggaggcaaacaatgaaatggtccaacatgatgaatgataaaatgataagtaagtgagacattacagaatatatgtctaaatgttagcagcagttacttcggtgcagttacttcagtggattgtaattacaggtttttctctctgtttactttcttattgttgtttcagatataattttattatttatatgttctctgtttaatctcgtcttagttattatgaagtgttattttgataaaaatttagaaaactgaagagaagaatgggtgaaatttaatgaacactaaagttccaggttcttgcacacatttctaagacagtgttcacagatttggctgtgagctttctggcaaccaatgcaaaaaaaaaaaaaaagcaataataataaattataaataattaataaaaatatcatagatcagaaaaaggaagtacttcaggcttcaggcctcatttaggggcaaagataagtatttcttgacaaggtctttaaaagttgtgtttgtaataaatatttttaacaaccatcctttgatataaacagaaacataattattggggctgtttccttaaagagtttgtctacatgaaactatcccaaggatgccagaagtactcatcaagtccctgatgagtaaactgacaattcagtgcacatagtatgtctatacaaaataaagaagcaatgatccttacataatgttttgtaaaaccagcttttgatatatattttgctgtaaagatcagctattagcgatttctgacaaggtacttcaatagagatatttttcactaagcctccatttacatgattcagcagtcaacaaagccagagctgcagctgaatcatcctagaggagctgaaagaagacctgcaaatggatggcaacaacacgtgatcacaggaaacccacgaagagaacaatgatttcccagaaataaaggggtctatttcatacatacaaaggacctacactccaatccattgcacaaataatttatatctgcaaaatgtatgtatggataatgatccttcatgtgaagcttgaggctaaaatataccaatgaagcattcaaggaatatttagctttaggaggtttctatcttgttaaaacttttggaaaaattaagaaaacatacgattttaggaaaactaatgagatcattgccacacagatatattaaataggctagggaaacaatggaggatattacatgtactgatggttgtggtctttggtataggtaaagcaactgtggccagttttccctaaggcggccttcttctaggttgaatggtaagtagttgctgatttttgaccaattggcacctccatgtggcagttttatgtgttttaacctaatagttcatgaggacaaatttattttattcactcatgggagaatctgtctttatgctttctatcaggagttagaatccaggcaataaatatacctacgtgcacatgtaaaattgactctcttattagagaagtagaataggttttacttattcccactctgcatctttctgatttcagtagttgcaatctctagagatcactgtgattatgggtaagatgataatgaccttattccagagggggagtttgtaacctaagctaagtcaataagccctacacacaatcatctattggttcagaaatggatatgttacaatggtgggctaaacagagagaggttggtgactgttgaaagtgttatgcatataaatttgaaagtggaataggataggctgagattatgagggaagactgtcttaaaatgaagtcatgaccaatgaagtaaaagctgacagacagtaatatcgctaaactcttgggtcagcccttgcctgaaggctgaaaggaattctagaccttcagattcataagccaatgaatatgctgtattctgtgtgacaattttagttatgtttttattactttcataataaagtatcttaacacatatgtgaaggcagtcattctatctatatctatctatctatctatataaaatcattaaaaacatattaagaagacatttatgcatccaacagacacatgaaaaaatgctcatcatcactggccatcagagaaatgcaaattaaaaccacaatgagataccatctcacaccagttagaatggtgatcattaaaaagtcaggaaacaacaggtgctggagaggatgtggagaaataggaacacttttacactgttggtgggactgtaaactagttcaaccattgtggaagacagtgtggcgattcctcagggatctagaactagaaataccatttgacccagccatcccattactgggtatatacccaaaggattataaatcatgctgctataaagacacatgcacacgtatgtttattgcggcactattcacaatagcaaagacttggaaccaacccaaatgtccaacaatgatagactggattaagaaaatgtggcacatatacaccatggaatactatgtagccataaaaaatgatgagttcatgtcctttgtagggacatggatgaagctggaaaccatcattcctagcaaactatcacaaggacagaaaaccaaacatcacatgttctcactcataggtgggaattgaacaatgagaacacttggacacaggaaggggtacatcacacactggggcctgctgtggggtgggggaaggggggagggatagcattaggagatatacctaatgtaaatgacgagtaaatgggtgcagcacaccaacatgccacatgtatacatatgtaacaaacatgcatgttgtgcacatgtaccctagaacttaaaggataatttaaaaaataaataaattaacataaatacataaatattgtgcaaactattggtaaatttattatgctctatagttccaaaacaatttagattcaaaatcacacaaatatgtgtgtatgtgtgtgtatatatatatatatatatacacatatcttttataattattaagttgccactctagaagtgaagaaattcatgttttatactcacacacacacgcacacacatttgtatgtatacaaattatatttcttctcttctagaatggcaacttaataattatgaaaatgttatatgcagctagtggtaatgagtgctgggtttggatttctgatctggtatatggatactaatgctttgggattctactaatgtgttagatgtaaacagatgtgagacagaagtaaagtggtaggtgggggtgatggggaataatattactgacattccacattttaaacatttccaaatcctctgttaccttgtgaggggaaatcttcattcttaatgacccaaaagttatttcagccattgattatattccaagacagaagtgcctccaccaccagtttctctagttgtggtatgaacctcaatgttcagacaaactgaataacagctgattataactgacaggctttcagagggtctggggtcaaaaataaaagcttttaaagtgacaaatacatgaaatcattaaagaagtggtacctagtagcatgattcaatttgttctaagtaaaaaaaaaaaagaaagaaagaaaaagaaaaaagaaaaaaacaaactgagtaacagaagccagaagctgtcagaggcacttgatatatttctgtgatggcatttgtaatctcaagggattgagcagggagctttatgtggaaatgtgtgtggggtgtgtgtgtcagaaagaaagggagagagggagggagaagagagagagagagaaaaaacaagagctcaagatatagacagagaagtgctaaagtgttttgctgtttgatgaagcaatttttaaaatatcacctaatttgggccttgcaacaaacctacgcagtgtgaagggcagttattattatcctcattttaaaaatgatgaaagggaggctgatgtcctcagtggctaaatgactttagtacagacaaatagctagtgaatggtggtcttgggattatatttcagatcttctgactgcaaagtccttaaaagttttacaactccttcatattataatgcaccactcataaaaaaaattaaatctaaaaagctgctaatatggtttcaaatggaatattttgtcacatcctagactgataaatccagttgtatctatctatatatagttatatatatatctcttcaaatttcctttaggaggtaagattaccatatctatctatctatctatctatctatctatatatatatatatatatacacacatacacattatatatattataaagatatatatctatatctacctatacatacactatacaaagatctctctctctatgttatgtacacacacacatacacacacacacatatacacacacacaactagatttgttagactaggacgtgacaaaataaatataacctggtaaatttattgagagagaaaagaaaaactgtcttttgtaaatgtgtaaataaatatatatatatcttaaagagatatatataaagagataaagagatataattatatatctttataaagagatatatttcttaagatatatctatattatatatagatattgtatattatgtatatattttaaagagatatataaagatatatgtgtaagtacatattaagagatatatataaagatataatatatataaaacatatatattacatctttgtttatccttttgcaaacgacggtttttttttcctctctcaataaaattatcaggttatatttattaaggtgaaaaataaatatatgaagtagtttgcctaaaaccatcttatgtgcttctgaactttctcataaaacacttaaacatttatttggacacctttaggcatctttaaagctactccaaatcttcttctaccctttcaattcccccatgaaagagaataaagccaaataattgttgtctctgtttcgctaccagtgagaagcggccctgtgatccagttctgggtcataaaatatcaatgtaaaaatttgtgcttctgagaaagtttggctttctcacagtaaagaggaaagctttcgtacagattttacttttttcttgctttaaatttgagcacaatgactagagagtcagcagtaatctctccacctaaaggaaagttgaaagcaatccgggaggcagccctgacatgtttgcactactgaaaacatactagcaactgccatcctctggatttgtcttggtgggaggtggaggcagagggaagggaggtgttgtaggttttactgtttatattcattcacatctgaaatatccaaataatgctttttttggtccccaaaactctcgaaactacttaacacatgtgctatgtcactgcttaggacagacaatattaacagcatcatcaggcattttaaatatgcaccattcttacctaagggcaaatgggcccctctcaatcaaagaatgaaaggagtccctatcatgctaacgttcttcagcacctttgcatttctgttgcatcaagtatatggcaccttataagcatcttgttgatgcagactgacttttcagactaacgctatatgctcctgctaagtgactatttgctaccatcgccacctccttttccttatttatgctcttccatctagcagcaatactttctcataattttctcctctgtagcactgcctgttgacgtctaggaatactctttacaagcttatctacagcaatatctcttatttaaagccttgcctgcattatctgtcatttaaagccttgcctggtacttgtaaccaaaattatgttcttccttttaatctccctggggaaattgttactgctcatgtggcattaatatcacacattttctcatattattacgtgcagtagacacattccttgtcatttgcaaaattatcaccctcactcccagtagaccatagagctcgttccctgagggcaggaagagtatgtgattcactttccatagtcatacagtatataccacaaaggtgataggggtgggatagctatgggtaccaaggctgaaagagtttattctctgcaaaaagttattcccttcttcatgccctcctctactgctacaaatttctcaagaatgagaataagcaaagaggaagggctatcttatggatacaattttagagagtttgagatttaagtacaaaatctaaaacagagatttccaaatcagacattttttaaaactacctctgcataatattggcgggggttggaaaattccagcacacaggccaaatccagcccagtgggctgatttgataaagttttattggaacccagccacatatttgtttctataatatctaaatctgcttttgcactataaaggaagagttgagtagatgccagagagacccatacagcctgcaaagcccaaactatttaccctcttgccctttatagaaaaactttgcaaactgttattaggaaggttataaaacaatgttagaaaaacaaatttttagcatttttcttgatggcagaacttctctaaccctttcattactattacaaattttcatatcattttcctgagctgtcaaaattatttccaccacagaaaaatttttaacggaccttatcttctcaggacaagtgatctgaggatcgcatttggcaaatgctgctttaacaaagtgcaagaaaaaacaattgttaaaatgatttgcaggtttctcttcaagtaattgcctcatctgttaatattcaaccctgtgaatgcgcttattattctagtaattttctaggacacaattaagccacatagaaaactgttgtggcccatgataaaagaaatacttaagctcccttcagataaaaagttacagcataccttgtgctataaacaagttaggtggtaattatctgagtgatgtggataattaacatcaaaacagcagcaaatgtacttgagggagaatctatgatgctggacttaaattatttaatctaatttaaatggagtcaggaataccagactttagatacattaatgtggatagatcacacagttataagttccgttagatgtagaacttcccgtatttgcttatagttcttaaattactttctttaacctcagtgttttcccttagaaactatggttggtctcatttatatcccttctaaaataactatgtttctttaacttgaataaacatagtgttgatgtaaaaaggtactaaaacaaaatgtatttttttccagaagttttagaattgtgcacaaattatttagtgatcaaattcatttaaccgaacagtagggaaactgcctttgcaaaaatggtaacagggagaaaattatgacagtgaaagagatctgacctaaccaactccatcttgcctttaacctctaaattgcccttagtcattcctgggcatgggccaagctaactttgggagacatttagtttatagtttacatgataatagtccttcccagaaactaaactgcctttgtaaaactaatgaaagtccaccaggttaggaggctgagaagcgcctgaatattgctaagactcctgtcttggggtctggattgcgacctctttctggtaatataacctcagaccagatgtcttcctattgtcaatggagaggcagcatgatgcagtagaacctactatggctgtgaagtcagacccaggtttgagtctcagtccctctgcttagtattacacaacttaggcttaaacaattaccagtcattgttctagaggttacaagagctgcaacttctctaattatttttgtaattaacatcactatttcagaacctaagatttgctttttaaggtggttctacagacttttgcatttctgacaacctgatgactccacccaggccagggactattctgtggctccaactcagaagcacactcagtccagaaggaccattttccacaccttatcaaccaatcagcaattttcctagccctctgcctgccaaactgtccttgaaaagccctagcctccacattttgtgggaggctgatctgagtagtaataaaactttagtctctcgtttagccagctctacatgtattaaactctctctattgtaactcccctatcttgataaatcagctatatctgggcaagatgaacccattgggtggttagataggtccacaaggaattataactatgctgatgcatgtatactccaaagagactacttagaactatctcacaaagttatattcaatatataaagacccacagcctcagatttatacatcatgaaaacttattgattttatcagaggcattcgaaccaaagagactccgttatgaagaggggctgggaaaaataaggctaagacctattgggctgcatacccaggagattagaccttctcagtcacaggatgagaaaggatgttagctcaaactacaggtcacaaaaacccagctgttaaaacagattacggtaaagaagctgccaaacaaaatctgcccaaaccaagatggtgaagaaagtcacctctggtcatcctcagtagtcattattcactaattataatgcattagcatgctaaaagacactcccaccagagccatgacagcttacaaatgccatggcaacatttggaagttgccctatatggtctaaaacggcagggaggaaccctcagttccaggaattgcccgcccctttcctggaacactcatgagtaatctaccccttgtttagcgcatgatcaagaaataactgttaagtatactcagttaagcagctcatgccactgctctgcctatggagtagcaattctttattcctttactttcttaataaatcaattcttgtacaagggtcaagaaccttctcttggggtctggattgggacccctttccggttacataaccccagaccagaggccttcctgttgtcaacggtgaggccacacgatgcagtagagcctactatggctgcggagtcagacccaagtttgagtctcagtctctgtttcgtattacacaacttaagcctttacatgagaaaaaatatctgacaaataaagttggagtacttgagtacagatactaaaggaactttatctcgtattttctcagtcagtggtataactgggtttcacctattcaacataaaatgtatttttttttttaaatattctttttggtcaatgttttgtttccttgacctgttaagacaactgagaacatcattaataatacctatcaatgtaaaatgttgttttgaataatttatctgttaaatatatttatttaatataattataataagaattttaaagatatataagatatacaaaatgctgtaagaaaaataattaagtaatacaattggagtaaaaaagtaacatcttaggttaagtaattgaaataagtattgaggatatttctgcaaaattaccaaagttgttcataattttcataattcatgctcttgttgatttattacataacaacagtattttaattgtccaaggagagaaacagattttctttgtactaatgtcaggacaaaaatagaaatcacaaaatctcaaaaaggaaaaactaaagatgtcttatgtttttcatgactaccattttacacctctgatgaaactgaatcaaaatggcctcatcattattagtcatcatttgtacacactcttactacgcaagcggattgaaaaggtgtacgtgtagagtacttaccctaatccttcaaggaatttcttacacagaagggtagagaattgagaactgttacatattagagtgtttgtattggaaattttgatactggtctataattatctatttatctatccgtcatctatccatttgtgcatatgaaaacatatgaacctatatggtattaataattattaaataataagctgtttgtgctacatttttatttgaatgtcctgaaagaaagtttatcataaactcacctgaactctaaatagcaagaatcttggggacatgaaaattttgtcttttcaagtattcgtttcatgattttgtatactcaacaaacgatgaaattataactttaaaacaatttcatgtgatttttttgcatgaaaaaattatatctgaaatatattgttacataggaaattaaatatgcatatatgaggaataaaattatggttgaaaaatataaagcctaaggctcagcctcaaatctgtttaagtgtactgacacagaaatgtcttaggtacgcagagaaggacctatagcacttttaaaacttgagcatattatttaaaatataatttattattactaaaagagaatgttatttcaaatctttatttttataaaaactccacaaatccccctgcaaaacagcattttatacattaaaaagtataaaatggtaaaattatttttatttttagtattttaacatattcagtagcaaatagtagtaaatgcctactttgccacagctttatgataaatgctattcatatactcgtggatgaaagagagttttttcattttttctggagccaggagcaagagataaattaagcaagtatgataagcagtcatgtgtttatatacacataacatatatgtgtatcataaattgcaaattacagttatatatttcttctttaataatatttgatttccttaaacatgttccagttctgagtttttatttataaattttattcattactaccttgatttcatagacattattctatttctgtacctttttccataaatttctatttcggattctatttcaatggatttaaaacattataataccactaaaatacaattctcctaactttcactgaagctattgttacccaaattttattttaatttctattttgttgctccaatgttataaaagctatttcttctgtaattgaagcacaagcctcacttcagaaacacataaaagaaaattgattttcatcctgaaaatgtcaaacttctgcctataatactcagctatggttttctgaaacaacaaagttcaaaaagagccatcgacctgatggccctttgacacacaatgatggatgcaatgtgtctactactttactgccagaatgttctctccaagagaatgaaacaatcaatgaagaataataaatctaaactgggtagaaggtttgcttgttttaaatgtactaaaagagaaacaacaggtatttcacttctctagggaaagacatttatttactacttgattaactattttctctccgtctagcttatgtgaatccaacataacatatatctgcttaaagacattgagcaatgcctggaaatttaattccatacacagttcttgaacttactgtgaaatatagatgtaatgtattgttattcttcaaaggagaaggaaaaaattataaaggaggataccactttactcaccctagtgtcgtgtccttttgtcaacctctaggtctgtcaacttcaactgtttctagggaatgatgtttccattttcctgtagaatagagttattgatcaataccacatcaaaatcaaagtcgttactctagtgcaaaacataggagcaattcattttcttacagattatgattatattaagatttcttgtgcttaaaataaattcttgcaaattatcaaaagtaaatgagtaaaagattgcaagaatcttaaatataagtttggaagtggaagacttaagtctaatttaaaacttaactcttagaatgcatatctatgcctcaggttatattctttacccaggaaatgaaaaaccacttccacctgcatatttggtatgaccagagtctgccatttcaccagtcttaacaacgaagcactgcataaattctccttaaatgacacttcaaatatatgatgttttatgatatggtgtacatattcaagacaattaaggacaattatatagattgaaagttacttttgattccttagcatttttattttattttgttttgagacagggtcttgccctgttgcccagattggagtgcagtggcacaatcacagctcactgcagcctcaaccacctgggctcaagctattctcccacctcagcctcccgagtagctggaactacagatatgtgccaccatactcaggtcatttttatattttttgtacagtttcgtagttttgccatgttgcccaggcttgtctcaaacttctgggctcaagtgattctcccaccttggcctccaaaggtgctgggcttacaggtgtgagtcacccagcaatacagcacttttggatttcaaaattttatactataccattattattttataccaataattttattattgccacaggggcacagcttttgtatttatgctttgtcaaagtagaaataaattaattttatgatgatgtaatataaaattgaagttataaaagttgttaagaaattttaacattggtatctttctactgtgttttgatttcaaagttagagaacatgtctcaattattcacatctctcatgcacatgtcaagaaataggtacagaaatagatggaaatagctatattttgtttcaaacacacaaacatgtagaatataaaattgacagatgcatttaatttatggaaaacaaaacaatgatttatttcttacaaccaaagtttggttgtgatctgctgaataagtggaaataattagaaagaattgttattttacaatggttctaaggtgaactacattaaataacatcctgaaaaaggagatgaatatttataaaaatctagcgcatataaattaaaattttaaaatactttcttttcatagatatataaagatctctacataaaataaaaattaagaaatgcatacaagtcaatttttataatactttggggattaatgtatatctatcttaaaggagaaaataaatagtactatattcaaaatataaaaacaataagcagtgtattcagcactttttcacaataaaatttaagcttaatagcaatatgtaaaacatagcagcaaatcctttccagacaaattatggatgaggtgtgatgggatcttctaaatatttgccaccaccacccctatccccgaccccaagcccagtgtggccccttggtagcatatgagacaattttatacaactccaagtttccatagaacaaatttggaaaactcttgatataaatcatttttaacattctttaataatgaaagctataaaatggatattgcaaagacttaagtaaaattttctcaatttgtttaatcaacaataaccacaataggaggaaagtttatgcagtgacctcctgactggacattagctctgagtgtagcatcaaacaccagaaatagctagatattcccctaggggttctgtacatttgtgaacagtgctgaaccttcaattagcctcattctaaggaaggcattttgcactgtgctttgtgtcgatttagtaatacagtgggtggcttatgatttctgagtcatcattacacatttcataaaatatagcagaaattgtagatttaaaaattaacacttaaagcatttaatgccttcaggtcaggggataaaagatgaatgaaagattatcttttatgtgtacagtatatgtaattatgattatataagaattaatttcatgtgattgtgcacgcattttatcaatatagttccaaagaccaaattattacttaaatgctgacttttaaaacatttctgatactctagatttggggagttataaattagatcttaaatagagagtgtaggatttcaattaaacaaataatttatgtttataaagattggaaaataggataaaagtcatatcttagagtgagtaccaactctctgtggtatttcacttattgtgaatcttaatttttaaaaacttgtttttctagattgatatttcaacagtaccgttctggagttctacctaataccgaaaataaacatttttaaccgctcttaactacttcaatattagctagaataaataagaaaagaagagattctattaatttaaagcatacaatttcccacggattgctttggaaatgtgtggtataatgaacctaaactagtattaaaatgtagtcattgcacagtgtatatatatttgaaaacgtcgtgttgcacacagtaaacacaattttatctgtcaattaaaaaatcaattgctaagaaatacattgtttcctttaaaaaatgtgttattcatgattaatctctatgttgtagtaatacagtatttaaccaacaagattcattatttaactacatttcaaccctttaaaggtgtcactaaatgtgcaacagcagaaaggtttatactgtgatctaattgaacaccattccaccttcaaccaaacctgaataatcaattaaaatttattaacataaaagcaggttttataaaaggcagtttcagtcttcataaccactatccacaaaagggcaatactttgatttgtgaagccataattaaacactagagaactacaaattgatacaaatatgaaactacgtcatatgttgctatgtaagtacaagggtggttgtaggcatttatattactaactgccaattatcagaggtaattacaataaacaaaaaacaaatatgcacctaggtgtgaagtggaaatagcaaacattagtataattaattgaattttgaaaatccttaaggataccaaaattaatgtgatttaaataataagaagatttacctttctacataaataatgttattaaccattagtagacataaaattctatgagtcaaattccatagactgttacttaaatttactgatagaataaaggaaggaaggaaggaaggaaggaaaggaggaggaaggacattaagtaggcagtgagggaaggagtagaagagaacttgatgctttacaatgctacagattttttaatttgaacctacttgaattttgaatgttttattgttgttgatgtgggttttgttttatttgttttgctttttggtacagtgtctcactcactctgtgacccaggctgaagtacagtggcatcattatggctcactacaggcttgacctcctgggctcaagcaatcctcctgcctcagccccccaggtagctgagaatacagatgtatgccaccatattggctatttaaaaaaaaaaattgcagagacaagtcttgatatgttggccagttctgtttcaaactccttggctcaagtgatcctcttggctaagcctcccaaagtgctatgattacaggaatgagccaccgtgccagccttaaaggtgtcttaaagctggagagatgataataccactaccacccccttttccgaatgaaggaaaagagaaaaatgtgctaagaaattttttaaaatgtgattcctagtagcaggtatatgtacagggcacactggtagaaagcataattgatggccgagtgcagtggcttacacctgtaattccagcactttgggaggctgaggtgggtggatcacgaggtcaggagttcgagactagcctgaccaacatggtgaaaccccgtctccactaaaaatacaaaaattagctgggcgtggtggcatgcgcctgtaatctcagctacacaggaggctgaggcaggagaattccttgaacctgggaggcggaggttgcagtgagccaagatcgcaccattgcactccagcctgggcgacacagggagactccatctcaaaaaaaagaaaaaaagaaaaagaaaaagaaagcgtaattgatttttctcttagtatattttcttttttggattccaggatacctcacttcctgatgtatctcctacatttctggttccttttttgctggtcctttctcatttctccatctctcaataatagaatgccctagggcactgaccttaactttcttctcatttctacatataataatattctagctgtttttattcaacctatggaattaaacatcatctaaatctcaaaaacaccaaaattagcatgtcagtctactaccctccagctttttccttcacatctaatttaaggtctgtagtcatgtcaaaattaatatggccaatgccaagctactgattcttacagctcttctactctgtataaatagcaattctattatttcaccagcttaggcctaaatgatgcattcatacacatgaagcctcaaagttaaaattcactatttcttgaatctttttcatccaacatttctatgttcatgatatagtcccaaagtcctaatgactcataaattgtgttattattcttttcatccttctagtaacttcattcagcttaatgaaatccccacttattttaggccacgataatataaggcagtggaggggattaaaattaaaaaaacaacgacataaaagaaaaatggaaagaaatttaagataataaggagggggccatcctactctgctatttggcatttgaccaagttctttgcctaattacactttaattttcatatttatatagtaagtattttggtatgatttctaatatgtctttcagatctgtgattcaagactacacaattttatgtcagaagttgatactgacttcaagaattaatattagtcatttggtagtagattgttacattaataaggatttgattagtgatctagaaaaaaaatgctatgttcaagatgttgaatggctaaatagtagtgatgtacgccaaacaatgttcacatcagcagtatatttaaccagaaaagaaaaaaaaaatcaatgccaacaagcttttattaaaaatgccttcttcaaaccaataaataatttcagaaatatgttggatattacatttcaaaacttttagaaacaataacataaactcttcctggttgctgtggaatggattttatgaccacttatctttatgtaaatctagagattttttcaaaagattaaagtattgtgcttgcttttctcaacaccataaataatataaaatataaattgtcaagagaataaatttatatttcataaaaatgtcagtattaatagggaaccttgactgacaaaaatgaacacctaaacagaaaaagaaactcttactcactataattatttattggcattatttcttaaacgtaagtactcctctaattaaaatattgcagcttttttttcaagataaaagtacaaaagtgtacaaataaaggcatgacctttgatttttgaattttttttctgagtaaaagatagggcataatatcctagaaacagctaagagaacagtgttttgttcaaaactaaagtgattaataaatgacttttgagaaagcttactattttgcataacaagatgtgcaatgaatggccacttcagagcatttggatattataaatcattataacaccattttgaaatttaaaaggccttctaatactcagcatgctacaataactccatgaaattatttttggcatacttcaagagtatgtatttagtcattacattttcctgctgagagagttcacacagaacacactattctttaaattatgttttatagaatatttatggtatcattaggatgtaacaaaaaaactaaaaagtgcccaaaggagagatggggcctatgtatgttaaaacaaggacaaaatttaaatatatatatatctattacatatgtatttcttttagattgtctctgcttgagaaagctgttattagaaaaagggcaccatctttgagagttgcaagcacttttagaagttctaaaagccttttaaatgcaaaggtctacaaaaaaggtttgttttatgcaaatttaagcaagtcagctgaatcatattgcaaagatgaatggctgcttattttgattcagattttaggtcattctttcacatacaaatggccatataactgtatttgactaatgctggggacatgtatcaattctgcaaaaaattgattttgctttgtaattggcaattaaaaaaaacactttagaattccttgccacttttttttttaacctccaggtaacatactgaatctttacatttaaattggcaaaggtccaataaggacttagagaactattttaagtcatagggaggggaagtgacaaaataggaatcctttgattctatattagaaagattatgtgtgtgtgtgtgtgtgtgtgtgtgtgtgtgtgtgtatgtgtatgtagaaggatgggggttaggaagactgtgcttataaacatcttctttaagatatgtaaaaatttatatgcccattcattgttttgcaaccttccctgatttccctaatctcatagaaaatcatagttaatttcataggtaaaaattaatatgacatcgtttaatttgtagtttttacatacatgtgtggttgaaagctttaatgcatttgcttttcttaaaattatcaactttctcaatttatccgtttaaaaaaactattgtataactttttagcatataaaaagttattagagatatttattgagccagtattcatgttgtttacatttttgctagattccttttcttagtttgtagtatgatttcattctgcagcatttgacataaatgtgaaatgtttatatgttaaaaatgtatcatttttcctttgcgttttttcttcccttaaactgaaactttactccttagtacagattttttgatgtttcattcatctatctattttcatattagaaaatttataccaatacatttaatgtatatgaaattgattttgatgtaaggtaagtgtttatgggtccaaatatgaattactgcatttcaaagctttattatttcacactttatggtacattttgctgatccatcatggaaacaaaaatattcaattttatagacaaaagtagatctttgctataaaagtagaattatattctcaaatccttgataatagaatactgttgtataactattcttcattaccatgacatgaaatcgattttaaattgataaatgcttacttttcttttttggaaggcatcttttagtttggaatttagatgtgaaaactactaccaattgaatactgatgctagcaacaggagacaggcaaattcctaggcagaaaggactcagggtccccactgaaacccgatcttgaaggcaaggacaatttaaagcctgaaaaccaggctgccagttctgaagaatccacgaccagagtgagaacttctatcctcatcttacccactctctctagatttgcttataattcagcttggccgaattataaactgcaggacagagaagcttggcctccagaggaaagtattttcacactgtcctgcagctggaccttttctgtaaatgagatggccaaagtgtccaaggtcgcatatgtgcaggctttctttgccttgcatgatattccaaagctttgccaacattgtagaattgatctagccctcctagtggtcatctcaggagaggctgcaaacggcaatctcaagggacaagggaagcaaattccagagctgcctccagcaggcgagtccagtttctctggtcctgttcctcctgatccatcctgtcctccctatccatgttctttcttaacttgtcccatcctagaaatcctcattttaagtgggtcccagcctcactcatgcccctataagagatgccttgtgaatatggccctattaaggtttaggtccccttttctctacaagacttaagacaaattaagggggatcatgttaagttttcagactaccctggcaggtatatagcagctttccagaatttaacccaagcatttgaaatctcctggaaggatgttatgttacttttgactaccactgagaagcaggccgacttacaaacagcagagaagtttggggatgagcttagttttccatatagtgccaagaaaggggaagaaccttatccaattggaaaaacagcagtaccattggaggaccctaaatgggaccccaaagaagacacaggagaatgaagaaggaagcactttcagatgtgcatagcggagggcttatgaaggactaacactaagcctctcagttactccaaactatccatgatagactagggatcagatgaaaattccactgccatcctggaaaggctaagagagtccttggtaaagcatgccactctacctcctgattcaatcaaggtacaactaatcctaaaggataagtttattattcaggcagaacctgatattaggaggaagctacagaaacaggctatgggaccagatagtactttagaggtgggtgaatcacaaggtcaggagtttgagaccagcctgaccaacatgctgaaactccgtctctactaaaaacacaaaaatttcccgggcatggtggtgtgtgcctataatcccaggtacttggggggtggctggcgcaagagaatcactttaacccgggaggcagaggttgcagtgagccaagattgcgccactgcactccagcctgggcaacagagagactctgtctcaaaaaaaaaaaaaaagaaaaagaaaaaaaaagaaaagaaaaaagaaaaagaaaagaaaagaaaacctcctgaaaatagccacctcagtcttttataatagggctcaggaggacactcaagaaagaggagagagaaaaaggcagaggttctagtggctacattgtaggtttgcaaaccccagaatccctgagatgtacctcttaactgctatacgtgtggcagccagggcactataagaaggactgtgcaggaaacatggggaagccaccttaaccctctccagtctgcagtggggaccactgtagggtggactgtcccgggagatgcaggttaccgggtacagatagtctcccaaatagtcaagcaggactgatgggtccaagggctcctctctccagctccgacgactcagaccaccattaccatccaggagcccagggtgattctagaggttgaagggaggaagataacttcctcctggatataggagtggccatttctgttctcctctccaatccaggcttcttctcctccctcagtacgaccatgaggggtgtctcaggacgatacttttcccaacccattagttgtagttgggaaaacctcttgtttactcctgccttttaaatcatgcctgaaaacttaactcctcagctaggcagggatattttagctcctatgggaaccaccatccttatggttccagggtatactctttgtcttccccctggtggagactgatattaactcaaaagtttgggcaactcaagggaaaattggctgggccacaactgccatacctgtccagatccattgtaaagatccaaccttttttcctaaccagagacaagatcccaaaaaccagaagccaggaaaaagctagaatcaatcaatgataacttgatgttccagggcatcttcaaaccctgcaacaacccttgtaatgccctgatattgagggtacagaaacccaataagaaatggagacgttccaggatcactacctcattaatgacgttgtggttctaattcatcttgtggttcccaatccctatatcctgctaactcaagtacctgaggatactaaattgttcacagtcctggacctaaaggatgcttttttcctgcataccactacaccctgacttccaatatttctttgcattcgaggatccttgcaaccagactacccagctaacttggatggtattaccacagagattctgagacaggccctacctgtttgggcaggcattgtcaagggatctctctttatccacaatttaaagttttataatatgtagatgacattctccattgtgccccaactgaggaaatctctcaggaggggtataaggctcttcttaattttctagctgacagaagatgtaagatctcaaaatttaaggctcggctctatcagacttcagtgaagtacttaggtttagtcttgtcagagggaaccagggcattaggcaaagaaaagattaagctcatctcctccttttccctcccctaaatcttcaagcaactgaggggattcatgggcattagagtattctccagattatggatacctgggtatgatgagatagctcatccctttatcacctaaaaaaggaagctcagacagctaatttgggaaccagaggctaaaagggtctttgaccaattgaaacaagccttgtctgaggcatcagccgttagtcttcccattgggaagccgttcaatccttatggatcagaaaggaagagaatggccctgggagttctaacccaggtccaagatccagtccagcagcctgtaggctatctaagcaaggagcttgatttggtggctaaaggatggccggcctgcctctgggcagttgcagtggtaactttgctggtgccagaggctactaagttaacgatggggaataacttaactgtttataccctacataatgtggcaggactgctgtcttccatgaggagtctccagctaacatacaaccatctcctcaaatatcaagctctgctattggagggatctacagtccagttaagaaggtgtcactgtcaaaactcagccaccttccttccagaaaaagctggggaacctgaacatgactgcaaacagatagtagtacaaatctatgcagccagagagaacctcaaagaaactaccttggagaacccagattggactctttttacagacggattttttttatagaacaagagatccataaagcagggtatgcagtagtcaccctgaatgacactattgagagcacacctctttcttcgagcacaagtgctcaactagttcagctaattgtcctcataaaaatgtttgaattaagcaaagggaaagcagtttacaattatactgattctaagtatgttttcctaatcctccatgcccatgccaatatctggaaagagagagacttcctcatagctaattggtctccctttaaacaccatcaggaaattaacagactattattctaggttttccttccattggcagtggcattgatacattgtgaaggccaccaaaaatgggtggatgaaacagccaagggaaatacattggcagaccaagcagctaaattggcagtgagagttccacagatatctgatccacttgaggcctctaatctgggagggctgcataagagaaataaaacttcaatattcttctgaggaaatagaatgggccacctcttgggaatacacctttcagccctcaggatgactacaatcagagtatggcaaacttcatccagcagctttcagccaatggaaagttcttcaaatccttcaccaagccttccacctaggaaaggattaaacctatcaattagcccagtggttgttctcaggtctgggttgggagggaccttacagtgtacttctttctacttcttcagcagtgaagatcactggaatagattcttggatatattatactagagtaaaggcctggggaacttatggaattatctctgttgacccagagagcactcaaagcaccaatgtaaagaaattggaaacctgaagctaaagatcataagtgtcagtaattcacctttcatggatatcctttatagtcctgcctatgattgctgttctcaccttcattctgttcctcaccattaggtgtctttgccaaggacccctaatcctgaatgcccatgggattatctactcccctaaacagaaatctcttttctaaaatttaactgccctcccccaaattagatttaatttctttcacaagggtgaaactgctctggccacaacattgttttcagaatgattagtctattttacttcttatttctgttatctctggcacaagattattcccttttagctcctttttgtataatactcatatatggttcatgcatacttaacctccttgtaaaatttgtttctttttggctaaaggccatcaaactccaaatgatcatgtaaatggagcctcagatgatggctccctttttactggggacccttagataggcctctgagagatatctgacagctgttttcccaaaacaattccccccgtcggcaggaagcagttagagcagtcattgtccctatcctaatggaagttagatgcacctcttcagaggggggattgatagtgaaaggatacagacgaattcctaggcagacagggtccctccctaggacaggtctcaaccttcaagccaggatagtttgaagcctgaaaactgagatgccagttctggatagagtccatgaccagagtgagaatttctgtccccggtttacccactctccctcaatttgttccttctcgatgataccttttaaccaaactttttccaagcctgctcatggacaattcagcacacactcccccccattctaagcccatagaaacctggactcagccacaaagttagcttacccacttacaggtcccctcagatgctgagagcttagtttctgtcgctcaatacaattctactctgccttactcactctctgatttccacgtaccctattcctcttggttgtgggacaagaacctagaatttgctgaactgcaggagtgaaaggggtgtattgtttctgcttgctgatctgcaggtggcaggagtaaaagagctgtaacactctctcccacttgctgaacaatgggagagaagtggcaactgggtgacactccctcctgcttgctgaactacgggagtgaaaaacctgcaacagtagcagtaagaatctctcagaaattcaaaactgtgcatagatgtgcctaagatacaaagaataataaacacatttctattctaagggagtttttaaatctaggagataagttggctcttgttcacatatacctacaattcaagcagaatgggaaaactcaccagaacattctggaaagctgagaagattcagggaaggaactggtcaggaagaagtcacaaaatggctttaaagaactctgagaagttggagagggatttggcagatggtgaaacccacaagagaagtacaaagtaaagagagagaaaatcagaatcatgaagtatcaaaagccaggaaaatctgataatttgtaaataatgtaggctggctccagttgtacaattgtagaaagtttggggaacaggtcacaaaatgacttcttacaatacctaaagaccctggattctatacctttgagatggaaagttttaattttattgcttctaataagagaccgtctcaccagtatgtgctttagataagttaaggtagaagcaaatttattgtaaaaggggaaatagttaagaagctattgtattaattcactcatctattcacttgtccatctattcaacagtgatttatgaaatgcctgctatgaatcaggcattgtcctgagttatgcaccacagaaaggcatagagtgcaataactcaggtaagattaaggtcataaattagatgagaatatgtctttctaatatgacaaaaacacagaaactataaaatgatagattgtaaatttgtttgcatatttatacatttgccttcatggcaaaaatatcatgaaattaaatcaaatgtaattttggggaaaacaaaactcacatttcagttgcagatgcctgtctccaacacttccagctacctttctaaaagtgtttgttttgagttaacacttatatggcactctttctgttctatgtttgttttattttagcccagttggaataaaaataccttggctgtcatgttcctagagggggaaaactcagagaaaaaaaacatatttttttaatactaaaagatatggctttgaacagattattccaggggctatgacagacacctagatgattaggaattgggacttactttagatagtgtggaaaagaagagtagttctggcaaagtgatatttaaaatgaggcctaaaatatgtgaagagaatagaagtctgagggaaaaatcatttcaggtggcaagaataaagcaagtaaaagccatgctgtgaaaatgaacaaatacagtctgacattctgtgatttataattctttaggctttgggctttggccagcatattataattattgttttgccttttttaagtgaaaaatttttaagtattgggttaaccatactcttttgcttatgaccattaaacaaatgggttaccaaagtaatgagctctactaaaattatgtattgaatttgaactcttctgttaaaatatactaattaatgtttctttctattgtgatgatacattgggtctaagttttcccattaggataaaattggcaccttgatccacaattatgccaggtagtacatcatcttcatttaagtagatatttaaaggatcttcatcactcatctgtttcattgttagtttttaaggactattttaaatttattgacgataattttctaagagtgtcaacatttttaaagatcttgaactgtttaaaaaagaaggctaacattggaggaccctacaccaattcaaaatcattttgtgtataaatgcatatattatgtgcacttctatattaaactaaaaagaggcctaatgagatgtagattaaaactgattttctgatttttaaaagctgaatattcctttaaagccttgttcttgtgaactaaaataatttttaatacagaggtatttaagtaggattttataaatttaaaatgttagatgtctcagaagaaaatttggggaatactgttttattaatgttatcgacctatccccaacactttactagacttaaatctctataatctaattttctgtatcaagattgtccttcttcagaagttttggtgattgaggagaagatccagggtttcaacatgatgaaccgtgtcttgttctcagcaaacataataaaagagaacttagtattatataatagaatctgggagaaaacaagattcttggcattctgaggttttctagcatgaggatacttattttacatgcaggcttcagggaggtatattggaaagttagtaactgtgccatgttattttctctttagatatttggaaacaaaaccaaaaggacaccagtaacaagtgaataaaaataactacaaaaaattacacctgacttcaaagtataaaattactcttctatcctacttttctgtatctaccattaatacacagactttctcttaccacctaaacaaacacatatgtacatgcacacacacacttgcacttgctcatgaatacaacatatcatagtggttaataacacaaactctaaaatcattccacctggaattaagtcttggctttgtcactgatcgctgtcaacttggacaggttactttacctatcagtccttactttcctcatccataagcagatctataaagcatattctagcctatgttgttagattaaatgaattggtatatgcaaattacctagaccagtgactatcaaacagtaagtaatacataagtacagatggtatgtatgatgtaagtgttaaatgacatcattagcatgattaccgttttaatgcatagcagcacaaagtctatggaaagaaaacaggaggaaaactgtgggatttcattgggaggaaagaaatgatgtacttttagttccgagaaatgacttgtgttcagtcaagttaggaaatcatttagcaagaccttgtgacaaagcaggcaagaaagtgagaaagaaactgaaggatatttaaatttttgtgattttaaaagcaaagtgagccaatggtctgtatccaatccaggtgggcagaaactgtgcagcccagatagaaacatgtagcactacccttggtcactctaaatatggactccttccttatggcttcacatctatattctcatctgatgcccaaatccattatgagatatagatatggtatatatttatattattgtacagaggaagcagttgattttgaaaaagttgttacttatctaatgtcaaaatctattcagttttagaaatagaatttgaagctacttctcagtttcatatattttgcattataccatttgtccttatgaatgtctcattttagaaatattgtcaagtgttttaagggatagtaatatcaccatcattaagaatatgtcctgatataaaaacatagtagcaatttccacatcttgatacatattgtaaattatcattgatgaaataaaaaatctgagataagtttcagaactattcctgaaacatgtacacaatgtggcttttaagaaaagcgctctatacacccaataaattaacccaaaataagctggttttcatggtgcacacctgtaatcttagctatacaggaggattgcttgagcccaggagttcaagactagcctgggaaacactgtgagaccctgtctcaaaataacataaaatgaaataaccaaaaacaagaaaaaaattaaactcaaaaactaaaactgcttacattgttttttcagaggaaaggcgggggtaacaacattaaaacctattttttttttctaattgaaaaagaatggtttatgctatcagatgaatgcctccagcagaatgtaatttggttaagacattattggtaatgctgtatgtgggatgaccacacgttttgtttgtcctggacagtactagtttatccctatttgccttgcatcacttctgttagcctttgtctcagatttttcaattaaaaattattattaataattacatttaaaaaggttagagttattttggcaatcctcactttgtacttctagctgtgaaaatataaatggattgagaacagcatccatactttaacacacggtcaagtaagctatcaggtttacctctctttttctgatgctttccaggagccgtataactcttggtaatattttacagacagtgtatgtgaccctgcatggtaaaaggcagtggtgggagaagtattcagagctggtaactaaggtctcaacttggccctccagctagatgtggttttatgcatcctcagcttgtgaaatgctgaaaaccacaaagcactggtggtagctggtgaggctggtggaacaatgagacaattatagttttggtgcatgtgaaataactacaggaaatatggactcatccgtactgccatagagaatatagagagtggtgtgaggactcactacaaaggacttgtcatttattgtttggtgaaaatctatactgttcaattatttactattttagtgcttatttatttttaagccataaactccatctgcaacaataaacagtctcactccccaaaaatgcatttataatacaaattaagaaataaatttccatttctcaagaaagttgatgaataatatgttacttgtacacaatgtctgttgacatttacgatacttatcactcacacagaaagtggaagaaaaagacaaaattgctcaagaagcaataccatcaattttacaaataagtagctatattaagacagtgctctaaaataaagatttaacacatacagctgtagagggtatattttcatagcatttgggaagcatgatattttatttaaatcaaatgacttttcctcaaaattaaacttgatcttttttattctaagatttatgacacatgcacacaaagttaaaccacggatatcagttccattaatatataagaatttcaaaattgtcaaatattgccacatttatcaaataatgccaaatagaaaatgagttaaactaattttaataatggattgattatttcatggaattcagaaatcaaagtaaacattttagaagttccttcagttggatgtgaaaattctaccattattaagaattccaatagaaagtcagttaagtaatccattatttaaggtaaaataacttgcttttgtggcaataatattaaaaacatttttgaagcacagagtcatagtgaaaacaatgtttaaccacattaagaaaccaataaactgaaattgtatttggaatttaatagaaactgttttgtaaacctaaaatatatttctatacccagagatataggacaccaaagatttgagacaaaacaaatgtttaggtggtatacactttgtctgtttgtagctcattatctataagatgttagaaatatttgaggctttaatgacctagtttgtaaatgatgttgcatgtcttaaaatgttattgaaactttctataaactaggcctcttaaatttgcttaaattttgtattaaaaatcagctcagaatctttattaaaagactttgatgagtgcaacatcaaataagtaatcttttgaagcttctagtaagttttagttatcaagaataaagattgctaggaggaagagaaatatcagtatatctctacaaaaatatgaggagttgagcaagttaaaaataaaaagtcagtgagtaagattttattttcaaattatataaattttctttagaatattatgtggaaagaatcatttgacagggcttctatttttatttggatacagtgttttgttttctatgcatgaacagaacaccttgacaggttttctcagttttgcagcctcgaaggttgacaaaacattcaaaacaatcacaaacgaaggtaatatatattgagttttgttatatgaaaatatttgtcataaagaggccctctgcatggaggaaaagaacagtacctgtaaaactgtttggattgaaatatttatacatttgaatatttacatatttcaatacaaaaatagaaatagttacgcatttcaatatgaaaaaaataatactgtttatcctctatgtattagtatttgtttgggacttggaaattatcaaaaggattttctccttcagaaacaaatgatctacagagaaaagtcatcaaggatgtcaacaatttcatttttattaatcataaaacaaatgttagaagactgaagcctatttgagtaaataaattaaaatttataagactatattgaaaaaatacattatttgactaaatataatgcaaatgattttagtcatacagataaataaagaatggattaaagtacataaaaatgtactggctaattattaattattccactctatgttttttatttttagatgaacaatatttaaaaaaaaactttttgctttatgtacgggacatttttctttgtattttttaaaaaaccaattgaactgtttaaaacagcctaaaagaagatttcaacatctgccactataataaaatcaaatataattaataaatacatatatatacaataattttaatagtttgcctactgtctttcattcatagacgtatcctggtttggacaaactattaggtgtttgctttaactttaaattagtcaatcagttggcagaatagacaactaatatgagactaccaaaagtgtagtctgctttcacagctgctagtaaacattttcctaaaaatttttatttagaaaaaacttacatttttaaaaaatctataaattttagatttgtgccatgcacaaccatgtacatttacatagaactaccagtctttaacagtttaccacatactctcctctgtgtgtgtgtgtgtgtatttttttttcctgaaaaatttgctagtaagttgctgatattgtagcacttcaataaattagactcatcagatactgttttatgcttcagtacttagttggtaaaatttaaattcaccaagcttatattttggtatagagttatgaaagtcattctttatatcagtatagtgtgggaagaaaatgaaaataaaaattctcagcgttgaatgaataaataacataatcattttaagcattacaacaattaatgaataaatgcacttattttttctatatttaatcaatatttattgagaacctattatacctattcctcttttataacaaatattgaacaagatagtcaatgttcatatacacagagtactttcagtctagtggagtgtgaacagacaaagaggagataagttcatactcacgtaatatttcattaagagctttaaaaatccttttgataatttccaagtcccaaacaaatactattacatagaggataaactcagtattaattttttcatattgaaatgcataactatctctatttttgtattgaaatatgtaaatattcaaatagacaactgaaagtgttatttcaggtagcatacatgagacagagctctcttaggagttgtattcgaatgtaaactttaaaaaggtgaaagtgtgtgtcttgtgaatatgtggtgatagaatgttaggatcagaaggaccatcgtgtgtgaaagccatgttgaaaagaggagagggccaatacaactttagggctgataatatagggacatcacctagaagatgacatgagagccactgtcaggtatagaccgggtcacataagggttttgaccatggcccaatcttagatttatgattcagcaaattacagctctgaggccaaagctggctcatgggctggtttaagtgacctatgagccaatattttattttttagatttttaaatgttcattaataaacatcaacaacaaagaaaaagaacatgtaacagagagaggctgtatgtgagccacaaagcttaaaatatttactttctggtcttcagaggagaaaaaaatatggtaattccagatggaaagtcatcacaatttgagagctggagagtcacataatatgtattatattttataatgactactttaatattagtgttgaaaatattctgcaggcagtcaagagcagaagcagaatgatccgttaggacgctatggcaatggtccaggcagtaggtgggaatggctaggtctagggtggtagttttggaggagctgaaaatttacaggacttgggctataactagaaggtaaaatcaatagaatttgctaatttggtgaatgaagataagcaaacagtttaaaacatgtgcaactgctcactgtgtggtgtttttctaggaagtgacaacccagagtgtgcacattttatatcgtgtttatgttacagataatttatttatttcttctagaattaaactccttttaccaattctatataattttctcacgctttctatttttttttaagacaataatctgtgatggcaaatgaatgctaacaaaagtaatagttaaaagagtcactctatttcttaaatatcattattttatatatttccattttgatcatcagttactttttctggcatcaaatttcaaaataacagcttaggagtggcagatgtattttgttaaagacagaaagtaatgccgtcatattcactttaaatatgttttgtcatttaacagaccctcactctttctctactggagttaagaaactatttttgttaatttgcttaagtaacctataagtgtttttccattttgcacagctcatctaaaatgatcatttttccagttattttagttgccataagacaatttccaaacttttacagtatcctttttttaaaaaaaataaagttatggtcctttaaattctcactttcttaaaaatctcaatagcctttgctattttatcttatttttacatacatgtgtatatatacatatatgtaaactaatttcttattatttcaatgtaaatatttccccagaattgttgtaccacattacattcaactatttgcttcctgaagaacttttaatttggcccaaatttctaaaattttagaaacagttacatggaacttatcagggatatttcatcaaaatcaacaattaaaaaaataaaaaagagaaaaataattattcatatcagatgagcttttcatattattgctgagtgtaggttacctttgtagtagtaaactgatcatcaaaaaattacctttaaaaatgattttactgttctgatactctttcctactgtgtttcatggctacacaaggagcatggatgagcaacaagggcgctccaattctgttcctctcaagaagggttacatattttgactgaattagctagttagttgtaaaaaacgattttactattgccttccaaatttagcattcatttgcctagactgtgcaaatctaaaaaaattgacaataggaattttcatctgctttagctctcttggaatttaagtcaatatttcagatcatgtaaagatttttttaaatgtatgttcaacaatctgtctgcccaatgaaaatccttctctctttcatcatttgctatttaaatactgaaaatcaaaccatttcttgctatagagataattaaataacctcatgtttttgtgactaaagttagaccagctgatacaaaatgttagattctacagaactctagggattgtattcacactctccagaacttgattttgttttgaggtgagcagaacttctataagctttatgtttaagaactttgttttacataaactatattcaaatctcaactctacaacttactcctattagctctctttatatctcagagcatgagtttctttttctttttttgcaataaaggattttaacacttctgagaagtttttactgaaataatgattgtagactaataataaatgttgacaaaaattggggtaaatggagttcttatacattaatgaatggagctgtcacttggttcaaatacttagaaaaatttttatggtattcactagagctaagcatttccctatcccatgacccagaaattattaatacaatatgcatgatacgggcacacaagaaatggagtgcatatgtccatccaaagaatgttcatagcagcttgattcctgatacataaaatggaaaattatccaagtactcttcagtaagaatgtgggaaacaaatcatggtctctctaaacctgcatgaaatgaaagagctacagatacacaaagcataaatgaatctcatagtctctatgtcaagcaaaagaatccagatacatgataatacatacttcatgattttatttgtatgaaattcaagaacagacaaaactaatttatggcaatgacagtcagaatagtgttacatattggagtgtcatattggctctgaagttattaaaaaaaaaacttctgctgtcatagaaactttaatatattgatcccagtagtgtttattggagtgcacacatgcacaataatttatccaggggtatatatatgaaaatccagcaaattgtcaaggaaaagcaagcattttattgtatgtaagttatgattaaataagaagttatataaagcagtttgaacggtatctgacaaataatgtgcaaacatattcaggagaacattagctataggtcaaaataagtgttatttaaaacccttacataccaattcccaattacatttagataaaagtgaacataaactggtcacaaaaatactgtttaataataatttaataattgaccaagtgttctctaaattacacattataaacagatgtttagaataccaactgcacatcaataaaatattacacaatttaatttagatggtaggaaatatatgcatattgaaacaatgtttaggagattttagagaaaaataatttaccatccatctgtgaaactggtaagatgcttaatggaactctcatttagtgcacaaaacataagatttgacatggtagatataataggcattactctttataaaagagttgatccacttttaaaatcaaaccaaattcattatttttttttgacattaacagaaatgaaggtcagatgcagtctgttgtatttaatatattatttgataaacttattttgacagatgtcttatacaatattccttctccaggaaaaaatatttggggttttttaagagttaaagtaatattgttttgcattttcagccagattttattagcaattagctggtgaatataacaaaaatatggattttttttggttggataccatcttgtattaaacatcatagagataagagactctgattttcagtccctattgaatctttattatagcttaagatttttttttatttttgtgacatatcctgttagttctaagtaaaagcactcagcatgactaggatcactttttatctacttttctatcagcagtttttcaggtacagcatagttacctatattattcacttacatgtcacttatcttcaggagctaatctgctacaattaccaagaaatgtaagatcctaagtatctcaacatatcttttgtttttatcttttctagcataattttgttattttatgtgacatttacacttgtctcaggaatgcaagattaggaaactaagtgatatgactaaaggtgcacctggtttgctatcagatctaaattcaaatctagaggtatggcttactcatgtaaaattatttaatctcttttaacatgggaattataactacattacaagatgtttgcaacaataaagatgaaatcacgtgactaattattgttccataatcagttgataagtggcacttaattttatgaaggttcatttcttacactgacttgaaaccccagcaaacccaagaagtgacccacttatctagtcaatggccaactattgttttcagtagcccaaacatttgggattttcacctttcactgtaactttcccaaacaattttcatgagattcatacggcactttttttctttcttgttctcagcctctcaaagcatgacactgtgtttgaacaagatagcaaaccactgcaaatcccgtttgtctgaactgctaaaaaaaattagttaaaaaatagacgttgtcacacttttcagacaagaaaatgtttagctattccattgtcagtgtaagataataatatcacactaaaataaagggacttttttttcttaatttccatagcctatggatattcatttcaatatctgagaaagcaatgacaaggcaatgtggaacaggcactccacttcattagctagttcatcccactctgaatatctaagtttaagtgccaatttcttcagagacaggatgaaatttgtaaattttatttcctctgtctcttccataaccaaaaccactggggggttatatacagtgccattctccagatggcttatgttatgagactatttataaaagaaagattgatgtttggcaggaaaaaaaataaaatggtcctacagtgacctagaagacaaaatatgccctatactcccatataaaaaagttatttctctctctgaatagatattccacacggaggaaaccgactcagaatgtttcacagcagcatgagttattttctgggtcacttctttttttttaatacttttcctgcctttgataaagtttcctttgcaatgttttggatattgaaatctgggagtttcaaagactaatcccaaggaatcacattatagcaaataattaatcttgatattggcaatttcctgacctacatattaagctattgcttatttcactaaacatttttcttcattaaaggcaaaggaaataaattctgagtttcatagatgaaagaatctctctctctctctctctctatatatatatatacatatagatacatgcacaaagacacatagacatatgtacatgcatacatgtacatacatacatatatatgaatacctgcacacacttatatgtataatgtattttatgagtttatatgtatatacatatataatctgtttattgtaacatgtgaattaaaatatagagaaaaaatagatataaaatatgcctgcataggtagatttcctttcctatcctttcaaaatggcttttttttttttttttgataattgcaagatactttaaaaaagatgaagtaaattttgcctgggaggataaatacttaaaaatttacttgctactttgtgtaagagacactgtcctcaacctggacatactgctctttgtacactgtagtgtgtaattttgatgtgtcatgcaggaatttttcccctcacgagttatgtcagaaattctagggtggcttacgatattggagatattcaatattcattatagcaagcaccaattaaagaagaacagaatataatctagaaaagcaatttcaatatgaaactgtaacacaatatgttcatttaccttgattatatttagatttcaagccagctgttgtatcataaacactgtttgtttcattgccaaaattaatgtgcctagtctgagttatttagaaaaatacatatgcaattatgttaaaattaaagaagttatgaaatatgattattaatcaaaatgctttacattgatttaaaacaagataatgcatttataaaatgagttctactgcatcccctcttcaggttaatagtttgagagttcatcattttttatttttctcagaagaaaataaatgtaaatggtttaaattcaaatttaataattcaataaattaaattctcatatgctaagttacatttaatccatgaataatgatagtttttcaacttatgtgtgtttttaactttatcatgcatttagtactggagatatttgtcttaaatattcatgatgagttaaataactttttgtgtacatggaagttcaaagagccaatttttgtactttcttctttcaattatattatatatatcccagaggttaatatagacatattgagagtagtgttgcagcttgatacacaattaggtaaactatgggtcccttaaataatgataaagccataatccaataatcctgatgctaaaacataatttactgaataatactaatattagcttatatttgctgcatgtatgcttccagtgcaccaagtacagtgctaagttatacacaaaacacacacactcatatttatatgtcagagtaaatttataatcttgatattattattctcaccatcttacatattcagaaaatgaattttggaggcattcaaaatcctggcatgttggtcaagaacttacatttgcagagcattgatcttaactgtgatgttatagtgattcattgtctttctttctttcttaaaccattacattacaatttccccttggtgtaaataacagcccttttctctcttcatcattcttttatctcaaagaaagagtatgacaggtatgttaaaaactattgtctatgtgtctcttattgtataccaagctgtttgaagtagttaacgtaataaattcatttaattccaataccaatgttacaggagatgaaccatttcaattttttagagataaagaaacagaggcatcaacagaataaaactttccttaaattgcaaagcccaatggtgatagagtcatgaaatatgaacccagtttgtcttgctccaaaatctgtgttttcagtcatcactgtgctttcattcaaagcaaggatacttgctctttcaagtagattatcattttatgcttattattattgtaatggaggaataagacatatacccaggaaaaataactagcaatataactagacatatacccaggaaatatatactagacatataccaaataactagacatatacccagtaaaaataattagcaatataagccgaacgtgatgagcgactatatatagtatgaatgagaagcactactgtaatttagaagtaaaaaaaaaaaatcaattatttccccactttagcttcctaatagcctttgtctcaccttctctatatgtttatatacaattcaacatatgttaaaaatgttatagcaattcatgctaccttttaacttactgaatttcagtcattcgctctgctttgcctagcagtagccaaattacacacacaagacatggaagaagaaaatttttttttttttttttggagacggagtcttgctctgtggcccaggctggagtgcactggtgggatctcggctcactgcaacctctgcctcccgagttcgagctattcacctgcctcagtctcctgagtagctgggattacaggcatcagccaccacgcctggctaacttttgtatttttagtagagacgggatttcaccatattggtcaggctgctctcgaattcctgactcaagtggtctcccagcttcggcctcccaaagtgctgggattacaggcatgagccactgcgcccggccagaaatttcattttagcttatgttagaaatgtagtagaagccgggcgctgtgattcacgcctgtaatcccatcactttgggaagccgaggcaggtggatcacgaggtcaggagttcaagatcagcctggccaagatggtgaaaccctatttctactaaaaatacaaaaaaaaaaaaaaaaaaaattaggcgggcatggtggtgggtgcctataatcccagctactccggaggctgaggcagagaatttcttaaacccggaaggcggaggatgtagtgagctgagattgcgccactgcactccagcctgggtgacagagggaaactccatctaaaaaaaaaaaaaaaaaaagtagtaaaggagacatgcgtgatagatttaaacaaaatgtatatctaataatataactatcaaataaagtatttctgtgataaaatttattgtggaaatattcatgaatgtcatagatgagatttgctttttcattgttttattaaacatctgtgcttccattttgaaataatacttgaaatcccactgtttatcttactttcctttgtcagtcataatctttgaaaatatgtagtgcaagtgctgaactgcatccacactagttctttcctaattaagagttgcagcatatcactgaaacaaaagaaaaatatttttattttttcaggtccttaaattatctatagctttagacactattgaccaattgtcagtgaatcagaatctccttccttactgttcttaatgactttgtacagtttgtatctcattctgaagtataatggctacttttactttcttaattttcctcacctctgcttagtgtgatagccagtttggatattcattgcctattacgacctcctacacaagtttattccatttttttccatcatcccagtcatgtaccattcacactgtagttatctgagtaggtaacatagtattacctcaaaaataaacatattaaaatgtaatttatctttttctttcaactgtctttcccatgaagttgacaccacttacctttcaatggctttatattctgaactcatcctgctagatcttgttttaaatgtaagccctattatctctttcaatagagctctcaattatttcttctttctttatgtctaatgccttcaagttagttcatggcctaatgaattctctctgaattatcctaacagcttcctggatataatcacaggtacaatataaggacatacaacaaacataaggacataaagccagagcacacacaatctctaattataaacttcaaggataaatgtaattaaatcacatgctattaaaagtattaaagtaaaagtatttcattaatggtaatcgcttggcacttctctaagccagatacatttagtccttaagaaaaatactatttatgtaaagaaaaattttccatacggacgagttttgtctttccaaaacacatttttttcagtcttactcacgatgaattatttaaattatgacaatgcttttgtagaataattgtgagatgagcgagaatagctactctaactttttaaacatttacaaaaaaatactgtgccatggttatattggagaaagaatttttaaaaattatcacctctacccaagtaattatataatcctattgtatatctttgtatttgaaactgtaatccttttgtcaccatttttttaaatagttacttaaaatgctcaccacttctttttactaggtgagccacctagttatgtaaaataaacaagtacttctcagaggccagattgaaacaattttatttagcttaaattcttcctagctacctactttcttcctttcaaaactcttattttcaaaaagatattaagataccagcactattcatttatatcacattgattatgtaaataaattgaaaacgtttccttacaaattaaaagagaaaaaagtaacttgcaataaccctgatatttttatctctatttattcaataaacagcatctttttgctctaaaacacacttttgaatacttgcagaaggaaatccagattttgattaaattttctattgattgctatgcaattctgtatgaatcatggttccttaataattccactataagtttcagattgaataagatggttgtcgatagacttggacttcaacactgtagctttatataagtcatttgaaccttcagattcttaaaaatgccataatgtcagtataacacaataattttttgattctgggtcaccaaacaaaatgttcataaaaagtcattcatccagtgttagtggctacataatagaagcaggtggaaataacaaatattttttatcatccacttctacacatcctcctggttcagggcctaaatagcaagtgtttattcctggtaagtacattatcttcttgaaatgatatattttgcttttaagtggtattacagtgagctagaagttataatacattcccattatgcatctaatatttatttgaatgtacccattgataagataccatacttatatatcaatgtttcataattctttaaaatggatggatataaagattaagatacatttaaagataacaaatcaatattagtgaagttattttgttaaggctgaatataatgtgctgaatattcagacatctacataaaagggaaatctgtggttctgtgttctgcctcaggaggtagaaaaaggatggatagatatagatagatagtgaatggtaagaaatcaatggaccaaacaacgatctgcaaatcatggttggttatgaagtgtcttgcaagtaatatgttcttcttcactgttaaggtagctgataattttttgcagttgctcttcaataaaccactattattcactctcagtttaagtagttctactgagtagaatttacgttgcagcttgatatggtttggctctgtgtctctacccaaatttcatgttgaattttaatccccacgtattggaggagtggcctgataggtggtgactgaattcagggggcggacttcccccttgctgttcttgtgacagtaaatgaattcttatgaaatctggttgctttaaaagtgctgttttaaaagtgctcatgagatctggtgtttaaaagctgcttttaaaaaataagttatttatttattttattattttttgagacggagtctcgccctgtcgcccaagctggagagcagtggcgcgataacagctcactgcaagctccgcctcctgggttcacgccattcccctgcctcagcctcccgaatagctgggactacaaggcacccgccaccacgcccagctaattttttttttttttgtatttttagtagagatggggtttcaccgtggtctcgatctcctgacctccgcatctgcccgcctcggcatcccaaagtactgggattacaggcgtgagccaccacacccagccaaaagctgcttgttaaaaagtactgtgtagtgcttccccctttgctctccctctctcctgctctgtcattgtaagttgtgcttgcttcccctttgccttcgccatgactaagtttcctgagacttcccagccacgcttcctgtacagcctgcagaactgtgaatcaattaaacctcttttcttcataaattacccaatctcaggtagttatttatagcagtgtgggaatgatcacagaaaattggtactaggagtggggcattgctataaagatgcctgaaaaggtggaagcaacttttggaactgtgtaatgggcagaggttggcatagctggggggctcagaagaagacagggaaatgagagaaagtttggaacttcctaaagacttgttgaatggttatgaacaaaatgctgatagtgatatggacaataaagtccaggctaaggtggtctcagatggagatgaaaaagttattgggaaacggagcaaagatcactcttgctatgctttagcaaagagattggtggcattgtgcccctgatctagagatctgcagaactttgaacttaagagagatgatttagggtatctggcagaagaaatttctaagcagcaaggcattcaatatgtggcctggttgcttataaaagccaatgctcatttaaataagtaaaaacaacttatatttaaaagggaatgagatcataaaagtttggaaaatttgcagcctgaccacgtggaagaaaaaaaaaatttctggggagaaattcaagcccactgcagaaatttatataagtaaagaagagcagaatataaatagccaagacaatggggaaaatgcctccagggcatttcagggacctttgtggcagcccctcccatcacagacctggggacctaggagagaaaatggtttcatggtccaggcccagggacttgctgctctttgcagcctcaggacatagcaccctgcatcccagctgctctagctccagccgtggctgaaaggtcccaaggtacagctcaggccattgcaccagggggtgcaagccctaagccttagtggcttccacatggtgttgggccttcgggtgcacagaaagcaagaattaaggtttggtagcctccacctagatttcagaggatgtatggaaatgcctcgatgttcaggcagaagtccattgcaggggtggagccttcatggagaacctctactagagcagtgtggaggggaatgtggggttcgtgtctctacacattgtccccactggggaactggcttgtggacctgtaagaagagggctaccatcctctagactcagaatggtagatccactgccagcttgcactgtacactttgaaaagacacaggcactcaacactagctcatgaaaacattcatggggaatgtaccctgcaaagcaacatggaaggagctgtccaaggccttgggggcccgtcctttgcatcagtgtggcctagatgtaagacatgaagtcaaatgagattattttggagctttacaatttagtgactgccctgctgtgttttggacttgcaaggggcctgtagcctctttatttgggccaatttctcctgtctggaatggaatcatttacccaatgcctgtagcctcattgtatcatggaagtaagtaatttgaacttgtgttttattttacaggctcataggtggaagggaattgccttgtctcagatgagactttggacttggacttttgagttaatcctggaacgagttaagactctgggggacttttgggaaggcatgaatgtgttttgaaatgtaagaaagacatgagctttgggaggggccaggaacagaatgatatggtttgactctatttccccacccaaatctcatgttgaattgaaatttctagcgttgaaggaaagacctggtgggagttgactggattatgggggcagatttcctccttgctgttctgatgagagtgagttctcatgagatttggttgtttgaaagtgtgtagtgctctccacttcactctctctcctgcctcaccatgttaaggtatgtgggcttccccttccccttctgccatgattataagtttcctgaagcctccctgccatgcttcctgtaaagccagtgaaactgtgagacaattaaacctcttttcttcataaatcacccactctcaagtaattccttatagcaacatgaaaacagactaatacagaggtctagagattgattaatgacctaggtatgatatacttcatttcgtatccttagtatagtgactggttgagcaacaacacataacctgaggccaaacaatgagttccttagaaaacgaaagatttcaggaaattattactctttctgctaagcagctacactgatagaatataaggctggaaatatcagaagctacttttgtcacacaaggtaaagaagacctccatactccctaaaaatgaagtcactggggtcacgcagagcctgaagatgaataaatcacataataagatgatctgaatcattaattcaagccatgcaagaaccagccttactcctgtttcagttatgcatactagtttaagttgtgtttctgttacttgcaattgaggggggaaaaaacccaaaatgtaggagaaaatattgctaatgatttattatataagcaccttaaattatgtcaattgcatcattattgtcatttacttcttcccctaatgacttgtacactggatgagaatgtagaatttaaggtcttccaggaacacctatgaaagactgaaattgttgtggatgctttggcagaaagatatcaaggacttttgctctgatgtagtggttgtctactgctggtccacatactattgatgttcattgatgacattccactgatacgtgaaaacgtgggaaaatagattatcagatgagttattcacaaagtcaaatgcattcacttggaagagctccctttccttctcagattatgacttctaagcttttttggtggaatactgctttttcttttttaaatgaaataatacctttaataaataggtttgtttgtctactttacaatgtgcttttttaaaattttgcataataaaaggccagtttttctgtgctgcactttcaaagaatttaaagtttttcattttttccccctaggtttagaaaattctgggataaactgcttgtagtaatttccttgaaagtgtttatggtatcacagctgtcactagagattttaaccaaccatctgaagtgaattattctctaaagataatgctgagagactagtattaagccatttgctgaattaaagatagaaaaattttgaacggatgaaagctaccaatgtatggagcttctgaaagccatgattaccaggggctgctgtggcttctgtagtgttattggaaacttcatctacgcagagccagtataaatgacctccaagatggcgagtcaaaaagcagccacggggaaatacttttgccaggatttgtagctgctagggtagagacagcaaataaaagacatgcttttctcccttccatcacccatggcagatatagctaattttaaaccatgtgttgtgcaaagatgaatactacttcccattataggcctaaagataatatagtgctccagttacaaggtatgtgcctttctgcttcaaacacactgtttatacatttctctgtgatgctggagcggaacactgcaaaccacatttctattcattaattgcctccacctattgaagaaaggaggtagggggagaaggcaagtttgaaagagacaaatggacactctccttgtttgcgttcatttcttgtccatgtcactctacttgatgtggtttggctctgtgtccccacccaaactttatcttgaatagtaatccccccgtgtcaagggagggacctagtgggatatgaagaaatcatgggtttcccccatgccgtttacatgatagtgagttctcacaagatctgatggttttataagtgtttggaagttcctgcttcgctattctctctcctgcctgctgtgaagaaggtgcttgctttctcttccacttccaccataattgtgtgagtttcctaaggcctcccaggccatctggaactgtgagtcaattaaatctctttccttcataaatcatccagtcttgggtattttatagcagtgtgaaaacacatacttaacaatgcttctagttccttacaataccatcaattcaatctcattaagagttttacagataaaaatcagtcttatcatgcccctctgagataccagcgccagcatgccctagtgccctcctgaaaggcttggactctagctcctcctggactcttcttggttctgagaaatatcaaacagtgtcctttttcaaagggatgagtgtcagctctgtagggcttctcttttacacttctaattccataaattctacaacttccatttgttttctcagccttaaggatagtagctgatttctggattattattattattactattattataacaatattatgagttctgatatctcagaagtgtattaatctctcatatcttacatatatatttaatcctcacaataatgctacgtggagagtcctattattacccatatttttaaagataaaggaaatgaaacagaaaatacgatatttgacttgcctgtggtgagatgtgagtcatcagaagccgacattaggaacagcagtggggaatgttaaaaaaggaaggcttccttgctcagaaatcactagacttttctgtcatctcagaataatcctctggtataaacaactgtgggtcagagaggggccatggtagttggctagtagtaatcctttaaatatctttctcattaaatagagataaatattttcccaagaagactaagtagattggacatttccaaaactttggaaagattcctaatatccactggagagcatagcctgggataaagatgatttctacctctattgtaccaaatttttaaaaagtgttctactcaattatggccacctgtttctaccccaaatttctcctttctaaagtgctgtgttatttactgtgattctaagagatttggtggttaaaatgcaatacatttcagctgggcttggtggtgcatgcctgtaatcccagcaatttgggaggctgaggcaggtggattgcatgagtccaggagtttgagatcagcctgtgcaacatagtgagatcctgtctctatttttatttaaaaaattaatttataaacattatatatagtgcatttattatatatcatatacttatattttataatgtaatatattaaatgtgtaatttaaatatttaatatatttaaaggattttatactaatatatttattttacatatttaatatactcaagggttttaaatatttaatatattcaaggaagacttttaaatatttaatatattgaaggaagtgtttaatgtattgaattttatgtatatatacacatatatacatatacaaatatacacatttgtttacatatacacacatgtatatatatacatatgtacgtgtatatatacatataatgcaatacattaaatataaaactcttccttgaatctcagcatagttattggtagtttggaagtgcttatgccattaccatttataaatgcagtgctaatatcttcatttcaattatccttagaaaaggctactataccttgtccatataaaatcttattgatcaaatattaccaaggagcatgatctgctaaaggtctataagacccagttaaatggctccagaaaatctaaatttgcaaaggctggagagatcttaacttcagagagaaaattgagtcaggaatgcacaacttttgtggactccaacatacactgcaaacagtcactggtatcttttaatagtatgaaaataaaaaatctttatcaaggactcagactgtcatagctatcattctaagtatgaatcatgtttaattttttacaacagttctacgtggtgagtactattatatccacattttacatactaagaaaactcaaatttaaaactatctgagacccacacagttatattattttttcaaataacaatgcttggattaaatctattaaataatttttagaattataatgccaacagatttttctacacaaatttggcttttttctgttttgtaaatatttgtttgttctctggaagttggttgaataaacaggctcctcagatatcctcagatcttacttccaagcaagccaactatttatatgcaattataagaagtatagtttcaagaattagtatgatagagaagtgataaaaataaaagaaatattaaaataaaccacttacgtaagttacaataaattccaattaactcagtatgaaatattattttgcaaagcttatttaataaattattacagatatctatgataatataaacctaaagtatttagaattctcaattaaagcaattataaggcatccctctggaaatcggtctacttattcctggaaaacagatttctacaagaatctggactcagtaataacaatgatagcaacatatgtaggacatataattatgtatttttactgagaatctaataggagatctaatatatatatgtgtgtgttcatatatacttacatatattttcaaatataatattagttaatagtctgttgaaatatttgatacactacaatttttatataatccaataatgaatgcaagaaacaagcaaaattttaaacatatttttgaggacattaggtatattattgctttcaaaatttgtcaagattcgtaatattactgataagatacaggattctttccttcctgtttaattgcttaccacccccaccctcaacacacacacataagaaagcatattgcatgtattttggtgtttttaccttccgtattagccgttttcacgctgctgataaagatataactgggactgggcaatttacaaaagaaagaggtttattgaacttacggttccacatggctggggaggcctcacagtcatcgcagaaggcaaggaggagcaagtcatatcttacgttgatggcagcaggcaaagagagagcttatgcagagacccctgttcttaaaactatcagatctggtgagatccattcactatcacgagaacagcatgagaaagacccacccccaagattcaatgatctcccactggttccttcccacaacacgtgggaagtatgggagctacaatatgcgatttgggtggggacacagggccaaaccatatcaccttcgtaattttgagatgacacattatacaaccctcctaaaacttgtaggaaggcttatgatgaaaaacagaaacaaaacagatcaaaaggaaatactgatattgcaaattgcttggcagtttttgtttgtttttcagatttcagcactccaaatctggaaaacttaaaaatgtatgtatttaatttaaatgtcaagttgtgatctagcttttgcttggatggagtgataaaagatcactacttttccaagtctctttcccataagtcaggtatggtgcactccacagacactgatggcaaatgccatcatctggaaggctaattttaaccagaaaagtctgggttagtagttttctctcagcttgtctttagttagttacttaacttgagtttcagtgcaggcttgggactaaagtaaaaagaattttgtgggtttgaggtcagactatgtgaactattgattctttctcttcacaattaacatcacataatgctataattaatataagtgcatttaaaacttagactacaactttagacacattttggagcagtctgttttcctattcaagttggtaatatctacatttaaatacttatatcacatattaaataatgaaatatcattctgatgttgtttgaaaatcagaggtctttaaatatctgagtacttaaatatggaatcaaagttattgcctgaataaataattttgaaattttggaaaataggaaattaagctaaaagtagatagatatgatgaatgatttttgacctcttaaataaatctcataaatgtgaatttttatactaatttgtggacttttttgatagagttagtcgggttcagatctctctatattgatctctctttctctttctctttgtttctctctatatatatcagaatacgcataatattttctctcacacccttctaacccaagaatcaagtaataatcatcaaattaagcacctcagagactctttgccatcagaagtcgggagtaattacttctctgaaaaactttgttatttattaaatagtaatttagcacttacaacatgatgaatttgcttaatcattttttgatatagcaggaataagacatatatattccatatcaatatggaacttgtatgccatatgttgagacacatacaatttagtagtatggttttacattacactctcccctaaatctcagtctgccctaaacctcaagagtattccctaaacctcagaagactgaagcgtatttgcctaaattagtagttgtcaggcccgagtaaccactatgcatttcacattgctaagaatggctccgttatttagccagtcaagcctag

SEQ ID NO: 424 - DNA, 91580 bp, Homo sapiens
tttcaaaccccctgctgactatacacctactccctctgtccccttcttttacattggcataacgtttgcacaaaatagtggagaaccgcattggcctttagaaaaagaaagattttcccaaattttctccgagacttgtttttccttttacttctgcccatttgtcatcttcaaacttccatccagttccctttgatactctatcttttccatttggtggccaatagctaaaaataattaaaaggaaacattagagtttggcaacctcatgaaaaggcctggggggaggttgctaatgtccctgagacccccagaggaacacaggaaaggcaccattgactaattttcggagaattctatgtttctcacgaaatcctcaggttcattggcaggttcttctcatgtctaaactaaagctctgctctcttttaaattaatctctctgaaatctttggcttttgaatatatacatgtgcacatgtgtatgttttgtgttgtgtctaaatgtatgtatatgtctgtacatgtgtttgcatattgtcctcatggtaccaaattgacttaaaaataaattaatactcacaaattaaataactaaccaaaatgtttttcaagttcaaatgacctggataaatctttagtaaatatgactagttaaatattgctggttgaatagaaagggtttcttttctaagttataaacaaaatacccatgtatttaactttagggtacttgctttgatggtaattgactatatcatgtgctatatcattgattaatagaaaaataacgtagtcattagactaagctttatctaatttctactgtattttttccaagcataattgctaaggatgaataaatcaaataaatataagtagaatcaaagactacaaaggtactccattttaacaacaattatgttgcataatatgtttacttaaagctttctcaaatctctttgacaagtacacccttcaggttttactaagttaaattaagtgataggtattcaaccaaattttagatcattttcaaataagataaaatactaaatttataacaaaaggtttatctattttggcttcttattataaagaaacaaaatatattttggtctgttaattagtatgttctgtttcacattttttaaaatttgtgggaaaagtatttttagaaattacaaagtatggattcataaaatactgatatgtaaaagacaaatgaaattgcttactttctaggttttccctggatattaatgatactaagagttaaaagtctaattaatatacataattaaaactactaaaactcagagaaataattttgtatgtaaagtgtacagaaaagcaagatatgtttttggtgaagaaggttgtaagaaaaaaataagagtattgcttttgttaaagaaaaagtaacttttaatagtttagaggttaaagtttgttttagaatgaaaaaatatatacataaaactgaatgagtaaaaagttacaaaaggataatgaaagataaatcttaaaatgtatttgtatgtgtgatcaaactgaataaaattaaattaattttatgtagcatttttaaaaagtcttaatatcaaaagtacactgatacaaaactacaatatgtcttctcttttcaacaagatttttatatattaagagatagtaagatatttttgtttaccttttgagcgaactgaaaagagagatagattctaatgttatcaagatattttcctgtgcttcatgttttctttattgggtctttgattatttaggaaaactaaatatttaagaagttaagagttttttttacaatcatgtagcttcctgtattagtttttaaagtcttttaatcatgactctggttaaattaataattattattttataatccataattttatttttgatcatgtgtttcaaaactattttgtgaaacttttcaaaatcaaaattaagtctttttaatttcaagcaaatttttggacattgcagaaagaaccctagaccaacagaaagctattaaactgattagtctcatttgctatgttaaaattatataaagaacattgtcaaaatagaaattacatttaactttctttgagttatatttggatatggtattgacatatatgttccaaaattatatgagattcctagaaatctaatttatcttggtatatgttatcagtcataattttaattattatgttttattgttgtagaccacagaaataaccaaatttccttgtcagttgcattattattataatgaactcccatccaatctctaatcatggccattgtaaatctttttgaccataagtgattgctttattctaatgcttttttatttccctgaaagctctttgcaaatcctacagtgttgtgtcctcaaggagatatgtggaaaaaataaaaagagctctaccattccttctgaaactatgccaatcaatagaaaaagagggaatcatccctaactcgttttatgaggccagcatcatcctgataccaaagcctgacagagacacaacaaaaaaagagaattttagaccaatatgtctgatgaacatcgatgcaaaaatcctcaataaaatactggcaaaccgaatccagcagcacatcaaaaagcttatccaccatgatcaagtgggcttcatccctgggattcaaggctgattcaacatatgcaaatcaataaacgtaatccagcatataaacagaaccaatgacaaaaaccacatgattatctcaatagatgcagaaaaggcctttgacaaaattcaaccacacttcatgctaaaaactctcaataaattaggtattgatgggacgtatctcaaaataatcagaactatctatgacaaacccacagccaatatcatactgaatgggcaaaaactggaagcattccctttgacaactggcacaagacagggatgccctctgtcaccactcctattcaacatagtgttggaagttctggccagggcaatcaggcaggagaaggaaataaagggtattcaattaagaaaagaggaagtgaaattgtccctgtttgcagatgacatgattgtgtatctagaaaatcctactgtctgagcccaaaatctccttaagctgataggcaatttcagcaaagtctcaggatacaaaatcaatgtgcaaaaatcacaagcattcttatacaccaataacagacaaacagacagccaaatcatgagtgaactcccattcaaaattgcttcaaagagaataaaatacctaggaatccaacttacaagggacgtgaaggacaaggagaactacaaaccactgctcaatgaaataaaagaggatacaaacaaatggaagaacattccatgctcatgggtaggaagaatcaatatcatgaagatggccatactgcccaaggtaatttatagattcattgccatccccatagagctaccaatgactttcttcacagaattggaaaaaactactttaaagttcatatggaaccaaaaaagagcctgcatcgccaagtcaatcctaagccaaaagaacaaagctgtaggcatcacgctatctgacttcaaactatactacaaggctacagtaaccaaaacagcatggtactggtaccaaaacagagatatagaccaatgaaacagaacagagccctcagaaataatgctgcatatctacaactatctgatctttgacaaacctgacaaaaacaagaaatggggaaaggattccctatttaataaatggcgctgggaaaactggctagccataggtagaaagctgaaactggatcccttccttacaccttatacaaaaattaattcaagatggattaaagacttaaatgtgagacctaaaaccataaaaaccctagaagaaaacctaggcaataccattcaggacataggcatgggcaaggacttcgtgtctaaaacaccaaaagcaatggcaacaaaagccaaaattgacaaatgggatctaattaaactaaagagcttctgcacagcaaaagaaactaccatcagaatgaacaggtaacctacagaatggaagaaaatttttgcaatctactcatctgacagagggctaatatccagaatctacaatgaactcaaacaaatttacaagaaaaaaacaacctcatcaacaagtgggcaaaggatatgaacagacacttctcaaaagaagacatttatgcagccaaaagacacatgaaaaaatgctcatcattactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtgaaagtcagtgtggcgattcctcagggatctagaagtagaattaccatttgacccagccatcccattactgggtatatacccaaaggtttataaatcatgctgctataaagatacatgcacacgcacgtttattgcggcagtattcacaatagcaaagacttggaaccaacccaaatgtccaacaatgatagactggattaagaaaatgtggcacatatacaccatggaatactatgcagccataaaaatgatgagttcatgtcctttgtagggatatggatgaagctggaaaccatcattctcagcaaactatcgcaaggacaaaaaaccaaacaccacatgttctcactcataggtgggaattgaacaatgagaacacatggacacaagaaggggaacatcacacactggggcctgttgtggggtggcaggagtgggcagggatagcattaggagatatacctaatgttaaatgatgagttaatgggtgcagcacaccaacatggcacatgtatacatatgtaaaaaacctgcacattgtgcacatgtacctaaaacttaaagtataataaaatagaaataaaaaataaataaaaagagctctaacaaatacaggtttctaataactttgagtttgtaccattggaccctatttcctagactctaataagaaaaaagctggactcataaaactgccaacatcaaccagaacaataattaattacatagtattgaactgatgaagtattataatttatgactctaaaacattgctaattgttgttatgttttgttttccagattttatttttttctcttaagctatgtatagtttacagcaattggtaaaaattactttcataaatagaattgaaacatttacttttttctttttgactgatccctcaaagtttttaaactattgatgagtatatgcatattatggcaatatagttactcatataagtttaataaaaatctgttcttctactaagaggacaattggaaacacttgttatattaccaaagttttacctggaatatcctatcatcatatatgaccagacaattttaagaaagtgaggttgactttataaagtcactagaagctttttggacaatttgcatgacaccttgtctacatgtttcccttataggattcctagccttgtaagaatgtcgctttctgataggcccaggaacctcaagacattttaagggtcttaagaagagaaaaattcacccaatttgtacaggaatgacaggcacagtctgaggatgtgttcttaattctggcttctaagcctcaaaaggctttctaaaaggttaatctgggtttcttatgaaaagttcaagcaaaagcaacgttaaaagaccctatatagtaaatcactattcatgcccaacttatgtaaatgattaggccagtcttaatgagactaaacatattttacaaattagtcttaccacgattatctttgatagtaatggggaggactggatagagaaaaattatgctacagggggaaaaactactataaggcaatcattaatggattccagctcattgtttttagattttattatttacctgcaatttgaaccaaatcctgaattgttttctggctgcaagtctctgaactaacatttcgaaagttttcttccatttttccatcttggtctcactgcagttaaaactgcttttttggaatcccacaagtcaaaactgattgactggattagacttcagagaaattaccacacattcaaacagcaatccagaaaaatcttccagattgccacctcctcttcctgctccaactaaagatccttcaaacccaaatccaggaatcttctcaactgatcaccttccaaactctagaaaactagtttttagactactctagacaattggctttgtttttcctctgtttccatacaactgcttcttaatgaagatcagtttgtctgcatcatatattgaggctaactttgaaagcccaataccatcttgtagaattagacacaactgtttaattaaactgcactattcccagtgatgggagactggtttaataggatattttgccactcagctacaaacttggttattttttctcaacagctaccagctgtgtgggtttttgtgcatgaaactgtaagggatgttcagacagaagaatattgtggctcagaaaacaacaccccaaaagtacaatgctttggcatgttgaacactttgagctaaaataggaatgccacagaagctgcccccaaatcaaggactttttttttaacctctcctgtcttcatactggcacagggaagagttttactctgatattttctcatatgccttaagaccagaccctccaaagagaatacagttgccttccatcccctcactgaaatttcattatcaaccacagattgagggatgcaaccacacctggatggactttgtcacatgacgttgtctatctctcaggatcattcaaattacaaagaaaatcatttataaaataatgcctgcctcttgggtcctcttaattcccctaaaaaatatttactacctctcaaaaatttcacatttaccccttcttttcctctatgaagaagagtatataagcatgaaaaccttattgggttattgggtaataattctgcaattcccctcttatgagtgttaaataatttttatgcctttttctttctttattctgtgtattgccagttacacagcaactagcaaaccttcagagaataagaggagactttcctttctctcctggaagtaacactgaagagcccgtttgtaaagttcacataatttgtattgttaccttttaaatggtttactgattattctaagaaaatcttttaatgtatctccatgacattttataatatagcacaaaaaagaaaaatgctaattgtatgtatgttataaagttttaccatcatttctaagttaaaaagtattaaattgagattgaaaccgcctacgcaaaattatgacagtgaagcagctccattatctggggtaaatacctggggatcatcatcttgtgctaagaaaatttaggacacggacacacacgaggagtttaggaatggaggtttaacaggcagaagaaagagaaaggagaacagctctctctctctctcggaggggcttcgggaagggaaagaccagctggcataggatgcgctagattttataggcaggcttgaggaggtggtgtctgacttacctagggccctcagattgatttgatcaggtgtgacttttacacagtgtgcaaggaagactggccaccccaccccaatctttttatgcaaattggctttccacttgacctgcgctatcttgtctgctccttactgtacacatgtctggcaaaaagaagagaagatggagctgccattttgaacatacctagtcccaggcagtatttttctgccggcattcacccgtgcaagcttccagcttgcttgtctatgtctgcagcttgatttcacaggctgctatttgttagaaaatgatttgggggctgcttttcattaaaaaggaaaactttccccaggactcctgtgccctcactatctgcctaagtaatttcttcttaattcctatatcaacagcaagagaaatctgacatagttgactctatcttgcttctcatctccaaactttctttggtcatttctgggagtagaagctaaatttaggaggaattcagtttatagtttaacttgaaagaaagaatgagaacaatctttctaaaactaaaccgttccccattcagggctgaaattgtctttgtaagactgatgagaggtcacaaaataggtatagtttctgtaatcctttactgctcaggagttatgtagccaaaggtcacaaaatttgtgacctaactcatgtctcaacttatcttttaaccccacccagaggcagactcagtgcacgagggccattttccacacccacatgatttcatccccaaccaatcagcagcaccgcacctattccctagccccctgcccaccaaattgtccataaaaaccctaagctgtaaaccttgagggaggcaaagtgataactccagttcttccatgtgtgctggcctttcatcaattaaactttctccactgcaataccgtggtctcagtggattgatttgctctgtgcagtgggcagaaagaacctgttgaacgatcacaaaaggtaaaaaatatattgtctttcaatttaattgacgatgtctcctgcacattctaggtattttaaaaatattttaaattcacccaaattagattacaagtatatatgcttatgtggttttttgctgctggctgctcttcctctgaaacataaaatattttctggaacagtatttcaagcaactgttgaaaattagccacatgaactaatcatttttatacatataaaatgtttttttctaaaactcaacagaatagatgactctattgctaattgatcctaactcctcaatttagttaactttgaacttttctgtaattctcctaatttaatctctttaactctaattaggttgccatgtacaatgtcacccacttccacccacttgtttatactaacctaattttttaaatcacaagttctactttcagttgattcttaggcaagcattcattctgatgatgctaagcattgctcataagtcatttcctactaaattggctaatgcttttttgttgtgttaacacatggactctcttaaatgctaaaggtggcattttctatttgcttaccttagtattagctttcttatccataaataggaataatagtttctttttgtttttatttttgttttcttgagacagagtctcacttggttgcccaggctggagtgcagtggcacgatctcagctcactgcaacttccacttcccaggttcaagtgattctcctgcctcagcctcccgagtagctgggattataggtgtgcaccaccacacccagctaatttttgtatttgttagtagagaaggggtttcaccatgtttgccaggctggtctcaaactcctgacctcagatgatccgcctgcctcggccttccaaagtgctgggattacagctgtcagttaccacacctggcccaggaacaatagtttctatcttacagtctttcatgttgccattaaagttaataaatacatattttttaaaaatctgtaaactaaataccactacaacagtctaaaatattgttctctttcttcttattgcttctgatgtaaattaaaagaattttaaaatgtgcgatttactgaatgttaaaaacttttatcaagctctaaacttactgtaagccattcctgtgaggttgtccaaagacctattgacagaggatcaagctggaaaaattaatgcacagctatttcaacctgaacctttggcccaaacttcaatgccacctcctttatgttgctcattatttgttaacactgagaaagtagtttctcctttacagacaaaagcttgggctaaaagcacacttaagcatttagtctagtactcttttgcagtgattgggaaattttattttatttatcttttttagacaaaaacaccatggtactagtaccaaaacagatatacagacccatgaaacagaacagaggcctcagaaataacaccacacatctacaaccatctgatcttcaacaaacctgacaaaaacaagcaatggggaaaggttccctatttaatcaatggtgctgggaaaactggctagccacatgcagaaaacagaaactgaactccttccttacaccttatacaaaaattaactcaagatggattaaagacctaaatgtgaaacctaaaaccataaaaaaaaaaatagaagaaaacctaggcaataccattcaaaacaattgcaacaaaagccaaaattgacaaatgggatctaattaaactaaagagcttctgctcagcaaaagaaactatcatcagagtgaacaggcaacctactgaaagggagacaatttttgcaatctgttcatctgacaaaagtctaatatccagaatctacaagagacttaatcaaatttacatgaaaaaaacaaccccatcaaaaagtgggtaaaggatatgaacagacgcttctcaaaagaaaacatttatgcggccatatgaaaaagtaaaaaagcaagttaaaaccaaaccaaaaccaaaatgtgatgtcattgcacacctattagaatagctaaaattagaaggaaaaaaattaaaaccctggcagtctcaagtgctgaggagaatgtgcagcaactttaactatcacacgttgccgatgttaatgtaaaatggtacagcatttttgaaaagtttggcagtttcttttaatgttaaatatttgtgattcagcaatcctgcttctagttgtttacttatgacaaaatatgttcccacaaaatattgttcttgaatgtttatggtggctttattcctgttcaccaaaacagaaaacaaccaaaatgtccttcagttggtgagcggatcaataaattgtggtcaatctactggatgggacatgactcagcaataaaaaggaataatcttttgatttacatgacaatatggattaatcttacatatcttaagaacatcataacagtaagtggaagaagccaaactcaaaaggctatgtaccatatgatttcatttacatgacatggaaaaaaagatgaaactatgaggatggagaaaaatgttggttgtctgtgattctgggtggggagaggcagaataacaaaatgatttggatgataaaaatatgtgtatcatgactgcggtggtggttctatgactctatgcatttgtcctaatggaagccagaaggcagtgaaaggaaatattgaatgtgctgaaagaaaaaataacaagaaaactcagccaagaatattatagccaacaaaattgtcttttcaaactaaaggcagaatgacaacatctccaggtaaacaaaaacagattatttgttgcaagtagaaccatcttaaaaaaacaaacaaacaaacaaacaaaaaaccactaaaggcaattcttcaggctgaaagcaagggatactagaaagtaatttgaatctactgaaaaaaacaagagtaccagtaaagtaatcatgtaggggaattgtatatctattctcttgcataaactaatttaaaaagtagcaaaaataatatgtatataattgtataattgggccaaaaacatatagaaaaattatatgtttaacaataatagcataaggaggcaactgcaaacaaaactgtattggagtaaggaaatgatatcaaatggtaatccaaatccacaggaagtaatgaaaagaaccagaaagagtaggtaataagttaataaaacaaagtataaatatgtactatttctactttcttttctctccttctataagacatataaaatattaatttaaaaaatcattgggtttgtgacatatcatatatatgtatatctatatatatacacacacacagatatataaacacatatatatagcaataatggtaaaatctaaaaaaggagagaatgcatatacatgagtgaagtttctgtatttcactggtattaagtaaatctaaaaaatgataaaaatatatatcataagacctacagaagctattaaaaactcttaaagtataatttaaaatttttaatgtaagattatttaatgctacactagaaaatatttagttaatgcaaaagaaggtagtaacagatgaagagagatggaaacgtgagacataaaatgagaaaaatgggaaatataagttcaacaatatcaataataatagtatatataaatgagttaagccaataaaactgaataaattaacaatgaaagcagaaatagagatgtcaacaataaatagttgaagactttgataccacacattcaataatgaatagagcaattacaggagattaacaaggatatggaagaatttaacaatactataaacaaacaaaacctaaaacatctataaaacactacattaccaacagtagaacatatattctccataacagacaatggagaccatgggtataaaacaatcctcagtaaatttaaaagaattaaaatcaaataaattatgttctccaaccacaaacaaattagtaatcaataacaaagttagaaaaattgacaaatatttgacaattacactatactctcttaaatatttaataactctaaaaagaaataacaaatttattgagacaatttgaaacaaaagacaacataccaaaatttatgagatgcaactaaagaagtgcttagatataaattaaaggccatgatatctattttataagctgtacaaaattaacaaatccttaggcaaactgaccgagataaacagaagacacaaatattactaacatggtaatactaaagtcaggaatgaaaaagaggacataagaatgaactttgcagaaaaatttttgagaagaacaagggaagaatataaataattcgattctaaaaatgtaagttacttagataaaatgagcaaaccttagaaatacacaaactgctaaaactgactaagcaaaaatagaaatctgtagaggcccattatggtggatcatgcctgtaatcccaacactttgagaggctgagacgagaagatcgcttcaagccaagagtttgagatcagcctgtgcaacaaagcaagaacccgtctccacgaaaaaaaaaaaaaaaacaaaacaagaaaaaaacaggcatgccactatagtcttagctatttgagaagttcaggtgggcggatcacttgagcccaggagatggaagctacaatgagctaaaaaaaaaaaaaaaaaaaaaaaaaaaaaaaaaaaaaatctggagaatcttttaacaactaagagaccaaattagtggttttttaaactttcctcaaaaaaagacttaggcacaaatggcttcattagtaaattctataaattctaccaatctttataaaaaccaaaattcttcacaaacttttccaaaattagggaagggaaaaacttccaaattattctatgcggtctatattaccctgaagcaaaaattaaacaaaaatatggcaaaagacacaacaaaccaatattccttttgagtatagttgccaaaaatctgcaacaaaatacagcaaaccaaattccataatatatataaagaattatatatcacggctaagtggggtttatcccaggaatgcaaggttactgtaacatcttgaaccaatcaatgtactagatctttgcaatagaataaagaacaaaactcgcctgataatctctatatacatcgaaatgtcatttgacaaaaatattaatatgatacctgtttatgataaaaatactcaacaaactaggaaaaaaagagaactttctcaacccgaagaagaaaatccatgcaaaacccatctaaagtacctaatgatgagaaaacatgcttttcctataagattaagaataagcaaacaaaatgtttccttttgccatttctatccaacgttgtactagagggtctagctagagcaagtcgggtggcaggggcagaaaaagcatccagaatgaacaatttgctaatacatgttacaacgtaggtgaaccttgaatccctatgctaagtataaaaaccaatcacaaaatatcgcatacgacatgatttcctcatatgaaatggccagaacaggcacatctatagatacagaaagtggatcagtggttgcttagggctgggggattagtaaaaatgcagagtaactctgaagtttaataggagtgaggtttcttttgggggtgaccaaattattttcaaattcaattctggtacttatttacaactttctgaatatagtgaaagtcatttaatcatagacattaaattggtgaaccacaaagtaattgaattgtatctagtttaaagatataataattttaattttataaaataattcataaacaggccgggcactgtggctcatgcctataatcccagcactttgggaggcgaggcaggtggatcacctgtggtcaggggttcgagatcagcctggcaaatatggtgaaatcctgtctctattaaaaatacaaaaatagctgggcacggtggctcacgcctgtaatcttagcactttgcgaggctgaggcgggtggatcacctgatgtcaggagttcaagaccagcctggccaacatggtgaaaccctgactctactagaaatacaaaaattagctgggcatgggggtgtgcacctgtagtcccagctacttgggaggctgaggctggagaatcgcttgaacccaggatgtgggggttgcagtgagctgagatccagccactgcactccagcctgggcaacagagtgagtctccatctcaaaataataataacaataataataataattcataaatgaggagatgtcattgttactattacctagactagtgtatacacaaagtctgtgacaagaaaaacaataatgctatgcatatatatatttaattttgtgatgctactgtattatttctggcaggcagcttcctaggtaggaactacatttctcaacttcctggatattttccggtggttagtattagccaatatagtggtgtttgtcacttcagggccagattttttaaaaaaagatatgcattatccttagtgtctattttcacttcagacagtgaaaaaaaaaaatttggctattgggtgcccctcacaatgatcttacataaaatatatgaaattttaaattttctagtaactactaattaatacctagctaatacaaaagcaaaaatataatatgagagataaatgatgagagcttactaacttctaatgaatccatgatggcttagccaaaatagttattctttcttttcattagcatgcagaatcaaaagcacaaattccacaagaagatggactcatggcaaggtactttgggttttctcagctctcttcctcttctaaggaaaagagacagtttatcttgttgcaaatccaactgaagttaatcccagaagtctcctgaaatgagactccaccttaaaacaaaaatcaatctgtctatctatctatctacctatctacacacacacacacacatgcatccatctaacattatatatgctcccccagatatctcctatttagctcgttttagttaaaattagtcaaatataagatttttttcccaaaattaacactttcaaagcaagaaagtaaaatttgctcattgtgtaatctagttacagaaatatcttttgacttcattgtatgtatattatatatgtatacctatgtgtgtgtatatatatatattctcaccactatagtgttctcactactatatatatatacatatatataacagaacataagatctaacctcttaaatttttgtgtgtgcaatggtgttgtcaaccataggcacaatggtatgcagcagttatctagaacttactcatcttatatattattgaaggagtgtatacaagatgtatatgcatattatcttttgtttagtatttttttctaagtcaacagatacatgagaatatttgtcttaagcacaaaatattaatcttctaagagtgttgtgtaaattttactaattttctaattccagagtgttatcatggtgtttgggtttttgttggtgttgtattgttacttgtttggttggttggagtaaaaactgtccattctgcattagaattcacacacagtgtgtctggatacctggtatgtggttagtatcatgtgaattatctacattaaatgatcttcatgaaactcaatgatttttctaaatataaagatgttaaaaagtcaaatcttcaccgttatagctgcaaaggacataacccatagcctagctgaagtaatgggtcctggcaataactacggattttattttctttgttggtcttaggccaattctgttcgctgttttggcttatattatcattcaggggctctgagggctttaatttttttctttaagagacaaggtcctcctctgtttccaggctggagtgcagtggcttgatcattgctcactgcagtctcaaactccccggcttgcactccttccacctcagcctcccaagtagctaggactgcaggtgcatgccgtcatgcccatatcatgcttttattttcatttattttttctagagaaggcatcaccctatgttgcccaggctagtctcaaactcctagcctcaagtatccattctgtcttggacttctaaattgctaggattacaggcctgaaccactgtgcccaggctttaagatatttttaatcttcacaaatgagttctctcagactaagcaagaagggtacatggatgccctagtgttaaagactggatggaaataggaaaacattgtatttttaagtgtatagaccccataatccatgggacattagacagagactgaggactctgaataggtattattagacagagaccgagaactaatttagttgtgggggttatagttttcatgcaacgaatctgtttcagtatgttagacaaccacttggtgcagcacgaaaatgttctagttctatcaaagagaaaaaaaaaaaaaaaaaaaaaacgcgacagctctccaggaactgggaattctgccagtaactatgttcatgaacctacttctcagtagcttatataaaaagaaaatttgcctactaccttgttcaaattatgccatatccctcataaatactaagaatggtttatagtcatcacttaatatatcttttacatacccacacacgcatgcaaacacacatacatgtacatacatatacacatatacatatatgtatatataggtaccagaatgtatataaaataacatgaaacaaatgataatacagcatgataaaatatatttaacttatcctcaagattcaaataataccactgtaaattttctgcttcaggaactcaaaatacaatttagaaaatggttcagtattttaacaatatcttaaaacactgtatgaaaaggtttaaattcttgaaatataatgaaagataagtgaatactgagaaatggcaagaaacaaaattgtttaaaaggagtaaaacctatattgagggtagtaagtgatttaaatggcacaatggaaacttgaatacatcatgtgaaagacattcttgagatgttcttccataatgtaaaggaaaagaacaaaactttacagaaggagaaaacaagttaagaagggttgcaatgtaatctaccaattatatgggacactttggaaggaaccacagcaactagaaaagaaatgataggccgggcacggtggctcacacctgtaatcccagcactttgggaggccgaggcgggagaatcacgaggtcaggagatcaagaccatcctggctaacacagtgaaaccccatctctactaaaaatacaaaaaattaaccaggcgtggtggcgggcgcctgtaatcccagctactcgggaggctgaggcaggagaatggcgtgaacccaggaggcggaggttgcagtgagctgagatcatgccactgcactccagcctgggtgacagagcgagactcggtctccaaaaaaagaaaaaaaaacaaagaaagataaataagctaagttaaaataaaagacataattagcagaatctagtagaataaataaaaaatatgcaaatataacattactggtattatcattagatcaaagtgatatagaaaatatatgtatggccaggaactgtggctcacacctgtaatcccagcacttggggaggctgagactggtggatcgcttaaggtcaggagttcaaggccagcctggccaacatggcaaaaccccacctctactaaaaatacaaaaaaaattagctgggcatggtggcgtacatgtaatcacagctatttgggaagttgaggcatgagaattgcctgaacccaggtggtggaggttgcaatgagccatgatggtgccactgcactccagccagggtgacagagggagactccatctcaaaaaaataaataaataaaatacacacacacacacacacacacacacacacacacatatgcatccatgtaatagtgaggttaagttcctcataaagtactaaaattcaaactcaacataaacttcctgtttgtagtgctcaaagtcacatactgaataagcatttttaaattcaaatctaattttcttctctaatgttggggtgacatcttaccagtcttactcctacacaggaaattgtgtaggagtcacacatttctgaatgtaatacaaacaacaggtacctgaaggtgctgcagagtgaacagaattagacagacctttgtggggtgcacacactgagaggagaggaggtttacaaattgatttcatgttgtcattggcttttaggtttgagccaagagcattcactgtggggtgggagacgaagagggtaccattggaaaaaccactatcttttggacctgcctacccatggcctctaaagaaagtagaggaatcccataagagaaagggacaatgaggggattacctaattctctgaccaaacacacacgggagactcaaagctagttagctatatatattcacaggcgtttaccttttcaaaaatgttataaactacacgttttaaagtatatttaaaagcaatgaatacttgctgaaaaaaatctaaaattacagaaatagatacataaaataaagataattttcctataatttgatttattccaattgtctgagaaattaattaaaattaagaattcaaggtatggaagccatggtatatacttcctttctttgctaatcccaagaaactggaaaaagtgttgtttgtaacttggctttcactatccagttaaatgtgtttgctgcttagcttcatgatcacttaagacaattcatgctcctctctttaacacttaacagaaaatttaaactttttacatactcagtagattgggcctatagaattactaatcctaaggaagtgttttcctgagcagaagtaactgtggagagcaacataattgatatagtcaaggacaagaaatttgagaaaaggttttctgagtattcaaattgaatatctttttattttaacttttattttttgtagtaacaaggtcttgttcttttgctcaggctggtctcaaactcttgatttcaagcaatcctcctgccttggcttcccaaagtgctgagattacagtcatgagccaccatgcctggcttaattttatttttatattggtaaattttttatttgtcagcagacttcttttctaaaatttttttaaggaccatagttaagcctcacaatctagtgggttaactatgaatataagaatacagtatgtatagtatatttccaactattatataaattaaagcaaaatgattacatgaaaagcatctaagcgataaattattgattgtaatggatggcacactaacgttaaagaagtatgaattaactttattaaaaaataataagtgtcagtaattctgaattctgtttaaaacttatttgtttccaagttctattatggtgtttcaggtgaagtctacccgaaaccaaaatatatttttcttccactgctagaattgtccatttcaataattccgtttgatcttttaaaagagagcattgtttgaggtggctgttcgttggctctctgacaaatggcccgtgtccatacggagcaataaatggcaaaatatctgcctgttcattttcctctcaaaagtctccctgactgatagtgacaaaacatcattggaggccaaacaggaatagacatggctttaataagctgagggggaatgccatgattcacatccaaggtcttttttcagcttgcctctttctctaacaaggtccaggactcgagctgctcctctggaataacaaatgcacgtagatggaaagcccgcaacacctctcatctgtgtacctagattacggctgaactcagtcgtcctgatgaatttacacagatggccagctgcaaggcagcctatctggtacctttaaacatctcttccaaggaagaaaaatcccccatgatgctcatcatttaagaaaaaaatagtatctctataaaactgctgtttaaataaggacctttcctgtgtctggtcactttgtggctgaaataaaacctagacaaaaatcagtgtgctacaatctgggccttgagaacctacctaaaatgtgatgtttggttaattgattgagtttaggaattttagtttttaggtttttttcaagactgaactttccattgaatcaggaattcttgtctgctgtagctttatattcatccagcattgtgtggaaattgtgagctgcttggatcattgcagttgggagtcattctattcctgggttagaaaactgagctaaagatgaggttaaaattctaaacctccaacttggtagtcttctgtgagattcaaatttctccatcttcagatttggggtgttcattttgaacctttatttgtcgtggagggttgttggggtaaaattaaatgaaacattttgtataatgttctttcaacatagaagaaccccagtatagtgtcagtttccttttcttttcctttgtctcaggagaatgaactctaggtcccaaatagtcaagttggaattcatcctctttaatttagtttagccccactttatgcttcctcatccacttgatctatttaattctttatatcctattcccaatattcattcctgtccacacccacaaacacactccaacacacaccaacacacacatctggctaagatatttgacttagaaaagaagtttgtcttgttttctaggctaaagcctaccttagaaagcatttgaagagtccagccctgactagttcctacattctatgactcatgatgcaagaggtgggcaaggaagtgctgggtagaggagggcatggtccctgctgagggctccaccccagggccggtgcccacggacctaggtgaggacaggcttttctgttttcgcgcttaagtgttgcatttcccaagaccatcctggcctgtcacggcccatcctgtgcctataaaaaccccgagaccctagtgggcacgcacacaagtggctgaacgtcgagaggaacacaccagcgtaagagcacaccgacagacactggcaaaccggtgggccatcaaccagtggaatgacatggagtttgacaggggcagttgaaggagagcctgcatgctgagcagcccgactcctggggaaaaccaccttcccactccatctcccttctggctcccccatctgctgagagctacttttactcaatgaaaccttgcactcatattccaagcccatgtgtgatccgattcttccggtacaccaaggcaagaaaccttgggatacagaaagccctctgtccttgccataagacaagctgcctatggattgctaaactcaaagggcacatgaagacacatgcccactggggagctgtaaacatacacccctagatgctgctgtggggtcggaacccaggctccccaagacctgcctgtttgtctgcatactcccgctaggagttttgagcagcagggcaccgaagaagcgagccacacccccatcgcccgccctacaagggggacaagggaacatttctcgtttcagaaaaaaggtacactgtgaccagttgcagcagactcttaagttttcacttctgcagttttacttcctggatgttaattacacttcctccactctgttaaattcaggcctgacatatgatacgctttgattaataaaatttgaggagaaatgacatatttcacttctggggagatgttttaaaagccagtgcctatgccatgcatttttttcccttccccttgccactaaaaatgtttgaaaaagtgactgctctgttagtctgggttccaaaaagaggacattgataatacagatgagggctcccagcctacttttgatcaactacatcatgatctggaaataagcatttctaagtcactgagatttgggagattctctattaatagagcttaacctaccctctcatgactccagactagagtaagcacttcattttgagtaagcttcagccttttttttttaattgaatatgcttttcataaaccttcctaataccatagtcatttgatttaactagaacagttttatacatttcgacttcacattaagagagtatagctgggccaagctcagtggctcatgcctcatcccaacagtttgggaggccaaggcaggctggttgcttgagaccaggagttcaagtctagcctgggcaacataatgaaatcttgtctctacaaaaaattaaaaaattaaatataggccaggtgtggtggctcgtgcctgtaatcccagaactttgggaggccaaggcagggggatcacctgagatcaggagttcaagaccaacccggccaacagggtgaaaccctgtttctgctaaaaaaaataatacaaaaaaaaaaatagccaggattggtggcttacacctgtaatcccagctacttgggaagctgaggcacgagaatcacttgaccctgggaagcggaggttgcagtgagcagagattgcaccactgcactccagcctgggtgacaggtgagactctgtctcaaaataaataaataaataaaaataaaaataaaaaatatattagctggatatggtggtgtgtgcctatagttactcaggaagctgagggaggaggattgcttgagcccaggaatttgaggttacagtgagctatgatcacatcactgtactctagcctagactacatagtaagagcctgtctctttaaaaataacaaaaaatacatatgggtatgttcttgagtctctagtgcctacttgcattacttgataatttcttagatttacatagagtccttgccttggggtttccatcaatttaatctcccatctgttgcaaaactcatttattcattttggcaccttaatgactattgttttcatgaactgtgtgggacctgatataaccatctcttcttgtgcactaggctttatagccttagacttagtacctttcctaagcacaagcaccttgatattgttctcttgatgcctattcagccactatttttgtggaaggattcagtttctatgtcactctcagtctatcaaatgagtgaattctatcaaaactatcctttgaccactaatggaatgctcattttgtgagtttctcactttgtgacattatcattttaattatgacataatatttgtgacaatttaataaaacatgccatcaaagatagtttaactaattgtgtgggccaaattaatttacctatgagatgggaaaatgattcagaaaaggaaatataaattgtctaccactcctgtgcacgcttgtatgcacacacatatacatgcacacatgcacaaacattcattagggctaagttaatttatttccttgtatgtattttttcatagatgctacagttggtaagaagtgaactattatgttttgggggaaaatatcattgcttcccagataatttttagaattttacaatctactcaaagaattaaatgtctatataatggatgaatgccactagactacattactctccaggctgacatgcagaatttctaaaaagtattacattattgggataccatactgatgttccaatatagtaaccacgtgcttcctaccctgatataaactgtctaagaaggcatgagccttctgtatgtaaggacagatctctgagaagcctgaattaatgtttgatcagactcctgactcttcagcttgtcatacctctcagtcatacctctcagtctaattctgtctattctcacgttcatatgccttgtcattgatttgcccacagcatctagtctccagttctcttatcagtaaaaattatccaccctcagatctcccctagagagggagtagccttccagactcattcaaccacatcaactctaggggcagctcttcaggttttagcacaccattcatagaagtaacactaccctctagcactttctcctttcatgaagtgggagaaaaacacttgtgtgattaaataaacctgaagtccagaaacatgttaagtaattttctttataactgcataatcagtaggcccagagttcaatgtaggtctatatcttcttataggcagtcattgaggaaaaacaggaaaagtcataatgccttgagtactgataaaggaattgtatttattttatcagggatgaaaaaagtatgaggcagaaaaatggatgctgatagtctcccagtttatgtaataaactgcctgaagatgaatgggagagagagaaaatggtaacagagcttaggagataaagaatgatatgcaaagtgttcggggtaatgaataaatgttaaagagtattaatgaatgagctttacaagatccactggtagcctagttggaacaggataaaccttctagattcaaggtcaacatttttgcacttcccatcctcatccacttcttcactgcctgaatcattatttcttaattgcttttacctgttgtaaaaatgttactatgggataatgactgagagcaacataccaagagaaactgaggatatagagttttctggcaaagacattttgattttgtgcattcagcatgcattccatatctctcaaaatcaccatagggatttattgttccttgtagaaccaccttgaggaaggaagggtttgacaagcctgaaaaacatcctctctgctgtattcttaaagatgttagaccctctgagaggtgaggctggctgggcttctgggtcaggtggggacttggagaacttttctgtctagctaaaggattctaaacacaccaatcagcactctgtgtctagctaaaggtttgtaaacgcaccaatcagcactctgtaaaaacacaccaatcagtgctctgtgtctagctaaaggtttgtaaatgcaccaatcagcactctgtaaaaacacaccaatcagcactctgtgtctagctaaaggtttgtaaacacatcaatcagcactctgtaaaaacggaccaaacagcactatgtaaaatggaccaatcagcactctgtaaaatggaccaatcagcaggatgtgggcagggccaaataagggaataaaagatggccacctgagccagcagcatcaacccactcgggtccccttccatgctgtggaagttttgttcttttgctctttgcaataaatcttgctgctgctcactctttgggtccacactacctttatgagctgtaacactcaccgtgagggtctgcggcttcactcctgaagttagtgagaccacgaacccaccaggagaaacaaacaactctggatgcaccacctttaagagctgtaacactccctgcaaaggtctgtggtttcactcctgaagtcaagctagaccatgaacccaccagaggaaagaaactctggacacatctgaaggaacaaactctggtctcaccatttttaagaactgtaacactcactgcgagggtgtgcagcttcattctcgaagtcagcaagaccaagaacccaccagaagaaaccaattccggacacatttttgcaaccacgaagggacaatcaccaagtggtgagtaccatcagacccctttctttcacttgctattctgccctatttttccttagaatttgggggctaaatactgggccagttaaaagcacctagcacagtcgccagactaaagacacaggtgtcaggctttctgggaaagggctctctaacaaccccccaaatctttggagttgggagcattggtttgcctggaaccagcttccacttttcctatacttctaggctgagccgagggttgacaggaaagccattcagctccgggatcctgacaataagttggttgaccctgcggccatgagcagaaccctcaaagtcatgtcacccaagtgagactcgcccatctatcctatctatcctgacccttgcctcctgggtcctaatgcctgtctgataaacttcctctcgcttctcttctctgaggctagtctcacttctaaaaaccactccctgtctctggtgcttttctagtttctcctataagaatgatttctagtataaacttcaggactctgttactttctttagacacctgggctcaccaatcagaaagacataatttttgcccaaagccccatcataggggggactatctggaattttaggatccctcctcagacaagcaggcctaccaaaaactattcctgatgctaggatatggggagcctcagaaattgtatccttcctattcatataagtgaggaaaaaggcatcacccttccaactctggagatcccttccctccctcagggcatggccctccacttcatttttggggcataacatctttataggacacgggtaaaatcccaatactaacaggagaatgcttaggactctagcaggtttttgagaatgcatcagtaaaggccactaaatctgatttttctcggtcctctttgtggtctaggaggacaggccagggggcaggttttcaataacgcatcaggaagggccactaaatcctacattcctctgtcctccttgtggtctaggaggaaaactagtgtttctgctgctgcattggtgagcacaactattccaatcagcagggtccagggaccattgcaggttcttgggcaagaggtgttactgctgctgcattggtgagtgcaactattctgatcagcagggtccagggactgttttgggttcttgggcagggggagaaacaaacaaaccaaaactgtgggtggttttgtctttcagatgggaaacactcaggcctcgacaggctcatccttgaaatgcatcctaagccattgggacaaatttgacccacaagccctgaaaaagagggcttacaaggttttcaacaaaagtaaagtttgctaaaagttaacggtgtaaacgtatattatcctaacttctaatcttgtggaaatcagaccctatcagtacccctcaaagctcaagtccctcagcacagagccatacaactaataccccctacttatagggttaagaatggctactgctacaggaactggaatagccagtttatctacttcattatcctactaccacacactctcaaaggatttcttaggtggtttgcaagaaataatgaaatccatccttactctacaatcccaaatagactctttagcagcagtgactctccaaaaccaccgaggcatagatctcctcagtgctgtgaaaggaggactctgcatcttcttaggggaagagtgttgtttttatgctaaccagtcagggataatacgagatgccacccggcattcacaggaaaagtcttctgaaatcagacaacacctttcaaactcttataccaaactctggacttgggcaacatggcttctcccctttctaggtccagaaggttatagaacaccaggagtatagttcataaaaaatgtatacacacacacacacacacacacacacattattatatatgtatatacacacattatattgtatatatatatgtatatacacacattatattgtatatatataagtcaatgcatacatacattatatacatgtgtatatgtgtgtatgtatgtgtgtgtatatatatgtagagagagagagagtgagagagatttgtaatcatttctcttctctctcatatgctaccaccatgctgataagcccacaggaaaaacaatggagaattatgggtgaaagagtggaagagctgaaagacacagactgtccttgaggagaagtacaaaggcacgcccccaaagccaagaggagatgaaataaacaaacccatcattgggaatttaaaaatcctgtgctaaaagttaacaaaacaaaacataaacaaaaaaaaaattaaacacatgccaaatttctagtcaaattaacataaatccttacactaaaggtcttatacgtcaattcctattaccccataagacatgtccaactttcaataaaaacattatgaaacacaacaaaagttaagaaaaaacacagtctaaagagtaaaagcagtaatcaaagctgtacacagttatcatacagatggaggaattatcagaagaggatttaaaggagccatgattaatgtgaaaaagtagatcacatgcaagaccagatgaataatgtcagcagagagatgggaactataagaaaaattgtaagtacatgctagagatcaagaacaggataatacaaataaataaaatattaaaagaaataggaaagggggtatcttcagctacaatggagcaaggaattatgcaaagaatttaaaagaaaatataattataatgaattacaatagagtcaagcaaaaagagagtggagtgaaatgtttgaaccattgaaagaaaataaacaaactctgccaatctagaattctatatccaacaaaagtatccctaaactgtgaaggaaaaataaaaattgtctcaagaaacaaaaactgagaaatttattgccagtagagcttccttgcaagaaatgttgaaagactactcaaattgttctgaaaaatagaggaagagggtatacattcaaactcattctacgagaccagtattaccctgatattaaaattaaagacatgtcaaaaaaagaaaactacaggccaatatcacgatgaatattgatgcaaaaatcttcaacaaaatactaggaaacagagttcaacaatacattagaaatatatcatccatcatgaccaagtgagatttatccctgggatataaggatagttcaatagatgcaaatctatcaacatgatacattatatcaacaaaatgagggataaaaaccatatgatcatttccattgatgctgagaaagcatttgataaaattcaacattgcttaattataaaatcatctcacaaaaaatgggtgtagaaggaacatacctcaacataataaaagccatatattacagacccatagctagtatcatattgaatggggaaaagctgaaagccattcccctaatgtctaaaacgcaacaaaaatgccctttgtcactagtgttattcaacatagtattggaagtcctagctagagcaataagataagagaaagatataaagggcatccaaactggaaaggaagaagccaaattattcttgtttgccaatgttatcatcctatcttggaaaaacctaaagactccacaagaaaactgttgagctgataaacaaattcagtaaagttacagcatacaaaatcaacatcaaaaattagaaacatgtcaatatgtcaatagtgaacaatgtgaaaaataaatttaaaaagtaatcccacttacaacagccacacataaaataaaatacctaggagtaatttaacaaaagaaataaaagatttctacaatgaaaatcagagaacactatgaaaataatttaaaaagacaccaaaaaatggaaagatattccatgttcatagattggaagattcaataatgttaaaatgtccatactacccaaatcaatctacagattcaatgaaatctctatcaaaatagtaaaaacattctttacagaaatagaaaaaaaattctaaaatttatatgaaaccacaaaagatccagaatagctaaagctatcctaagcaaaaagaacaaaacaagaagaatcacattacctgacttcaaattatactaaagaagtatgataaccaaaacagcatgacactagcataaaaacagacacataaaccaatggaacagaatagagaacccagaaagaaacaaatccacagacctatagtaaactcgtttttgacaaaggtgccaagaatatacactggggaaaagacaatctcttgcattactggtgctgggaaaactggataaccatatgcagaagaaagaaactgaactcctatctctggccatatacaaatatcaatcaaaatggattaaagacttaaatctaagacctcaaactatgaagctactacaagaaaacattggggctactcttcaggacattggtctgggcaaagacttcttgaacaatatcccacaagcacaggcaactaaagcaaacacagacaaatgggataatatcaagttaaaaagcggctccatagaaaaggatacaatcaacaaagtgaagagacaaacaacagaataggtgaaaatatttgcaaactacccatctgacaaaggattaataacagaatatataaagagctccaacaacactatagggaaaaaaaatctcacaatctgttccaaaaatgggcaaatatttgaacagaattttctcaaagacatacaaatggcaaacatgcatattaaaagatgctcaacatcattgattatcaaagaaatgcaaattaaatctgtaatgagatatcatctcaccctagttaaaatggcttatatccataacaaatgctagcaagagtgtggaccataacaaatgctagcaagagtgtggagaaaagggaacccttatacactattggtgggaatgtaaattagtgcaaccactatggagaacagttcagagatttcccataaaactaaaaatagagatagtatatgatccagcaagcccactgttgggtatatatcccaaagaaaggcaataagtgtatcaaagagagagcctcactcctatgtttgttgcagcattgtttacaatagctaagatttggaagcaacctaagatttcatcaacagattaattgataaagaaaatgtggtacatatacacaatggagttattattcagccatgaaaaagaatgagatccagtcatttgcaacaacgtagacagaactagagatcattatgttaagtgaaataaaccagtcacagaaaggcaaacatcacatgttttcatttatttgtgggatatataaaaatcaaaataaactcagggacataataatagaaaaatggataccagaggctgggaagggtaatgggggttgttgacggggagacggggatggctcatgggtacaaaaataaataaataaataaaatagaaagaatgaataagacctactacttgatagcaaaatagggtgagtatagtcaataataacttaatcgtgtattttaaaataacttaaacagtacaatgggattgtttgtagtttaaaggataaatgcttaagggatggataccccattatggataatgtgcttatttcacattgcatgccttattaaaatatctcatgtatcccataaatatacctacccatgtattatgtacccacaaaattttttaaaataatttgttaaaattttagaaaaagaaatgttaaatttttcaggcagaaggaaaattatacaagccagaaacctgtatctacattaaaaaaaaaaaaagaatagtgtcaggaaaggaataaataaaagtaataatgtttctttaatttttcatttcttattcatgtaaaatatatctataatagtaacaatgtattgtatcgtattaaaagtatataaagtaacataggtaatggaaattaatgaaagcaatgccacaaaatatgagaaggaggagttaagaatactttgttacaaagtacttgcacaacaggtaaagcagtatgttgttatttgaaggcagacccaaattaattaaaaatatacagtaaaatatataggccattactaaaaatagttttaaagaagtacaattgataggctgaaggagtgcctaaaatgagattacataaaatgctccacatcagaaaagaaagaaaaagaggggaaataaagaaaaaaaatgcagcaaatggctacgaatatggtagctataaatccaaatatacaattaagcaccttaaatgtgaatggtccaaattcaccaatggaaagaaggagactgtcagagtgtataaaaaaatcgaactatatgttttctataagaaacccactttaagtattaagactccaatagtttaaaattaaagaaatagagaaatatattatgctaatactaataacaaaaactcagtagctatatgaatttcagacacagcagactgcagaacatgtaaaacaaccagtgataatgagaaaatattacgcaatgataaaagagtccattgtagaagatataacaatccaaaacctttatgcatgaacaacagagtatcaaattacaacagacaaaaatgacagaactggtttttaaaaacagacaaatccattactttagttagagacatcaacacctatatctcagtaaatcatagataaagcaggcagaaaatcagtaaggatatagatgacctgaacaactctataaatcaacttgataaaactgacatttatgcaatacaccacccaacaaaaatagcatctacattcttctcaagcattctaggccataaaacacactgtggctaatttaaaggaatataaattattcacatatgctcttagtctacagtgacattaaactagaaatcaacaacagagagagggctggacaatttttaaatattgcaaattaaatgacacaattctaaatctaaggtaaaagaaggtgtctcagcagaaattttaacatatatttaaataaatgaaaatgacaatacaatttatcaaattttgtgggatgcagctaaagcagtgctcagatagatgttatagtattaaatgcatatgttagaaaagaggaaataactaaaatcaataacctgagcttccacctttgaaaccatgggaacaaagcaaactaaagtaagcagaaagaaataataaaaatttgagcagaaattaataaattgaacacaggaaggtaatagagaaaataaatgaaactaaaggctgatttcttgaagagattaatgaaattataagtctctagccagcctaaccgtgaaaaaagagagaagacacaaattaccaatatcgctaatgaaagaggaatcatcactactgaccattaaaaggataagggaatacaacaaatagccctagtcccatatatttgataacatatggataaatttcttgaaagatacaagttaccaaacctattcaagaagaaatgtattttctgaatgccactatgtctaattaaaaattatattggtagctaaaaactcctcaaaaaatactgaggtcggatgatttcaataatgaattatattgtacatctgagaaagttataaagccaattgtacacaatatcttccaaaaaattgaagaggagaaaacatattctaactcattttatgagggcaacattaccctaaaaacaaatttaaaaaaaaaaacatttcactagaaaaggaaaccacggatgagtattattccttgacattgatgcaaaaatcctttacaaaactgagtccagcagtgtattacacaggataatacaccatgaccaagtgtttttcattctaggaatgtaagtttgatcccacctttataaataagtcaacgcaattcatcatattaacagattaaattataaaaaacgtattatcccattaataaatgaagaaaaagcatccaaccatgttcaacatacattcataattttttaaaactctgaaataaactaaaaatacaaatccttgtttaactgaataaagggtatatatgaaaaaaaagactacaactaacatactacttaatagagagagactcaacactctctccctaagattcgaatagggcaaagatgtccttaccacttttattcaacgatatactggaaaccccagcaatggcaatcagacaggaaaggaaaataatctgtctttatttacagatgacatgcctttctttgtagataatcccaaagaaaattcctagaactaataagtgacttatgcaaagtcacaacatacaaagtcagtatacaaaaaagaatgcttttctatatagcagcaatgaacagctagatataaatgctataaatataaaatgcaatattttataaattttataaaatgtagttataaatatttaataaaatacttatttgtaattataaacataaaattttaggtaaaatttataaatatacattataaaattttataaataaaaatatatttataaatataatagcatttacagtagcatctcaaaataaagtacctaggtataactctaaaaaaatatgcataggatctagctatatgcaaaagcaacaaaatacagttgaaagaaatcaaataaggtctaaataaatggagagataattacatgtttatgggttagaataatcaatactattgagatgtcaattcttcacagcttgatatacagatttactgcaatcacagtcaaaattccagcaaaccttttgtagatattgacaaactgattctaaaatttatatggagagacaaattacctagaattgcaaatacaattctgaaaactaataatacatttataagattcacattactcaaatttaatacttattgtgcagctgcagtaatcaagatagcatattggggtgaaaaacaaacatatcaatggaacagaacagagagcctagaaatagacctatacaatatagtcaaatggttttgtataaaggtgaaatggcaattgaaataagatatgacaacattttcaacaagtagttctggaaaaatcagaggtacatattttttaaaagccctctatcctggtctcacaacttataaaacattaactcaaaatagatcatagacctaaatgtaaaatgaaatatgataaaactttttaaagaaaacatacataaaaatctgtgtgatactgagtttggttatgagttcttagctaccttaccaaaaggtcaattcataaaagaagaaatgagttgaacattattaaaattaaatatttctgtgaaatatattgttaagagaattaacagactgggagaaaaacatctgcaaatcatatacttgataaagaactatcatccaaaatatatatagaacatttaagacccaataacaacaacaacaaaaaatcaaaaatgggcaaaaatctgtacatacatttcactaaatgagatatacagacagtaaataagcatatgaaaagtgttcagcattatttgtcatcagggaaatgcaaatttaaaaccactacaaacctattagcatgtctaaaatccaaaaatatgacaaaagcaagtgtaggtgagaatgtggagcaacagaacactcatgcattgcatatggaagtgcaaaatggtacagctactttgaaaacaatctggcaaaacaaaacataatcttaacatatagtccatcaattatgcttctggatatttacctaactggtttgaaaactcacaaaaaactacatatgaatagttgtagccgttttttgcgtaattgtcaaaacttggaaacaaccaagatgtactttaagaggtgaatagattaccataccatgataatccttactttgaaaactcttcagtgatggagagccatcaagccactcaatgacatggataaatcttaaatgcatgtaaagtcaaagaaatcagtataaggtaacgtgctgtatgcttccatctatatgacattctgggaaagataaaactatggagatacaaaacatagtggttgtcagaggtttagggagagggaagggttgactggattaaacacaggagatttttttagggccatgaaatgaaccctggcattcttcaaggctttatgaagatcacagagaattacaattaccctttggatgggatttttttccaattgaatctaagtacatgttatgcactttgaaaaacaggtactaattgactagagatcctaaccttatggaaaccaagtactgtggtgataaatacataacagcatctatttaaaaaaatctacagaagtttacaacataaagagtgatacttgatgtatttaaacttttagtggaaatatcaaacatgaggtttgaggaatttcaggatgtaatgtagatcatgtccccaaaaatggaactgtgatacaaatgtatgccatcccctcagtggaggtggtggaaaaaaaaatgaggcgttgacctaagtaattttggaaataacttgaaatcataaaactaaggaaaatattaattgtgtataagtactgcactctaattggtaatattgtttctaataggcacaggggttaacaattccaaaactgctgcccatcaatcctggcactgaacaaataagtagatggatgaagaatggtgagaaccaggcttctcactgttggagtgggagattatagataggctaggggagaaaggtacaatgaaacacactataatcagagtgtatatctacatctatgtatctgtgaatctatttatctgtctgtctgtgtatacactggctaaggtacttacatatgttacctatgtctgttcgctgagagggtgtggaagcaattataccactgtaaggggtaagtaaaagcacattcagcacctgaaccatggtttataataccattctttaaaacaaggaatccactttgggaggccgaggtgggcagatcacgaggtcaagagatggagaacatcctggccaacatggtgaaaccctgtctctactgaaaatacaaaaattagctgggcgtggtggcacgtacctgtagtcccagctactcaggaggctgaggcaggagaatcgcttgaacccaggaggtggaggttgcagtgagccaagatctcgccactgcactccagcctagcgacagaatgagactccgtctcaaaaaaaaaaaaaaaaaaaaaaaaaaaaacaaaaaaaaaaaaaacaaggcatcatggttctttagagaaatggcagattatagggctgaggcaaaaactgtacattagaaatctgaaacatcttgtagtgctagaaagtaaggaagtactcaaaaatgaaacgatgacattatgtcaaagggacataggatccaattggaagatcttccattggacaaggtggacagatttgagcagcaagataaataaaatagttttggattataacctgcataagataaatgtccatgattccatactgatataaataaatgattaaataaataggaagaagagacaattctcccatacagaagtattccaaataatgtatacaaatattcccccttcaaagaaatggagtataactatctgttaaatatggactgcatggtgtggcttgattcctgaaggtacagtgtacaaaggaggtatatgaaaatgtaacaatagaaaagtgaatcttggcaaacactatcttagccaggtgatcaagtttaacatgatcagtgataagtcaagttgatagcatttgcctttgatatgttgcattcagaatgacacttcacagctgtggtcctccccgaaagcaaaaatcccagtctgaccacgggaagaacatcagacacaccaaaattaagacacattctacaaaacacctggcctgtcaaggttgacaaaaacaagtctgagaaactttcacagtgcaatggaccctaaggatacatgacaattaaaggtagcattgtatcctgaagaggatcctagaacagataaatgaccttaagagtaaagtagcaacattcaaatcaagtatgaagattagtcaactttttaaaaacaaaaaaggttttatgagtgaatataaaatcgacatccttgcttctcactgggccattaactaccaagcaaattttaaaagaggtaggagcatatccacagagtgaagaaagctctggggtcttcaaggctttatgaagaccacacagtatcacaactgcctttggacgggcgttttcttccaatcgagtttaagtacatgttacaactttgaaaaacaagtactaatagactagacatcctaatgatatggaaatcaagaaaaatgttcttcattctttctctctaaattctttcactcaggtaatgttttgcctggaaatagtagtgcatgtttagattacaaaatgtagtaagttctaataacatcatcttgctagggatgaactgcttataggctaagaaattatttaccttcttaaattttgtaggtatgaccccaatgcatttatgttattattcggagtactaatttttaaaaatttgaaattgggacacatgagtagtttagggtttgattattctaacgttggaagctttataatagctaccatagatgcaaagaatgacacttccagaccgaatctgctgacggggactagcttccaccagacatctcagtaatccttctagctgagaaacggttgagaaaaaaaattgtaaaggaggtttctggagcttttgaattgtttaattttatgggtaaggaatagactttagttttaggctttaattttggtgggaatttgttaatggttacctatattgctctaatttgagccatttctgtggtgcaggtgctgtattggtgtaatgctatcatgcggcactcaccatacagttcttcagcgaggaggattggtcaggggcctaaccacaaacccgaaatgaacaatagaatactcagtaaatatttggccaagcttgcagtgtagtcttggaattaatttaaatgttggctctctgacatatttcacatccttccatctcattaattccagaagatataaatgagcaagtgttaaacactgggggaaaacagcctggcttctgatctcttccttgcatagtcagctgttgctctggctgattttagacttaaacaccgaaacagcgagctaagagagaacgcatccacaaaattgggtaacataagaaggataatttttgagagaccacctgtgtgcaaatctttttctcctatttacaagttgtgtgattttaggtaaattattaatacttgctcaaccatatttcatcatctttaaaatggtgaactatagtagcacatacttcaaaggattgttataagagtaaaataggataaagtataagaaaagtatttattctagtgtctaacatacagcaagtctcaagaaaattagcgtcatttttattgtatttttaagaacagcagacaagtgtatctactactcatgtcttatgctactttccttacaacaaaattatcccaatgaccgttttgcatggcacatttatgatcttctatttattcctgttcctccatcccttaaagctgataagctctgcatgtctgtgttttcatatgaagatagactctcctcttatttaaactcctcacctcttcactcctccatgggtcttttccctcaccatatggctcacctcctgcaggaaccagcaggtcattaattactcagtaagggtctgccatgctaacctacctctcagaaccttataataaaatattaatgccaaaaactactgaaaaattaaactctgcatgatcacccttagagttatgcagtaataactgacagtaaactgttgttacccaaaccaactgttaaagtaaactatgatgcctctctgagaagtggctgaggcagaagcacagatccttctcactcattaatttacgttatttgggaagcatccacttgtcacccagatttggctggtgaataaaaaaagtggcatgaacttatttaatgaatttttttctccctgtgtatcatgaggacagagtttgagtaaactcagttttaagactgaacgaatcatctaatcttcccatctcttcacttgccctttgattttacagatagtttcagagtcatacaatgaattgcccaacatcttgtgttgaatagtgatggccatttttcaaattcattcacttgtctccttactctcctatttccccaggtttttttttttcaggctcttacacttacagcttgcttttatattcctaacaaatagctaccctaaacttatgaaatgcatattcttcctttgtcttccttatgctattctctattgcatgctttctcctctattccttttaaaaatgcaaaatgtcagaatcagagtgaaatcatctcttgaacacattaaacccaattacttttatcaacagcagcactaaaatatatgttaacataattgatggtttctgtgcctttatttctaaatatattgtacaatattttataaaaaacatttatgtcttaacattttctaaattaggctttattttgtaaggtgctattaggttcacaacaaaattgagtggaaagtataggcagtttccacatgcccccagcctacatacacagacagccttcccataatcaacacactgctgcacctccccccaacaccaccctgccccagcaaagagtggtacatttgttacaattgatgaaccttcattgacacatcattatcatcccaagttgattgtttacattaggacttactcttggtgttgtacattctatgggtttcaacaaatgtataataaattatatttaacattataatatgataaagaatagccagggtgtggtggctcatgcctgtaatcccagcactttgggaggccaaggtgggtggatcacctgaggtcacgagttctagaccagcctgaccaacatgggaaatcccatctctactaaatacacaaatttagctgggcgtggtggtgcatgcctgtaatcccagctacatgggaggctgaagcaggagaatctcttgaacccaggaggcagtgattgcagtgagcagagattgcaccattgcactccagcctgggcagcaagaacaaactccatctcaaaataaataaataaataaattataaagaataatttcactgccctaaaatttcgctatactctgcctattcattcttctttccccctagacccctggcaacaactgatctttttactgtcttcatagttttgtctttcacaaaatgtcatgtatcgacacaactagttttattgcatttacgttattgcacttcacggactgcacttttcataaattcgaggtttgtggcaaccctgcactaagcaactctgtcagcactgttttcccaacattatggctcatttaatgttcccgtatcacttttggtaattctcacaatatttcatacattttcatattattatatctgttatggtaatttatgatctttgatctttgatattagtattgtgattgtttttggagcaccatgaattgtgcccatacaagatagcaaacttattctatatgtattatttgtgttctgactgctctgccaactggccactcctccatctgtctccctctcctggatcctgcctattctctgagacacaatattgaaattcatttaattaataaccttataggtctctgagtattcaagtgaaagaaagagtcatatatctttttcactttaaatcaaaatctagaaattgttaagcttagaaaaaaatgttgaaacctgatatgagccaaaagctaggccttttatatcaaatagccatgttgtgattgtgaagaaaagaaaaagttcttgaaaaaaattaaaattgctactccagtgaacactgagtgataagaaaacagaacagtcttattgctaatgtggagaaagtttgagtggtctgaatagaagataaaaccagccacaatattactttaagctaaagcctaatgtggatcaaggccctaactcccttcaattctatgaaggctgagagaggtgaggaagctgcagaaggaaagttggaagctagcagacgttgattcatgaggtttgagaagagaagtcatctctataacatgaaagtgcaaagtgatgcagcaagtgcagatgtagaagctgcaacaaattatccaaaaggtctagctaagataaatgataaaggtggctaccctaaacaacaaatttttaatgtagacctaccagccttctatgggaagaagatgtcatcaaggatttcatggctagagggaagtcaatacttggcttcaaagcttcaaagttcaggctgactctcttgttaggggctaacgtagctggtgactttaggatgaagtcaatactcattgacctttccaaaactcctagggaccttaaaaactatgcacatgtgtttatagcattatttactgaatatgttaagaccagtgttaagacctgctgctcagaaaaaaatattcctttcaaagtagtactgctcactaacaatgaacctagtcaccctagagctctgatggagatgaacaaggagattaatgttgttttcatgcctgctaatacaacctctattttgctgcccatagatcaaggagtaattttgactttcaagtcttattacttaagaaatacattttgtaaggctctagctgtcatagagattcctctgatggatctgagaaaagtaaatttaaaactttgtggaaaggattcaccattctaaatgccacttagaacatttgtgattaacagaagtaggtcaaaatagcaacattaacaggagtttggaagaagtagattgcaaaactcatggaggagtttgaggagttgaagaattcagtggagaaagtaactgcagatttaatagaaatagcaaaagaactagaattggaagtggagcctgaagatgtgactgaattgctgcaacctcttgataaaacttgaagggatgagaagttgcttctcattgataagcaaagaaaatggcttcttgaaatggaatctactgctgatgaagatgctgtgaacatcattggaattacaacaaaggatttagaaaattatatagacttagttgataaagcagagggagagtttgagagaattgaattcaattatcaaggatttcatagctagagagaagtcaataactggcttcaaagcttcaaagagcaggctaactctcataaagtttgaaagaagttctactcaaacagcatcgcatgctacagagaagtcttctgtaaaagaaagtgtcaatcaatgcagcaaacttcactgttgtctcattttaagaaattgacacagccccctgttgctttagctaccaccatcctgatcagtcaacagccatcaatatgtgtcaaatattttctctcagtttcttgtttatgttttcgttttcttatcaagataagactttccagcaccaaaaaaattgctgtttgctgatagcttaaatgattgttcactaaaatattttcaataaggtatgtatatatatttttagacataattctattgcacactaacagactacagtatagtataaagataacttttatatccactgtaaaactaaaaacttatggctccctttattgagatagaactgaacccacaatatcttcaaaatatgcctgtagctggaatcatacagcatgtggccttttcagactggcttctttaacataatatgaacttaaggttcctctatgtcttttaatggtgggctagctcacttattgttagtgctcaatagtattacattgcagggatgtatcacagtttgtttattcattcaccagttgggcatgctggttgtttccaacttgtggcaattatgaataaagctgctataaacatccatgtgcaggtttatgtgttgacataagttttcaactcacttcagtaaatgtcagggagcataattgctgaattatatgttgagtatgtgtttagctttgtaaaaaaaaaaaaaaaaaactgccaaactgtctttcaaagcagttgtagtatttttaatttcaccagtaatgaatgggagtttctgttactccacatactccacatccacaccagcatttggtattgtcagtgtttgaattatcaccattctaactggtgtgtagtggtatctcattgctgttttaattttcagtttcctaatgatatgttaagtagattttcatacacttatttaccatctgtgtatcttctttggtgaagtatcttttcattttttgcccaggatttaatcagttttttttaattattgagttttaagagttgtttatgtattttggatagcagttctttatcagatatgcagtttggaaatattttctcccagtctcttgattgtgttctcattctcttaacagtatgtttcacagagcagtagttttagattttttttattatggtaaaaaagaaaacatgtaacataaaatttaccatcttaaccattcttaagtatataggtcaggagtgttaagtatattcacattgttgtgaaacagatttttagaactgtttatcttgcattatgaacctctgtacccattaaacaacaactctcctttccctctccttcatttcttgctaatcaacattttgctttctaagaatatgactactttgtatgcctcatattagtggaattattcagtatatttctttgtggattggcttatgttacttagaataatcttctcaaggtttgcctatgttttagcatatgacagaatttcctttattttaaaggctgaacaatattccattgtatgcatagaccacattttgttaatctagtcattcatcaataaacatttgggttgcttccatctcttggctataatgaatagtgctgctgtaaaaaagaatgtgcagatatctctaagagaccacgttttccattcttttgtatatatacttagaagtaagagtgctggatcacatgcttatttatttttaattttttaaggaaattccataccatttttcatatgagttgaatcattttacaattccatcagtggtgtacagggtcccaatttcttcatatccttaccaacacttgttttctgtgtgtgtgtgtgtgcgtgtgtgtgtgtgtgtgttgattttgttttgttttattggttttactagttttttgcttttaagtttttttattgttgttagtagtagctattataatggttgtgagatgactttctcattttggttttgacttgcttttcttggataattagtgatgttgaacatcttttcatatgtttcttggccactaatatatcatcttggagaaatgtctattcaagtcatttgcccatttttaagttgtgttatttgatgttttgttgttgagttgtgagagtctttaaatattctggatgttactctcctatcaaatacatgatttgtaaatttttctttcattctataggttgtctcttcagtcttttgagtcctttgagcacaaaccatttttatttaagttttatgtaatcccatttgtctattttcacttttcttgactgtgcttttggtattatattcaagaatttatgccaaatttaatgttgtgaagtttttctgctatgttgtctgccaggaattctctcattttatgccttacatgaaagactttaattcattttgaattagttttgcgtatggtgttatataagggtctaacttcatgcttttgcatgttgacatcctattttcccaacaccgtttattaaagacattgtctttttatcattgagtagttttgactcgcttgtcaaacatcgtttgaccatggtattagtccattctcacactgctataaagaaatacctgagactgggtaattcataagaaaggaggtttaatgaagaaatatctgaggctgggtaattcattaaaaaggaggtttagttggctcacagttccacaggctgtacaggaagcatgatgctggcatctgttaggtttctgaggagtcctcaaggaaactttcaatcatgtcagaaagtgaaaggaaagcaggcatgtcttacatggcaggagcaggaaaaagaaagtggggaggtgctacacacttttaaacaaccagatcacaggagaactcaatcactatgaggggaccagaaccaatggggaaatccacccccacaatccaatcgccacccaccagaccccacctacaacattggagattacaatttgacatgagatttgggtggcaacacagatccaaaccatattaaccatatacatatttattcctaggctttccattttctttccctggtttatttttctttctttatgtcagtaccatgctgtcttaattatgtggctttgtggtacgtttttaaaaaggaagtgtgactcctccaaatttgatctttttttacaaaactgttctggctatttgcaccataattacaatagcacaagctaccatttttgtcctcatatttacctttatgtgtaacaaatatatttgttatattttttgtgtagctttgtattgctgtctgacaccctttcatttcaacttaaaggatgccttttagcatttccattaaagaggtctacttgtaatgtaattctgcaattttgattcatctaggagagtctttatttcttttttattttcaaaaaacagttttgctgcatacagtatttcaacatgctgaatatgttatcccactcccttatggtccatatagcttctgctgagaaatgtgctgatatttatggaagcccccttgtagataatgaattgcttttctcctgctgctgtcaagattctctctgtctttgactttagacagtttgattatgatgtgtctatgcgtagttcaatgtggactttttctagttggagttctttgagattcttgaacctatatagcctctgctttcctcaaatctgggaagtttttggccattattttcttaaataagctgccctcctctttctctatgcttcttctgggatttttataatgtgcatattagacttcttgaatgtccaaaagtcccttggattctctttgctgttcttcatttttttttacctttttattcaatgatttcaaataagttattatcaagttttgcttattctttcttcagccttattaagtcagctgttgagacccgctaataatttcttcagtgtacttacgatattttcaaatgtggaattcctattttattattttttatgctttccatctctctgttgatattttccttttgttcatgcatgtttttctgatttcatccagtttattatgtcttttagttcactgaatatctttataagagttattttagattctttttcagacagctcacaaattgcatttatttagtcttaatttctggagttttgggtttctttgatttgaccatgttttctagttttttaatatgccttgtaacttttgccagaacttgggcatttaacaaaaactaccacctctcacaatctttgtgtaactggctttaggcagagaaaagtcttcatcaattagccaggctggaggttctaggacctctcaaaccttttataatctcttgctgtcactgatattggtctttagaactgcaggtctaacatgcaatggtgcttgcctgttattcagcaggttccaaactttgccatttatctgttagtgctttaagtcaagcaagacagcaatgagtccctagggtatctcccagacaagccaaaatgttggacacacagtccacttctttatctccgttccaagagaggatctctgtgtggagggcttcctcccagttgctctatactatatcacatcagaggagttgtttgaatgagtgcgacaagcaccacacattttttacccctttctctgggatccattcttggttttacaatggccaaggtactctcacagagctgctctagtttatatattgttgttaactaaatgtctctgaggcagaaagagggtctatgacttcttagtctgccatattgccgatatcactcaagtttttttttgttttttgtttttgtctttttgagacgagagtctcactctgttgcccaggctggaatgcagtggtgcaatcacggctcactgcagcctcaaattcctaggctcaagtgagccttctgcctcagcctctcaaatagctagggctgcaagtgagaaccaccaagaccacctaattatttaacttttttttgtagagacagtatcccaccatattgtccaggctggtctcaaactacggggctcaagcaattctcctatcttggccttccaaagtgttgggattatagtcatgagccaccactcccaggctcagaagtttttaattgtaatgaagtccaatgtgttatttgtttctttcatgtattatgccttttgtcttgtattttaaaagtcatcatcaaacccaaagtcatctgcattttcttctatatgttatcttctaggagtttgagttttgtattttacctttaggtctatgatctactttaagctaaattttgtgaaggatgtaggttctgtgtctagattcttttagtttttcttttgttttgtttcttttccatgtggatatcaaagtgttttagcactatctgttaaaagatctatattttctccattgtattgtttttgtgtctttgtcaaggaacaaagtcacaaaatttatttatttatttaaatttattttcatttatttatttattattttttttttgacacagagtctcgctctgtcatccaggctggagtgcaatggcatgatctcggctcactgcgacctctatctcccaggttcaagcaattctcctgcctcagcctcccaagtagcttggattacaggcacttgccaccatgcccaagtgatatttttgtatttttagtagagacagagtttcaccatgttggccaggctggtcccgaactcctgacctcaggtgatccacccacctcgacctcccaaagtgctgggattacaggcatgagccactgtacccggcccacaaaatatatttatgtagttctatttctggactgtgttctgttccattgatctgtttgtctatcatgtgtttttgcaggataattcttaaagtttctgaaatatttcttacatctaagtaaatgtatatagttctacaagatacgcagtataagaaggtgaacactaagtcagcattaatgtaagggatagaacattgtcaatatagtaaagcttccacacaccccttactgaagaatatacctacctgacttccaagcttaattccaatattatatttatcattccgttgcttttattgtagtttactacaaatatatatctaaaattaaacattaaattgttgatttgaatggtatcatcctgaaaagacccattgtcttttcattgttttactgttagaatctagtacaaagactgagaaagtagaaatagcatgggttttatttgtttgctggtttatttttactattacttgaaataatacaaaagaatgtgttatcatactgaaatacccagatgctctctaaggcacctataaaggattttccatttgacaaattagggctacaaggctgctttgaaaagcttctttgatgtagttgtacccctgaaatagtagactgaggatcagagtcattgtattcctgactgttccattgtcactgacaacgcaatagtctaccttacattactgttttggtttcacttcagggagaactacatttgagatttcttgatactttccacttccagaatgtttacattttttactcccaacaatcactggcatgctgaattaatgttttagataaaacaaagaagtcagctactgataaagatcccgtctcttccctgtgttcaaatggcaattctttaattactctatttctgtaaaatagaaaacttgtggtatggggtataggagagaggccagcatcataagggcaataagatgtggccaaacactctccacttaattgaaatttgtttcctaaaaattccagcaaatacctgacaaagtttgtattcatctttacgacctggaagagtaatctccaatttttccctacctttgatctttgttggaatcctctaactatcatgattttgttttggtgattttttttccattctgctccaaaccacaggtttttgctgctgttagctgcacctcctgcaagatctagtctagacttgtctctctgctgaaggtgtcatttttttaaatccacttttctaggagctagctgtcctcagcttaccaaaggattataaggttaaccaaaatcctaggcaatgtagaacagataaagtaaaatctttcctcatccatcacaaagttcatggccaacactcctatgaaaaaaaaattaacaagagaaaaacatagcaaatttaattaaccaaagtttgacgtaacatgagagcctttagaaatgaggacccagagaaaattgtgtatttttatgtgaagtctgatgaaagaagtaaatggttgtaaagaaacatgaacatacagaaggggtatgacctaacgataataaactaggagagaatgcagcaagctttatgtgttagattcttctctgtgtgactgtgtgacattccttccccctgtgtacggagcgggacacctgtcccatgacggtcttttgacctacttacagaggacagccctcacagagaaaggtagaaaaagtcagggagtgacctccaagttatcttatttcgggtagcatagcccgcaccctgtcagtgataataaataaaataaagaagaaaagcaggcaatttgaagggcaatagtctggtttaacaattattattttagaattcagaaaatgagctttaacatatagttgctattaattatgagctgtatcttcttaatcaaatgatttgttttatttgcacagtggcatagataatatttgcttcacatggttactgttttatttttttaggatgatatgattgaattcaccctctgatctccaatggcctaagtgactataagtatttaaaaataattcttggggcctgacaaaggtttgggaggtatgtggttaaattgcagctactgtgaggtttttgacactatgtttaaaaatagttatattcttgtaaaaataaatgcacatggaaatgaacaatgtatactaagtaggaggaataaaatatattaaaagaatcagagaagtagttgttaaaaaaacagaatggatacattatggcaaaatttgcctttagttttcagagaggtcattgacataggaaatatattggattctttatcttgtcatttctgattagaaaaaaattaatcttacaagtatgtttgaagagatctggtgtagcaataaataccccaaattctagtaaatataataccacttttatgttaatgttatcattacatttcatgtacagctgcagtttccactaaagtcctcgttatacttcatgtaaatttctacacatttaaaaatatacagcaatatgtgaatatatgaaaatgtcttttactgtaagatcaattttctcttattttacaatgggagatttcaatggaggagaaacccaaatgtcaaaatcctgagtttttttagctaggattttgactattccagtgcctctagaaacaaatttactaagtcatttttttcagattcaaaaaaaaggttttgtttctctcaccataatggtatctgtgtaaactgactttgtgttttgtcaaaatactttatgagtgttgccaaaacataacctcccctaataaagtgacttattctggtgaaaagcctgctcctcatgacttcttagtctcctcctgctccctggaaatcttatttttcactggattttcccttcccttcccttccctcccctcccctcccctcccttccctttttcccttcccttcccttcccttcccttcccttcccttcctttcctttctgtttttgagacacggtcttactctattgcccaggctaaagtgcactggtgtgattactgctcactgcaatatcaacctgccaggctaaaatgatcctcccacttcagcctcctgagtagttgggactacatgcccagctactttttttattattattttttgtagagatggggtctgtgttggccaggcaggtcttgaacacctgtggtctcaagtgatcctcccaccttggcctcccaaagtgctgagattacaagcatgagccaccacacttagcctagatttgtttctttttaaatttatgtgtgtaaaaataatttactacacgcttaatttaaatatattcttgggactactgttttgaagttgatttaattgaatttattatttctcttgagaaattttatcttcctaccaagtgcttcatgtatctgtacacacacacacacatacacacacacatatatacaaacacacactatttatttgcttcatatttccagagaactaaagtatgtttactcagggaaaaacaaaatgataaaggggaacatgcaactggatagtaatttctgaagcagtctttccctactttatgtataataactctgaacaacaacaacaaaaaaaaaacagaaaaatgtgaagttatcagtgtattgctagaaactgagtaatattttcactaactgaaagacgataaattgttattaagaaactcaatttgtgtggcataggaaagagcatggcctggtctacaaaagccaagatgttttaagacatgttgtcccttctgcactcttttccccatgatcagaaatgcaagatccttctaaacagaaaacacggtgtatgtatctctcctgcaaggatgttcctctgtgaggtggacaaagtgctgttctcctcaagtatccttgagtactctctatacaaattcatacagagaccacggaatccaaaaacaaataaaccagagcagtgagagctgatggtggcatactgaatgctgggaaacacagaccacatcattaaaatgtagcaaagtagtagagacagagtgagatttagatgctccaaactaagagtttcagctttttatatgtttaaaatgtatttagaaagcccaagaactaagcacaagaggtaaaagagaaactttcttcaaatagataggtgtattatgaacatttaaaatacgcttagatacagaagaaaggggttcattaattggtgagttcatcaatcttctctagatatataaagggaatttggccatcacttaagtgaaccatataggcaaggacaattcattcatgtgtcagacggataacgtccaggtgtatttttaatctttcaacaatgattgatgagtacaacaacaacaaaatattttacatatataaaattatctatttaccaaatattgatcgtgctaatgtttgttctttaccctgggatgcctttagggaaagaatagtcaaaaatgtaaagataagaagataagatcaaaagacagccatcagagatagagtggattaagaaaagatgactaacatataaatttttaaaacagaaatagaaataggatagttagagaaataggatcttcattaaagacagtgaataaaagctatagtgtgaccctcttctcaactgtttcttccaggtgcctttgtgctccacttattgctatcattcttccagacaatttgttcacgtggacagctgcaccccacctttcattttcagggtaaacattagtaccacgaatggcactttctcaagaccaccaactctggtgctaatctccagccaaaatcaataggaaaatacttccactcttttgatcagtgtttttttttgtttgtttgtttggtttggtttggtttggtttggtttggtttggtttggtttgagacagggtttggctttgttgcccaggctggagtaccacggtgtgatctcagctcattgcaacctctgcctcctgggttcaagcaatcctcttaccccagcttcccaagtagctgggactacagtcatgtgccaccacactgtctaatttttggatattataaagacaacatgttgcccaggctggtctcaaactcctgggctcaagcaatcctcttaactcggcctcccaaagtgttgggattccaggtgtaaacagcatgcccagccaagtgatcgatgtctttagaggattttattttctctttttcagctgaattttcaaggtcttagccatgtaaggaaagttttccttttataatgtagtcccttctttagagtacatttgctctttgggaaggaaatattttgtgtgtttaattgtgatagtgttctctcgtttaaaaaagttgaaatcctaatactccagaacttagaacatgacgttatttggaaaagggttgcagatgtaattagttaagatgagttcacactggagttggataggcagttcttaatcaatatgactggtcttgttattagaagagaagagatacacagaaggaagatggccacatgaagacacaaggaggatgccatgtgatgatggagatagaaattggagtgatggatctacaagccaaggacccgaaggattgccagctgtcatcagaaactagaagacagccctggaatagattctctctcagaactctccaaaggaaccaaccttgctgacacctcagtttcagacttacagtctccagaggtgtgaaagattaaatttctgtggtctcacaccacctggtctgtgatactttgttagaggagccatagcaaactaatataggatctaatcttgcaacaatgactcctggctgccagcagtcccaggtgttcagtccgcacctttttttcagatcgttttttttctttttttatcgtaatctttttccaagggatccagtttcttttcttctagtctgtccccatccaggcactcttaactatgaataagattcaagctctaccctataaaaacacacatgtcattgaaaatcaaggattatttgagcaatagtgtccatattcttaaatattccatgacaaaagctacaatgccaggaacacacacattccttctgtgaagatactaaagaataaattattcaataatactcattaaagcctggtaaggtagaatttattcaggaccattgtgataggtataaggaccacttcaatgatattttgcagtgagaaagagagattgagctcaactgcaaataaaacatggcaagtgtgaattcatagcccacaaaggtcagggtaggggtcagtgaataaaaaattaaaggtaagaaggaattctgactaaactgacttatcaggattttttctgaagacaggctagggtaactaaatatcatctgggagatagtggaagttgaggaagctgatcacatatcgagggtgatcacacatcaaaggaagggggttattcttgataaactgacttagcaggattcttgctaaagctggattttataagaaagtgcacagatgggcctaggaaaacattcaggagactgactaaagtttggtcaagcagagaatcttagccaaagacacacttaacctcacagagctgtttaacagagacacatctctgataacagccataagacttacatgcatttttttttttttaaacagggtcttcctctgggagatcacagctcattgaagccctgattgcactggctcaagtgatccttccacctcggttataataataaccaatcctctcagaaatgtgagaatggttcctgctttagcctcccaagtagctgggactacaggtgtgtgccaccatgcctggctaattttttgatttttttgtagagatgaggtctcactgtgttgtccaggctgatctagaattcctgggcttcaagcaatcctcctgccttggtctcccaaagtactgggattagaggcatgagccaccacaactggccagacttacatatattttcaaaatattcatgcatataatgtgcaaaatattttttatttttgtatattttccctatatatgttaaaatattttcttatctttatgttgtctatcatgcctaggaaaaaaaaaatctcagaaatgtgagaattgttcctggtttaatctctgaggttttaactatttttttctttacttctaaatttagttttgaatcagcattcagtttgcttaagtaccccaaacattgggacagataaccttgtactttttctcccaaagtgatgtctaaacttgagagaatttttaaaatttatgagtgatttctcaaagaatttatctcatttgaaattacggagatcatgctgatcctataaaccattagatcccatggagaaatgttagctatagggctgcagtgatcagattgctctagatgcaacaaatcttttctttactagatcagtaacctaacaggttttgtttctttcctggctctgttttagccctgtctctttttctacctcatatcatccattctccagaagctaatattactcatcattttcatcacaagttcatgcactcaggcatggaaacccaataatatattctggtacctacatataacttacataataaaatgcaacattatatttaaaaaccagtcttctgtttcaaaaattgctgtgtgtatgttgaagaatcttgtttaccctgttaaagagtttgaattttgtcttgaaagtgctgaatacttattaaagggttttgtgatagaaaataaaaaatactatacttctagttttgaaagcctgaggctaatggtgacaagtaaagaacatgaattagagaggtgattctagctcctagatataaataatcatggtgactttcaaagtaacaaatgtactagacaaagttaaacaggtaagaaaggctttattcgagactactacaatagggagagagactaagttcaactaagtagaagcaaaaggtgagaaggttttgaggcacttggttgatccagtgaaaaagaagttatggtgaagattaatcaatgggatgttttgagcatattgagtcgttcctgagtttgcaaatgcttttccttgtgattaggccatctgtgttagcaaatcagcatacccacagaaattaagctactactctcctatagaggatggaggatagaagtgttattttcttcatgtttacatttcaaagagatggttcccagccctttgagacagacgttttctgggttgtaaactggaaagaggctatttacagccatttcaaaggaacagaaaaagagtatacaattggcaagttttctacagtaaatgctgtaagtaaagggggatcaggagcctaaaggtagaagaagcctgtttaaaatgtgtaaagctgaggaaaacattgattccatgttggttagtagtcattaatctttaatatattcttggaactgtgttatttaataatctcattaaatatttagaacaattttgtaaaaaaaagatatttatctccattttacagaaaaataaaatcttgtaagggtaaagtcacttgcacaaggttgtccaactggtaaagagcagtttatgactttttttgagacagggtcttgctctctcattcaggctggagtgcagtggtacattcatagctcgctgcaacctcgatctcctgagttcaagcaatcctcccgcttcagcctcttgagtagctgggactacaggtgcacaccaccatgcccagctaattttttttaaaaaatgttgtaaagctggaatctcactatgttgcctaggctggttgtgaactcctgggttcaagtgatccttctgcctcagcctcccaaagtgctgggattacagttgtgagccactatgcccaatcacggttgtgatttctatccaggttcatctgtccatctgaagctcatactctcatcactaaattaccatgtctagagacatggggactgctgtgtattttattgctggatgttagttgagaaaaataaattttgaggttgtggcagtgaggatgacaaggtaagaacatatttcagggctatttggtagttagagtagagaggtctttgtgattacctgtgtgtaccagatgaaagctacattaaatattagatttctggattttaaaaatgaattaaatgatggtaacttttgcaaagatggaaaagacaggatgagttgtctggaaaactaaaataagtttggttcgggaaaagtgaattcagctgtgataattaggtaaaaaaagaataagggatgaaaaagtagtatagattgtatagtcactgacatacaagttgaagccattggggtagaaggaactgctcaggaatagtgagtagtgagaagaggaaagaatagaaaagggtgttttggtcaggaacaagaaatgcttgaattagtcaggttagccatgatgagctgtattgtcaactatagcaactgccattggtttcggaaaattagagataatcacatttccaattgtgctaaaggcaaagtcttctaatatgaaggtgttttatcagactacaaagcacacctatatttactcatgacagcctaagattccttattccttatcttatttaatgggaatgaagacccaaggctcaagggaaaacgatttttatgcttagattcaatgaagagtgaacagttatctaaaaatgaaactggtaaaagaccgaagggaaactcagcaaggccaatctgtttagatttttcttggcctctctctgtacagcattttctccttctgggtgtgatgcaggaccctttccaggatgggagtcttatgacctaccatcgagcaagataggcagaggctttctgtaaggccaactcttacatagaaagtcagggaaagtttcaataatattttcatgtcttatggctgattttggagggaaattggttctaatttctatgatccaccttggggaagaagaattctcatttcaaaaacagcaaggattgaaagagacatgaaaatgttaataactttagaaatattaattttgctccttgtaattttctctagtacaatagcacaatagacaaaagaaaaataacacatggagatagctaccacataattgtgtaaaacaaaaaataattatatttagagacagatagatataattagtttttgtttagatataataaatataattattttttgttttttgtttgtgcgtacacacacacacacacacatatatgtattttccaagaataatttggtaaataatgactcatacatgttatagaatattatgtcatcaagaaatttttacacttgtaaaccaaaaataaaatcttaagcccctctaacagactgaagggacaccttctgggtccaaggagacctcagagaaaccagaaaaactgaattcccagccacagtgggagggaggctagatataccttattatacctgctcccttttggagtttaggcacaactgaccaaagttaacattaaaataaggatcataagactgacaaaacagactctgtggcaagaagatacaaaattccaacctgattctgatatagcatcacatgacagatagcatgccctcaaggaaatcaaaatattttaccccaaaatatacttctttgacacatttttaaatggtcctgcaaagccatcttttatgggggaaatttgtatctgtaaagaatctccattaatgcatgcagtcaggactttcctgggtctaggctagattaactgagtttgatgttttttaaggtcccaaaaaagacatatgagactttaaatgtctattctctctgaaagctgttacctggaggcttcatccaaaataacaagaaccttggtctctcaacccccacttaatgcttaactcaagcattttttttctactgaattcaagtctttcagcaaagcttaattctttcaaccaattgccaaaaagaaattctttgaatcctcctgtaacctgtaagccagccactgccccggcaaccaccacttcaaggcatcccacctctttaggctgagccaaagtatacctttcatgtattgatttatgatttttaactacagttcttatctccctaaaatgtataaaaccagcttgtaacctgaccgcctctgacactccttctcaggattttttgagactgttttatggaccatggtcactcatactggctcagaataaacctctttaaatattttatataatttgttttttcaacataatattatatattatttattcttcccacaaaaaatcaaaaggtgagtcactggattaatagaaaaacttagaataaatgcagcaagcaagaggtaggtattcagaatgtatgaaaatttttttttaaaaattttaagaagacaaatccaagagaaaatgagtagataaaattataggcaaattacatacacacacagaaacacatacaaagaaactttattggcaaatcaaacaaacaaaaaacctcaatctccttagtagcaaatgaaatagaaaaacaaagttttaccaaagatttggaagtatcaaattttggtgaaaatgtcagaaattaaaatggtcttagtgggaataaataaaattaaatcatttggaaagttatctgtatattctgtaagaaacgtcagttccaatagtattttatctgctgtaataacaatggcaaccaactctcagtggcctgaaataataatgtatgttgtattcatttcgcagtgccatgagaagtagaggggagttgggagctttgctccatgtgtcattcatcgggacaaggatcctttcatccagtagtcctaccatccctgagtcatccatgtaaccagctacatttggctagtagatgagaaatgaaaacgagaacatcaatgatttctttagatgttttagggtcctgctaggaagagaatctatcacttccatggagatgctattggtcacaagtaaatgacctgattccacataagggaagactatataatgtggcctagttttacactgaggagaaaaacaaaatgagttactgtgtacttctagagaaaatcacatgcatgtagcaaagacatataagaactctattacatcattgtttataatttaaaagaaaaaggaaaaaggaaaaagaactatgtccatgaacagaaggaatgaaaaatttgtgatttagtcactaatggaatattgtatacattttcaaataaactaaaaatgtataaaccaatttgtctttcaaaaacataaggcatgtaagaaaataatattacaaaagcataagtagagccttataacatttgtgtaaatcaaaaaagcacaattaaactctatgtgtatgtcctaaatggatgttcacaaagtataaaagtatggatgggaaaaatacacccagaaattgtgagatgggaagagaatgattcggaaagtttaaaaagaacattagtactgatattttacaattgataatgggaaattctattaattctgaccaaacatgagtctaaagatgatcatcaaaaaaactcagggctgggcgcggtggctcacgcctgtaatcccagcactttgggaggccgaggcaggtggatctcaaggtcaggagatcgagactagctaacacagtgaaaccgcatctctactaaaaatacaaaaaagaagccgggcgtggtggcaggcacctgtagtcccagctactggggaggctgaggcaggagaatggcgtgaacccgggaggcggagcttgcagtgagccgagatcgcgccaccgcactccagcctgggcgacagagcaagactccgtctcaaaaaaaaaaaaaaaaaaaaaaaaactcagtaggaaatatataaagaaactttgccaagcatcacacagataccaagataatgaggaacaatgagaccaagctctgggatgataaaaaataaaacagatgatgaaaactgagagaactgaggccactactcagagccacttttgcttctaaagctgagctgcacttctggcaacatgggaggtcaaagacacaaaagtcagaacccagagcctgccaagcgaggaaccctggtgaacacctactgcaatgagctgcacactagcagcgaggatgaactagatgaactcctcgtgaaatagagttgcacattaggttatctatatcatatcaactataaattcctacaattcggcagtctcattgctagcatacctggacacctggcagaaataaataccttcactggaggaagatgtaattatcagagagctcaaattacttctgcaaataaatatttcatagtaacgttcactaaaaattaaagtttctctgggcacatatggagacaagccattatgagcaagaaaaagatcgaaacaacagacaattcatactgagtcaatttatcaaaattatgagacagactttaacaatactaggtttatcttcttcaaggaaattagagccaaccctgaaaattttaggagagaaaaggagacagaaatatgtctttgaaaaagaactaaatataacttttagaactaaacagtgcacagtacaattaagagctcaagagatgggtgggttaaatcagaagttaaaaaacgatgatttctgagctaaatgaagccaaatacctgtttttttgtatggcatgtgagctaagaatggtttttacattttaaaatgtttacatcttaaatggttatatgagtatctaaacggtatcttttattttaccccttggcttgcaaaatctaaaataaatactacctggacccttaagacaaagtttgtcagttccagggttaaacaatgaattatctccaggttcatctaattaaggcttagaattttaaaagatattttataggcctaaagttcaaaagtaactctctgaaattaatataggaggaatgaaaaaatagagtatgaaggataaaggtcagaaatacaagcgacactcgaggcaggtggcggggactgtaaatgactggtaaatatttcactgaagttccagaagaataggagagaatagatattgaaaataattacagctgaaaacttaacacagctcacaaatgacagcaatccccaaatcaaacaaaagtccaacaaattcaaattcagcgaaataagaagaaatccacacctagacacgatgtagtagaacttcattaaaaactccataaaaccaaagagaaaagagaaaatttgcaatgttggaagagggaaaaattaataattttcccttcaatatatgtgtaaaaagtggcaattgactttgaaatgcaaaaaaggtaatgttatggactgaattgtgttcactgcccccaaatttatatgttgaaatcttgacctccaatatcactatattttgaaacagatcctttaaaaagacaattaaggttaaatgatgttataaaaatgaggccctaatgcaataggactggtgttcttataggaagagaaagtgacaccagagattcactccaccctggtggtaccacgtccacacagaagaaagacaataaaaggaaacagcaaaaaggtggccattgagaagccaggaagaaaggctttactagaaaccagccctgatgggttggacaacctttatcttgtatatctatcatccagaactgtgagaaaattaattctgttgttcaagctacccagtctatgacattttgtaatggcaatcctaggagactaatatagtgaccaaaaaagtagaaaaattagttaataaattgagaaaaaaaattccaggccatacatctatcaacagaaaaactatccatcaaaggtaaagacagaaatatagatttatttttcactaggagatctatactaaaggggattttaaatgataatacagcagagaaggtaagccaaccaacaacaacaaaaaatgctcccctctatagaaagagctgtggccaggatgcactctacaaatcagaggctgtattccccagccctcctccgtttagacaggatgaaatgacaaaacataaacaatatgaaatgtggacagaaattatgcatatcaagattgctaagtatatgaatgatttctgaaatctctatgtctcttctttggtgacttttaggctatattttgaagatgcaattctgacaatttgaaaggagtctggatccctgagtcaactgtaggagtcttgatttatatatcctgatgtttggagtctcccaggatagtcatgaaatcaggaggctgttcatatttacataaacaaaaaataaaattacgttctgtcgagaacagaatttgggattatttgccacatcattaaacctatgctgcctaattaagtttttgattgagcaaaaaaataataatttttaatggaagataaaaaatacaggaagaaaggttaacaatggaagtaataagaataaaaaagcagaatccaatagaaataaagacaagaaacaataaggacttttttttcaagatatttttaaaattgaaaaactctgaaaaagataatcaagaaaaaaagagagaaaacaccaattataaatgcgaagaaggaaaatgtgactatctcttttggatatttgaccctgcaaacctcatgttgaaatgtgatttcctatgtaggaggtggcacctaatgggaagtgtttgggtcatgggggtggttccttcatgaatggcttggtaacctccttacagtaatggatgagttcttgttcttttaattcctgacagaactggttgttgaaaagatgctgccacctccccacaaccttgcttccactctcactatgtgatctctgcacaccagctccccttctccttttaccatgaatggaagcagtgggaagcccttaccagaagctgagcagatactggtgccatgtttcttgtacagcctgcagaactataagccaaataaactgtattcaaaaaaataaattactcaatctcagttatttctttatagcaacagactaagacaatcactatagatctacagatgtaataagagaattgggttgtgaatttacaagtttcaaagaatacacaaaaaattactgggactaatattaataagaatttggcaagatggcaagatacaatgtcaatataaaaaataaattttataccgatgtatagcaataaataatcacaaaataaagtttaaaagtactacatacaacagcctaaaatacatcagatacccagaaataaatttagcaaaaaactgtgcaaattatctatactaaaaactatgtaaaggagctttgagaaattaaggaagacctaaccaatattgctgaacaagtttttaaaacaccttaaaaaatcaaggttttatagattagaagactcaaaaatgtttaaatgtctatatttctctatttcatctaaagaatcaatgcaatgtgaacaagaactcaattgggatatgttgtagaaattgaaaagctcagtctaaaatttgtttagaagtacaaaggacctataagagccaataaaatctttaactaaagaacaagaagaaggtttattactgctcaatttcaaaaattactataaagctataataactaacagtatatgatattgataaagatcaacaagtatatcaatcagaaaagagagtgcagaaatagacccaaacatacatgttcacttgatttttgaccaatgtgttctcttttaatttaaaagagaatgttgttagagcagctgatatctatatgtaagagtatgaactttaaactctaactcaccaaaagtaattcacgttatacataaaattaatatgatattatccagaatcctaaatgtgaaagctaaattttaagcatcttgaagaaaaaacatactgcaatatctatgacttttgtccaaaatttcttaaaaccaagaagacactctattttttaaacaaagataaattagattttatcaaaattaaaattttcttctgaccaaaactagttttaagaaagtaaagagtcatgtcacacacatggagaaaatagtagcaatacataatcctacatggggtttatttccataatatatgaagaaacaatttcaatttaatgttaaaaagaacatcaacccaataaatcaaatactttacaaacaaacataggaatgactcttcataatatgaaagttattagcttttagggtaacacaaattagaagcacagtagaatagtactatattcaccagaaaagctataataagcagactgacagtatcagatattggcaagaatacagagcctagggcacttttgtacatggctagtgggagcacaaaatgcacaatcaatttagaaaactatttggcagtttcaaagaaagttaaatactcattaccctgtgatccaaaaattccacttctatataatcaataaaaaccctaggagataggtcttaacactatagtatagagtaaaatcaatgggggaaaacctctgagatttatatgatataataaaaaaggaaaataacatatgaattggagtcacaaaggagagtagaaaaagaatggaaaagaagcaatattggcagagataatgaaagataattttccaagtctgataaaagttattcaaacacaaattcagtaagtactcttaacctataatagaatacattgaaacatttaccccatgcacatcattgtaaaattgtttcaaacaatccagtgagaatagtcttacttttaaacaaaccaaaatgaaatagaccgttgacttctcaacaggagacaaatagatgacatcctcagatttccaaaataaaataatttcaacctagatcctgtacctaaccaaatatctctcctaaaaaatggcttttgaacaaatctcaaggggatcgaatagtttgcaaataactacatggtcttctagaacaatgtttaacattctttaaagaaatgccaaaaagcaaagcactagtcaatgtaaaatttacaatgtttggtatctaatcaaacattactaattatacaagaagcaataaattttggcttacaatgtggaaaataatagaaataggatccagaaataaaagagagaaaataaaatttgcagacaataacattaaacatgttttcacaaatatgtgcaatatgcacaaagattaaaagaaaaacatgaatataattaaaaatggaagatataaaaaaacagaatttctagatattaaaaagtccaattattctcatcaataacatttttaatggatgaaaataaagcagattagagacaccagatgaaaataaaagtgtacttaaaaacataggaaagtaaatttttcaaaatgaagacacgacaaagaggactgcaaaataattaagtagggccttgggaatctataggagcataacaggcagtcttatgtttgtgactggaatcccagtacaagagggataggaatacagaaaagctacacatacaatgtaaaacgttacaacaatatatttccttttgaaaaaaatggcaaaaaaactttccaaatttgatagaaactgtaatgtaacagatctcagaagctcaacaaactccaatccaactagctacaagcacacatacactcagagcccacttcataacactgcatacacaagtggctgaacactaactacagagagaaaatctcaaaagaaaaaaaagacataatatgtacagacaaattaaaaaaaacttgaacagatttttgcatcacaaaaaagtcactgtttaacggaatgccatgtttaaagtgctgaaaagtcaaaaatatatacaaaccctatgaaaatgtccttcgagaaaggtaaagcaaagacctttttggacaacaaaaagctgaaagaattcatcacaagcatgtctgtattacaagaaatgttaaagggcattcatgaggaaaaagagaaataattccagtcagaaacttggatataaccccaaaaaagaaaaagacccagaaacggtaaataaatgagtaaatacatcagctatgttaaaattcctttaaaaagtaacttataatgtaaagcaaaaatcattataatgtgttagatgaattaaaacatgaaagaaaaataaatgataacagtagcacaaagaatatcagggtagcaaaatgaatatggtattgtaaggttcttacattgtagttttagaaggttatttgaagataaactgtgctaagtgcacatacatattttaaacactacgcatatattgagatacctaataagtcaacaaagaggataaaataagaccctaaaaataatttattaaaataaaccatgaaggaaagcaaaatgacatttaaaaagatacaataaagaaattttataatagatttaaactcaaaggtattaattttatatttaatgtaaatggtaaaaaaacactaattaaatgacagatattggcaatgtgactcaaacataaaaactaaccatattctatgtataagaaataggctttaaatatcaaggctcagataggataaaagtaaatggatggaagaatgagtaacatgcacatactaatcataagaaacttgaagttactatattactatcaaagtagattacagagcaagaatcatcatttcagggataaaaagagttatttcatcagacaaagggtcaagacataaaattgctaaatgcccattttaaaactcaaagaaaaaaagagctttaaaatacatgaggcaaaaacctgattgaactaaaaggagaaatagacaaatccacaattatagctgaagatttcaaccctcctttctcagtaattgatagaagtagtccgaaaaataatagagaaatagaagactctagcacattgatattattaagacatgcccaaaaaaacaaaatacacattcttttcagttgtatgtggaacattcaccaaggtaggccacaagctaagatctaaaattagtcttaattaatttcaaaaaaatttattttacaagggatattttctgaccactacagaattaaattagaagtaaattacagagatgtctgaaaaagccacaaataattggaaattaagcaaaacaccgctatataatcatggttcaaataaaaaatctcacatttgaactgaacaaaaatcaaagcataatgtatcaatatttgtgtaacttacagtaagtagttgagaaaatgtcatattggcaaaatgacaatagaacgatgttacagaagacagtctagttatatagactatatatagttgcttaatttttgaaaaagttgtcatggtaatccaatgagaaagagctaatacttttctagaagtagtattacaacatctgagtatgcatatgaaaacaaatgagctttatctcatggtatatacaacatttaattctaaatggatcaaaggtcaaaatgtaaaagcttctaaatatgaaaattctaaaacttcctaaagaaaatacacgagggaaatttctgtgactttggagtagacaaaagatttcttagggcacaaaaggcatgacacacgaaagaaaaatactgataaattgcacttcatcaaagttaaaacatctggtcttcaaaagactctttagaaaatgtccagtttacaataatttgttaagttttaatcttatgttttatatactcgtgtatatgtattatatatctaaaaactagagtttaataataagtaatttatattttaccttcaatagttatttaatattcatctgaagtgaaagttataaaaatattgagtgttaattctgtatctttgacatgtttatgtttatattattactaatctgtctgttattcttgaaattttccactattaaaatgtatataaatatcatgtagcaagataacaaattccatggaatattattcattaagaaacatagtatttaaagttatgtttatactgttattactagctgcataaaaaagatattaaaagatctaataattaaaatgctatcagtatatttttttcatgttggtacaaaactgggtatttttttccttgaaaagttgtgttaatttttttcaactgtagtgcatgttactagtatacattacatttgatattattcagaaaaataatctaatgaacatcataattatgatatttctactttattcaaggtagttgtccacctttaagagaaagagcccttttgcattttaaagatcgttgtcttagtgttcggaaatcatggcctttctctgaggcctagacagacaagaaactcctgtttgcataggaagactcaagctaaggcatcactctcatcagcagatttgtgtgatgataacagttgattaattctgtgtttgctggtggcacagtgtgggtgtcattaaactatttttatgcttcatgcatatggctttaaatcaacaattagtgatcctcatatttatatttgagtggcaggttgtcattttttttaatactattctcatattcttttttattaaagaagtgtcaactcataaaatataaaggtgaataaaatctacctaaaattttcattaacatattcgtgaaggattccagagttaaagaaaacatcagctaaaaagaaaggctataatgaaacaaaaataaggatgcccatacattcaaatatgaatatattaattactacaaagcacagtttttggttacaaaatgatacctaaaaacttgtctaagaggaaaatttcatctaacatgatacaagatttttcacataccagctattgagcagccaccgtggcaggagttgtgcagggtatgtggacattcagaaagggaagagacatgggccttccctcagaacacaccgactggtacacctccattctttgtagtctgtgatgggctcccactgaaaatatcaaatgcaagatcaagtaggttgtgtctcttttccaaaatgaaattagactcagcccaacttagcttcaggagcacactgatgtgagctgtgtttagttttctggactcaaatgaaatccaactcagcccagcttagctttgggagcacactgatgtgagctgtgtttagctttctgagctcatacagacagaaccccaatgtcatgtgtctttgcttgaaatctgcaggctctctgagcaacaaccagggctgacacctgttaccaaaaccagtttattgtattcattgaaaactcctgtaatctttgagacaatggggctctctaaaaagaagaagagtggtaaaggatgaaatcagagtcctttgcattaagcaattaattaaaaataaacaaggacattgcccttctgggaagatagagtagacatacctttccctgttccttccactaaataacaaacaaaacaaacataaagaggcctcagaaatatgaagagaggaggcagactggctagggtagagccttggaaccctttagctcacaatatgatggtgagctacctgggcatttttcctttctttctttctttctttctttcttcttcttcttgttttttttgtttgtttgtttgtttgtttgtttgtttttgttgttgttgttgttttacagacagagtctggctctgtcacccaggctggagtacagtggtaagatcacagttcactgcagcctcaacctcctgggctcaggcaattgtcctgcctcagctccctgagtagctaggattacaggcatgtgccaccatgcctggctaatatttttattttggggaagtgccggggtgtcactatgttgcacaggctggtctcaaacccctgagttcaaggaatccttctgtctcaacctaccagggttctgggattataagtgtgagccatcatgcttgacctgaggtttccttcttgccttacatattccagacttggagctaaagaagccagcaaccagaatatgccaacaggttcaatctaataagtaaaagaaaatgaaaaaaaaaaaaaagaaaaagaaaacaaaaaagaaaaagcctgccttctgcagcttgcaagtgcagtgtaacaagaaagaaaactttgaggcaataaccactctactccaaccaaatactgtggaaaaaattgtggccccactccaccttcaccagcaaagtccaagttgggagcctagacttctgccctctggaaattgtaaagaggggccactatccctcctccctcaccacagtggtatcagacaaagatagtgagagagtactttcatgcctaatgagtggtaatgagccaccagtccccactgacctgtcattggtgaccacatgggaaacctagacttcaaccaccacccccagcactcacgaggtgccccttaacttctggaatggggttaaagaaggccaaatggagagccagggcttttgctatgatcccgctataagacaaagccatccgttacacctccaccatacctcatctcagaaggaggccaagataggaccattagcaaggcacctgtagccagggatgtatcaatggagaactagagggaatctggcattcccactcccacacagcttcaataaggttcccctttgtgagtggcaacagaagaaaatggggaacctagacttctcttcccacctggtagtaataaggtgcgacccttcatttttcaatggagcagttttacaggtagttgcctaaaacaggtttaaataaaacccagagtcttctaacatgagatcccaattttcagatttcaaaaaacaaaaacaacaacaacaacactcatcatatcataccaataaccagcaagctctcaaactggacttaaaagaaaacacaatcagtaaattctaacactgagataatacaaaactgcttcaatgagcaattacaaatacataattgaaataattttaaaagagagagtctcagcaaagaaatagaagctataaagaggaaacaaatgaaaattttataagtaaaaatggataaaattaaaagaaaaaatttaaaaaattataattagaaatgaagactattattacctttctcaaaaatcaatagaacaactagtaggaaattgctaacaatataaaatagctcaattccaccaaccaccaccatctaaatatcatttgtagatcactacaccaacaatagcaggatacgcattattctcaatttcccatataacatgtactaagatagaccacatcctaaaacatcataaaggtcataaaataaacttcaacaaatttaaaataattgaaattatgcagagtataatctctaatgacaacagagtcaaactagaaatcagcaacaacaacaaacaaaaactgtgcaaacacttggaaactaaacagcatactttttaataatccatgggttaatgcagaaatattaagagaaaacaaaaaaatacatagaacttaatgacaattaaaatgcaaaatatcaaaaattgtaggacacagctaaaacagtgctgagagggaaacttagagtactaaatgcattctttcaaaaagaggaagagtctcaaattaataatctaagctctcatgtcaagaagttagcatcagaatagaataaaaccaaatcaaaaagaagaaaatagtaaacatagaaatagaaataacataaatcaataatagaaaaactagagaaaatcaaacaagggactagttcatttcaataaatcaatatgtccaactggttttctaacaaaggtgttaaatcaattcaatggaagaaataaaccttttcaataagttggtgcttgaccaatttggtattcatagggggaaaaatcaatcttgaagaaaatcttacatattacaccaaattaattcaaaatgtattacaaactttaatggaaaatgtaaaactatctacattttaggaaaaacacagcataggagaaaatccttgggatctaggaggaggcaaaaattcagttttgatactgaaagcgtcacccacaaaaaaaaaaattgataatttgggcctcagaaacttagaaatagtttacctgaaaaagatccatattagaggataaaaagacaaactaaagactgaaagagaatgttatcaaatagcgtatacaaaaaaatatctggagcatgtaaagaactctcaaattaaaatagtaaaaaaagaaagccagttagaaaatggaaaaaaattcattacagacattccatgaaagatacagaaatgacaaataagcacatgcaaaaatattcaccattattagcaattaagaaaatgctcattaaaaccacaatgagttatcactcaatagttatcagaatggctaacataataaataacaacaccaaatgttggtgaggatgtgaaaaattgggtcactcatacattgctggtgagaatgaaaaacagtacagccattgtgaaaaacagttcagcagtctcttaaactaaacatgcaactaccatatgacccagcaattgcactccttgacatttattccagagaaatgaaaactttgtttatgcaaaaactgtatgttaatgtttatagcaattgtattcataacagcccccaaatggaaagaacccagatatccttcagagagtgaatgagtaaactggataaatttccagggaattatgctcagctaaaaaaatcaaaaccacaaaaacaaataagaaaattatatacagtatgagtccacttatatagcattatcaaaatgacaatattatactgtcatggagaacagatgagttgttgccagagttaacgaggagtgaaaggtgagcagtaagtggctgaggctatacaagggaagcataaggtatccttgcagtaacagaaatattttgcatcttgactacctatttcagtatcttgattatgatattgtacagtttgtacatccctaatctaaaaatttgaaatccaaaatgctccaacaaatttggagcaacaaatgctccaaaaatattcaaaacgtgttcattgctgacaagatatcacaagtaggaatttctgtacctgacttcatgtgacaggtcacagtcaaaatgcgggtgcacaacataccatttattcagtgtccccaagaaaaaatgcccttccacccccacctcagctgtgatatatattttctgcacatacccagactccccacctcaggcagggccaggggggtaatgaaatgacatgtgtgtaggccagacacaccaatggtatgttcctcacaatgccccacatggggccaagacctatatctagtactcaccatgtgtcgttgcttattctctgctccgtggtgtaaaaattttgttgaaagtgtcaaaaaggctcatagatacccctgtagctaccagtaatgaagaaaaagaaagaatttttgtttatctaaagcacagaaagtcaaactgttggagaaactgggcagcgatgtaagtgtgaaacatcttacagaaaagtatggtgttggaatgatcgtcatatatgacttgaagaaacagaagaataaacttagactttctgtgctaaaagtgatgacgagcagacactgcacaaagctaaaagtgaagattttgattgtgtattgaaagtgtggatgcattagtgtttcagtaaacacatgcctcttaatggtgggttgatcatgacataaactaagattggctgggcgtggtggtggctcacgcctgcaatcccagcactttgggaggccaaggcgggcagatcacttgaggtcaggagtttgagaccagcctggccaacatggtgaaaccctgtctctactaaaaatacaaaaattagccaggcatgatggcctgcacctgcaatcccagctacttgggaggctgaggcatgagaatcgcttgaacatggaaggcggtggttgcagtaagccaagatggtgccactacactccagcctgggtgacagtgtgagactgtatctcaaaacaaaacaaaacaaacaaacagaccaaaaacccgaagatctattatgatgaactgaaaattaaagagaactgtgaacattaagcatgctgatcacaaaaatttaagaaaagacacagcattctttttttaatttgtagcgataaactatttgttgatcacgaagcagtggcgagtttgccaaggtcatcggcgagtttgccaaggtcattgttgatgaaaatgtgacacaagagtaagtctataatattgatgaaacagtgttcttttggtattattgcccccagaaagccactgtctctagctgatgaggcagtccctacaagaattaaggatgccaataacagaataacggctaggctgtgctaatgcagcaggcagtcacaagtgttatctctctgtgttagccaaaaatgtgcatcctcactgttttcaaggagtgcatttcttatcagtttattactatgctaagaaaaaggcatggataacaaaggatgtctcttctgattggcttcacaaacattttgtaccaagtgacttgtgttcattgcagagaagctgaactagatgatgagtacaagattttgttattccttgacaactgttctgctcatcattcagtgaaaattctcatcaaaaataatgtttatgccatgtactttccctcaaatgtggctttattaatctagctatgtgaccaggctatctttagctcaatgaagagtaaatgatttaaaaaacccactttcttgaacagcatgctagcagcagtgaacagaggcctaggcgtggaagacttataaaagaagtttagcatgaagaatgccatatatgctgttgccaacgcttgaaacacagtgactagagacacatacattgtctataacctctggcctgtgactatgatcagtgatgttgatgtacaagatggtgactttgaagaatttcatatgtcaattgagaaaaaataatgcctgacctccttacatatgtaaaaaatacatgttcagagtccttcagtaagtggaaaagagtagctatttcagaggtttttaacatttacaatgacactctagtggttcatttatggaccaatgctgaaatagctaaaatgattctaaatcaagaacatcgtgatacttatgatgagaatgatgacattaacgcagcagaaaaagtgcctgtaggtgacatggtgaaatgtacaatgggcttactgaaggactagaagagcatgcattcagagcagaacaagaaatcatgttggtttataaaatcaaagaaagacttttaagacaaaaaaaaatcttttttttcttaaaaaagtgggcaggtcacaaatattaaaaaaaattgttaactaggcagatgactctaaatatttttaaaagccacccagtaggccagccgtagtggcttatgcctgtaatcctagcactttgggaagctaaggtgggcagatcatttgaggtcaggatttcgagaccagcctgaccaacatggtgaaaccccgtctctactaaaaatacaaataaattagccaggcatggtggcacatgcctgtagtcctagctactcaggaggctgaggtaggagaattgcttgaacccaggaggcagaggttgcagtgagccgagatcacactactgcattccagcctgggcaacagcgagactccatctcaaaaaaaaaaaaagccatccagtagaacgcctcatcacccctagagaactcactttctggtcccttaactgcttcttatctaagaaaaatagaacagtttacagtcttttaatcatgacacagcattttaggtggatactgaaaacctgccactgtttgttgttactgttgtttaacagcagatacaggtattctggaaatgctactgtgctgcttagttattctgaacacattattttttcattgtattaatggcatgtcactttttaaccttactactaagtatttatgtgtaaataagtgtaaggaaatgattgtttattggtagcatataaattcagagtcaggaatgatggtgatgccaaacaaccacagattgtcaagatgggtggctgagatagtgacacttttgttttctgatgattcagtgtacataaagtttgtttcaagcacacaattattaaaatattgtataaaattgccttaaaactatgtgtataaaatgtatatgaaacattaattttgtgtttagacttgggtcccctccccatgatatctcattatgtaggtgtaaatattctcaaatcaaaaatttataaaatccaaaacactctggcctcaagcttttttgttttttttttttgaggtggagtcacccaggctggagtgcagtggtgcaatctcagctcacagcaacctctgcctcccgggttcaagtgattttcctgcctcagcctcccgagtagatgggactacagatgtgcaccaccacacgtgactaatttttgtatttttggtaaagatggggttttaccatgttggccaagcttgtctcgaactcctgacctcaagtgattcacccacctcaggctcccaaagtgctgggattacaggcatgagccaccacacccagccttctggtcccaggcatttggataagagatactgaacctgtactacagttttggaagactttactattgaagaaaaccaagtaaagtatatgttggaattttgtacattattccttacaacagaataatctacacttgtttaaaaataaaacatttaattaaataaataagcagaggattgcagacataacaaattagaagatagtgtgtagtgtgaaagattaaccatataggtaaagctttattgaactgaggaatctaatgaaacttaattgacaaggtttagagaaggcatcacagaagacttgcttagaactagatctgaagaagtaataggatcctgaaaagcagaggttaatggccaaatgaaaccaaaaacagcatcagaggaacatgaggacaggtggagcaattaaaaacaaggatttactaaggatacagtagaggcagtatggtgtggagggaggaatggcaaaggcatttctgtgaggtagcatccacagagttagaagagacacaaaactggaaatatcacaggtttagaagaatatgttcagcgttgaaaggtatatcagaactctgagttgtgaatgcttttagaataaggacatttcttaatcaatattgtgtcaccaaatcacagtctaatatctggtgcataacaaacgattcattaaatgctgttgctgatttcactgaaaacaattttagtgtagtgacgggggaagtagacagatttcagtgtgtcgaagagtaaaagagaagtagaaaataaacgattcttcttaaaaggcttagttctgaaggtaagaggcaaaaaaaaaaaaaaaagaggcaaggacacattttatattacattctttttgtcattttaagatgtgagaaacttgtatatacatctttgttagaaaaggagattgaaaacccaggagaaaagataaaggtacatatggaaatgaaccttacggaggtaaatggatacagatgtttgtaggtggagtggtaggagtgcacgccagatggcctctatttttcaattaagtgggaggtggttcgtgctctgctaagagagaggagaaagaatgggggccagaagtcagtctcgagtttggaatagatggaaaatgggaatggaaactgagctatcaacataagcccattcctcttaaatatttgtctccatgtgggcagcacctttattcattgaagtgttcttcctcactttgaagctgatattttcaaccccaaattatgcacttctcttctcagccaggctttctgctaagaataactaaaaactatgtataaatgtctctatatcccaaatcatatttaatcagcatagtatatttttgaacttatatacacatgttaattttttagagacatttcaacattatgctttcttcaaggacaaaatgaatgaaaaagcctagagatgtgttttctcaccttttgcatgcactctattgaacacagaatatcttataagtcataggagagtgttacctatttttagacaagtgcttttgtaaatttcatacacaatggtagaagaatattttaaaccctaattgaactaaaccatctcattatctggctctactgaccaaagcgtgttgccatggtgataagggaatcaagtcagcaggtcctactgtgagaattttccactccagatgcttcatcagttccatcttgctcatctccagacacattgtgatcaatttaatggcagagaaacaggctctacaaagggggagaaaaggagtgtttttagcaaaccttatgccaaaatatgttgacatataatttacaaaataagcactttctaaatacaataacactttaggtttttcaagaacaaatgaaaacctttaaagatatatgtattaatttaacagtttatgaatttttatacatatccaggtaaaaatcaaagctcaagcaataaaatgtttcgttgtctgcataactggtcttaaatataattaaagcttatttacataaaaggtttggagcccaaataagacttacagattggcggaattcaggttttggctaaggataggtaatttctatactgaaagataaaatctaagagcaaaaattcaaagtagtttcaatttatgtctcaaaatggaacttggaactataaagcaatgttttagactataaaaaatgttaaaattttgttacttctacatgtttgctattattgctgtttgcttagccgaagtggcattacaaagtctcaaattctaaggcattatgaaattgtgtttaagagaagaaacaagagacagaactagaaaaactgcctccccgctccccgttttttgtcacttgtggtatgggaggaaaaccacatggaataaaatgcttgtgacaggatttaagtaaaaaaattctggataaaaatggcaagaggctaaccaaaccaatatgtgtctttcaaatttcttattaaagtgttcatgaaggtatactaaaacatgatgcaaagatgtaccatattctaaaccaaaaataacacaaaacaatatcccagaatctggaattaatttatacttgctggattttatctgttatacagttaggtgtcttctctgttttattttgctagtctgtgccccaagtctaggatattccttggcacttatcaggtgctcaaaaacatttgttttcctcattgttaactgtacagtttttggatattgattgagaagaactttttagactacataccatgtttggtcctttggaaaataacatcataatgtgacagtgggtagctagtgagacacaaacagggcaggagacggcccccacaccccaccaggaaagtcaggcgaccatcaggtgatgatcaggcagttgtcacactgtctctctaaaataattggtcacaccagtgccagggaaagtagtttccctataaataggaaacacctgaaactgatgaccagcagtttcctgtaagatcacaggagctgggtaagtgggtgcacacatatgcactaagaagagaaatggcagaatttaactcatatatgaccttccaggggcattctgtcagaaaagagaaaaacacctcaggtgagcatgcgtacaactccagtaaacacactgcacatgcatcccgcccaagcactagtggccaccaggcatgcggacagcccaccccaacaaaagaatcaagggaaaagggatgcaagaccccagaagtatgccagcatataaagccccaagtcaaaaggtcaaacctggcacttgtccttcaagtcacccacctgaccctctcccaagtgtactttccttcctcttgttcttgctctaaagctttttaataaactttcactcctgctctaaaacttgcctctatctcttcttctgccttattacgcccctcagttgaattctttcttctgaggaggcaagaagtgaggttgctgcagacctgtatggattccctgccgctaacaataagcttccaaagaaagtaggtaaacagaatgcctcatctcagtgtacacagggacacactaaggaaaacctactatgtaagtgccatcgtctgggccagtcagaacgagaatcatctccctatttctttttcatattttttctcatgtatactcgtcttcacaactgccaaggttccacacagcaggaacaagagagagatgtaaggtagtaggttgcaacttggcaaacagaagcagagtttgaggtaaaatttaggagcaatcctttctgggttatttagattttcatatcctgcatgacacaaaggggattataaacatttgcttctttggattactcatagaattcgactatcagagcaaagtaggtgcaactaaaattaattcaacatacaaacacacaaaaaataatatccagtgacatgcaaactaaaatggggtgaaatacccattacacgtcacccaaagacctagctctaagtaggaaaatgtgacagcatatatgtgtgcagtaagcactgaaggtagggtctctttttaaatgctttctaaaggccaacatcagaattaaaaagcatgattgaaacagaatagtgccaggtatggttgctcatgcctgtaatcccagcattttgggaggctgaggcaggagaatcgcttgagcccaggagttccatacaagcctgagcaccagagtgagaccctgtctctaaaaagaaaaaaaaaaaaggatgaatactgaccaaaacaatgctaaatggaactggtgaaatactactttaaaacaagaaatgattcacatacaaaaaaataaaattgaaaataatttttctaaaagaaaatgtatatgtgtatacgtgtatatacacacatataatgtcttatcaatgaaatgtattattttcatccaattactttcaccctctaaacataagtttatgagtttattcaataataattacaatgtaacatgcactataaaatttaaactcccttaggtgaggagcgtctctgcccagctgccccgtctgggaagtgaggagcgcctctgcctggccgccccgtctgggaggtgaggagcgcctctgcccagctgccccgtctgggatgtgaggagcacctctgcctggccgctgtgcaaccttccaagtgtgaagtgacagcctttctgcaggtgtacccaacagctccgaagagacagcaaccatcgagaacgggccatgatgaggatggtggttttgttgaaaggaaaaggggaaattgtggggaaaagaaagagagatcagattgttactgtgtctgtgtagaaagaagtagacataggagactccattttgctctgtactaagaaaaattcttctgccttgggatgctgttaatctataaccttacccccaaccccgtgctctgaaacatgtgctgtgtcaactcagggttaaatggattaagggcagtgcaagatgtgctttgttaaacagatgcttgaaggcagcatgctagttaagggtcatcaccactccctaatctcaagtacccagggacacaaacactgcggaaggccacagggacctctccctaggaaaactagagatctttgttcacgtgtttatctgctggccttctctccactattatcctatgaccctgccatatccccctctccaagaaacacccaagaatgatcaataaatactaaaaaaaaaaaaaaaaaaaaaaaaattaaactcccttaaaatatcattttcgtaaaaatgatattataaatgtccaaagcactggttctttgatcattgataaaactcatcatcaccgtctaattatcaatgctatttcatggaaattttggcaactttatatagctttttaccatcttttagatgtattttcctcatttcaacaaagcacccttagcaaaatgtggcatatcatgaacaaagagaaggaaagatctcagtcaaaaattgaaggtggtagaggcatttttatcactgatctattttagcacctactggcctgtgtccccgagaggtacatctttatcccctcagtccaaccaattttccattccttttctctgtgacagcaactgtggcatgttctttcctttcttcctttctcacttcattgtctcaccgagaaagccaagaggaatacctgtttgccgtttggattaggaaacattaatataactcacgtaaggaagaataaaatgttaattttcttatctccttactttctccttgttttcttatctccttacttttctatctggaatcacgttttccccccatctttcaactcacaccctctccaaattgttatatgtaaatttattatcaacctatccattcttattttctaattttctctatctcctcataaatctccataatttgggttttctattaggcttgtttacattcttatttggatgactattttaacacatcaggtaaccttttccaaaaatttctgtaacagtaagacaatttcctagattttcctaggatatgaggtaaaattatctcgttttttttttttttaagacagagtttcactcttgttgctcaggctggagtgcaatgtcatgatttcggctcactgcatcccctgcctcccgggttcaagcaattctcctgcctcagcctcctgtgtagctgggatttcaaatgccccaccccatgtctggctaattttttgtatttttagtagagacggggtttcaccatgttggccaggctggtcttgaactcctgacctcaggtgatccacccacctcggcctcacaaagtgttctaaaaaatttatttttctgtctccactctgctaagcatcaaaaatattcctacaaaaattcagagcaatagctcagttataaaacctaactttttaaactttttcttattcctttcctctgaacccaaaaatctattaggctaaatagttcttacaactgatactaaccttgcagtaaataaaattttgaaaacatttctggaattagttttatgagacataaaattcaggactaagtactccttcagaatcacccaggctagtcaatctttctgatttgggaaagtaagctcccttctgatctcatgatttacagtaataactttgtggtaagagccaacaaatacttaattagcctacttgtcataaatgtgctctgtggacaattaagcatgtcaagtttatacagtaggggtgacttacagagatagaaaatgtgactttaaagattgtgaatccatgggggaattctttatgagatggcttactgcattagaaaaatgcaaacaaatcttgctaacagcccaataaaatctatggggccatatttctgacttgcagtgaaaatctttaattctaaaatttcttgtctcctatgcacacccttgtttcattcttcatattagcaaactttcccctacaccagagtgctggcttgtgccaggcacagctttttcaaggctgcctccctgctgatttgtctcccctgacaagatccagttggcttcataaaatgctgtctgcatagttttgaacttgatcgatttctttgagacattagctcacataagaaatatgtcttcccagatgctgaggcacatgctttctctttctggatccctgtgaggcatgaactctggcgacccagcttggcaattggaatttctgaagcaatgtatcatcagctgtcttcaaatcatggcagcatccaaatgctcaagcatttgcctactaaagtaagagaaatgtccttagacccattgatacaccctgacatcactcaccggcagtgccttttctgtgaggtcagagagaacagtcagtgtcccaggctgagcctctggttgtcacagaaccaggcataatcatagcaggtttctttcatcaccctcagccagatgttagcctcaggatctccattgtttactaaatgtagtatcttcttagtattagtaaaagaaaactattttttagagcagatattatatattaggcacaggatataagaaatgtgcttatgttaatacattaatatcaatgactttttgttttagtctgtttttgtattgttaaaaagggagacctgaggctgagtaatttacaaagaaagcaggttcatttagctcacagctctataggctgtataggaatcatggtgccagaatctgcttctggagagggactcaggctgcttccactcatggcagatggtaaaggagagccagcatgtacagagatcacctggtgggaaaagaggcgagagaaagctgagaaggtgtcagactcttttcaacaaccagttcttgtgggaactaagggtgggaactcactcactttcatgagaataataccaagacattcttgagggatctgctcccatgatccaaacaccaccccccagcccccacctcccacaatgaggatcaaattttaacctaagacttggtggggtcaagcaaatgatattcaaaccatagcacatttgcaagaaaatatgattacgattttacagatagaaaaaccagagctcggtggtattaatagctgaatcaaccacaccactccccattttgaatatagtttcatctgttgttaccatttttaaggctccaccatcctctccaacattccctggaagcttcaaaatcccattaacaatttttatttcaacctcaacccctataattatcctgagacatttcaatgcttagaattacccctcatctcaatcattacatccccttaaactccttaaatctagcaaactttatattcgctccttggaaattcactaactatattggcatctggatgtgctccactttagaatttcacactactgttttaattttggccatgacctttcatcctgacctttcatcctgctcattctcttttccttcactcacatccatgtgcacacaactgcatcatgccctccagcacctcaactcttctattgctgtctagtcttccagatggataaatcatctcactgcttcagccttctctccagagacctacctctgtaactgccctttgttgatctctgtcaacttctttatgcattaacacctttgctgttcctgctacaaaaccctggccctgtttaccggacgtttgttcctactcaccacttctggagaacagagacatcctagtgaaagtgactaaactgaccagccaggctccaatacaaacacgtggtttccaagtcttttgaaactcaaaattagattatctggttctttattttgtaaatctatgttctctctcaatatatgcttccaattggcataagcatgctcctgtttcccccttaataaaatacccacaaaaatattggaattctataattttttctagtccctgttatttgtctcctttgctttgcatccaaatttctcaactgttcatacatatttgatgtacttatatgtattctggatttctctcccactcttttgttaaaacaacttctgattatgtcacctgttgttgaatccagcaggtgtttttaatcttcatcttatggcatctatggcattttgtaccatgaactcctttagtcacccatgaaacagcactctactgaatgtctttctagctttcagtcctttcccttgcctcctttttaggctcattctattcctcactgttattaagtgttggagttcctcaatataaggccatattgtaactatttactttctcctagcaagcacatcaatacctatcttttcaatttcccttgtatacaactgactggcaaataaaacctctatacagatctgctcaataaaactatttgcaatgttgaaatgttctataatctttgccacctaatatggtacatatattgaataaacctttccatttctccagctgctcaagataatcaccttagcatacattcaagatcctgtggggtcatgtctcattatgctccatcttcctttagcagcttatgctaacttttttttctggaaacatcataaccaattttccccccattgaaaacctttggacacttccttgaagtaacctttctcaactcctggtatcaattttctcaattatcttctggaaatgtatattaatttgtgtgattctttgattaatatctgactctttaaaataagagcagaggcctttgctttttgtagatgttttgttcaccattttaatcccagggcctagttaagttgctggaatataacagatgtacattaaatatgtgttgaaatagcattttcctaagttctggatttgtagatagctccaacttcttcttagatatttttatatgttccaaagccatcttaaaatgattttactactctgccccatacctcttactattactacacacacacacacacacacaaacaaccctatacagacatacttaagatatatgacaacatacttaagatatatgacacattcggttccaggccagagcaataaaatgaatatgcaataaagctaatcccacaactttttttgtttcccaatgcataagaaagttatgttttagggggctttaagatggctggctagaggcatctggcactcacctcccccacaaaacaaaccccaaaatagtaagtaggtaatcacacttcacatagatcacctaaggcagaacagtggaattcagcagagaagtgacaggaaacactaaggcatagaaggagagagaagcaaggcagccagctgggccaggattgggtgggagactggagaggctccttgatgcaaggaaagggtgagtaaaagattcacagtgatccaaattcccaccacagactcatgcctggagtttgggcgatggcattgctccagagagggagctcatgctagggggagctcatgctaggtcccacatccccctaccaaacccaagcagctgtatagcgccatcctgacagtccagaccctacaacattgcatcttgccctggggtctaacagcccctgcacctctatatccctgaatccccactgatataccctccacatccacctggaggactacagtggtgccattgcccattggacccagcagtgtggcagggacctcaacactgcagcccacacaatgtcctactgggaacaggtggtgcagcacaccagggaggctgctccagacaaagggagtctaagtgtgcactccccagagcctgaaaaccacttgcctggggctgttgccactgatggcaaccctgtctcccaccagcagcagagccactgcactcttgcacatatcctgagagtcctgagaagaggctctccccgcccattactgctgctgttgctgccacctgaacacaccactgggccctggaaatagccttgtcctgcccaccacaacccggtgggattgcatcagcaaggcgagtgagaataggcccacccagcctggtacaatcccctcagcaccacccgctaggggcttgagattgcccttctctgtcaatggccttgggcatgcatacagaacattagagggcccaacaacagtctcagaaaactagctgctggtgcccaaacacatggtctgaaagtctggggattggcttggcccatcctccaccactggtatctgttcactccttccaaaagattgaggatgggcacccactctgccgccaccacaactgcgggcacctacctgcacaggccacctgacagcctgggaactggcctgcccagccagttgcagccactcttaacaccagcacaggctacatgggagcctgagtgttgccctgctactgctacggccatcacacatgtaccacacatgctgcctaggggcctgaagatccacccaccagtccagcttactgatgccattgctggcacctgagcaagccacatacaggcccaagaattggccttcctggacccattaactccagtaactccacacgccacctgggggcccaaagataggcacacttcacacaccactgccaccaatggagctgaagaattggcccacttggcatcctcatccccagcacccagcctcaccacatcctccactgacaactgtagttcaaaccactgaggaaatcacagacatcaatgatactgtttgcagctgaagaaatcattaggggattacaccatagcatgcacccagaatcaaggccaaagggccatactcaaccaacaccataatatatctatagagaaaagtcttctcctattaaagccaatccaaaaaatacaaagaaggaattgttacatcagatacacagatatcaacataaggacacaagaaaaataaaaaaacaaggaaatatgacacctttaaaagaacaataattctccagcaacagattgcaatgaaaaagaaattatgaaatgtccgaaaaagaattaaaaacatttatattaaagaagcacaggcagatgtaagagaacacagataagcattacaaatagatctgaaaaacaattcagaatataatgagaaattcaccaaaaagatagatattacaaagaaaaaaaacaaacagaaattctggaactgaataattcaatgaataaaatataaaatacagttgaaagcttcaacaatacagtagactaagtagaaaaaagaatttcagaacttgaaaacagatattttgaaataaccccatcagaaaaaagcaataaaaagaataaaatcaatgaataaagactgaatgtcatataagagaccacaaagcaatgaaatatttaaatgctgggtgttccagaaggagaaaagaatggcaaaacttaaaaatccatttaatggaataatattgcatgttttcactcatatgtgggagctaagatagttgatttcatggaggcagagtatagaatgatagttaccagaagctggaaaggggaagtatatatggggaagcagaggagtgaggttggttaattggcacaaacatgcagttagagagaaggaataaattttactattcaacagcagagaagaatgactatagatagaaacaatatattgtttatttcaaaatagctagaagagagcacttgaaatgtttccaacacatagaaataataaatgctcaaggtaatgaataccctaaataccctgacttgatcaatacacaattagtgcatgcaatgaaatatcacatgcaacttaaaaatattaggtatacatttaaaatataatgtatacatttaaaattttaaaatatatgaaagttatgtttacgttattctgtagtctactaagtgtg

SEQ ID NO: 425 - DNA, 129166 bp, Homo sapiens
agatataccacatgacattatggtatacatatagatagtaaattggttactattgaaacaaagtaacatatttatcatctgacatagttcccattttttttttgtttctgtgtcaagaacagttaaatccactcatttagcatgaatctcaaatacagtataattttattacccatagtcctcatgcagtacattagacctggggacttgttcatcctacatatctgttactttgtatcttctgacttccatctccccatttccttcaaacctccttccatctccaccccggtaatcactgttttgttctctatctctgcatatttgaattttttttaaagattccacatataaatgagatcatacaatatttttctttctgtgtccagcttatttactatttcacttagtataatgtcatccaggcttatctatgatgtggcaaatggtaaggtctcattctttatatatattagagtttcagtttctttatccattaattcctcaacagacatttaggctatttccacatcttggctattgtgaataatgctgcaatgaatacaggagtccagttatctttatgatgtgggaggatttaatttcctttcggtataaacccagaagaaggattgctgggtcatatggtggttctgtttttgatttctttaggcacttccatactgttttccatcatggctgtaatttgatatgttgtgttttcatcatcattcagttttaaactaccaatttcccatttcgatcttttttttacccatgcattatttagaagcacaattcagagacagaattaaatgcaaatgggggaataaacacccacagtagagcttgctctggagcccagctcagtgtggacagtcaggcagaaaatcaataggaaagagtcgagtgcggcaggtcacagtggcaagggacactgataacattatttccagaaagaggatttcaccatgagtgagaaaatataaaacaggtcagagtcctcataagttggagtactgattactgaataatttaaataaacagacttgaaaatgttcagaaccaaagaggtaatcctggaagaccctgttctacggaagaggtggtagctagaaagagagaagcatctctgggtgggttggtggtaaacgaagaaggaagcaggtagagggaattcacaattctatcaaaaagaaagagaactgatgaatcagaagacattttaactttcttcattcatgattttatctccaacaaaattctctctgtaccaagagagaaggatgctcttgaactagaaaacctagtagcctctctaaaagtttttaatcttcccatctagagggggatcagttgctgatctagaaaaatagaagacattttaaaaggaaagaatggcagaaaaaaggcagaaagtcatacaagcataaatagaaaatagaaagtgagatgcaatatcattaaataaatgataataaaacatttctctaaaacaaaaatgaaacaaaaaaactgtaacataatactctaacaaaaattaaatactattaaacaagaatatgcagatattaaagagcttctttattccaaatgtaaaactttgagttaaaattaaaaacccagaagaaaaatgacccaaaaaatgttaaaagaaaaagaagtaaaataagaactgatcaacttcaggacagaatttgtaagaaaaggacagtctaagaaatgaagaataaataatatgtttccatgggataatgaagtgaaataataaaacagaataataagaaataaatacaattaagatagtggttaaaaagatcagaaaaaaatacaaatggaagacaggcaaagaagatccaaaatacctattattggaatctctgaagcagaaagacaaaatatgaaatgaaactaatatttacaactgtaatttaaaaagtctgtaaatgaaagagatccttatctgtatatcaatattttaccctgtatgtttggaaagtgaaccagtaatgttcaactctgagatatatccttgtgaaacttttacaatttaaaggtcaggataaaaaaatatcctctgggcccccaggcaaaaaagatcatacagccaagaaaggaaataaaatcattttggcatcagaatgctttccagcaacctgcaaagcaagaagaaagaggaaaaatgaattcaagaaacagaaggaaagaaagtgatagccaaagcctttatgtccaaatacactgttctccaagctatcagaactttaaaatttttttttaaatattcaaaactccaggaataccatcacagagctcttcctgaacacactctgagagataagcttcagctttaccaagagtgatagggagtttttcagcaaaaggacagtgaggaccatgagcattgaacctgctccaaggaaggtccaggctctgctttgcttgacctctaaaccagcttgactttcagaaatgcagctcagatgggcagacctaggatcaaccaggcagggatgtgagtgtaggctgtgtgcaagctgctcaactgttaaaaaacaaactaaaaacatgttgctcatttcaataggaaaatatgttctccatggattccttccacagctgtggctgcttaagataacagacagtccaatgacagtaatgaaaagcacagagggcagaaagctgcaacctgcccatgaacatttgcagaggagaatttgtgaatttgaggcatacaggcaggagcagactgtcttgtgtagagaaatcaacaaagaagatgagagattctaattgttttcggcattcttcccttgggtatttgaatctctctattggttgacaaagacaacattctgtacccttccatattatgttaaatttgtgggaggatgtgctctttgggtttcataaacatccgaagcccacatagcattttttttttggtgctggtaataggaaatgggcatccctgaatggttttaaggatttcctccctctgtttaacttctggtaatataaaccctactatgtaaagcttgtccttctactagaagaattggcatcatcagggagcttgttagaaacatgaatctgtctgcatttttaaagtgtgtctcaaactagaatatacatcaaattatctggggatcttgttaaaaagcagattttggttcagaagtctagggtggggcctgagattctgtatttctaacaagctctcaggtgatttcattgctgcgggcccttgtactacaccagattacttatgctcaactcccttcctgagtatttgttaaagaatcttttctgatatcccgtggcaaactagtgtcctgtgtttctctataaatatctaacaagagtagtaaggtaccataactggagagactctcctgctactcttccgaggacccaggcctaggtattgtatgctgtggttgttctagactagatttccctttgctggtattcttaggaggtcacaaagggtcacaaatcacattagcccatagctgtcttgaagtgtttaataatcttgtttattgcatagatttaagagagggctggctcttaatatataggagaatttattttgcaagacatcagtaggagtataatcaagagtaatctcacaaacataaaaatagggctttttttttttttttttttttttttggtcagggttttacttgcatcacccaggctagagtgcaatggtgtgatctcgcctcactgcaacctccacttcccaggctcaagtgattgttctgtctcagcttcctgaggagctggaactgcaggcacacaccaccacacccagctaatttttgtatttttttgtagagacagggttttgcctggtatcaaactcctgagctcaagtgatatgtccacctcagcctaccaaagtactgtgattacaggcataagcaaccgcaccagacccaaaatagggcttcttgatcttgattgttcattataatcatatggggcctttacaaatgctgttttctaggcctcacctcagagacagtgaatcagcatgggggtaggtaacaggtgtttgcattttaaaaactttatgggggttgtctgggcgtgatggcacacacctacattccaggtactcaggaggctgaggcaggaagattgcttgagcccaggagtttgaagttacagtgagctatgattgtgtcattgcactccagcctaggcaacaaagtgagaccttgtctctaaaaaataaataagtaaacaaatgaaaataaaaatttcatgggcgattttgatgcatagtcacttgagaacaaagctctgtgtaaacaattcccctagagttgtataaactggtggtacaaggtcaaacagatgacaaaggggcaaagatagcaagaatacagaagattcaaatggcccaattaacaagttcaatttaatggagaaacagaactgtgcactcagtaattggaaactacacattttttcaaacatacattaataattaccaaaattgtacatgtaatggggtattaatcaaacctcaacaaatgtaaaagaatgatcagtacacagatcatatttcctatcaataatgcaattatattagatttcaacaataaaaacttttttttactgaaaaagccctacatgtttagacatgaaaaatacacacttctaatatacacaatttgacttaggtcaaagataaaatcataataaatattagaaaatgtttagagtggaaaaatgaaaccgctaaatattgaagtttgtaaaatgcagataagcggtaattcaagagaaacttgaaagtttaaatgctcatattaggaaaaaagaaaatttgaaaatctataaactaagaatccaacttaagaaatttgaaagtgaatatcaaactacagacaaagaaaaagaaaaaagaaatacaatgcatagttagttttttaaaaactcacttgaaaatgttcagaaagattgaataaagaaataaaatcagtattaagaataaaaaaaggagggcatgccaaaatatataatagagattaaaaattaataaggtcacacaatggtactttataaacttgaaaaaggaagcaaaattactagaaagtagaattcattaaaattgagtcaaaaaggaaaaaataaattaacaaaattaaatcagagactaaaaaatatctacactgaaaatgcaaaaacaaaaacaacggcaacaacaacaaaagactgacagttttgcatttgaattctaccaaatacttaagtaacagacaattctaagagtatacatattccattagagaatataatcttattttataggaataataacaaagccgtgtgaggacagtataagaaacaaaattataggccaatcccactcatgaattgggagcaaaagtctgaaaaatttttcaaataaattcttaatatataaaaagataatgtatcatatctgatatgaattatccacgaaagcatggataatttaacattagaacacctgttactgtatttcaccacattaaggactaaaggagaaaaacacgtcaatagatacagagaatctatccgtactattcacatgtagtcagtaataaaatccctagaaaactagtaatagatggaagctcctgaatctcataaaggatatctatcaataactgattgcatgtaagttattcacttataaaaatctagaactgtttcctttaaaatcagaagcaatatacgtagctttcagtgtgcctcagccacttggaaatagccaaatagcatgtaaagatcaactctatgacacttaattcaagaaggaaaatggaaattcaccaggatagtgaaggacacatcaaacctcgtgaagagaaggtggcaaagcagccactctacggtgtttcgcttacaaagtgagtgaagcctcagtacatgagaggagtagccactctcccggtgtggctctcacttttcactagggatcggtgcaacccaggccaagggagaacaccctgtttctcccaagcccaggaattagcatggggaagggctgaaagacacagagagggaaagataactaggaaaatctgcaggcattttcccagacatagactgagagaaggacgccatttttaatctgggatcttacagtcaatgtttggcaatggtggccactgcagacattttagtcttcggccaaagattagagtgcttgctgtgtagcaggggaaggacccccacagtcagaactgagtggcgaatgtggagagtgccccagcagtaggcatggaattgggctctttcctgttgcaggactggaatgggaggagagttatgggagagagagagagagatgggagataaagcgatgattctcctgggtggtgtgacttggagtcagggacagctttgccacatggaaccagtctgcatgtgtcattgctgggcaccccagtctgctcccttgatcatttgtgggagagtgctccaccagctctgtggagagggagggaggcagatcccatttgctttgagatccaatccttgtgaggacagcccctaagggtgtggggggaacaaaacccaccaaagcccaaggaaacaagagcacagcaccagctgctaaagggtgcaaaaccaaaggccaggaacagacttggagtgggggtcatctcttgaccccagccctcctggcaaatgcactgttgtggatgtggcagcagctcttctcattagatttctaggagtgtgggctgaaagaggcacttattgggcttttccagttgctccacctctgctgaacaccagctgtgctggggggagggtgatttttgacttctcccttagcacccccatctggactgagggtgaatagatgcagagtaagtctccaactgtctcttactcttaagtcccatgcactggactgcagcctgtattacaccatcaagcaaaaatatattcctacaccaagcaatgtctgagaaagccaacatggtaaactctctgaaaccaaggaacccatatagagctgtgggcctctgagagtactcagaaatgaagcctatcaatcatatacaacatacaccacagtcataccctcaagagaaaaaaggataaaaaaatcaaaaagtcccatccaaatgatagcaaattaaaaaaagaaatgtcagctccctcagataagaagggaccagtgcaagaactctgaaaatacaaaaagtcagagtgttttgtcacctccaaaggaacacaatagcttcccagcaatggatcctaatcaaaatgaaatgtttgaaatgacagattcataactcagaatatgggaggcaagaaaacctaatgagatccaagagaaagctgaaatccaacacaaagaaaacagaaaaatgatcaggatttgaaagatgacatagctatattaagaaagaatcaaacagaacttctggaattgaaaaatttactataggaatttcaaaatacaacagactagagaaagcagaagaaagaatttcagagctctgagaccaatcctttgtatcaacccagtcagacatgaataaagataaaagaaacaaaagaattaacaaagcccttgagaaatatgggataatgtaaagtgatcaaatctaccacttactgtcattccagagagaagaagataaattcaacaacttggaaaacatatttgaagatataattcaggaaaatttccccagttttgctagagaggttgacatgtggacacaagaaatcaaaagaactcctgtaagatactatacaagatgcatccccaaggtacataatcatcagactatccaaggtcaacacaaagggaaaaatctttaaggtggctggagaaaagggccatattacctataaaggaaaacctgtcagactaacagcagacttctcagcagaaactttacaagtgagaagagattgagggcacatttttagcattcttaaataaaataaatgccagccaattacttcatttctcatcaaaataagcttcataaatgaaagagaaataaaatctttcctagacaagcaattactaaaggaatttgtcaccaccaaactggccttagaaaaggtgcttaagggagttctaaacatggaagcaaaagaatgacaccacaaaagcacatgtaagcacatagtccacatgctttataaagcaactacacaattaagaccacaaagctattagctaacaacactacaacaggtacaaagcttcacatatcaacattaaccttgaatgcaaatggcatatacactacatttaaaaaatatagagtggcaaattggattaaaaaatcttaatctttctactgtcttcaagagacctatctcagatgtaatgacccaaataggctcaaagtaaatggatgggaaaaaaatctatcatgcaaatgaaaaataaaagaaaaagcagaggaggtcactactcttgtaatagttaaaatggaccttaaaccaacaacagcaaaaaactgttgtgggagagtgctctcacagaagggcattattacacaatgataaagagttcaattcagtgaaaaatttaactatcctgaatatatctgcacccaacattggagcacccaggttcaaaaaacaattacttattgacttaggaaaaagatttagagagccaaacaataatagtgtggtcttcaacaccccagtgacagcattagacagatcactgaggcagaaaattaacaaaaaaattctggatttaaatttgacacttgaccaattggacctaatagacatctacagaacacttcacccaacaaccacagaatatacattattctcatttgcacacagaacatgctctaagattgaccacatacttagttataaagcaagcctcaatagattaaaaagaagaaatcgtatcaagcctattctcagactacggtggagtaaaaataggaatcaatatcaataggaacttcaaattcacacaattatatagaaactaaccaacctgctcttgaattagttttggatagacaacaaaattaaggcagaaagcaaaacactctttgaaatgagtacatctaaacaaggaggtaaaaggtctctaggagagacacatcataccaaaacctctgagaaattacaaaagtagtatttggaagagagtttatagtgctaaatatctacatcaagaagatagatctcaaaataacaacctaacatcacacatagaagaactagaaaaaaaagaagaaactaataccaaaacccacaaaagaaaagaattaactaaaatcagagcaggactaaataaaattgagataaaaaatacacaaaagatcaataaaacaataggctgattctttgaaagcacatacaaaacactgatggctagattaacaaaaaaagagacaagatccaaattactacaatcagaaaggacaaaagtgacaacttacaactgatcccacagagactattccaaacacttccatgcacacaaactagaaaatctagagaaaatgaatacatttctagaaacatacaacctcccaagattaaattagggagaaattgaaattgtgaacaaataatgaactctgcaaatgaatcagtaataaaaacttaccaaccaaaaaaagccctggaccacatggattcatggcttaattctaccagacatacaaagaagagctggtaccaatcctactgaaaaccagtatcatcctgctaccaaaatctggcaaagacaacaaaacaaaaacactacaggccaatatccctgatggacatagatgtaaaaaatccttgctgggggtggggattacacctgtaatcccagaactttgggaggccaaggggggtagatcacctgaggtcaagagatccagaccatcctggctaacatagtgaaaccccgtcactattaaaaatacaaaaaaattagctgggtgtggtggtgcacgcctgtagtcccagctacttaggaggctgaggcaggagaatctcttgaatccgggaggtggaggttgcagtgagccgagatcgccccactgcactccagcctggtgaaagaactggtgaaagactccgtctcaaaaaagaaaaaaaaaatccacgacaaagtactagcaaatttaatctagcagcacattaaaatgttaattcaccacaagcaagtgggccttattcctgggaagcaaggttggttcaacatattcaaattgataaatgtgactcaccataaacagaactgaaagcaaaaaccatatgatcatctcattacatacagaaaaagcatctgatacatcaaatatccctttgtggcaaaacccctcaacgaagtaggcattgaaggaacatacctcaaaataataagagcccttgtgacaaacccacagccaacatcatactgaatgggcataagctggaagcatttcccttaaggactggaaaaagacaaggatgcttattctcaccactcctattccgcatagtactggaagtcccagccagagcaatcagataagagaaagaaataaaaggcatccaaattagaaaagaggaagttaaattatctgtctttgatgatggtatgattgtatacatagaaaatcctaaagattctgccaaaagactcctagacctgataaaagtcttcagtaaagtctcaggatacaagatcaatttacgtaaatcagtagcatttctatataccaataaaattcaaactgagagccaaattaagaaggcaatcccatttacaatgctcacacaaaaaataaaatacttaggaatacatctaaccaaggaggtaaaagatctctgcaaggagatctacaaaacaccactgaaagaaataagagataacataaacaaatggaaaaacctttcatgctcctgaattggaagaatcaatatagttataatgtccatattgccccaagtaatctacagattcaacactgttcctgtcaaacttccaacaccatttttctcagaattagaaaaaacaattctaaaattcatataaaaccaaaaatgagcctgaatagccaaagtaatcacaagcaaaaagaacagagccagaggcatcatattacctgacttcaaactatactacaaggctacagaaaccaaaagagcatggtcatggtgcaacaatacacacacacaatagaacagaatagagaaactagacataaagcctcacaactacacccaactgatctttgacaaaggtgacaaaaataaacaatggggaaagacctccctattcaataaatggtgctgagaaaactggctagccatatgcagaagaatgagattggcccctcctctctcacatatgtaaaaattaactcgagatggattaaagacttaaatgaccaaactataagaatcctagaagtaatcctagaaaatattcttctggacactggcctaaagaaagaatttatgactaagtcctcaaaaaaatgcaacaaaaacaaaaatggacaagtaggacctaattaaactaaagagcttctgcccagcaaaagaaactatcaatggaataaatggaaaagctacagaatgggagataatatttgcaaattatgcatccaacaagggactaatatccagaatctaaaagaaacttaaacaaatcaacgataaaaaactccaaataaccccttgaaaggtgggggaagacataaacaggtacttctcaaaagaagacatacaagcaacaaacaaacatatgaaaacatgcttatgatcactaatcagcagagaaatgcaaatcaaaaccacaatgagataccatttcacacccgtcagaatggctgttataaaaaaatcaaaaaataacagatgctagtgaggctgtagaggaaagggaatgcttacacactattgttgagaatgtaaattagttcagcctctgtggaaaaaagtttggagatttctcaaagaacgaaaaatagaactacactgtcactcagcaatttcattactggatatatacccaaaggaaaataaattattctaccaaaaagacacatccgctcctatgttcaattcagctctattcacaacatcaaagacatgcaatcaacctaggtgcccatcgacagtaaactggataaaaaaaatatgtggtacatatgcaccatggaataccacacagccgtaaaaaaaacaaaatcatgtcctttgaagcaatatgaatgcagctgggggccatgattctaagcaaataaacaaaaacccagaaaaccaaatacttcacgttctcacttagaagtgggaacgaaacattggacacccatgctcataaagaagggaaaaagcagacacttgagactaatagagggtacagggagggaggggagcaaaacttgataaacttccttttgtgtactatgttcactatttgtgtgacaggatcaatagaagcacaaacctcagtatcacaaaatataccctgtaacaaacctgcacatgtaaccccgaatcgaaaataataaaacagatatcaacttaaaacaattgtgttgagatagttgattgtctatatggcaaataaaattagattcattaattatacagttcacaatgataaattctagtgaattaaatactttaatcagacaggaagtgtttaaaaaacttctaataagaaatatgagaacattatgaatttgagttagagaaacattttttaatcaagacacaaaaaacacaaactgtaaacttgattgactgcagtaagattaagaagaacataaagaggaagaaaagacaagttataaactaggagaaattatttttcatagatataactaacaaaatattagtatcagaaaatgcaaagaactccccaaactcaatataatttaaacaaagaattccatagcatgaaataatgaacaaaagatacaaatagattacagaaaaggaaatgcaaatagctaataaaatatgaaaatatatccaaactcagtagtatctaggaaatatgtattaaatacaatataatttatatcttcctgaatggcaaaagttaacgtcaaatgatgcgaataactggtaagaatgtggagcaatgctaattcttatatactgtggaagggaggttgatttggtaaaaccactttggagaaaactttggcattatcacttgatcttagccaaaaggccgagaagcgataaaaatttggtattatctagtgaaactgaagattagcctttccgtatgccctgagcatttcttacagaatgggagcaccttgtgcacatgcaagaggagccaggcacgaggatccttcacagctgtgttatttgtaatatcaggaaattgtaaatgaatatcaattcagaggcaaatgaaaatatgttatgattatacaaagaaatattataatactacagcaaaaaagaaatatattacttagatgtatctccagaaaaaagaagctccagaagaacccatttggaacaatataacttttgtaaattaaaaacaaaacaaaacaaataagagtaaacaaaatattaggatatgcacatatattaaaactgtgtagaaaagcaaagctgtggtaaatacaaaaattaggaatatgagaatgtagttacctgtaggtgggagagagaaggatacaattgccgattttcatatacaaaatgttctgtttcttaaatctggtggtgagttcatgggtatctaactgctatgtcttatctctttcatatgtgtaattatttaaatataaaacatatttgaagataaagtattaaataaatgactcagtcagttatatttctaggttttgttttgttttaaaaagcagctccaaagctaatgcaaaacatgttatgccaatttttaaggcaggtagaatgagtcagagtgtaatgttcctgcccttacttagaaaacaaatccattaaatatctatagtaaaggccttcaacagtccgcatttagttaaaagtcaatagattgcttgtttttgaactctgaacctaaattctcctcctaatcacattaatttaatttcctgagacattttctttttaaaataattgttattgtgtgtatttaaagtatacaacatgatgttatgagatacatgtagataataaaatggttactggagtgatgcaaattaatatagccaacattgtggcttctaagccacatttacttgttttttctgtttctctttcatttcaggacactttgatggctccctacatcagtcatggaacataggaaccacgctaggtatttcagtagagagtccttctcttccctccacctttacagttttcttcttgtgccttctattggtagaacctaaaaggaaacagctagccaagaggacattttatttctagggttttacctccagcatcacaaagtggaatatcagagggtggatttgaagctgtgagaatgtagcttactgacgatcatgctttccctgtctttaggcttcaagaactggacaacctcagagcttagctatgggtccattttgccccctgtctatcctctctctttatggaatctcatccagtctcatgctttctatatcatataaaatgaaacagctcccaaatgtgtttctccagctttcacttgcactccagactagtataccatatacataacttgacaactctatttggatgcccaaaaagcaattgcaaactcaatatttacaaaatggaattcttgtagtttcaaacctgtttccctcttctcagttaatgtcaccaccattcacacagtttttcaagcaaaacacctaaatgtaattcttgctttcttcctttatatcaccccattcaacctaatcaaaattcttgaggttttacctccacaatacactcagatccctcattttcacccaatgtgcatggccatgggtgatacaaattgcttttcacatagaccacaaagatagcttttcaaacgttctcccttgtttggttcttcattcttcaccccacttcaccccacttctcacatagcagcataagtgatcttttaaaaatatcaagtatatcatgttgtttccccacttaaaatcttcaaggatttccgttagcagaacaaaaaaggcatctgtgaccccacatgacctagaccctacatctccatgatcatctcacacggttctccttctagcccactgctttctggccccactggccaggatgccctgtcagtacaatgcatggctggctctgactatcctacagatctgagtttatttatttatttatttatttgttattttttggagatggagttttgctcttgttgcccaggctggagtacaatctcggctcactgcaacctctccctcctgggttcaagcgattctcctgcctcagccttccaagtagctgggattacaggtgtgcaccaccatgcctagctaatttttgtatttttattagagacagggttttgccatgttggccagactggtttcaaactcctgacctcaggtagtctgcccacctcggcctcccaaagtgctgggattacaggcataagccaccacgccttgcccagatctgagtttaaacatgactttttcgcagaggtctttccttatgatctgtgtaaagttgcccccttgccttccagttacaccctatcatttcatactatttatggtctattaatacttgtatttgaagtttttttccacgtgtttcatagctagactctaacatctgtgtgggtagtgaccttgtctgtctttaaaccactgcatctccaggatctataacagtgtctagcacatagtgaagttcaataaacatttgttgaattagcaaggcccatgagagcagtccagctttcaatcatttccatgctcattgttcagggtaaactcagtaaaaagtagaccaacatgtgagggggatctcatatgttaaaagaaaaacagaccagttaaatttaacagaagttcaattgagcaaggaatgatttgtgaattgggcagccctacaaaccagagtaggttcagagcaactcaggtgctgctgcacggtcagaggagatttatagacagaaaagggaaactgacatatagaaaaaaagaagaaaggtacaaaaacatctgcactggttacagctcagtgtttgtttgccttatgtgatcacggtttgaacagctggccacctttggtcaaaattcagtgattggtacaggaataggttatagtctgtttacacaaccagtttggttacagttcactacttatggagaaacctttagtacaaacttaaaaacaaggaggcagctttaggctaaacctaatttaactcatgacatggcaacatgttcaatttcctaaaaatgaaggcagcatgaaactctcttatgcctagaaagtagattagaaaggtttgctctgcaagtggtgcatccaaaaatatcaccaccagcctcccagatactcaactatttatgactattaactgctggccaccctctccgaccagaactgctgatgaaaactagctggctggagccaggtcacttccctgcatctagatagagagttcatggtcttcattcgattaaaagaggccacacagaccctactgctaatagccacttctgacactaattggttctgttcttttccagtggtggcctagaacagactggcactgggaaagaacaactgacagaccctggagtccagtagcttcaggcttacatgcattttttcctgcttgttttcctggcaactctgagtttcagtttcctcatttgcaatgtgccaatactaatatttatatcataggatgtttgtaaagattaaaagaaataaaatgtgtaaagtgtctaaaaatgtctggcacaaaataggaatgaaattgccaggaattatgtaaaattaatctcaggatatttagaatttaggagtaagctcacaatgctaaccccctcttttgcttccctttgtatgatgaaagaaaaatatcttggggccccaaaatcactaagctaaagggaaaattcaagctgggaactgcttagggcaaacctgcctcccattctgttgaaaatcgtctctctgctcactgagataaatgcatatctgactgtctcatttggaaaggctaatcagaaactcagaagaatgcaaccgtttgtctctcacctatctgtgaccttgaaaggccctcacctctttgagttgtcccgcttttgcttccagttgtcctgccttttgggctgaaccagtgttcatcttatatatgttgattgatgtctcatgtctccctaaaatatataaaaccaagctgtgctctgaccatcttgggcacatgtcagtcaggacctcctcaggctgtgtcacgggcatgcgcatccccaaccttggcaaaataaattttctttcttttctttttttctttttctttctttttttatttgagatcgagttttgctcttgttgcccaggctagactgcaatggcgcgtgatcccgactcaccacaacctctgcctcccaggttaaagagattctcctgcctcagcctcccaagtagctgggattacaagcatgcaccaccacgtctggctaattttatatttttagtagagacagggtttctccacgttggtcaggctggtcttgaactcctgacctcaggtgatccgccagcctccgcctcacaaagtgctgggattactgacgttagccaccgcgcccggccagactttcttaattaattaagacctgtcttaaaattggggggttcacagtattcactagagaggaaaagttccccctttctgtgctatcttctctttgctccccagcatctcttctttgcccttgtccactttgctcttgaccagagaggctgtatgggtcacaccaccagccccttatcctgtggttgaggcagatgtggagcactggcaggggcaggggatgggcatgcattcctcagctctctccctgcaggatggccagaggggctgcatccttcatccacaggtctcagctctgatactagatcctctgcagggcatcctctctgcctctgagttgctacaactgctccttcctcttgcttcttcagccaagaatcagtaactccactttcttaaggtattatgctattcttccccttgtggtttctgtaaactctgctaacaccctggtcaacagtcccgtttttaagctttctgaattattctaatctgggcatgtcatctatttctgccagaattaggctggtggaaacagccactagtgtgttctcagacataattacatactctggcctgaacacacacgtgtgtgtgtgtgtgtgtgtgtgagacagagtcatgtggttgtttcttattattccccttgtggggaccagggatcactgagtccactactgccccactctagatgtgcccatttgggccattgttgccaccagccatcctgactgtggcctgggtgggtctctgccatgaacacattcatttagggctatgactctgctttcagctatgtctccaatttgccatttgacacaaggtcctaatctgagaaggagctttcagcttcctggtctggggacaacactagtgctgtgggtctctgggtctctaacacttgtagaatgagatgtcagctgctttctcagctgaaaaactcccttgggctctacttctttctctgtgcaactcttccaggatgggaagcaaaggctctgttcactttccagctgcttgcatgtttgccaggtctgtggaaccactggggctgcctagcagcagagtgaatggaaaagaggcctgcgtggtgggattctggtctttcttgagtagatggctgtatctaataaagctgagtatttggtggtaagagtcataggttgctgttatttaataaatcccaatcccatccagaggcagctctaatattctggctgaaagcattattcttagttccttacagattcaaaattgctgactttttaaccactagaaaaaaatgttaaagaagcttctaaaagctttcctttgttaccaccaagacatatttctagcctctaaaacacagaataaaatgataaaatctccattccatggctaaactctccacctggcttcccttaactcttgagtctgaactctgtacacttcctccatcagccacagccacacacaactgcccccgatgtccagacttacccaccacagcatgggtaccacaggaattctgctgagttactagttttttaaaagctctgactttaataggaatgctacgctaggaaagcagagaattacagtgggcaaatacgaccatttgatatggtcttagggacactttggagaaataagatcgggctcagatggtggttagttgcatcataactggcgagccaatgatattcaaggctttacttcattaaatgtcaacgttgggggaggcctctgagaaactgctcctgggttcttccccctctcccatcctgttcaaaagactatgacaatgttaaataaaggtctaaaaggatgttataaacattacctatgacataaaattagaaggcatagaaaatatttggttgacagaaatagtatccagatgtcctcaattgatagtaaaaatgagttgaaatatgcaagaaagaaaacacattcagaatgtcaattgtaaacacaaaactcacagccatatacacagtaagacagtaacctctaacagcaaggcacaatctgttgggaattgccactaaccacaaagcaaagaaaactattttgaaaaactcctatcccagtttggcctcaggatgtgactacttaataaaaggtaagaagactctttatagtgccttcactgtctgctttttcacttatatactaggtttgaccaaatttgaaaacatctgagcagtcactgtcaatttcctgcaaggaggctgactccgtgtggtcaaacagtcaaaagttactgcctcctcctcacatttttctgtatcagtgccaaaaactcaaatggctccagggcctaggcaggcaatatgttgagtaaagtatggaagagagggaggtgggaactgaaatgagctgaagatgctaaaaaattcatgattgctgtccaagtctggcaaccactcttcagttcagttgtcaccgtctttgaatatgggcacactcttatcagatagtctcttttagtttatactaaatctgataattattaaatgctggcaatatatttgatttctttatttttttcatttgttttttcttttcttattgtggcaaaacatacacagcattaaatgtaccatcgtaagaattttcaagtgtacagttctgtggcattaagtacattcacactgttgcacagccatcactaccatccattttcaaaacttcttcttcttccccaactccattaaatgataactccccatcctcctcttctccagcccccaggaaacaccattctactttctgtctctatgactttgactactctacatgcctcatgtaagtggaatcatgcaatagctatttttgtgtgtgtttggcttacttcacatagcataatatcttcaaggttcatccatgtaatagcctgtgtcagaattttatttcatcttaaaattattatttttattctctgtaagggtagagtatacataaggtaaaatttactactttaacttttaaaaattattattatacttcctgtgttggggtacatgtgcagaatgtgcaggtttgttacataggtatacatgtgccatggtggtttgctgcacccatcaacccatcttctacattaggtatttctcctaatgctatccctcccccagcccccaaccccttaacaggccctggtgcgtgatgttctcctccctgtgtccatgtgttctccttgttcagctcccacttacgagtgagaacctgcggtgtttggttttctgttcttgtgtactttaactatttttaagtgtgtagttcaataatattaagcacattcacatggttgtgtagcacatctccaaaactttttcatcttgcaaaactgaaactctgtacccatttggctactccctgtttctctgttgcctcagtctctagcaatcactattctactttatacttccacaagtttgatgactcagttctagatacctcatatataagtggaataatacagtattttgactttttgtgactggtttatatcacttagcataatgttcccaaagttcattcacgttgtatgtgtcaaaatctcattcctttttaaggaagaattatgtttcattgtacaggcataccttgaagatattgaggatttgttcccaagaaatttagtatcacaataaagtgagtcacaccgtatttttggcttcccagtgcatataaaagttatttttatacaacactatagtctattaagtgtgcaatagaattgtgtctaaaaaacaatgtatatacctttattagttagagttctttagagggacagaactaatagcatagatgtatatataaaggagagtttattaaggagtattgactcacatgatcacaaggtgaagtcccacaataggctgtctgcaagctgaggagcaaggaagccagtctgagtcccaaaacctcacaagtaggaagatgacagtgcagtcgtcaatctgtggctaaaggtccaagagcctctggcaaaacactggcataagtccaagagtccaaaagctgaagaacttggagtccgatattccagggcaggaagcaggcagcatgggagaaagataaaggctgaaggacttagccagtccagtccttccgtgttcctctgtctgcttttatcctagccatgctggctgctgattaggtggtacccacttagattgagggtgggtctgcctctcccagtctactgactcaaatgttaatctcctttggaaacaccctcacagacacactcagaaacaatactttgcatccttcgatccaatcaagttgacaatgttaaccatcacaagtgcacccttgtcaccttgaaccatacacatatcctgaaatcatgcattatctacaaataataagaataataaggtgataattacacctaacataatacagttatcctttatacggccagaaacgcaccaattcctgccccaaatgctattatataaagttaacaatacttaaatgctgatatgaagtcttatttcacatgataaaggaaaagaaaataaaatgaagatattttcttagtacaaacacaaacatgtccttaacaaagcaaggaggaaatattcatgacaattatagtcctcgtttctgcagctggtcacgtggtcatagctggtattgatgactaccttcttctactacccattctgtattccctttgccttcagtaagcacctcggcaagtcgtggctttttaccagtggagtgacccaaaccttcattcttgaagggtctgggccatttgtagtcctgcctggattgggttgttgtagtttcccattgaccttaatcacaggacatggtaatactaagagatgccctaatggttctcctgtattccatgcaaactcttccttacctccattgtggagtggtagactgttttcatcttgatagtccggattgatcactccagccaacactgtaatccccttcttagcctgttgacttagaggtaggaggagcccaaagtggccaggtggcaatcttaacttccagttaaatgaaatcgttgttgtgtctcctggtggcaacattcctccctctggaactaagacctctaggccagcaaaatgtaatgtcgcaggaagaggaagcaaaaattttgctagtgggtcactaggggtgatagtgaatggtgccacttccacttccatcccttgattcctggacctgtgaatcctggctatgggagaaacagtaccctatattggatgctgattcagagcatacatagacatccggagaactttgccccagccctgctaaatattgtcacctagttggtgttgtaattgggatttcaaaaggccattccaccgttctatcaatccagctccttcaagatgatggggaacatggtaagcccagtgaattccaggagcatgagcccactgccacatttcttcaccataaagtggttgccttggtcagaggcaatgctgtgtggaataccatgatggtggataagatattccgtgagttcacagatacaagtcttggcagaagcattgcatgcaggataggcaaacccatatctggagtaagtgtatattccagtgaggacaaacccctgccctttacatggtggaagaggttcaatataatcaacctgccaccagatagctagctgatcatcctgaggagtggtgccatatcgagggctcagtgttggtctctgtggctgacaaactgggcactcagcagtggctgtagccaggtcagcctttgtgagtggaagtccatgttgctgagcctatgtgtaacctccattcttgccaccatggccactttgttcatgtgcccattgggcagtgacaggggtggctggggaaagaggctgagtggtgtccatagaatgggtcatcctatagacttgattattaaaatcctcctctgctgaggtcatcctttggtgagcactcacatgagatacaaatatcttcacagtttttgaccactcagagaggtacatccacataactcttccccaaatttcttcgtcaccaatttcccaatttcccaatcatgcttctttcaattccctgactgtccagacaaaccattggctacagtccatgaatcagtatataatcgcacatctggccatttcttcttccatgcaaagtgcacaaccaggtgcactgctcgcaattctgcccactgggaagatttctctttgatgctttccttcagggatgtcctagaaaggggctgtagtgctgtagctgtccactttctggtggtgtctgcatattgtgcagagccatcagtaaaccaggcctttgtcttctttccctctgtcaactgatcatagggaattccccatgatgccattggtgcatgcttggggagagaaggcagggtggcagaagtggggatcatgggcatttaagccactttctcatgtaacttacttggacctgcttgagcctgatcacatataacacttccatttgatgatggaatgctgctgtgcataacccactttatggctaaatgggtcagaaagcacccagttcatgatagacagttgaggctgcatggtgtttgatgatccatagttgaacgttcagtttctatcaaagcctagtaacaggccaagagctgtctctcaaaaggagagtagttatctgcagaagatggcagggctttgcttcaaaattctagaggcctcttctgtgattcacctatgggggcttgccaaaggctacaaacaacaactccatctgccactggcagctcaagcaccattggatctgctgggtcatatggcccaagtagcagagcagcttacacagcagcctggacctgttgcagagccttctcctattctggaccccactcaaaactggcagcctttagggtcactcgataaatgggccagccagaataacacacccaaatgaaaaacatgttccctccaaaatccagataggcccactaggcgttgtctttttttcttgattgtatgaggagccaaatgcaataacttatccttcaccttagaaggaatatctcgacaggccccacaccactggactcctagaaattttactgaggtagaaggtccctgaattttagttggatttatttcccttcctctggcgcacaaatgtctcaccaataagtctagtgtgtttgctacttcttgctcactggatccaatcagcataatgtcatcaatataatggaccgatgtgattccttgtggaagtgaaaagccatcaagccctctccaaataagatgatgacacaaagccagagagttgatatatccctgagggagaacactaaaggtatattgctggccttgccagctgaggacaaattgcttctggtaggccttatggacaggaatggagaaaaaggcatttgccaaatcaatggctgcataccaggtctcaggagatgcattaatttgctcaagcaatgaaaccaaatctggtagagcagctgcaattggagtcaacacttggttaagcttacaatagtccactgttcatctgtcttctgcacaggccaaataggagagttgaacagggatgtggtgggaatcaccactcctgcatatttcaagtccttgatggtggcactaatctctgcaatccctccagggatatgatactgtttttgatttactatttttctaggtagaggcagctctaatggcttccatttggcctttcccaccacaatggccctcaccctaccagtcagggagccaatgtgggggttcagccagctgctaagtatgtctataccaattatgcattctggaactggggaaatgaccacaggatgattctggtgcattgtcaatgtgcagtaatagtttgaatttttttttcctgagcagttgttattaacagtgggtttaaaatatttagtaaatcatgtggtaaacagatgtgccattacccaggctttgttgtttcatttataaaacacagtcagagtagatttagcatagttcttcaggatcctaggattttcagaatggtaaacaagcattggcttcagcttagattcaccagctgcactagcccctaataagaaagtcagcctgtccgtagaatcattgaagctaggcattgacttctcccctctagccatgaaaatcctgcatggcatcctcttctgatggaaagctgttttatctacattgaaaatctgttgttcagtgtagccacatttatcaatgatcttagctagatcttctgaataattcgctgcagctcctacatcagcacttgctatttcatcttgcacttttatgttatagatttgacttctttccttaaacctcatagggcaacctctggtagtttcaacttttcttctgcagtcttctcatctctctcagcgttcacagaattgaagaggtttagggcctttctctggattaggcttaggtttaaggaagcattgtgtctggtttgatcttcagtccagatcactaaagctttctctatattagcaataagaatgttctgctttcttttcatttgtgtgttccctggagtagcacttacagtttccttcaaagccttttccttcccattcacaacttggctaacttcggcacaagagccttagcttatcaacgtgccttcttcacttggctttattatttccagcttttgattgaaagtgagagatattactctttttttcacttgaacacttagaggtcattgcagggttattaactggcctaatttctttctttctttctttcttttttttttgcatctcagggaatagggaagcccaaggaatatgagagagatgaggaaacagctagttggtggagcatcagaacacacacaatgtttacggattaaggatgctgttttgtatagatgtggtttgtggagcctcagtacaattacaatagtaacatcaaagataacagatcatatgtcactataacaagcataataataatgaaaaagtaatgtgatctgtgacatggaggcgtgaaatgagcacatgctgttggaaaactagttccaacagacttgctcgatgcagggttgccacaaaccttcaatttgtaaaaagtgcaataaaacaatgcaaaaaacaatgcattcctgtatgtatattccacattttgaattgtggaaacaatgcaataaaacaatgcaaaaaaatatattcttttatgtgtattccacattttgtgtatccattcatcttttgttgaacatttgggatgcttccatcttttggctctgtgaaaaatcttgctatgaacattggtacatacatagttttttgagtccctgctttcattcttctgagtatttaccagaagtggaattgttgggtcaaatggcaattctatatttaatttttaaaggaagtatcatatcgttttctacagtggccacaccattttacatttctaccagcagtgtacaagtgtttcagtttctccacatcctcaccaacaatgttactttctattttctgttttgtttgttttttataatagctattttaaagggtgtgatgtggaatctcactgtggtttgattggcttttctctaatgatgagtgatgttgagcatctttttatatgctatggccatctgtctatcctctttggagaaatctctatccaagtcaattcactcactgtggtttgattgacttttctccaatgattagtgatgttgagcatctttttatatgctatggccatctgtatatcttctttggagaaatgtctattcaagtgttttgtccatttttaagttggataatttttagttgtttgagttgtagcagtttttttatatattctggaaatcagtcctttattcaatatcagatttgcaaatatttttcacattttgtgagttaccctttcacactgttgatagtgtcctttgatgcaaaacacttttaacttggatgaagtacaattaatctattctttcttttgttgcttgtgcttttggtgtcgtatccaagaaatcattgccaaattttatgccataaatcttttcatctatgctattttaagggtcttacagtttttgctcttagatgtttgataaattttgaattaatttttggatatagtgtaaggtaatggttcagatttttccttttgcatgctttctcatcaccgtttgttgaaaagactgccctttctccattgaatggttctagcatccttgttgaaaattgtttgaccacatatatgagggtttattcttttacacttgtcgatgtgtctggcattatgttcataccacactgttttgatcactgtagctttgtagtaagttttggaattatgaagcatgagatgtccaactttgttctctttcaggattgttttggttacttggtcccctgagatttcatatggattttaaaacagattttaaaacaattctgtcaaataaagtgtttgagattttgataggaattgcattgagtcagtagaattccttggggagtattcatttcttaataatggtatcaatttatttttgaagcacttggagagcaaacaaaatccacccataagagatgttatctctgttcattagtcattcagtgaaagcaaattttagaagatagttatgtagaaagtagtgttgggaatgtccacagtaacacattgcattctggatagtaaagagccctgaattttgttgtttagattatctcaagaatataagaaatctaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaagaaatctatataacaaatcaataatagatgagtgctcttagaaaatgcaaactgaactacggctgggttcactaatctgcccactaaatgtagttcagagggttaaattcaccctgccttaggtgagcagaaaacatcaaaacaccctgtcattttgcagaaacaactctagatctggaagttggaaaatggagagtaatcattcaggtagttcatttgctaaagaagcaaaagtaataaaaatgataatcaaagttataaagaagaaatgtttcctgagtttaagaataaacatacatatttatatttaaaaaaatcatcgatatcttgaaaaaagtgaaatacttataaacagatactctgtgggaaaaagttataggtacacagagaaaaaaaacagctaccacaatcttaatagtatctagccagaatataacagtaggttcccacaaagaaataaagctcaggctgccataattctatttcatatcaataaaacttagaagacaatagaacagcgtctgcagaggattaaaggaagaattttttttacccaagaatttcaaatcaaacaaaattctctgtcaatgtgaacataaccaaaagacattttcagatatgaaaggtttcaaaaaacttaaaacatatgtatattttctcataaaaaatttgaagacacaccccattggacttaaacatgaagcaaaattaataactaagaaatggagaaaatataaaataaatgtgtttgcggaatagctgacctggacccaagctagctggctaatagtaggtatcatcacacagccacaggagaaatggaggaaaataggctcagtgtcctctgaggaactttttgttgcatggtaaaatagtgatatgctgctttgcacagtgcttttttgagaagcttgagttcatacttatgaggctgcaggttaaacaaaagagtaatacagcaaaagataggtagaattgagtcttgacttcctaatttgtgtcccaaggctattacctcaaagtgtctcagaaaataatatacagaaggccgggcgcggtggctcacgcctgtaatcccagcactttgggaggccgaggggggcggatcacgaggtcaggagatcgagaccatcctggctaacacggtgaaaccccgtctctactaaaaacacacacacacaaaattagccgggcgaggtggcaggcgcctgcagtcccagctactcgggaggctgaggcaggagaatggcgtgaattcccggggggcggagcctgcagtgagccgagatcgcgccattgcactccggcctgggcgacagcgagactccgtctcaaaaaaaaaaaaaaaaaaaaaaaaaagaaaataatatacagaaaaaacagtgcttcattgagtacctctcacaaaatatgctaaatgaggctgaatgttaactatatttaaaacttaaataaacatttttgtaataaatcaacaataggccattgttcaagtacagaaagcaagagaactgacttgttagttcttcatggaactgaggctgatcacagctcattagaaacagagagagagtggtctaatttcattctgatttggtaacatcacatctgaatctaggttttggtgccggcaacagcaaggttagagtgggactaatagcgagagaccacacctctcctctatagcagagttctgggagccaggtgggtctgggaacctgctgtgtggtcaaatcttctggtgaagggagtggacaagtaatttctaatgtgaaaaatataaatgtgcagggattgggcaataggtggatcattacaagaattagtggttgtggtttcaaactgaaaactagataatggaggaagagatatttttaaaaagggtcactttaaagttttcatgtcaacatatatgacatatttattctgcagagcaaaagtgccatatccgcaggggactgaacatactctgcctctggtgtgtcggccaaacccttcacacttgtctgaggtccaggcagggccaaggcccaaggaaatgctggcaggaatctgatctagaaaatttactcgtgtctccagtgctgtcaaaacttctttgacatttttggcctggtgaatgagagaataaaatttgattttgccacacagatcttgtactgtaaccctccaaggtgaagaaatttctaatttaatagtatgttggtcaaacattcccagagccatctgtggctgctccagtggaagtttggcctgtctctgttgggcagctagtctgttcagattattccaatagactacagttcttacccaaaagatgagtcaagtaattctggggcaagaaaaggctcttttcatacagtcttttaagccaaatgcagatgattccctgtaatctgattttggaattatccatgctcctactccctttatggatggttaaaattggaaataccgatgactaaggtcaaagaaacactgaggttaagagcttgtgtgcagataggtggcaagagtgtggatttgaatctagtgttgggccacaactttgcttcagagttaccgtactacaaaggaaatctacttgttttattagtgaggccctacagctccaggccaaactttggtccagaagctgctacctttattaaccttttccttcccacctcatgcctcttaccccaatacctctactccttatccagagaaccacctgtaggaaggactctggaatggggccacgttaaagggatgtaatcattttgattttattacttctctccaaacctgtggcttatagctgttttccattcatcaaaataatgacagcccttttgaattaaacatgattttccttctcaggaaacagaagctcaaaggaaacatcagagttaattagggaaagtgatattgtagctgctcacagaaagaatcccatcaaaggcaatgttaagggggatcccaaatcatcaaagcagagtcattcagttgcaaattgctttctatttcagcttcgtagggcggacgatgttctgggatcttgctgggctgcagtttggccagcatagtacaggaagaaggctgggatgcaaacacagggctctactagtggtgtctaaagagaagaccagatgtccctagagggggaaaaaaaagcttgaagatggcccatctctatgattttgaagttcacaaggattaacttagaggattctcattgtatgaagtttttgtctgagtggtgtcaaataggttgtttattctgttatgtgtgcagaagtacttggtttcttggtatcttagtttgtttacatttctataaagagatagctgaggctgggtaatttgtaaagaaaagagagttttttgactcaagttctgcaggctgtacaagaagcattgcaccgacacctgcttctggtgagggtgtcaggaagcttcttctcatggaggaaaaggaaggggagccggcatcacatggtgagagagaggtgaggaagatgccaggctctttttaacaatcagatcttgtgggaactaacagagtgagaactcattcattactgcaaggacagcaccaagccatttatgagggatctgctaccatttcccaagtacctcccaccaggccccacctccaacattggggatcaaatttcaacatgagatttgttggagacaaatatctaaattatatcacttaggcttccaattcaaatttaccaacctgccacgtacaagagtctgtgctaggtactggctcccttgtccacttcaaatactttgacagggcctgtttttgatacccaaagtgattgaaaagattgaaatccaaaagtgtttgtgtatgtgtgttttgattggttgtgactttggcacaactgaagtagacaacattctcctcctgctttagggtttataatatgcactgtaaaatcagtttactgatgtaatattcatttgcttcaagtctctcttagtcttagatgggtttctcattccaggtacagatgctccctctcctcaactgctgaaaccctgacaggagcagtctgtattttttcttttccaatgtagtagtcgtccacgtagtacttgcacactttgagttctacttctattgttcctctgacagtgctcacactaaggtgacccatggtgtctagtcactcatctactgaaatattttagatctgtctccctttgccttcctggcagcagtcacgctgtaatatggtttggctgtgtccccacccaaatctcatcttgaattgtagttcccataatccccacatgtagtgggaggtgcctggtgggaggtaatttaatcatggggttggttaccctcatgctattctcgtgatagtgagtgagttctcacaaaatctggtggttttataaggggcttttccccttttgctaggcatttgtctctcctgttgccttgtgaagaagaacatatttgcttccccttctgccatgattgtaattttcctgaggccttcccaggcgtgaggaactgtgagtcaactaaacctctttcctttataaattatccaatcttgggtatttcttcttataacagcatgaaaatggactaatacacactgtgaccacatactccccatcttttaatctccttgtctattatttccctctgcttttttactattctaattctcttgaatggctttctaacaatttttttctcaactctttttctttgactgctttgcttttaattttttgattctttgtttaatcataatcaaaataaggttcatatattccaattgcttcatatgtctcttaagtctcttttagtcaattagttggcaaatgttctctggaaaggcccagatagtacatatcttagtccttaggggccatataatctctgctgcaactagtcaactctgtcactatagcacaaaagcagtcatagacaatgcataaatgaatggacttggctatattccaataaaactttatttacaaaaacagtgtggtggccctattgaccacagtttgcataccactgtttcaatctataggtgcttttgttctcctatttcccctatacagtttatttgttgaatactttgtatcatttgttttatagaatttgctatagctgagttttgcaggttacatgttcctctgttgtctgtatttcctgtcaatttgtaagagatctaggggcatgatcaaaccagttttttgctttttttttttttttggcaagactactttcaaggaggtgatgtgtatttctgtcacctggtacataatatgaggttgattctccttttatgatgctaggagctattgatgaccatttcctagatccactgcttcatcagggctttgcaaagcagtgcctttacacttatgtcattccttcttcatttactagctggaacatgtctctaaagaaaatttttccctcatcaactgttttcttatccagaaatatatcttatataggaaaggcaggataactgattatttcccttgaattgtcagctatcaaaatttgagttacatagaatcatccaaaattgactactaagggcattttttttttcttttgtataactttgaactcatggatttattagtatttgaagtgattcaaaccattgaattagttgtgcgtttatggaccagtgggaccttcttcaaggtggttcttccattcttttggtgagccctcagtgggttttaagacattctttcctccaggtatgaaaaaaatgtccagcacatcttatacatttgttgctctagacctgaaatcaagaacctttcttctttttagtggaaagtattagagactgcaatctgagccctgagatgtttattactatctactttatctttatttctagttttgttcagtgagtaaagctaggaaatagtgttttaaagttaatatcatcatgggttcatatacaagaccacaaggattttactgaactgtggttattttgcatccattcaaattatttattttaaaatcaccaaaaattctttctctttgtattatgtcactgtggtggttatgacaccaaatcaatataaagttatattcatttgttttattcatttttttatttttagaaattttaaaatttaattttgtttaataattccataaacattttacagaattccacagtcaaagttataaacctgagaagtataatttttctctttgatgcctgcccttctgtttcttcataccatttactggtaaccattaatatttttggtttggtttatccttttttttttttttaaaaaaagcagagagtcatatatctatatcatggtctcttcttagatgaatggggatatcctagaaatcctttttccacattgcctttttactcagtaatatatcctggagattatttcacagctgtgtatgaaatatcctcacatcctctttagagatacatagttttttcattgtatgggtggaccatagtttattcaaccattcttctgttaataggtatttaggtgattttcagttttgtcaatcagatatctctactcatctctactttgctgatcatatatctctacttaacaagataacttatgtagttgtcttatatttttgccaatatatcgtctagagtcttagaagttggattgccaattgaaagggttgaagtgcataaaaatttgctagatattgccaatttacctttcacattggtttttaccctttgatattcccaccagtgatttctaagaatgccttttcatagacttcttaagaatatgttgtcaagctttttgtaattttggtaatatgattgcgaaatgttatctgtgcagttttaattttcatatctcattatgagtgaggctagacatcttttcatgtgtttaaggcacatttattttctctgaacttgctcttagagtctcttatgagatttttcttgacgtttgtctccatttttagaaagtttttatatattagggataattaggaataataacctttgcaatataagttgcaagccttctttgtcatttattatatcttttggaattccttgtggttatttttgccctgtagtttgttttcattttagtgttgtcaaatatataaatcctttttcttaaagaatttggattttgtgtcatagttaagaaaattttcacagtcccagattatgaagaattcacccatttttttgtagtctgtgtaagattcatttaattttttaccatttaaatacttgttccatttggaataaatcttagagcccaatatgaagaatagatccaatcttaattatgtggtgatccaacaaaacttattaaataatcatttttctcctactgatttgagatactgcctttactgtgcactatatttccatataaaattacgtctatttttgaattttttatttttattgatatatttgtttgttcattcattagtactacactgtcttaattataaaggttttataattaactttattatctgaaagggctacccaccacatccccactagccttcactcttcctttcctggatttttgtggctactcttgctttcctgttcttagagatgtatgttataattaagttttatagctacaggaaacaatatgaaggaattggtattgctaattcattgaatttataaatcaacctaaggaagatctttgttatattgattccttctaagaacatagtatgtcttttcagttgttcatggctgagtacatttgacttctttttttgcgatgggttgtgggacagggagacactaaatctttgttactagcctgctccttcttccactgcaaaacccaaagaaacacatatcctagctttctatttggagacacacatgtcctacctttctatgtggattattcttcaaaactgatatgaatttgaatttcactggccatgtgcacctggggctcctgtatcacgctgttcagtatagcattactggaaacccagggctgctggtcagaagatatgcagtagcatcttctgttgaatctttttttttgtacagaccaggcataatcccattagtcgtgagaaatatttggaaagttgggtgactcctagagactcctagttggtagaactccactttaagctgccaatcatgtttaagaaaactaaaatcagaaaggctgagcttgcaaaaactgtctcaaaatgacaggcatcagtccctctttccaaaattttatgtaatcctctaaaactgacagtggcacagaaaaagaaatatagtaagcaaagagactattttgctgtgaatcagaacacctaaacctccctgcctttcccacattccctgcggtgaaattggaactttaaatggaaccttaataatggaacaatctccaggtttattgattttcttcaagttcattaacctactcaggtgtggttttgctttccaacataaagcagagtctaattctgagtcctcgatgttaagttatttgaagtgctgaaaggaacatagaagttagttggaaactaattcaatcagctgtagttacaagcagaaagcaatataagtattcattagaaaatatttgtttacttaatgctacaaagcataagagatagttttcaaatatatataaaataaaattgacttactgtaaggaattaaataccagagccaggggaaatttaaatctggacacaatgttgaggtccttgggtaggggatggagttgaaagcattagaattcagaagtactgaagaatctcagatatttatgactgatgaggtggatattcatttctaaatttcctagagtccaagataaaaagaaaaatatagtaaataacttcattttctatgtaggaggtataaaatggtggacttatactgtcttcaacaaaaactttactaaatgtactaacatctctattgctccttcttgtggcagctgttaacatcaggcaaaatcatgatgctaaagtatgaaggatgattcaaatggagattctgagacaatatgattcaaaatgagtgttcagctaagcttgcagtctcaataaccatgaagtaatgccttgtagggggccaagaggaaaagagatatttgagaatgatgactgttaaattattccgaattataaaatcacgaggtatttaaagtcagctactctcagaagagccaatggaaccatgctttattatttctagaaaaccaaaattattaaagcttttttcctgcattgcttttttactgcttttatggtcacaccaaagccctgaaggatgcccttctttaaaaatacaatttttggtgtcacatgggtggggcccaaagcccacagcattgaaacccaatggaattgtgaatccctggtggaagcattaaacatcttgtgatggcctctccatctacgtggttcacaaagctggggtggaaagtctgcagagtggccgactgttaatggacattgctggctacctcacacttttctggaaattgtgcattggaaaatatatgtttttatttttatttttttggcttggtaatggttgctgtgcaaagcatcccaatatcaaatttattggcttcattagtaattagtaaaggttttatgaataaactgatggcacataaatgtttagtttatgctatacactgcttccaaatcatagtacttgctgtgatttatgagataaaatgagaatggaaaaatatgggctgcagtgtgcattgccagtgaaaaaaagcagttgcgcggtcctttaatagtgtcacaccgggcctcccactaatgaagagaaagaggtctgaagggcacctgccattagagcaattcaccaacttttgctggctggaaatcagggtctgggtgtctcttcagatggtgtgggtgtacttgccatgctgacatttaagttcctacagtagcctacaggtcaagggagacctgggaactgacttctccagatcaacattgcagatggcacagaagcctgggagctcctttttcctagcctttctgctgtttgaactgctctgtctgtttttctttatagaagtaaaacaagaagaggattgggcatccttaagtgaggataaataaagcctttgtttatttatttatttttccctttctactatttccaaagcatcctttggaaatacttgatggaaacactgctggctatttgtatgactgttctcactctgaacaggggaagaggtattgcttttggagtcacatggagttgtgttcagatcttacatctgccgcttagctatgtgagcaagttatgtcacttctctgagcctcactgctctgtgaaatgggaacagtgcttcttaccacagaggtttgttgtagggtttaaatgaaataaatcatgcaaagtacattgtgcagtacttggcacacaggaggccctcggtaaaagtttgtgctctgacccttgtcataattagataccagatccaggctcctttaaaggcagtgccaccctgaaggcattcataaagttgatgcaagttttacaaagccatgcattattctgagaatggctctgactttgcactgctggctcatgcagagaaagctaacctcctgtaacctggcaactgaggagactgagggacttccagaaccctggggctggctgggggaactctctggaatggggattttgttttctccagaggcaggtgtcttctcctagaactagacaaacaggagcactggttgtgacgttaggttatggagaaccagcagcttaactaggccttaggaggaaatggacctcatgggccttctatggctcagctgaattctcagaacattgtctgggctcctgtagataattagtcttgagacttacaataaccaatctcatcaaacaccaacatgtaaaccaggtgccgaattactttgtgttgtgatgagtattcattcctcccacctagatccctccccatcaaatatcatgggaccctatgagcaattaagaatcatcaaaataatccaaagaaccaccatttatggagtgcccactgtgtgctcaatacaaatatttatcttttaaaaaataacttcaaattttattttattttagattcatggggtacatgcacaggtttgttacatgactatattgtgtgatgctacggtttggggtatggatcctatcacccagatagtgagcacagtacccaacagataacttttaaatccttgccccttctcccttcaccctctagtagttcccagcatctattgttggcatctttatgtccatgagtaccaatgtttagctcctacttataagtgagaacatgtggtatttgttttgctgtttctgtgttaattcgcttaggataatggtctccagctgcatccacaaacatttatcttaatcttaggttgggtttccctaaaagcagggcctgggaccagagcttgtatgcagttattttggatgtgacccaggagataggagtgagggggctggaaaaaataaaatagtggagaaaggaagacatgccaaggatgtgttattgggctggtttttgtagtagacaactgggcatcaatcccgctggagactctgaataggcacttcagaatgtctgcctatgacttagacatgttcattttctgatttctgtccaccattggtcatatgttactccaggggtattaactctttctagcttctaggtgtgtgcatgtgccaaaatggctgattagactcctgtaaggcatcccacagcaaggggcacggaagatcaaggacaggatgcaggtgatgcttggtgcagctgagccgaggtgctctgaagctgctgctctgtgcaaccagtggctgcatcaataaccagatcaaaaaagtaatctgagaggatgtgagacagggcacaacctgcaatcctcatagcagcccctcaaggtggatgatactggtgtcacttcactgatggaataaatgatacttagagaagggaaataactcacttaaggtctagtggctcaaatggcagggccaacactgaaatgtaggcttgggttaactttaaaacatgtgccatgtgacttctctgccatggccctagactagacaccttacaattgtccctctaaattccctcttctgcttctctaccccaagatgatgatctatagggagtttgtcaaggtgctctctttgcctctggcttctggctggggtggcacaaaggggaacaccagcaagtggtcaaagagagaaaggaggatatggttggggaagttatttctttcactccctccttgccaggttgcatgcaatcagctacgtttccagttggaagattgcagctcttcccaggctgtgtctctccacgcttctctttccacctaagttcttgtggatgctgcctttccttgccccttgaatcctgggaggggaggcaatattaatagtctactgtgatttcctcacaccctgccctcacctttgtaaacagtcacttcataacacctcttagaattatcctagtttgagtgtgctatgtactcctgggaccctgattgatacagccacctcccagatgtgggtggaaaagagccacggattgatctctggttaggtctgcctccacgtcacttacccacaggagaaacaatctctcaagtggccaaagacagcttgcaggcaagaccccatctgtccacatagcaagcaatgctgagaaaaagcaacacatcattgctcatgatttcccctgatctgtcttctaggctgacagacatcttctcgtccacacaatttctctccgatataataatatctcaacaataaaagcttaactttcagttatatttagctttgatgtcacagcccatctctgccttctttagttgaggtgacatctaatttttgaggtgctcctgcatgtggttaatctccttagttccagatgaattttgcacattttcctcatggagaatcagagtatatccaagtacttgtgagagagagaagagccctctttcaattcaattcatcaggtggtaagcgtgttggactgatgcaccaactacctccttaaagtccagaacatcttcccttcagtggctggactaggctgggaggatgggaaaggtgagccctccctgcaactgaaattccacttgcatgcctctcaacacctctaggtgttggagaactcactgcattcattttgaataaaaagagaccggctctgggtttgaacaaacatgtttttattcaaggtttaaacatttattttatggctcccctgctgggtttctgattgtttccctttcctcggagcatgaatgattgtttattaaacacaataataataataaagtggaggtagggtctcttagctggcattagttcagattctaatttaatccttccccagcctcacttcattacaactctattccgttgcgtatttcataaccagcatgtgtcacggtgaatgaagtcaagcttcagaataacatgtcagtaagatgattgttcatggaacacacagtacccctagtctatgattaaaaaagaaagcaacctggctcaaaaaataagaaatttgcttcactacatagaacccaggagcaaaggcctctttcctgcctttttcctgttccctgaatatcagggcagggagtgatgtttcctggcctcctaggggtgagaggactcttctggacagaagggcatgtacctttgattcttatctttccagtaacagcacgcttaggccacagtaggctctgtgtcttattaccgatatgaccccagctccttcagctacagagtggagtgataatagctacattcctacagctgttatgcagattacaaaacatgatatagtacaagtgattagcagagtgcctagcacacagcgaatgctcaatgcatagtggctgtttttattattgtgcaagattgcactccaaatagccttaacaattgtcagagatattgattgcctcaaagggcaggattctgggaaaagataaagatgatgttgttcagaacataggtctgaatattggtgagcacaaagactcagaaatggaagaaaacatcagcaaaatagtttggggttataatgggataaaaggacatcttttgatttgggggttgaactctccaagaacatgttcaaattacctaaaaagagatggctgctaagctgttatgtataagataagatgggatcgaggaagagataggagcctggggtctgggaaagggtagctggggtggagtggaggcagcagggtgtgaatttaaagttagaggaagtcaaaaacttgggaaaacagaaatatccaggagagctttcaaagctctttggtgtaaggtatatgataaaaacctcttccctcctccaggacagcttcaggcaaatccatctagtttacaaattcttttgtgtgagtggaatttttagggaaactgaaagtcactgagttctaccagctgagaacaaaaatagctttatgagacagaagacagaaagtaaggcagctggcctctgtgttgtaggaagagacacatcttagatgtcctatgaggctgacagtgtctgccagataggggctctgcagcacagggattggttggactccaattgacagacactcagccaggcttcacttgtcatagttcaaggtgggtcaggtctagtttctaataaagcaagctccccactctctcccacccatcaactctctgcaagtggtgataatattttgaaatgagatcatcttgagcagaattgtattcttgagaatttccattgaatgtcatgctctggttagtttagaaccaagaaacttactcaaggaaaagctaaaatcaggaacaggaatatacagttatccgtatcatattatggccagttgtgggtcctagccatctatgctaaagttggttaactctgcccagaaacatgcagagcccaggtgacccacctggggctgggctcatgaccaggcagtgtgttctagattttagacttggcccacttttccaactgcatgtgagcctcttaataaacaacagtatttctaaataacaacaagattttcttgtattctgacactcaaagcaccttggagtgaaaatagattcagtggtccattctgaccactggatctgtggtgatgtcccactagtcatgaggcatacagccatacttttttctctgggaggagtgtatcccctgagagttatccaaggccttgagaattttgttatgggctattgatggccttgatgtctctcagcattgacatttttttcagtcaagctcaaagacatgatgtcaggacgtcctggtcgcagaaactcctccatttctcacttagcctgtcacatggctcctattgcttagctaggatttcagcagctgggcaaagggactaggcctcagcttttaacagcactgagaaagtttcagtgcctccttccttgatgcctatcttcccctggtttctgggatattgcactctatggctgtctcatgcctcactggaagtaatccttcatttttctcttttctctcactctgcacatccaactgatcagaggatttccagagtttgacaactgctcccctatcctctaccaccatctactccaagtctccatggcttgttacccagtcgtggccagaggagtcctaaatttcacatacagtttagtctccagagtgagtcctttacacagcattcttgctggagccagggagattgttgtcatatgtaaatctaaacatggctctcttatccaataacttgatatggcaaactaaaattccaaatccgcatcagaccctccaaagtcttaaattatctggtgcctgctttgacttcatcttttcaccagcaatattggtgccctcactgttcctgcagcacaccagggatgctcttgttaggctgggggctttgcacttgctcttctttaagccagcactgaacctctctcacatacactcatagctcagccctcactgtgttcaggcttctgttcatcagagagctgtcgctcaccctcaccacctcccattgctttctatactcttacattttttgttcttcatagaattatttctgttttcatattacatattgatctcccttctctaaagtataagcttggtatgttttgttcacaccctattcttaacacctaaaatagtgtcagacacaaaatagacactccataactatttgccaaatggatgagggtacaggtaaattaggggatgagaaagtacatggactcctaatgtgaagaacattcatatacaatagaattggattcattcaaacttttctataagccaatcaatctcttagggaaggagcccccattgtcacttggcaatgtccctggatctgaaataggtggggtgcagcagtggtggagagtcatggacaaactgatatagaagaccccatttgttcattttatttagcttgttctagagtctttggactagaaaagctatggatatgagccttgcttctgatatagcagctgtttgttcttgggaaagttacttaactttttgagcctgcgttatgcaaaactgcaaaactgggatgtatatagggcctccctcacacagttattttccagattatatatatatatatgtatatatccagcacatagtaaatgctcaataacgagtagctgctctgatgatggggataatgatggtgatgaggatgatgatagtggtggtgatgaagaaggatgatgatgctgtcactgggaaggccatattgcttagaaaaagatatgagcccaggaacaggagactggttgttcaaggcttccctctagctgggctgataagagtcatagaacaaagacatattggataaatacttctcatctgtcaataaccttctcctacaatgaagctcttccatccaggcccaggtcctctgggcaagtatggtgagaacatgactttgtattattcccagctcatggttgcagagccactgcaggtgttagcagctgtgattggatgacacatggaaggcaaatgattcagactcactctcagctcattgttcttctgcaaaagtctgttgacattcaccctcccgggcagttagaaacgtaaagacctccaggtcttgttcagagcagagccaggcattctgtagctcacacaactccccatggccccaatgtctgcctcactgtcatcactggtctcttgctgtgtgtggccaactacgtctccctgtctctctaggtctttctctttctttctccttctacttcttcctcattttccctttctcctcctctcttggctcttctcctattctccttacttagatattcctggagcactttctatctggattttttaaatagctttgatgcaggccatccaattgttttgggggatttttctggtatgagactcaatctccagaaacagacattttgatacctacctacatgtttttcagatgacagacttatccagtttttttcataaatattttaaataattgctgttgaaaattgctcacaatatccaaaggaaaatattcaaagtattcactctccatggtatctgacaggaaaactgcctgcctgttggaacaaacaaaataagcttgtcaacgatttctatagaaattttctattatttccctcccacataaaatcctataaaacattttttctggtgcagcaacttaaaaaataaaagaggctggagaggatacagctatcttactgaatgagaaataatttttctactctaattatttccgttctgctggtctcctctagtgttgggaaacagggagataaaatactctttatttcaacctattctggtaatttagataatgacaataattataagacaggaaaagatgtttataaggtgacccttttctaacttctatagaagagctcaaagtaaacaaggaagatgacaaattattactccaagccctgtggtgagtgctttacatctttgatctaattgaatcctagaaatcctttaacaagtacccacaaatagatgcgtgcacataaatgtatgtacacatgtccacagttatcttaggggctttaaaggtataccatctgaggctgcagggagatgccttacagtagaaggatctgggttgggagttgggaggaggctctgttttggacttgcttcaatccttccccactggattttcacatcctgagaagttgctctttaaaattttgtttaaattgacataaataaccatacatatttatgggatacagtgtgatgtttccatatatgtatacattgtgtaacgaccaaagcaggatttttaacatatccatcgtctcaaatttggattctttccttatggtgagaatgttcaaaatcctctcttctagctattttgaaatatgccatacagtattgttaaccacagtccccctgctgtgcaacagaacactgggactttgaagggatcctatcatatcactttcccctttgatattgctactgctagggagcgcctgactagaaagtcaggcaaggcgggactgatgccagagcaatcctggccccagggtgggcttggctggagcccagatgttgcccctgtagctgagggaaaaattattagcaataccccaacccagagaggggccagcctttccctccagggcttctcatggttagtgctggcagaaggtcttgtccttcaacttcaattcagcagatagaagaaaaagcctatgtatcaattacatgtcagagggagagctaagagccatgctctggggttgctgtgtgggtggtcccatgtaagtaattacactgtccacttccaggatcacagctttccctggagccttttgggaatgagactataaatagctctagctttgcttgcagggaggtgaccctcccaatacagttggctacagaaaagagcagaggaagtgatagaccctgtgtggcagcacctgcaaagcgtggtgataagcggtaagtggtgggaatgacatggagggcaaggaagctagcagttggtatagtcccctcctcagactcctcctgcggaccaggctgccattacacagccttcccaggcagggccaatctcagccgtgcagagagcatctctagcggactgtgctgggacccggggtcacagggcttccctgggcacagggatatccgtggttccctggagcacaaagcatgcgctgaggatgagctcgtgtcttctctggagtgtgaatgttgagtgggagggccgtgagcaggtggggctctctaggcttcttccagccttcttgggggaagaggccacagcttcaagagatgaagaaaggagagagccagaaagacccaaagccaaggagagaaagaggcaggggaaggtggcaatatgggaaaaaatgagaaagggaaagggaaagatggcaggagggagagaaaagagagggagagttaaagagaagaaaacaaaagaaagagagatgacaaagaggcagagccagcacacaagaaagtagagaggcctgggaccttgtttcggagcatcagttgctgtgacagccatttctgtgcaactccccggggccagtgctcaccaggatgggacaccaggaagctggctcttatgtgccctttctcttaaactatctgaggctggctccagttccaggaggagctagatgccgtctatgattcataaagactcatgactcatagactagggactcaatcaagctcctaagtggccccaaggagaggctgtctgtgtgaggttgagacctggagggtgagagagcaatgatatttggacacatcagcacagagggttcgtggggccagagtgtagaatgctgctgtggttggaaggctggttaatggtaagccttagggaaggattcaaagcccaagtaatctaacagtggcatctaagggcccccagttttctgggagaggtaaggtagggctacaggggtcctgggaattacagctcagacatggataagaaattcagcaggcgaccagaggataggggacaatgtagagtctctggagagaaggccctactcaattctgctcactcttaactcaaatagggccacttcccttcagtccctaacccctaccgcgccgtatctttcttcggagcaacttcttcgcttttccttccaaccactctgtgaaacagctctagatagaacccagggctgtctgacgccagagctcataatctctttgtttgacaggaaagcatccctgtggcagtgaaatctgggcataaggaggtgaacaatgtggggagtgtagcatatgggttgctcctgtgatggttccttgtgccagatggatggaacatgcagagagagcacgcactcagcatggagattacgagggtgagaggtgggaaacacagtggaaaccagaagccaaggttccaggacacacctgcaagagccctagccaccaggaaattggaggagcatacactcagccttcctcaaggttggcagcacaactgttattgaatcaaattcatcacctctttaatttaggattcctcctcctgactccactatactccaacacccaactcagctgctttccaggagcgactcccagaagtctgtgtttctcttgatgactctaggcaccaggggattccttctgtagatcagtcagaactgaactggccttttcatagcaacaggcatctgtttctatggaaacatttggcagggcagggagtacttagtagggccaggaagtgctgtaggcttggaaagaaccatgtagatattccttggtttgctccctgattcacaacataaattaaacgcctcatcacacactgatggttctaaccgggagtcattatgaacagctccagttccaatcactggagtctggggtccaatcactaccgacagcaataaaagttatcgtccccaagaagattctatgtcagccagcaataccttagcttttaggttaagtgacaccgaagtgtgcatagagaactcaggaacctgtctcggtgaggttgtcttgcaggcagaagtgtgggagtggtttggagaaagaagcccgtgctttggttttaaacaggcctgcttcccactctcacatcaaccatttggcacctgactgtcctcaaagatgttgcttaccatcttaggacctcaggttccttatttccaaagtgtttctttggaaatagcaacctaatatcctgcataacacctcagattgccaattatttggaatttcttttgttaccttgctttgatgtaagtctttgagatttcctcatttatttttagaaaggcattggacaggccaccataatatagtaatttttttttttttgacagagtcttgctctgttgccatgctggagtgcagtggcacaatctcagctcactgcaacctctgcctcctaggttcaactgattctcctgcttcagccgcctgagtagctgggactacaggcatgcgccaccacacctggctaatctttgtatttttagtagagacggggtttcaccatgttggccaggatggtctcgatctcctgacctcttgatctgcccacttcagcctcccaaggtgttgggattacaggtgtgagccaccatgcctggccgtacaattaaaaaaaaaaaattgaagtggcagagtctcaagtctcaacttcaattacctttcttattaaaggtccatgaaaaatcttctttgggggacttagaatctcccaagaaaatgctattctgtaataaaacttatatttttggtcagagtttgttcctcaaagcaattatatcttgtcagccttaaagaaattctgaggctacctagtaacagtacagcagtggcaatgttatgtgtgaaaatggtagaagatgaccattcgagcttaggtatgaatgccatttattgcaggagtctcagggtattgttcatataattgtgggaaggtcaggtatgcaactgattcacaggccaactggaaccagagatttgcatgttgccagggtccagtctctgtcccttaacttatttctttatcatcatctaccacaaactggcttccttcaggttgtgagaaatgcagttgcttataattaccgaatctcctgccattcccttgggtgacttgcatctgttagtttcagttggaaaatttgaaggaagagctactactggtaagtggctcacccaccagtgacttcatcatgaccaacgagtcagggtgacctggtgcaaacacatacaagggaccctacctctgtatttagaccatttccagagatgggagaatttttacttaaggagttataccaattggtgtcaattctagacctttgctggccatgatcatcctacatccactcctgtactgaatgcaaacagaatcccagtataaaatagaagcctaggtttttagagagagaatccaggaaaatcttgagaggtgtgtcctgggtttacatattccaggagaactaggttcttttcttctaacttttagttacttccacatcatcaaattatgcttctttctgatcagaaaatagctccatggaactggtcggaactagttacacataaccccagtacatcctgtccattcacatgtcacctcttgatatggtatggctgtgtccccacccaagtctcatcttgaattcccatgtgttgtgggaggaacctgttgggaagcaattgaatcataggggtaagcctttcccttgctgttcttgtgatagtgaataagtctcataagatctgatggttttaaaaagaggagttcccctgcacaagttctctctccttgcctgctgccatccacataagatgtgacttgctcctccttgccttccgccatgattgtgaggcctccccagccgtgtggaactgtaagtcaatggaatactttttcctgtataaattattcagtctcagttatgtctttatcagcagcataaaaacggactaatacatctcttttccaatgtattagttaaggttactttgtttcataatagaatcaaagcaagcttaattacctgtcccctcatactgccctccatctgcccacaaaacaactattgtacaattaggatttgagaaaaagaatagccagagattatggaaatttcctcaagaacaggatcatcctaccctttttgatatgacccatggtaagaactacactttatatttcacctagaatgcacatatacacaattgaaataaaacttttgcaaaacaatatttacccttactatctgcagtgcactgcaatctattctgatagtatttattttattttttaaagtgctagtaatcagttataatttttatgatttactaatgagttgtataccacaattttaaaataactcttagtctagagcacttcctttggtatcattcagtgccagctccaagttcttaatctcaatttaaatcacaaaattgtcaagaaagagagcatgttgagttctgcttgggtccagggactgccctgtcctaatcaaaaagagtgggattctacacatgactgttgatgcccatgtctgtataacacagggcaaattcagaccctagaagcaggagagacacttcagatggtgtctgctacacatggatattgggaattgagacaatgggtctaagtcagtcagacggtaatggaggccatagctccagggtcaggtacagccagggccagagttgaagccatgacaatcccgttagacccacatgcaaggggacttcatggggaagcagaggtggttaaagaagaagagaatggaggacagcctcttgacttcctaggcttcactggagtctggactctgcttaccagagttgatctctgacatttccctgttggagtgagacaaagtcacttggtatgttgggcccagatcttctctctctctctctctctttttcttttcttttcttttttttttttttttttttttttttgagacagagtcttgctctgtcacccaggctggagagcaatggcgcagtcttggctcactgcaagctccgcctcctgggttcacgccattctcctgcctcagccttcccagtagctgggactacaggcgcccgccaccatgcccggctaattttttgtatttttagtagagacggggtttcacagtgttagccaggatggtctcgatctcctgacctcgtgatccatccacctccgcctcccaaagtgctgggattacaggcgtgcgccaccccacccagccagatcttctctcttaaggcttgaatatatgttttgtggaattctgaattacgctaagacagaagggagagatgaaaacatttcagctgaaaaagtcaggtgggaaatttctccaattttaacccatatttttctccttaagcggggtggggactctgagactgtgagagagacagcatggtgtgcacagctttgtcattgccaggctcagtgatgctcaggatcactcctcccacagctacatccgtgcccaggagtggtggccaagtatggccaagtcatgttgttatagcatcaggcaataaaacatcagacaataaaacacaatgtaccaaatatctttagtggtggtgaaggctgggatggaagacagtgttagtgtggtttaggactgaagccagagtgaagtgtctgtacagtgaaatattattcagcaataaataaaacttgattcattcaaaaaaatgagctatcaagccaggcaaaaatatggttgaatctgcaatgcatgaaggtatgtctcatgtagttgggcttggcttcactgcacttttcacaaattgaaggttgtgaaaagtgaggcaaccctgaatcaagaaagtctattggcatcattttcaagtgtgtgctcaattcatgactccttgtaacattttggtaattctcataatatttcaaactttcttcttattattatatctgttatggtgatcttttatcagtgatctttgatgttagtatagtaattattttgggtgctacaaacagcatccatataagatggccaacataaatgatgaatcttgtgtgtgttctgactgcactactgattggtgattctctgtatgtatccttctcctcaggcctccctattctctggcacacaacagtattggaaatcagctgtttaataactctgaggtagcctctaagttttcaagtgaaagggtgagtctcctgatgtcccccatctcttacattcaaccaatatagaaataatttatttagtgaggaaggcatgttgaaagctgagataggctaaaagctaggccacttgtgccagtttgtcaaggtgtgaacaaaaaggaaaagttcttgaaagaaattaaaagtgctactccagtgaacatatatataaggagaaagcaaaacctaagattgtttgctaatatggagaaagtttaatggtctggaaagaagaccaaaccagtcacagcattcccttaagccaaagcctaatccagaacaagaccctacccttttcaattttgtgaaggttgagagagatgaggaagctgcagaagaaaagtttgaacctagcagaagttggttcatgaggtttaagaaaacaagctgtcttcataaaatacaagtgcaaggtaaagcagccagtgctaatgtagaagctgcagcaaattatccagaagctctagctaagatcattgatggagatggctgcactgaacagcagattgtccatgtagatgaaacagccttctattggaagaagatgccaggtaagactttgtagctagaggcaagaagtcaatgcctggcttcaaagcatcaaagaacaggctgaccttcttgttaggagctaatgcagaaggtgactttcagttaaatccaatgatcacctgccattctgaaaatcccagtgcccttaagaattttgcttaatctactatgccagtgttctattcatgaaataacaaagcctgggtgatagcacatttggtttactgaacatttaaaacccctgttgagacctactgctcagaaaaaaatgtttttttcaaaatattactgtacattgacaatgtacctcatcagccaagagctctgatggagatgtaagaggagattaatgttgtttacatgcctgctaatacaacatccattctagtccatggattaagtaactgtagatgtggcagaaatagtaaaagaactagaagaattagaagttgagcctaaagatttgactgaattgctgcaatctcatgatgaaatttgaacatatgagtaattacttcttatggatgagcaaataaggtggtttcttcaaactgtatctacctctggggaagacgctttttatatttttgaaacaacagccaaagattcagaatattttataaacatacttaacataaatagtagcaggattttagaggattgactcccattttggaaaactttctgctgtggtaaaatgctatcaaacattattgcgtgctacagagaaatttttcatgaaagcaagtgtcaattcatgcagcaaattttattgctttaaaaatttccacagccaccccaactttcagcaaccaccacactgatcagtcatcagccatcaagaggaaagcaagactcactgaaggttcagacggttgttagtattttttagcaatgaagtatttatttatttatttatttatttatttatttaagatggagtctagctctgtcacccagactggagtgcagtggtgccatttcaactcactgcaacctctgcctcccaggttcaaatgattcttctgcctcagcctcctgagtagctggaattatgggcatgcaccaccacacctgcctagtttttgtatttttagtagaggtggggttttgctatgttgaccaggctggtctcaaactcctgacctcaggtgatccacccacctcggcctcccaaagtgctgggattacaggcgtgagtcaccgtgcccagccagcaataaagtattttttagattaaggaatgtacattgtttttgtagaaataatactatttcacacttactagactacagtacaaagtaaacacaacttttatatgcactgggaaaccaaaaaatatgtgtgacttactttattgtgatactgtatttcaatggtctggaaaggaagccacaatatctataaggtatgcttatactgaaaagtaagaggctaatctaaaaagactacaaacagtatgattcaacttatgtgatatcgtgaaaaaggcaacactatagttttgatttagttgagatatggtcaacctggatggctctcaatttggagaatttcagaatacaaagtaattcttagaatattagagacacactcaagtttaacagagaaaaggatgagaaatagcataaacattgtgtaagcgggtttatatttatctcaatcccaacacaaaccctatgagttagagattaccaaaatctccacagacagaggctcagagagtttctgaggtccaaggtgggtttttgaggggggagaatgactcggtctatcagtgagaagaaagcatgtggagcatcttccacagaactcttctatgccaattataggaaagctgaagtcctgagcagaagaacaagaagtgcagtggttttctatcctccttctttctgtcctctgagaacatctcaccgtcatgggaaggcaaatgcatgagttttgattttgccttgagtaccttaatttcctttaaatgattgtgatatgttttgagattcatttgttgtcttattctaaaatgtttaaccaaatgggaaattattctctctgtgtgtctcttaaattgttaattctttattttcatattgttttagtttaatttattccttctatcattaagtactgtgtccatgaatatgtaactggcattgttgtttgtctctttctaaccactttgtactaattttttaaatcctaggttatcatgtaattactgttgccatcatttttctgtgaaatccacatattctagtttatggatataagaagataacaattatcaagcagcttttgtttccaattttagtctccatctgataaataattgcgattttttccaccccctctcttaaatatacccaattataatactaaacatctaggaactggctcatgtgtgcttgcaaactcagccttcctgactctaggtgatatttacatcttccctctttctgtctttggcccatgactcccttcaccccaaggagatgtatttggtgttcctacgcaggaatgcctccactgaatttttggatttattctcagtcatcacccaccttaaccaggacaaacctactcaacctttgtgtgcaataagctagaagtgcagtacctcttttcccagcatcttaaagagatttcagtgatgtaatttttatgattattactcatttaaaattcagtctgttttcactaggtcttgggtgtgagtctaggagaggtggggtcagtagggacatgaggagcagccactttgtggaactcagtactttacctccagtgaaacatcacccaggggcttgtgatcatttctgcttcaagctctctctaccctggggtaaacacttctagggggctcctaggcaaaggttccctggtgggggacacccttccattcttctaggctatgccccacacacacacacacacacataaaatcattatcttttcattgacttaagtctaattaaaaaaaattggcttttattctcagcccattacaaacccaactaaaagcatgctaaaaagatatcagtggtaagggcagtccatatttgagcagggaggtcatacatctgtttcctgaagttgatctggagaagccctctcaaatcatcagaatggatcttcatttttctgataacatggaacactgaccagaagagaatcacagctatgttgaatttacatatattaataagatgtctgaattgaaaaatcagtgccattgcttcaggttctgtattgtcctatagttcaaggagaatagcctgataaaaatatgttatctctaacaataaaagaaaagttcagatcaatatccttgatgaatctcgatgcaaaaatcctcaacaaaatacttgcaaaccaaatccagcagcacatcagaaagataacccatcatgaccaagtaggcttcattcctgtgttgcaagtttggttcaacatatgcaaatcaagaaatgaaactcaacacatgacagaactaacaacaaaaacacatgattatctcaatagacacagaaaagactttcaataaaattcaacaccccattcatgttaaaaactctcagtaaattaggtattgaaggaacatacctcaaaataagaaccatctatgaaaaactcacagccaacatcatactaaatgggcaaaactggaagcactccccttgataactggcaaaggccaaggatgctctctctcaccatttctattcaacgtagtactgaaagtcttagccagagcaatcaggccagagaaagaaataaaaaacatccaaataggaagaaaggaagtcaaactatctcagtgtgcagatgacatgattctgtatctagaaaaccccgtagtctcagtccaaaagctctttctgctgataaacaaattcagcaaagtttcaggatacaaaatcaaagtacaaaaatcactagcatttctatacaccaacaacatccaagctgagagccaaatcagaaaggcaatcccattcacaattgccacaaaatgaataaaatacctgggaatatagctaacaatggtggtgaaagatctctgcaataagaattacaaaacactgctcaaagaaaccagagaagacacaaacaaatggaaaaacatcccatgctcatgagtatgaataatcaatatcattaaagtggtcatacttcccaaagcaatgtacagattcagtgctattcctatcaaactaccaatgacattcttcacagaactagaaaaaacaattttaaaattcatatggaatcaaaaaagagcctgaatagccaatgcaattccaagcaaaaataacaaagctggggcatcatgttacttgacttcaaactatactacaaagctgcagtaactgaaacagcatggtactggtataaaaacaggcatttagactaatgaaacagaatagagaccagaaataaggctgcacacctatggtcatctgttcttcaataaatctgacaaaaacaagcaatggggcattccctattaaataaatggtgctgggataactggttagccatatgcagaagactgaagctggaacacttccttacactatatgcaaaaatcaactcaagatagattaaagacttaaatataaaacctcaaactataaaaaccctggaagacaagctaagtaatgtcatcccagacataggaacgggctaagattttataataaagatgccaaaagcaagcacaacaagaggaaaaattgacaagtggaatcttattaaactaaagagcacctacacagcaaaagaaactatcaacaaagtaaacagacaacctgcagaattggagaaaatatttgcaaactatgcatctgacaaaggtgtaataaaacttaaacaattttacaagagtaaaacaaacaaccccattaaaaagtgggcaaaggacattaatagacacttctcaaaagaggacatacatgtggccaacaaacatgaaaaaaagctcatcactgatcattagagacatgcaaattaaaatcgaaatgagatgccatctgacaccactgagatggtcagaatggctatgattaaaaagtcaaaaaataacagatgctggcaaggttgtggagaaaagagaacacttatacactgttgttgggagtgtaaattcttttaactattgtggaaagcagtatggagtttcctcaaagagttaaaagcagaactaccatcggacccagcaatctcactactggtatataccccaaagaatagaaatcatttcatcataaagaaacatacacacgaatattcatggcagcactattcataatagcaaagaaatagaatcaacctaatgtccatcaatgacagatataataaagaaaatgtggtacatttacaccatggaatactatgtagccataaaaatgaactagtttatgtcttctgtgggaacgtggatagagctggaggctattatcctcagcaaactaacacaggaacagaaaaccaaatactgcatgttctcacctgtaagtgggagctaaatgatgagaacatatgaacatgaagaaggaaacaacagacactgtggtctacttgagggcagagggtgggaggagggagaggagcagaaaagacaactattgggaactgggattaattcctgggtgatgaaataatctgtatgatgaacccccatgacacgtttacctatgtaacaaaccttcacatgtactctcgtacctaaaataaaagttaaaacaacaacaacaaaaaaaccccaaaatatgtgatcgctaccttacctggtcactcttcattggcaaagacagctgcataacaggataagcggttccatttaggaaagaacttccaacataatgctcacagtttaactttctaaagcaaccaaatagtcttgacatttctgataattatcactggaaagcgatgtatgggcttctgaaatatttgtaccttcataattcacatttccgttgccaggattgttttggcataaagatggtcccaaataagaaccttttcttggtgctatagttaataagagtttggcaaagaaagccaaactcttaaaaagagaaagcttgtggctttctttttaaaatgaaactcttttttctgtttatcaaagttatatgtgctcatcacaaaaactaagaaaatatagacagaatcacctaaatcataccataaagaaatggtataatcattattgtgaatattttttattttaaagtgtttagattctgtcattggacatttgggtggtcttagctaagttacttaacctctctgagatttagtctccttattttaaagatgggggtaataacaacctaactgaaattaatagggttgttgtgagcacttaatgcatcaatgtatgtaaaacttaacaataaccagcacatagtaaatgctcagtacatgctagttgttaatattattttcataattgttatcattataatgatccttattatttccacataattttatccttttttctatatatgctttttcacatagttgggttcaggctgtctatataattttgtatatagcttaatcacaaacattagaaaataaacattaacgaaagttattgcaacctctttgtacacataattgaaaatagtgaaataatattatacttagacacggaaccttaatttacttaactgttgttagatatttatgttgttcataatttttcagtattacaaataatgagacaagaaacatctgtgcataaacttacgtgcgggtacttaagcttatttcttcagagtgaaattactagttcaaaagtaacacttgggatacatcatgtaaaattattttctaaaagagttttgacaactcatattccccagagcattgtacaattgggcatatttcagtgggatcttgacaacatttgaaattattgttgagattagttcttttacaggtaagggttcatcaatgcatgcaacacagatattattgagcctactgcatgttagaaactgttgggcactgagatagagggggaaaggacagagagtctttgttcttatggaacttatacttggggcagatataaacaggaaataagcacaatttaaacaatcacttaattgtgagtatgatgcatgttataatggagaaatatgtgctactctgagcgattaaggaggcatactgatttagtcttgacctctcaagactaaggcttctttaagacagagacacttcatctgctgcaaaaggggtaagttggagtatcttagtaaagagcaggtgcagggaatggcattccaggcagagggaacaagacatgcaaatattggtgagaggaccatggcttgccagaggagccaaggaagagccagagaggtggggcactgagaagcagggagtgtgccaaggaaaagacaggctgaagaggtaaggaggacagggactaatcctaagattagctagcgaagctgaaaggattttagtatgagagtaatattattagcattttaaagaggctaaattggttagaatttgcagagaatggtttgtagggaggtgtgagagaaagctcctgaactgtatctgtggagggacaatggtagtttaagctacagttgcagatagagaaagaagttctctatatatttaacatttaatatctatctatctatctatttaacttctctatctgcaaccactgtagctcaaactaccattttccccccacagggcattttatatatatatatatatatatatatagagagagagagagagagagagagagagagagagagagagagacgttatgattaggaggtaggagagggagggcagttgaatgtccttggaaggtgaaagaaaagaaaagcatatgttaaatacagttttcaaatttctggtatcagcaatggagtagattattatgaatggaaatggggggagaagcatagttgaaagagaatggacttcagatttgaaggtgctgaaattgatctgagaaaaacaagggggaaagttaagcagtgagttgagaaaatgtgtctaaaacccagataaggggtcggggatggaataagtggccattacgatgtatatatattagtatattgatggtatatatattagtatattgatgatattttgaattgcagaagttggtgagatgacttagggacaagtgtagagtgagaaggaaaaagagcctggaaaaagccctgaatgattccaaagtttaataatcacctagagaaggagaagctagaaaaggatggagaaattctcagaggtatggatggaagctgaggtgtgcggtgtcagggaagcccagggaaaaatgtgctctcaggaaggagtcatagtgtgaattgctgaatagaagcagtcaagaaagaagaggattgaaaggtatctataggattaaacaataaccaggtgatggctgactttacaaatgcatttttcaaggagtagtaggggtggaaggcagataggaatgagttgaagtatggagaggaggtaagtaagtggaggcaaaatgtgtagataaatctgaaggaatgctttctgcaaagatagaaaagaacattggaattgtggaaaccagtagatatagttttaaaggtgggagaggctagaaaaagtttcaataataatgggaaggatccagaaaaaaggagaggatggagatactggatgtggaggagatactgctaaagccaggtccagggaaggcaggaggaggtgcaggccagctactggcagagaaattggccagaacaagaggagaggcagtttctcattttgatagatggccacaaggagaggacaggtgcatttgtagataggtttctataattggtggtaggaacttcaggaggttatcctatgctggtttaaataaccttattaaagattgaagcaaggtgattgacagagtggggctgagagacaacttggatatttgagaaataccgagaagatattgaaaaagttggttaagaaaagataattgagttaccagctggttgtcttggtgattatgtgtttacagtgacattaacttgcctactgtgtgtgattttcatgaattgtgcttggctatgtacaggcctggagaaagcaataggtcatcgatggctgcagttttgctaggtggcctcatgggaggaagaaggagtgtggaagtttagaggtttggaaagataatggtggactgtgagatctaagctgggtgaggaggaagatggagaaagtattggaagaagtttgggtgtgtcaattgaatgtgattgaagcaggcaaagtagaggcgctgtaaaaggtgttgaataacaagtggaaggaggtggtcagcttttcattagagaccttgtacaaggtgttattataggaaaacgagggtatatttggggattttgtgtactgaaatgaatgggccgacagtgttctgtagaagtaaggagcttaaggaagtgaaaaacctgactattcagtaagcaggtcatccttgtggaatcataagaatgatggctttttggagttgagccaagaagaagcaggtgagccaacaactttggaaaacaatggagagtgaccaaatgtctatagaggatgagaataaagaggagaggttggtgcagccaggagagctgagcttcattatttcaatttgtatatttgtaaatggagcattttaaatgtttaacatttgtacattgtaaaggttgacctgagtccatgggttcacacttgttacctacattgcactggactcttatgactttcctgttcatgacttttttccatttctctgttggagttttagtgtttttactcatttattgtacaagtcatttatatgttaggattagacaacttttttgtctgctatctgttgcaaatatttttctaaatatactttttgattgttgatttggaaactattaatcgtggatttgtgttaatcattaacacaaaaattagagccaaatacagaacttgtacatttttaagcaacatatctatgtttattatttcttttaatttgaaatttaaaatgttattccaaagttaaatatttgattaaaattgcattaaattttattgtacattttaaagcagttgtgaagtttagtatttaacttatttattcctctgaattttctctgtatttagttttaggtagttttctataattttctttctatataaccaaccatgagaaattaactttcccactgatttcaagctaccaatgtgacctcaaccagatcacaaaattcctgaaaatttaacaatatgctctcacaagctggtacatgtggctctgcacatcactgttgcttctgcttcattactttctgcttagagaacttcattaggcatcatctttgctttattaccccgatgaactttggaatcatttcgtcaagttctcctcaaaactgtccagttttatgataagaataaaattaaatccatgtactaatcaaataattaaaaattatgttatagagtaaactttattgcagtttttttaaatttgcataatgttttattgctttttaatatggaatttgccacattactctttctatggtatctataatgtcatctcttttatttatattgtttatgcaatttttggaagctggttattcctggatataaggaataagtacatttatcttatataaagtcactttgaaggatcaatgctttttaacctcattatggaactcagtggatcataaagccatgtgttccaccttcacaacccatattcattttttaagttcatttttaaaggttagtttaagactattaaagtattgtaaaactactactgagcattcttgtgtgcccttcacccagcttcccccaaagataatgtcttatatagccacagtgcatcatcaaaaccaggcaattgatattgccacaactaaagtatagaccctttgcagatttacaatcagtatttctttaaaaatgaaatagaagagaataggattatcttctagaacaaacataccagagggcatcataagaaatataagtatgtatgtatgtgttataaaagttttattttacttttattggtttgagatgtaaaatgtcagggctgtgatcaaaaagttcaaaaaatattgtgctagattctctttttaattacaataatctttcttagtacctgagtagatttagaatgtggtagttgtatctttgaaaagattaaaaaataggcatcctcattgtttaaaaggcaccaaccctgaggaagaaggtaaggtcatctcctggccacacacttctgcatcatgtcacatgacccatcaagttagttatttagatgtcaggtttcaatctgactattttaagctccaagtgttttacactctgggcaattaggatatttatctcagaatagattaatttcagagttgaaggatctatgagacaatttggatggaaagagttaggtaacttgccaatgtcaggtcagtctgtctctgaaattcacattttggcatttaacaatgttttgattgaacaaatatctcttctgattactgcatgtgaagactcaaggataaatagtttttaatttgtccttttggtggctcccagcgggaaggtatttgtaaatctagaataatggcacttgtgctacaatagttatgatggaggcgtttgcaggtgctgcaggcaaagcacagtgaagggcatccaacaggagaagtgttggcctcatgagcagttgagggacccctgtcctgagtcttgaaggctcagatggatgagatagggaagtcataagaactgaggaaagagcacgtgaaatacgcagaggtgagagactgtagcattggggaggtaagagggtaccgagatttttcttctttcactggtgtgtgttttgggaaaaattagacagtgaagaaaatacccaattcttacagtggcaaatgtgagaaggaccctggaagtcagaagagcgggtgtgttgtgggagggctgccctctgaggcatgttaacagtgctccataattaccacttgacaaggacaaaggcaaatccagcgatgcagagagcccacaaacctccaaaatcttacaagcgaatcaactaatcgtcatcaaatacttaattgggagcccgcccagtctgcactccatattccttatgtcatattccttatgacagaaacatcctaggcctggcattagtatgctgccacacttgcattcactttgtcgcgtcagtctgttgttttgcagccagcataaatcaatagtaaccggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgctgtggcgggagcctgtagtcccagctactcgggaggctcaggcaggagaatggcgtgaacccgggaagtggagcttgcagcgagccgagattgcgccactgcagtccacagtccggcctgggcgacagagcgagactccgtctcaaaaaaaaaaaaaaaaaaaaaatcaatagtaaccacccagggtgtagggattgttggaggtttggctcacaatgaaagcagaacaaaccccaaaccacaggcgtacccacagcctagacctataggcatctctgagacccagggagccagggagctattccagccctccgagatggctatgggttaggaataataaataaagttattcactgtttaatcttttcctacctgcatcccctgaaaacctcactcagtaaagggcagcttgtttgaggctggtgtgggaggaattccgatgaagctatgtgcccagatctgcacagtgaggcgccttgctactagatagatgtccctgcctctgcgtacccgccagtgtaacctgtgtggacctcatggtttggctgttgatacagtgggttgcagccagatggcgcctgagtgtgactgtcactcagagagcctgttcttcttaaccctctcctacaactcaaccctgttcaattatgtgattggaatttcttgaaaagaaataccagagacattatgattctagtgaagattttttttttaaatcactggaggagaggttggaaatgtcaaaggatctaaaagcactctggaaatcctctttggggagtatttttggggaatataattgtgtgtgtatgcgtgggtatgtaaaatgctggtggcaggtcaagggcctggaagaaagatcacagagctggagatgcccaattcttttccccatggaccaacaacttctatcactgatcctgagtcattggaactttgctcctcacctttctgccaaaaaatactggaggacttaacttttattccttttattcttttcctcctgaaatttgccccataccgaggtcccagtgttgacgggaggtttcctgaggctgtagaagcggactgtggaacacacagattaatgccaaataggaatctggctgtccagagtgtgggaggaggacctgttggccccagtcagagaaatgtgaagcttctatgagtctcctcatcacaactcagtaaagtactcttggatttttccacctgaccttgagtttctgttattcccctcttcaaggttcagctaccttcttcaggtccgatttgcttcttttctttctcttgattagtgaatcttaatctagcctgagggtaaaagtctctccatcaatggtccaaatattttgtttatgacataaatgctggaggctgagatcttcaaaactcaggcttttgaaatccagaagcctcttagttgcttgtgtgttgtgcaggtttcctcaatgaagcaatgctgctgctggctgagaaggcaggaaggggaaggggtgcagataaggagggagaggacacctcagacaccctccgatagccttgactggatggacagcagccttcttagggcttggatgaccacgatgccccataggtgctaggattgttttgaaaattcttgtaataagacatgaaaaacaaataagagacataaatatttaagtaaaattaattgatgatttgcaggtgacatgattacctcaaaaatttaaagcaatcaatttaaggactattaccattatacttcaaaatgtagaagagtggcataataaaaggtagacaaaactaaacagatttgtttcgctttaatcaccatcgataagatgtgaaatacaaaaaaaaaaagctattcaaagtaatagaaaacaagatgaatatacccagtggttttaggcacttcattttttcctgtcatctaccatatgacacacacaacattattcctatttttctaaaaagaatcttgagtaccaaaagagactttgctgctaagttgccatactacttcatcttagaatcaatagagcaacagaatataataaatacatagattctaaaaaaaacctctgtataatgaaacataataaaattgagagaaaaaggactacttactagaaaatgtttatatcaaataagacagttacaaaaaaaagataaagtgcttaaagagcttatgcaaatgcacaagcactcacaaaaacacaatcgtttactgtgtaaagaatgtgaacaaacaaaagtgcatctataattagcaaataaatgattggaaagtgcccattatttttagtgttcaaaaaatggctaatgtaaaagacctgtggaaatcattttgcagctattaaagaagcacaatgaaaacttatgataacagaacttgaagttggccagtttatggtcctgcttgcaagattattcactgatggtggtgtttgaggtggaaagaattcttttgaacagtgttgtaggaatatttagaatgagccataaaggtaattatatttcttgacccaaccatttcagaccctatgaatttatcctaaggaaatattttccaggaaaaaaactccatttttgcacagatgataggtttgctgcagcagagagaggggtgtggtggtttagtgcctacactgaggagtccatgctcttggactcataagtctctcactcaactacttggtgacttccagaagtaatgtgacttctctgtatctcagcttcttcatggcaataagaatgatgaagcctaaatagtgggttgttgtgatgattaaatgaattcacaaatatagagtatctagaaaatgtctggtgtattgtaaccgttctattagttaatataaactatgatcatgggaaacattttaaaaaaggaatcaattacctcacactaagaggattgtttaacatttatattgccctgacatgatgctatttataaaaccactaagaaggtattttgaggactttacaatgggaaaacgaatttataatagaatattcagtaaaataaaggactaaaaatgctgaagttactatgatcacaaccatgcaaaatatgtataaaggaggaaagacgaaaattgttctgtaggagtaatttgttggattgagggtttgtggagcatttttcttccatcttattttgctgtttttaattaaaaataaaaaaacccaataccattcctaaactacaagcacaccacagagatattgcgggttcagttccaaaccacagcaataaagcaaatatcgcaataaagttaggcacataaatttttggtttcacagtgcatgtgtaggttatgtttacactgtactgtagtttaagtgtgcaataggattgtgtctaaaaaatgaatatagattaattttaaaatactttttttgtgtgaaaaattgctaatgattatctgaaccttcagtgagttgtaatctttttgctggtggagagtcttgcctctaggttggtggctgctgactgatcagtgtgatgattgctaaaggttggaatggctgggaaaatttcttaaaacaatgaggtttactgcattcattgaccctttcatgaagaatttatctgtaacatgcaattatgttcaataatattttactcacagtaaaacttctttcttttcttttttgagacggagtctcgctgtctcccaggttggagtgcagtggcacgatctctgctcactgcaagctccgtctcccaggttcacaccattctcctgcctcagcctcccaagtagctgggactacaggtgccctccaccatgcctggctaatttttttttgtatttttagtagagacggtgtttcaccgtgttagccaggatggtctcgatctcctaacctcgtgatccgcccccctcggcctcccaaagtgctgggattacaggtgtgagccactgcgcccagccaaaactttcaaaatttgagtcaatcttctcaaactctgccactgatgtaacaactaaggttacagaatattctaaatcttttgttgtgatttcaataatattcacagcatcttattgggattagatgccatctcaagaaaccactttctttgctcatccctaataagcaactcctcatctgttcaaatttgatcatgagattgcagcaattcagtcacttctaattctagttctcttgctatttccatcacatctgcagttacttactccactgaagtcttgaagccctcaaagtcatgtagaagggctggaatcaacttcttcataactcttgttaatgttgatattttgacctcttcccatgaatcacaaatgttttgaaggacatctagaatggtgactcctttccagaaagttttcagtttactttgtacagatctatcagaagaatcatgaatggcttatcttggattttgacacgacttcctcaccaagcttaattatttctagcttttgattgacagtgagtgacttgcgactcttcctttcatttgaacacttagaggcgattgtgggattattaattggtgtaatttcaacattgctgtgtctcggaatagggaggcttgagaggagagagtgagaggggaatagccagtaggtggaacagtcagaacacaaacacttatcatttaagtttgctgtcttatatgggtgtgttttgtggtgcccccaaacaaaattataatatcaagattgctgatcatagatcacctaacagatataataataatgataataataaagtttgaaatattgtaagaattaccaaaatgcaacagacatgtggtgagcacttgctgttggaaaactggtacttacaggcctgctcaacgcagggttgccacaaaccttcaacttgtaacatatacaatatatgtgaagagcaataatgcaaagcacaataaaacaaggtatgcatataatttcttttaaacaccaccttttgctttgactgctctagagcacaaaatcatgcacagctggaatgaggctgtttgggaagcctcagtggggtacagaagacacgcaaggtgttgacagctgcagcaagcagcagcagtgggagctgcacacttagctgcactggaagcttgagccctttcagtagctcttgctcagctttcctgaccctatactctgctatggggagacaagtggagatcccctctgaccagatcaccttctgctgcctgtcactcaaaatgagattctttatgttgctttttttctttcttttttcctttttattaatgtctgtgatgtattttttcctaaaaatagttttattgagatatgattgacatacaaaagctgcccatatttaatgtaggcaatttgatgagtttagccatgtgcatagatccatccataaagccataaccaaaatcaaggtaataaacatatccatcaatttcaaaactttcctcttgcccctttgttttgtttctgtttgttttgttgtggtaaaaatgagagggagaaatggggacttgttcaataaatatacaaattcagttatgcaagataaataagtctagagatctgctgtacaacataatgctgagttaataatactgtattgcacactcaaatacttgttaaaagagaaattatttgatttttattaaaaaggttttaagggccttgggaaaccttggaagtttagagtcaaatatctgaaagtcccttcctgaggaagaggtggggaatgatgattgggttgctgcaaatttggcctggccttgtctttggagaggtgagctgacaccatattgaagtctgagactgggggactagtttataagaataattaaagattctctgtaattggtatcaacatgctggtcttagatcagtaatgatcaagtgctgctccgttacttagctgtgtgcctgggcaagttactttcctcatgtaagaattgaggtaataaatgtgccttactgtatggattttgtaaaactaaaagaaataataaaaatattgtcagtacctggcatacatatagtaagtattcgatatatttcctactttttattttttttttgagatggagtctccctgtcgcccaagctggagtgcagtggcgtgatctcggcttactgtaatctctgcctcctgggttcaagtgattctcatgcctcagcctcccaagtcgctgggattacaggcttttgcgaccacatccggctaatttttatttatttatttatttattttcagtagagatgaagtttccccatgtgggccaggctggtctcactgacctcaggtgatccgcccgtctcggactcccacagtgctgggattacaggcatgaaccaccgcgcccagcctgtttcctgcttctgatgtaagcagtcttcagtgaggttaggcaggcaggagcagggtagaaaggaggaagtggaggagggcaggcaactgttcaggacaaggtgcacatgagctagattgttaatttcaatagtcttcatggatcaaactgtcttattatcttctgcagttaagcatcttgacaaaagcagttatttcttccccagctcctcccttttgatgacattcgtggctgttaactcattaatttatgcagtgtcaccaattctcagaaaaggatgatttccattgaggctaatgaggtgacacccaatgaacaaggctgatgtgtaaaggagactcagctgttggtaagcagctccatgtgtctcttgcaattccagatgaagctactgccagtgaggccagaggccttggtcctattgagtatcagaatgtatccttcacaaatcgggaagtctcctccatgagagacatagtacccagaaggctggggtcacctttggccagacttgggtagcttattaatcttccatagcattgatgtttgctaaaatgcttggctgacgattaaaagatcaacctaaaagcattacaatgtggtttccaatcttggagttcctaggtcataggctaaaactggtaatcagttgaatgctgttgaacaagatggataaggaaaagaaaatatttgaaaagtatgcagaaccagaaccttttggtgagaccagactgtgtgcataaatatcaaattagggctagtctgcaggtcaggccacttcttttatcaccaagatgacctgcatcactgcaaacatgatgcagtggggggcctgtgtttattgcttgctgtgttaacagcaagatttgtgtctccggcaagactaatttaattggttcatttactcatttcacaaatatttgagcgccaagtatgagtcaggcactattctaggctctgggaaatcagtgatgacaaggaccagtccgtgtgctcaggaagagagcatcatgttggaagaaatggacaattaataggttgataggtacatatgcaatgtaatttcaggtgcataagactacaaggaaaaataaagcaagactaaatggaaggtgacagggagtgaaagagctatttcagaagaagcatttggggaactctctaaggggattatacttgggcaaagggctaaatgaagtgaagaagtaaaatacaagacctgggggaattgcaacaagaaatgctgttggctctacctcccaattatatacagaatatacacacttctcccaaccttcatggccaaatctctgaccccattagcattaattccttattgtgggtcacccaatggcctccagaccaatatccttgctttactctctcttccctcccatcacacacagtctattcttaacacaatgtccagaacacatctttaaaattctgtcatttaatgccattttggtgctaaaaatcctgaatggctccctattttgttcagcatcaaatttcaagttcttaccatggcctaggaggactgatgagctctagttatttcctgtggatctgtgaacaggatgagtgctgtgtgcaatatagggatgaacacttgttccccattgccatcctaaaccctggaggaacaaaggtttctgctgcttccatttccagctttctaggcctgttgttgactctggacatacatgaggaggctggaaacagtggagactgtaataagagtttaggaataagagagcttcctatctccccgtctcattcctggaaaacaatgagaggatttggtaaatggcaaggcatcaaacttggtatattggttagggtgggtaaaatgcacagcctccaattttaatattttaaaacaataaaagtttatctggggtccatgcaaagtttgggggttgagggtgttcattctactagaactgagatccactaggacccagagattttctctatctggtggtttaaagaagaaagagagaaaacatggaggatggcacaaaatattttggagcttggtctggaagtggtatagatcactttctacctacattccactggccagagcagatcatatgcccacctccttacaaaaaggcaggaaagtgttgtttcttatgtgcctaggaaggggaaattttggtgaagatctggtcatgttctgctacccctggaagagctggatcatggaatgtgagttggtctaaatgttgaaaatttcaggcaaaggaaatgacatacagggcacagtccagtacagacaccagagaagtcaaggcatatttcgggactttacatgtcttttttgacttgagagaagggtattagtggggagaatgttatgagttaacacctgagagaaaggctgcggtcagactctgtggtgccctctgtgccatgcgaaagtgtttgggctttgctctgtagtaaagaggaagaggccatcaaaagactttaaataaaggattttcatgtttagagtgatattttggaaagtcattctaaaatggaggaaaagactagaagcaaggacatcatcaggaggctgctacttctagtattccctatctcagagattctcaaacttgactcacacataagctatgttttccaactttacacagcactgatatatttatgtatagatatatacatatcgcatatgcacatatataaaacagttcatgatagtttgtattataatatattttatttttttaaatgatggctgccacacattaaattgaattctctaccctctaatggattgtaaactgcactgtgaaaactactgccctattttattaaaagacagcaccctgcagacagtctccaggcccaaatctgggcatcatgtgaggcaccccagtcatccttacatgtctctcctccatgagagacatagtacccagaaggtaccccccacagcccattggtcacattacttctggtctatttctcaagtttccctcacctaatttttgctgtcatcactgtttagatgggtggcttgcaacgcgtggtctagggattcctcaggctctgcaagaccatcttatgaggtacaaagggtcaagaatatgttcacatttttatagtcacactgccattttcgttttcactcttattctttcacagctgtacagtggggttttctagaatgatgagtgatggcatcaattgctctgatggcaaatgaaatggatgcttgtgtagttgtgtgttttcattttcttttagttttaatgctcaatatgttaaatattgatagatgtaattaaaaccttgatatttttaagagtgcagtggggtcctgagaccaaggagctcaagagcccctgttttgcactttcatgattgtgaattctcattatcaccatgaatgcctggatgtgattttgtggcctgcggtgcctctgaacaaacactcatagtcgattatctggccctccacctcagcagtaggatttccttttctgattactcagaagaatgtctgccttgtgatttcttgagcgctattgccaactctgtccttgatcctcggcctcttcattgactttagaacattaggattctgcttttatactctaaaggttggagggtcctatgctgagacccctaagttactctgtcagaactcatgcatttgttatctcatctaattccaaggctgtgaacactatctacagtctgaccacccagacattttttttctctaattccgaccctgcttatgaactccagacttgaatgttgttgtacacatatgcctgctgctcacctctatatagatacttaaaatacaactcaaaattatttttcccataactgaattcctaatttcttctatagctccttctctcccaacttcctcacatcaacaaaaagcaattacattatttaagatactcaggccaaactccttggcttcctcatcagctcatctctttgctaatatatccagttcactaataaattatgttgactgtattatccatgggacagcatttcccatagattttccttaactttgctactcctaccttagatgtaaccaccatcatcttttgtctgaacttttactatggcctgctgatggattttctagcttctatccttgctccttgatattcaaatctccatgcagctgagaggcctctttatagaatcctctaaaaaaagaaacccattttcagtggtctatgtttccagagccacttccactttcctttgaggggcccagacttcgaggctctgtgtgggagagatttaccctcatgtccagataaggttagtccctgttacttctctaggaaactaatctcaaccagaccaaaactttcttattaagaccacactctagggatgatacacatattagagggatccagacaccaaagctgtcaaagtctaccaacaaaacttaactacacacaatacacaatactacctattttagacttcagaataaccttggaaagttagaccaatcatgcctggtaggcagtttcatggtaaaggtgttaggctctctggactgaggattggggtcaagactcaaagcaaggcacagaattctagaatagaggtctctggtccaccttgagctcatccatatgctctgtcacccaaagttccctccctcacctgacacagagccaagagcactctctagtcttgtttttttctgaggctgagatagaacaagtggttcccagtatctggggacatgcccaattaaattaagaggtaggcaggaagtcacatgttaatgagtgagtcagaacttattactagggacacagaaacaggattcatctaagaagaaagaaaaagaaaaagatcaaggcatgtcaatgactccatatggcgtgagtgaccaagtagaaaactgagataagatctcagacagggaggagagaggtgtaagacaaggacccaggtgaacaggaaaaaatggggtacatgtctgaaaacagtggtttaggcacagactcagatacaggcaacatccaggctgacttgatagtgaaacccttcaacctgttactattccacttgatgaagtttttaggttgtggttagatgagagatagggcctgtggctcccagcttgcctgttttagatgtcagttttgggcaggcagactaaaggacaggagccaagaaaaaaaaatgcctcgctcattatcttgctttgtgccggtcctggtgtgcagtgctgcacaagcattttctcatcgatcctttaacagcctgttagaaagaaattattatccctattttaaaggtgaggaaattgtgatttggtgacatcaatcaaatgattcagaaccatacagctagagaactgtagagtaagggtttacatctggtgtttctgacgccacagtccatgcccttaaccatggcactatcctctcaattatgagtcctgggggtagaggactatccgcacctaagtaactaaacagtgtgtggcttgagggcaggtaccaattgctttcttctgtgtgttattagcatctgacacagaaccttgcaggtgcttggtgaaaatgcacctaaaatgcactaatctcattttatctttcaaataatcaaacacacatgagtgtaatttcagcttccactactttaagaatgggcactagaagtgggtccctccagttttatcagttaacttttacttgattgaacctcagcttccactattatcctgtatcttatgctttatagacctaaaaccatgaaccccttagccctacaactcagagggacaggctcactttctcttcttgagaaactgccaggcttgttttttactataactgatatttccctgagtatcaaattccactgttgtggtgcacatccctcttctaaagggatttatttctttctcacccagagggatttgagggttccttgttctctttcctggaggactttacaccacttcctcttcctaacttgccaagcctctgtatggttattctcaaactggttcctgactgaacagcaccagcaccacaagggaatatgttagacatgcaaattatcagcccccacccaagacctattgaatcagaagcttgggggtggagccaaatagtctgttttcacaagccctccaggtaactctgatgcacattaaggttagagatccactattttcagccctcagagagctcattttgctatcttgagaacttcacaataagaaaagggaggctgagattcaatttttgcatcaaaatctcttctcaccagtcatcaccacccagcagagtcaaatcgttcaaacttcctgcagatctcaagaattttcaagctgagcctctgcccttgatgctctgtcagctttgtgtttcttagagaaatgtattcttatcattgtaggtgaactctgatgcctctttattgtattgacaggtccttgatagagtataaagataagaaactagattttgatgcaggatgtgcagaattagtttaggtggtggcaagagtaaaagtagatgcagagaagtgaggaggaaaaatggcccagattgggatggaattagttcccttgcttagggatggtgaagtgaatgtactttcaaggtcagtgcaaggctggttttgaggtgggtggctgcacctccctaggatggagagaagtaatgctgtcatttctgggggcgtctaggctactggagtagagtgaccgtgggtggaggatcatgatgaagaccattactgacaaggtacctcaggaaggacagcaaggagtctggacagaggtggctgccctaggaagatgaaggcagcagctgcaggggtgaaaggaatagagagggcatttgcaaagagaacagcagcacctatgagaagagagggcaaggcttgctctactgcttctgctgaaggttatatcaaagagcaatcaccaagcctgcagctttgtgttaagtgttctgttggggtctggtgtaacataagtgggcaggaggggtctctgtggaggaaaaaggggaggtgccaggatcctagcaggggaaggccagtgcttggagagacacaatggatatgtaagtactgcagcagggaaaataaattgttcattccataaacaggaattccatcctcaccattttccaggcactatgcctttccagggcctagggaccaagagttatatttctaatttttctttgtagttctaacttgccattctcttttttcccactctcttctgttctgtgggtcatgtcttgttagtgtctgtagattggtgtagtctaaggtgcctcgtgtcaagctgaggtttccgtagaaacagatagagattttgctttctgagtcttgcagggagtatttctggcaatttgtaagaaatggcagagtgttctttgggcaaggtacttgcactccttggaggagaaacaaaataaacagcacgttatccgagagcagagatgttatgttttatttttctgttttttcctttcccactgtgtctggctctgcaaatccacctatgagtactttctgagcatctccaagtgagatgtgttctactccagtttttccccacccaacgctggtgctatctcgcctcctccagatatagtccagagggtgtctaagaggagagaggaaggagaggtgggaagaaaagatcgccattgagggcatttgttgcaacaaattgagagagtgagggatgatggtttcagagaagccctattgattatgctcttgaaaattttggtagtttggggtcaaagttatgctatgtatgctagaaaaccttgtggaaatttgatgtttgataaaaatatccaggcaatggtaatgattatgatcttaaaatggagtttagaggcaaaggcaagatcaaaaggtaatcaatctaaattccataatgaccatgtcagaaaggcttaaagagtggatagaaattagaatagggaccagtagtagcgttatgagaatgggttaataggaccaagtctgaagtcagcagatattccaaactactttggccttcatactcaaccgctttgtctctgtggacggcccttgaatagcccacagtctgttctctatggattgtgacacttagtgagtgataatctacagcctatgttgttttagaacacacttatagtttccacttgtgatacaagcagagctagatagttagtgctgggctcctttcccattcctttacttaatgtgtggggtttatgtaagtttactgttcatttaaatctctaatgtgtggctgctggatgtgatgaaggacctatctggatccaagcaatattcttggcaagaatactcagatgcatcaggaatccatcagtggattgttttcctagaagtgatgggtgacttctgtaggtgacatgagaacccccaggaggttgtgatcattactcaagatcccttaaggaccaatgtctctcaatcagtggcaagggttaatttttttggctcactccatccatctcattagataatgaccctgctccatattgtgggatgtgtatcattttggggatgagaggaagagattttaaaagatgatgctatgtggagaagtaggtcaattatcataaactttatggaaatggtgacttacatccaggcttgagatgttaccttgcctacagctgtgtttccagagggtaccacatgattaattaaaccactcaagaatgtgaggaccaaattgttcttcatcttctttaggttatcctagtgactcctggagccacagctagtacagagtcctcaaagtattgatgaaacaataaaaatatgacttttaagaaaggagagataacttcatttgcacagtatttcccccaagagaatggtgagtgtggtggtgttgaaacagggctgcatgttctatgacaatcttcttacaaaggtatgaaaatgaacaatcctcttgaatctggatgggtttgcgagtgcttcaaccaagagaacttggcagaagagatgctatgtgacttctgaggctaggttatgaaggccatgagcttctgcctcattttctggcatactcacccttggaatcccgttactgtggaataaagctaactacacttaggctgctgtgatggataggtcccatgtaggtactctgagccaaacttctagacctgtaagtgaatgagactttcagatgagacgacttgaatcaactccacccattcaagttttcacatctggggctgcagtcattgtggagtggatataatccatccctgctctacctgatccaaatttttgacctatggaatatgagatcataataaaatatttactgttttatgccgctaaactgtagggtggcttgtgttcagcagtagattattagaatggtgggtaaagctggaatttgcacaacatcggtagctacacattgtacacttcttgttctacatttgtagaatttgtcaaagaaaggtatttctagttactagggatgggagttgtaaaagaaagtaaaaaactttaggatgctttaaatttattatgccaagggggaagttaagccctagagacttggtcacgtagcatgtttgcaattctgcttcttagattatagcttaacttttttcctcatttttctcattctgtaaatgactaggagagaccagagaccagacctcttccccttccaatcactgatctttgttatagattacctgccccctttattgtcctgaacctaagtcagaccagacggcaaaaaagacctcatgactgctacgtcttcagtgtggaatattaaatatacctttcttctaaaaaagaccccttaactatgaaatcattttagctgtacattaaaccttgcagagaaagatgtcaaaattctgtcaaggttctctaaactttgtctataaaaataattacaaacttttacacttcagaacactgacttccattcactggaatttgttttctgggtggccatcctcaaatgttgcacttgaataatagattctgactcttttgattattttaagttgacaggatggagtaaacaatgctgccatcatcaagaataagtatgcctccttggagacaaccatataccatttagggggactatccccaggaaattagtgggtgggggactagtgactcatacagtaagtggctggttggttctaggatcacgtacatattaacattcatggcctcactgaagatcatcaagctttccagttcccactgtgctccttttggcaaggatagttggtgtattaatcagtgtccattaaggaaaaacagaataccacattttatatagggatttaaatttgttatgtagattgtaaccattatcaattattacaagagtgctgtataacatgcttcctctccagcccccagtatttgatggtttaatgcaaaagcattcatttatctcatgaacatagcgatacaaaagagaagtagtgaggacactggagctgcactagagcttgggggaggggcccctgcagctccatcacttgagctatgcaggtggctgccatgctgctgctgatggtggggcacctgtgtcactgctccagccactaaggggaagctgtgcagctcctaaggcactactgatagtgattggagctgagagtgccaaaagattctagaagttgggcctacaactgtctgctctagtcaccagatctgtaggcagaaagagtcccttcttccctttactaaccttcttatctcctgccagtgcctctcattggccaaaaccgaaagaaagacagttgcaagggattctgggaaatgtggtttgaggactctgagctttacaatcaccaagcacaggagggatggtctcagagctgaggaactctggataaataactgacaccactgggaatcttaacccttggaatcctcaaaaaatcctccagaattctgtccacaaatcacagtaagttaggactctttttggttggaagaaaatctaaacccaagttaacttaagcaaaaaataaatttttggcctctatgactgaagaatcccaatatagctaggtttgggtaaaggattaaatgatttcaccaggacctggtctttctccatctctcactctgcttttctttttttcttttctacttttaggcatgatctcttaatatggaagcaagatttttctcaacagatttaaaacttcacagctacaaaaataacataaatagggatacttcctctccctttcaattattccaccctatctccctgaggcatctacgattggttctgatatttcatgtgaatttaccaagtaaattttgctaagttcaaccactaaataaagcttggattaaaggattggtagtaatatcaccttggactcaattcgagtgtactttaccttgctttatgtccaaagtatcaaataagttgtgcaaaaatcatacatacagatgagacaaggaagcatggatgtgagtgaggttccccattgcttttcttgttttactcagtcttagcaacctgtatggagaaaatatttcctgggtcagaggataacatgccttttactcacccagcctctttaacatccagaaaagtatttctactatgatccaaggaaatcattattttaactagcaatcaatgacccaagcatactctctggacctcaagacttttgctacactagccctgagcagctagcctcccctttcctgcactaaacggtagtgcctagggagtttctatttatatacacatgaagtctttccatggccaggcccagtcatggtttttcacaccatctatgcacatactatgtcatggggactttgatatcctcattgtatggattagagtcatatgcccatccttggacctaagatgagatcagcttaatccagtgtatgttcaaaagtaagggggaaggataacttcacaaaagaaaatattgaggcaggggtgagggtgcttttatcagaagaagagagactgggtactagggagacaagtaaaatcattctactagtggtttcctcttattctgggtgcaggagactctgaatctaggtccttacctgtgcccagcaacctgggttctgagaaaggacaagtcttcaacactctctccagttcttgatgttgtttcccaacacccagcttatccattctttcccagttgccatatattcactgatgactgttgtcgacacaccccagaatgccatgtctacaaccttggctattgttcccccatacttggcagctgtccactcttctccagcatctgctgccttagcaatgctatcctgagtgtgaggaggcttttccaggttggtttcctctctagcagggttttgagttctttccaactttggtgttttccaagatgcaatccattctgtttctctgcagttggggagttcccactagccaagaattacttcttgttaaatcaccccttccaaatgttttctctacaaccactgtaatgaactgacagatgggtgtcttatcttcaggagatataatgaagatttattttctaaactgttagaacaagccaaggttatcatacaaaaaagtgaacatactgcagattgcactcaattcaaccaaaaatgtcaatttcattggatatgacttttccctccaaatcatgttgacaatatagataaacttgcacatacagagcttatatcatcttgttgattgccttgctgatatatattaatttttgagaaaactgaaacttttgttggttccataaatcttactatatttagaataacatttaaaagcattaactctgggtaatagttgcattcatttgattctcctgtgtccttgagaaagaaaggatctgggtacctcatttgggcaacctgaagaaaaatactcacatgtatgggactatcaggtccatttgatacttaactataaacaatgagcttctgggattagaactattacggtagctcatatttaaataggcaaataaatctgccttgagaaatttttaattcctagaatcataggcaacatgttactcttgtgaataactaatcacctatcctgttacttgactttctaaagggctttattctctggcttctgtagcagctccctccctccctcttcctctattaaaaggtcattgcttaggagtttgctcagaggttaaatccagctgtattcctacagattttttttaacagtaataagcaaataccacaaaataattagcacaaaataattggcctctatgtctgaaatcatcacagaggcttaaatgccactgctaggtggtcaaaaatttatgttgaatgttctcgtggatgaattggctttatacccagagttagcagtgcaagcaaaccataaaaaaaaatgtactaaaccaccaactgacattatggaaataagaccctggctggccaaaaaccacagtgtatcaattagcaggattttagtagttggcagagagaactctggttctggaaacagaatgctacatgttttatgtagtcatgtaatatttcccttgtattcaaagatggtacataacacctgctgtgtgcatcgaggaagctcagattactgtgttaatgtttgcatcaactgagtttggaccgtctatccattaagtctggtgaatgaaatgactaatttaattacctaatggattggtctatttgcttttctctccacagctctccatagaaatctcaaggacacaacttttccccccatcttgtggaaggtgaggtgataggaatcttgattgcctgattctttccaataggactttacagaatggttgaatgaaccttggtgtgtggtcatcacagcagatgtgagtgacagatgttgaatttgtcagttgaatctgtcagtccttccagagttcagaggttgtatagaggaagttcacactagccagactcataggtccccaactctggaggtaacatatgtttgcatcagacagtcaagaattgaaatgttggcattgccatttattagtttattaactttgggaaaggctttattctttatgaattttagtttcctcatttggaaaatggagagattacctacctaatataattattgtgagaatggggaataataggtcaaacacaaatctctgcttggcatgcattaggtaccactaaatagtgttattcacttacggcagcagtaaacctggcaggacatcagtttcctaaagcaggtaaaattacatcctggaaaggtgtttggtgctcataaattcaggataaagatttttggatgccttttaaggaaaatttgtttgtttgctttgtttgttaaatccattaatttcacccttgaccactttgaaatcaggcagatcttattttccctgtagcctctgggaagttactggatcttcccgagtctcattttctctgcagtagatagaatggacaaagtagtcctggttttctggtattgctgtgaagattaaataagatgatattcataagccaccttgtacagtatctgcacctttgtggaataaatgtgataattaattctcttctctttcttaaattttaaggatgacattttctgatatttgcttcaaactctgagtgagaccctatgcaggtcccacaggtatgtaagcactaactgtctctcctaagtgactgggccactgtccttgcacagacctgcccatcttcccttactatgtttcagtaaagacaaataagactgaaggtaaagttaaggatgttttaccacccaattagcatttgtagctcatgctatcctctttgccttggttttgataaaagtcccagaattttattaactttggtgtatcaattgctggcattcagtcagtgcatctacaaatttgcaaaccaacttagcttaccctcttgtattagttttccattgctactgtaacaaaatgcaacaatttcagctgctaatacaacacaaacttagtgtcttacagttctgtaggtcagaaatctgacacaggtattcctgagctaaaataaaggtgtgcatggggctgcctttattttgggatactctaagaaagagtctgtttccttgcccatttggttattgacagaattccattctttgctgttgcagccctgggtccctgtgttctcgctggctgtaagctgctggcagtccccaggttctagaggctactgcagtctttggctcatgatctacttcctcattcttcaaagtcagcacgttcttctcacattgctcagattcaccctgcctcttccttgtctttcactttaaaggaattgtaagattaaatctgacccacccagataatccagaataatattcccatctcaaggtattaatctcttctgcaaagtcccttttgcatgtaaggtaacatactcacagattcctgggtttaggatgtagacatctttgggggtcataaatctgccaaccacatctctagacagacctggagaagtagagaaagcaaactgaagtctctgaggtattttgattttactacatgtgacttgaatattcctgtaaaaaaaaaaacctgcagcaaataaagagactgtagtatgcaacagattaagatatttaaaaggcagaaaaaaagagcagactttctagtacttagttacaggtcctgctaactacagtttaaattatcctttaaggaatttttgacaggttggtaaattacaacctacacaaccttaattaattttgtcatatctccaattcactcagattgcctgagtttttttccttccatattttttttagtggctctgagtttagttgctctcccaagaaaattgaggcacaacagaaagaacagctgtttttttttttttcattcatgctgtgctttttggctgaattcatcaaggcacagaaagatgaagtatactgtattaaactacagtaataacatgaagcaataatgtgggacagtaccacggtattataagcgagagaataatatgggcctataggttaaataactcttagcattcaaactccagaaattactctcatgggcattttgttaggtgaaagtgactctaagaaaaactgggatggtgtagactaggagaccatgtgaggcagactgggagagggtaatactaggtaagggttcctccatgccagctgcacagtaggaccacctagggagctttatgaaagtacgatgcctggatcccaacctcagagactctgatttaattgatctgaataatttttaaatagctcctcaggtaattctaatacgcagtcaggattgagaatcactgcatcaaattagcctccattatactagcgacagttctgaaaatccctgtgatgaggcatcaaaacagagggttttaaggggcagggatagatcagaagagtcaagtgaggctggggttccaaggtgcagcaatttgaggctgaacccttctgtatttctggcattcctactgtcttgcctgtccaatgagatagagtctgggtctcaggactctggccaaaagatcaaaattgatttctacctctaaggagcctaggccctggagcacattttattcatttccagaagaaagaaaccccttctcactgcaattcaagctcctatgggtgtgccattatgggagtaagtgtaaaggggtagactgattctaaataccttggtgaagataattccccaagctcctggctttttccctctcagggatcctgtttgacttcttcagtgccagaagcctttctactcgagatccaggctctctctccatggtttgaggctctttcaaccctgctgctcaccaaatgatctctctactggtgtcatttcttcttgtcctggttgtaagagctgagcctttctcccagatttgaagagagtttgatgttgatgtcatgacttaggcatatgatcttcactgagtggcaggtagcctctggggcaggtaatgcttctggaacagggttacagaccttaatgagaatctcaacagcaaagcccttttatataatagtccttcaattataactttcctatttattttcttatttcaggttattttaatctatcttcctcactgacacaagttctattggggctgagaccagagaagacaatgtgagaccctgcatccaacagtattccttttagaaactatgcccagactgagtgggtgcatttttgttctaatactttttctcttctgtagtttacacagtaggagataatctttgatatggcaactatgtcattcccctcagtgtgcccaacaactcacatctcatagctgcaataggtcagagacaaattccattatggagtaaggagacagtcttctaaaggtgcattgcatgtagtgaggtatagacatagcaagcaatgaatgttacatcccaggagcagagtctgagagaagacgggtagtcgtaaatcctgaaattacaacaattccatgtaattcatcagcttctgagtatctctcaagtgacatttattagtagaaagctttgtagaacagagcggtatgctggctagccaagttgattgcacttcgagggtgagtggattcctgaatcccctatttagatatagggctagaacaagattgaggagccagtgtgaatattttcatctggcatttcttttctctactgagtgaattcctttctccaactcccagaacattgttcaatgaggtaataaaaactacaattccagaaattgtagttggatactactttgataataatatcatttgaatcttagcctttatttacaacacttcatttataggcactatagttcccagaatgcaccagcaacgtcagtttcctttaccccacaattttgcttcaatatttttttggaatttgcattttttacccatatgttaaaaatacctgtctggatgaaggaaaattgaatctgtgttcagcctatattacaaagcaccattttctgtactaagggttggactgtatcccagatttctagttggactcatgtctgaatcaagcagcaaatggttaagaaggcactcatttttttcccctacggttttgaagttggtctatttttcatacagttaaagtggggttttcctttgacagaagccttagtaggattttctcaagtcagttttctctacgtcaaagttagaatctattattcccagagtctagcattggtgtatgtgactttatttagatgactgtattttcatgttttccccatgctctcatctgtcttcaaggctgtttatcatttctccttattttaaaccacatgcctcaaatgctttttgctcctactctttctcctgctttgctggagagaaagcatgcctgactttgtcatggtggaaatatcataattcttgcagtttatgtgaactgtgattattagcgattgaaatgttgctatgcttaggaagatagtaaaggtagagtgagatcctctcaaaaacaagacaaaatgaaggattgttagggccattcttcaccagtaaggatcatgtagtgcattctccatcatctagggccattctgaggactgtaatgatactgaagggtgacatgacatgcatctttatctgccccctaaatggagagatggggtctggcaaagcaggtgtcattcaggcttttcccctcaatgctcagatgcccatgtaaggttgggaaaggctatcacagccctgtgggtagaaggtgaagagaagatgggacatggactgtgaggataagaaggacatggggtggtggagagaggagggagtgctaggtgtgggtggggaggagcttgcattaatggaaagcgggtgggaggactggaaggggcctcaggatagagagggggaatggtgtgagaatggagggggagcctggagagaaggggactcatgaacggaactgaccataaggaagcttcataaattaaagacataatcaatagacaggcaacatggggagataaaaaggtattgatagcttgaaagataaaaggaaattttaattacactgtgattgataaaatacgatgaaaagtagttctttggctgctccttgacactgttccctgtttggaagttctgaggataaactaggattctagaggagggagtcagacctttgccactggatgctgtctaagcagaagcaggtagctattgggtcaggatgtcctaagaatactgagttgatcatccctctgagggccatttgcagtatgttatataataacctcacaggaccttacgcatcaatcgcacacactggggagtttgtctttagggacatttgttcaaatctctgcagtctgtctggaccaatgtagagctgctttagctaattcatatactaccctctcattccagcctgatagtcacaaaaggtcagatttattctgcctttataggacacctctttctctagcttgaaagtatcccagttgaagactcccgtctagggtccgaggtaagttctctgccccttcccagggcctgcactggctgccacaccatggcttcatccttcagaattgaggagccacttgcccttctgcagcaagagatggataacacaaacaccagatgctgtccccagtgagtccatgcttacattatgctaccatccatgcctttccccctaccttgtcccaccctaccaatctgtaaggtttaaaacacagcaggccacggaagaatttgcacaggatccaattcttcctctgctttctaaaacaaaataagtctggagaagaactcagagtcatatttcactgtagtctcctactaattaattacaagcagccacaattcatcatactttcaattaacaattaattatgtacaagagagacaaatgttttattgagaccaagaaacaacacatatcatttgtagtgtggggttttctcctcgcaccatagggaaaggtttatgggctacagattgtgtgaaccagttttgctctggaaaatacaaatctacctgaactcacaatcagaatcacaacctggagtcagaaagactctgggtttggtgccaggagaatttagcagttaggcatgctcctttcactctgcaggaggaaagtcctacccaagtggtgtgtacggtcctagcggggacctcaggatgcagagccccccatcagctaacacagtgttgtgtaaaggttctgatgtcagggggagtcagtgaaaggaagcagaagcaaggggctcccctgctgcacacagatggtccatctttgctaagagcacagggtgatcacagagagatcctcagaagggtatgagaaagtctcctgttccaagtaaggccaataaaaattgtcttttcttgaatggactttgtggggaagatgaggacatgtctgtctccaagatgggcacaacagtatggcagtgaggtctgagcactatgagtttctctactgagaaatagatgttaattgcctgcccgaaatttatttccctttttccccttcctgatagagctccacatttcccaatcttgtaggactgacccatcctggttttaggtgcagactccaggcactttgagccaatcagcatattccaccttggaggccctgtaatgcgttcggggaaactgaaaggagctgaggaacttttgggaaagttggaacatagatttcttttcctctgctgtgcttaaatagtggagaatattactattgctactacatgactgctgctgttgctgctgctactattattattattattactacaaacactaacacttgcaggtctcttactttatgatggagacagttccaaatgctttacatgtattttctcacttaaactcacaacaaccccatggaatagatgatatcattgtccccattttaaagaagagggaattaaaactagagtagttatgtacttgatcaaggccacatggctactaagcaatggggctaggatgtaaatctagctataaccattctgctatgggaagcttgtaactgctgaagacataaagtgaagtctgaagcttctgaggggctactgtgaggacctcaggaagaaatgggtccagaggaagcagaggtgatatcttatgaatccagtactgaattcttcctggagccagaaatagctaagtctgccctttgaagttatgtgaatcaatagattttctctgttgcctaagccattttgagatgggctttctctctctttcaattgaaaacaattaaacaacaaatgtacaatttgataccaggaaataaaagttgaaagagacagtgccatggagttgactgcactcatgtatagacaaggggaatgagagaaaaccctcaatttcagggagtgggattagcataccttgctatgttgtcatgcactaacttgttgaattgtctcatgttggttttgacattcataccactcatcttttaaggttgtagcattaggggtcctggaaaactttatggtgttgaatttgggtacttctcaaagcctttaataaggcttgttcaatggtctaatgatatgtaacaagccactccaaaactcagtggcttaaaacacatatttatttcaatttttcatgattctgtggttctttgggctcactttggtggttcttgcttggggtctgtcatgttgctgtccagtgatggctgaatctgccggcatgagatagctcagctgggttgtacatccagacagctcattcacagggttggaagttgatgctggttgttttctgggagctctgctaggctgttgaccagagtgccttcccataatatctccaaagcatgacagcagagttttaagaatgagtatgcctaacatttcaagaggcccaagtgtaagctgaaagacttcttataactcagcctcggaggactacatagggcaagaataccaggaggtatggctcactgaaagatcaatttggagaccaactccatgagaccggctttggagacctgctttttctcagccctacaagaaaaagaggtttactctggatttggcctgaggagtaacagagaggccccagacaggaagaactaacagaggctctttcagcatgatgcctgcagtacaaatcaactgggtgtgaaataacccaccacgttgcaacactgaaagaacggagctcaagttacaaacaggccagacttgatgtaagaaagaggataatattggggtgcaggatgatcctgattgcctcctctacatccaaaaaaatacaactccagacaggtctcttaaaactgcctccgattctgttttctctgcctggcacactgaagacaccctgcaacactgctttctgacatggaggaaatgggaggtgccttcccttccttggcttgtgcttcgaacgttcctgaggcagagtgtgaggtggaacacgagtactatgatggagagggatggaccgagaaccaacatctaacaccaagaggctaattgccgcagacccatctcagctgaaggatattacttgtcacgctctctagctgaggctgctgcttcatagactggctgaaagtcaatagatcagaattccatagagccttaagaacaggtttcctgacaaagaaactcaagttcagctaaacttggtctgtgattgttccatcccagatgaacatagagagatactgttattttaacttgcatttccttttttcctagtaagtcaagtatcgtcacatgtttattgactgtttaatttttatcttctatgaatttcttcataccttttatctgacatattatggatattacccctttatcatatatctgtgttgtaaatattttcccaacattttatctattgactttattaatgatacaacattccactaaaatatgtagtaattttaaaagtatttagtaatctaaatactaaattttgaagtatttagtaatctcttttaaaatataagacaattggactcttgtctttgttttaataatatccctaatacctcctggccactttccccttgctcagtctggaagttcctaaagggctttttcatcagcgagaagatcccagctccacctcaagtcttaagagctactcagaaaatactagtggaaatgaggaaagaaaaaaaagatgaaagatgatttttgtcttgagccatacatggaccagtatggtaactgagaagcaattattttttgctggtatctgggcttttgataaatgaagggaaaattcaaaagggtaaccatgacacaaggcaggacagcagacctcgttgtgtgtactctggtaagtgcagcttatcagaggcaaggtacagagggtattttgggcctttgagaatggtcttggctgagaggatcccagtgcgtgactccacttccttcctggtccccttcactgccttcctctttgtcctttcctcttagcctctcattttacttcattcgtttatctcctttcctcttcctccttttctcatttcctaatgttcttgctttttcttctgtttacttccttgagtcaaggcctcatgggctctagattcagggatgacctgaggacaagtcctgccttggtacttcccaggacagagctcagctcctgtttggcctcccaagaccctagcttcttctgcaggcagaaattcccctttatgttggcagatttgggacaacaagttagtggacaatgctgaggtcttcttcttctgaggcagatactcctgtgaagtgccagagcttcttccagaggacacagttctaataccaccacctccctctgtatacaataaagctcctcaaatctttataggtagtaggtactaggagaatctgttgttctgatatgtgatctttgaccccagctcctgatacagagctcctaagatctttgcaatttcctgaataataggatcatttggcacagagcttctaaatcccttggaatttcctgtgtgacaagagcatcttttgttctaaacaggcaatgctggatgagctcctggagagcctcaggatgggggctggttgccaacagaaccaaccatgtggttagagggttggaaatttcaacctgagtccctgacctccaaaggaggggagaggggctgaaggttgagttgatcaacaatgaccaatgatataatcaatcatgcctatgtaaggaggcctccataaaaacccagaaggatgaggttcagagagctttggaagtgctgaacacatggtaatccctcctaaagggtggcacacccagatggggtgtggaagccctgcccccttcccacatgccttgccctttgcttctcttccatctggctgttcatctgtattgttcatagtgtcttttataataaatgagtaaacataagtaatgtgtttccctgattactgtgagctgatctagcaaattagtcaaacctgaggaaggtgtcatgggaatccccaattcacagccagttgattagaagttctggagatccagatctaagactggcatctgaaatgggggcaatgtttgggactgagctcttaacctgtggggtctgactctatctttaggtagaaagtgtcagaagtaaattgaattacagcatacctggctggtgtccaactggagtatcacttggtgtttggagaaaaacccacacatgttttggtgaccagaagtaaagtattctgtgttgaatattgtgtggtgtagagagtagaaaaaaaaaacttaaaaaatatattttacaccttagccatgtaaggaaatttatagccatactatcaatttgtttaatttatcacttattaagcttttattttgattagttactaaagaacataacgagatttgtctttaggcaaaaaacaaggctcaaggtatatagtgagagaaagacgtgttcaaaaatacctcagggtggaatattaatagtgtacaaatagaagcattaagaactatgggaacagaagtaagaagagattaataataacaaaggaaaaatactattacatgtaacagtagaagtaccattactaggagtcaatatttattgagtgcttatcacaggccatgcattgtgctaagcactttaaatgcattctcttaattttcatgaccaatgtgtgttatttaagtgcttttattttattttttgagatagagtctatgtcacccaggctggagtgaggtagcatgatcttggctcactacaacctccacctcccaggttcaagcgattctcctgcctcagcctcccaagtagctaattttgggaggcacatgccaccatgctgggctaatttttgtatttttagtagagatggggttttgccatgttggccaggctggtctcaaacttctgacctcagatgatccgcccgccttggcctcccaaagtgctgggattataggtgtgagccactgcctgcagccttaagtgtttttatgttttcctttatgtttcatgtcatgaaggtaaacgtaacaaaaacgaaaacaccatgaggtggagtgagtttctcaacacaaacaggaaggaaatgtccaagcaagaatccacacccagagtaccttacactaaattctaggccctgagatgttccctcaagaaggcaacatttgagctacactaaagggagcggagtgtttggaaatgcagatttagcaacacagggaaaagcaaaagctgaaacaaacaccttgaagacagatgaatgcagaatgagttccactgttgccctcccgggaatcataatgacccctaaagctacaagaaatgaacagtttgtactagcctaggaacagaaagataaatcaatggaatggaagggagtccagagactcctagatagatacatgagatatcagcgaagcggtcctcacaggattaagaataattctggacagaaatataattaagcattcatcaggctacactttggcccacttcctttcaaccgaaagtcccttaggaccagatactgaccatttgcattaccatcgttcctgtagatagatttctgttgttagaattataaggcttttctttaagaattaatctgcattcctattgttcttatagataagatgtctgacattagactcataaggctttcatttaataattgcttaagatgtttctcagatcctgaaatccagtggaacagttgacaccaaccattttgaagacccccatagagaaactgaatcagcatgagaagagttttttcatcttcctccctcatgacactatcttgcgctctttcaccaacaaatgatcacacttgggcccactccaaaccccttaaaaactctagccccgaactccttaaggagatgaagttgaggtttcttccagtctcctcattcagtggccttacaatgaaacctccttctctgctgcaacccagtgtctcaggatattgacttgctgtgtgcattaggcaacgaagctattaagataacattgatttgggaaaagatggcatttaaaatcagtggctaaatgatgaagtattctaaaataaatggcattagacatttttggaaggttaaaataaaggcatacttcaacctcagattacttaattatatataaagaataaaaggactaaataaaaaatatagtcaataataaaaaaactaaaatattttaacagtttggtgataggcaaggtattctcatataagaacagaactcaaaagctgtaagaaaaaaatatacagatttgaatatatatgatttgaaccattgaatggcaaaaattactaaaaacaaagttaaacatttaaaagaaaatatttgccatcaaaatactagacataggattaataaccctaatatctaatgtgtttttataaataagtacaaaatagatatcaacagaaataaaagataaaagatgaacaggttattcaagcaaaagaaatacaaatagctaatgtactttttttaaaaagtcaaatttaccaaagatagggaaaatgcaagttcaaacaacagcatggcaccatggatttcctatcatgtgggcaatattaaaaatggtttgactgtaccagggatggtgggaatgtgaagaagagagtactaggaaagagacgcactgttgggcatttcattttctttgcagcacccactttgttgggaaatgactctcttctgcattcaagccccttggtggtcatcgtcttataggactttgtccattccagaagtcaaggactttcaaaggggaagactttccttttaagtttttttattacagtttttattttgaaataatgatagattcataagcagttgtgagaaatacagagacagtccctgtatgcttcaggcagtttcttccaatttgtaacatcttgcaacattagagtacaatgtcacaatcaggataactgacactgatatagtcaagatatgacatttccatcacaagaatccctcctgttcttttacagccatactcacttccctcccctcctcaccttcccccactgcctccttaatcactggtcatcactaatctgttctccatttctataattgtggtgtttcaagaagattccataagtggtacataccatacagtatgtacccttttgggattggcttttttcactcggcataattgtctggagattcatccaggttcttgtgtatatcaatggtgcattcctttttattgctgagtagcattgtaaggtgaggatgtaccacaatttaacaattcactctctaaaggaatcagttgtttccagattttggctatcacgcataaagcctccataaatattcatgttcaggattttgtgcgattgtaagtttttatttcaccagagaaaatgcccaagactgtgattgctgagttgtttagtagtcacagctttagtttttttgtttttcttttttctttttttttaactgccaaaccttgttccagagtgggtgtaccattttacattcccaccacgagaggtccagtttctctgcatccttgccggtagttggtgttgtcactgttctttttttttttttttttttttgagacagaatttctctcttgttgcccaggctggagtgcaatagtgcaatggcgcgatctcagctcagcacaacctctgtctcccaggttcaagcagttctcctgcctcagcctcccgagtagctgggattacaggcatgcacaaccatgcccagctaattttgtatttttagtaggggcggtatttctccatgttggtcaggctggtctcgaactcccaacctcaggagatccacccgccatggcctcctgaggtgctgggattacaggcgtgagccactgtgcccggcattactgttctttattttagccattataatattatgcaatgacattttgttgtgattttaattttcatttctctaataatgatgttggacatcttttcgtgtgctatttgacttgtgaattgtattaacattttttagcattccatttttatttattgtgcttttgagtacacatcttgaacagcttttttagtgactactctccatattaccttatgtacgaaacattatagtctacttgtttcatcctttcaccaatgtgactaaagtctagaaattttacctaccttatgtctttttatttgcctctgtttagaatataattgtcttagatatgtcacgtgcatacatttagagccacattagaaagtgtaataatttttgcttccactgtcaaacataatttagaaaactcaagagggaaggaaagttgattatatttacccatattttgtttataatgttctgtcttctttgttgatctttcaatattctttcttttatcatttcttctgcttaaagaactttgtttagtcattcttctgggtaggtctgctgggaacaaattctcttagttttccttcatataagaatgttcttatttccccttcatttcaggagaatattttcaatgtttgcaggaatctgggttaattgttctttttttctgcacttgaaaaatgttctgccacttctgtctgacctgcatgctttctgatgacaaatccattctactcaaattatttttcccttatagatattttatctcctgctgttttcaagatttgtttccccttgtctttagttttaagatatttggtataatttatcttgatgtggattttttgtttatcctatttgctcagctaaagcctgtagatttatgtcttcagtcaaatttaagaatttttcagccattatattttcaagttctttttcagccctggactctttctctcttcttctggaactattatcatgtgaaaattagatctttttttatagtctcacaggtctctgaggctctgttcctccttcccccttttgttttttctattttttccctattgttcagattgggtactttctagtgttttacacacttcattcattccttcatctgttccttccattctgctctccagaccatccattatgttttttattttagttattatatttttctgtcctaaaatttccacttggtgattctttatatatcttctctgtatttgccgaaactttctggcttttcttttcaagttttttcataactgcccactgaagcatttttatgatggctattttacagtctttgtcaggtaattctaatacctctgccatcttggtgttggcatctatggattgcctatttctattcaagtggaatttttctggctcggtaattttttcttaagaactggacatttggggtattaggttataagatgctaggtcttgtctaaaccttctgtttttagttggctttttctgatactgctctggcaagggaagggggtgcatggtgtagctgctaccaagttggagtggaagtccaggttcccactcagactctgtaaaccccagagtgtgtgagtgtgccaggggtctctgtgttcctgttgcatgaggcaggggttctaaaatggccccttactgggccttgggtcaaagcacttttactgggagggataagagtgcctccttaatccctctacatggcctccactgacaccatagtggggtggcctcaatgacacctaggagtggtaacagtcttgactctcccctaggcttccagcagaaagtgggaggaacacttctttactgcgagttgggaataagtccaggttatccacatgtgcaccatagtgggtggaggttagggcggttattactgcccagcagagatgagtgtcctggctccctccgcagccttttctaataatcatgagggtgtgtgtggcagggatggtgttaggggcacctccgctcagcctgacagtgtgaaagtcttctttagctccaagtctggtgtataggaggcaaaaagaaaacccaggaaactcgccaccatgctattctttgggtcctgagatctttagcccatctgccttcctttctccaactttcagggcgtccttctgtttgttttatatataatgtgtaggaataatgaagagattaaggaaaattatgagagtatcatcctactttctgcacagtgacttcataatgcattttcagcatctgctaagcaggttctctcccattcatctgctttatacattttttgaacactatcagactattttatcctttctgaaagatcattttatcttgtttcaaaagaataaccacaaaattggaattttaattggaactgagttaagtatatgtacacattttatattaattaggggaaaataatatttttatgatagtcttacatccaaaaacatgcaatgtttcatttttattgttctattttatgttctttgagatctaatagttttcttatgataggttaaatgctttttattgttaaatgtattcctaagaaatctatttcatttagtttttactatgaattgattatttttctccatttatgtctagcaaagatgctattagttttgtatacctaccttgtacccagtcactttgtcaaatactgttagtaattttgtgagctttttactggaatcttttgtagcttttaggcatgcaatcatattatcaacaaaaatgtttttaattatttgctcctcatctccattgcaatattaattactttatgagtttagtggtcaaaaaagaaatactgaaaaaaatacctttctatgtggaaatggtttaatcaatgtcaagttgtccacaaaactgaaagataactgcatgtggaaataagttaacttggatagatttcaacagtgaaaaagcaaaatgctgtaatatgattctgtttttttctaaaataacagaaaagtgtcagtatgtagatatatatacaatatatgtgtatatgattatataggtagagggaaagctacggaaagatgtcaatagagttatatttatgacgggtagatgagcaaaaacaaacaaaaaagactgcattacactatgatgttaatcaccatggaaacagcacaaatgataaaattccaatcatattaaattacaaagagatctataaaaagacacatggagtgatggccaaagccatgttacggtgcccatgatctcaggtggaatttcagggtaatttggtttttgttttattttttatgaattattcacaatgtttactataagaaattatatgatgataaaaacacaagataaagctttttttattataatgtttgttttaaagcacaatgccattaaggcaattccagcttaagaattaacttgtgacttttgcaaatctgtgccatattggttaaatttctttgataaaaactctagaaaatgaaagagaaacaataagaaccaaataatcaatttaaatagcctgaattgaagacaaaactttgcaataatcttttggaaggaaaaaggcctcggcagcactggaagtctagaaagtgggaagtggtgatcaatttcttggtacttcagagtgaatgcactcagattgttttcctcctggggatcactgggagcaagaattaaagtcttaagtcatagagcacaactgtccaagcttggcttacaagcaaggcccttgttcagagtaggctggagctgactggtttagtcttgccaagagtatatacaaagaggaaagggaatactttcctaaagaaggattgggatgcactcaccaaaagaaggggataaccagtctggggagaattaaaaaaataaccaagcaggggctcataaaggctgagggtctgccagatgcgatatcctctgctgggatggtcactgctcagtctgagtccatctgcattcctcttccttcccacaggcattgggggttcagcctgcagttctctccactaagtacattcacaggactccccttccttcaggtctcacagtctctgtcactatttttccttcatgtttcccttgcctgttggagttcaggctcacttcttcaaatggacatacggttatagcaataaatcaaaagggaataaaaagagcaagatgtactataaactgtctcagtcgaagggataaataatctgaggaaagtcaggttaaaagaaataactaccatgaagaattaaacatttattggatcaccgtggtaccccagaaaagacagaggaataggattggtggaagaagatacccctaactggtccatgctgggagcaggcctttagctatctgctgagatgagtgccacccattcacaaaaatttgaggagactttaaatgaagaacttttccttcttcacatgaaaagacccaccattagggactttgttcagaaactttggtgggcattcagcttcaaggaatctttctgtgtgtggatcctgtttagctacactagtggctgagagcaataatcatttatcctttctctcaggtgtgggtctgcgggggtgaatctccttcttggttcaggtgtgcgcgttgctggggtcatctattctctattctggtctcaggcagaagaggcatcagctaatgggggaaacttttctaatggaagtggcacaagtgggagaggaaaaggccaccagtgccagcacatcgcaagcttctgtttgtattgcatctgctaatgttttattggccaaagcaaatcgtgtgctgtgtctgatatctagggactggaacttcctactccatggaggttgtggctggggagaggcagtgagtgattttgaacatggaaaccatctccattcccacaagatcctgcctgagtgggtcaggggataatcagagatcccagagttgggtagatgtgtcccccagtggactaaaaaagaactgaccaaaaaaatgttgaaagagaagaggaaaggaaaagagagaatgagggaatctgaaactctgttaaatattaactatcattgttttggagtgacaatatgatatgtgattaggattttctatattattttcagcatctggcacggatatctaatgttttcttaatcggaaataatacacaaaagaaagaaagaaagagagagaaagacagaaaaagaaagaaaggaaaacaaaacaaagaaagaaggaaagaaagaaagaacgagagaaagagaagaaaaggaaagaaagaaggaaggaaggaaagaaggaagaaagaaaggaaggaaggaaagaaggaagaaagaaaggaaggaagaaaggaagggagagaggaagggatggagggaggcagggagttttccaaggagccttttgcttctcagctagtggaagcaagaacaacacagcattgacagcggggaccggagaacatttggttttttaaatatagtttttaaagggaaagtgaattctacaaaatgcccatttttctatgctagttaaattctgcacccagggcagaggctaaagatcacatttttataagaattttttttttaagagatagaaaacctcttttggaattggtgtccattctcaattctgttaaaaggatgatgatttattgggtcaaatatgctgactttcttctcctattcttcttctctcatttcctcatctgaaaaactaagatgctgaatgcaatgattgctaagatcccttggagatctaactttcagtaattctagtatttttccttcagctcagttatttccgggtctactatttgaaaacatgctccaaggcaagaggtcgaattatttaccctgcttcatgctgacattttcatagtagctaccagaaaagaaaatgtgagcagttcttttattattgtttttcagttacacaaatattaataggtgttatacaaatttaaaaatataaacaaaataaaaatcaccaaaccccaacactattaacctttcacagtatgtttctagcattctttcagtgtgtgaatatcataacttattttgaacaattattgatctcatttttttaactttatgtattgtgacatttctccatgcaattagattatcttctaagcatttaccttgaagggttagataagatttaataactaaattctttataaactgtattattgctaacctattttttgacctatttttttttttagtatagagtagggatgaaatccatgggttttgagatttgatagcccgagcttgaaagactgggtctattatttacagactgtaaaagaagtaaagtcttaagttgtagagtacaactatccaagcttgggttacaagcaaggcccttgttcagagtaggctggagttgactggcttagtcttgccaagattatatgcaaaggggaaaggtaatactttcctaaataaggatctggatgcactcaccaaaagaaggggtaaccagtctggggagaataaaaaaaaaataccaagcaggggctcataaaggctgagcatctgccagagcctgtatcctctgctgggatggtcactgctcagtctgagtccatctgcattcctcttccttcccacaggcactggggattcagcctgcagttctctccactaagtacattcacaggactccccttccttcaggtctcacagtctctgtcactatttttccttcatgtttcccttgcctgttgaagttcaggctcacttcttcaaatggacacacggttatagcaataaatcaaaagagaataaaaagagccaagatgtactataaactgtctcagtcgaagggataaataatctgaggaaagtcaggttaaaagaaataactaccatgaagaattaaacatttattggatcaccgtggtaccccagaaaagacagaggaataggattggtggaagaagatacccctaactggtccatgctgggagcaggccattagatatctactgagatgagtgccacccattcacaaaaatttgaagagactttaaatgaggaacttttccttcttcacatgaaaagacccaccattagggactttgttcagaaactttggtgggcattcagcttcaaggaaccaaagtgcagtattactgacctgagtagacagaagatacatctgtatatgtatttgtaaagttattgtcactgttcccaaactgagtaatcacgagctgaaaaggaaaaggaagttgtgggggcatcataggtccccttgccattctggcaccagacacttctgtgaagttgagtcaggggccatgggccctttgcatttctgtatgtgagaataagcaatagatcatgtgaagcaaagcacccacaggcattcttctggaagtgactctttgtgtctcaaactgcttagcccctatctgatcatctggtttgattaacaaccgtagggcagcctggaacacacatgatccctcgaccttaatcccttagggtgtggcagttaagggaaggctctcaggtctgaaggggttggactaaacagaaacagaaaggacatacactcataccttaaaagtacacagtgcctcatggtgtaagaactcactgcacttgcactattactggcatttacaattgtttccccaataaataatgaacatccttgtatgtgcttttctcctgctggtgattttatttttatatattaatttaatttttaattgacaaaaattatgtgaatatatggtgtacaacatgatgtgctgatatatgcatatattttgaaatgactaaattaagctaattaacatatccattacctcacatacttattattacttttgttgtggtgagaacatttaaagtctattttcttagcaattttcaagtcttactatttccttaggacaatatcttagaagtgcaattgtctttttaagtatggctatttttaaggcttttaataaatacagaccatcttgacctaagaatgaggtgaccaatttacattctaatgagaggatttgcttccctatgttttcacctaaattagtatgaaatacatagctaagttttgtttctatgattctaaaagtaatattatgaacatgtttattgtgaaagctccaaaactttgtttttaaacaagtacatttttcaacaaaagtagctctgagccattatttttaatgcaagctagtatcccatggactgatggtattttatttcaccagttctttattaataggcatttatattggatatattattttgctacctgctaaattttatgatttgtctcgcacatatatttagtgaatttgtccaattatgcccttcatgtaaattttagaagttaatttactaagttaaagcataatcagccatataagtttaatttgttaattactcattagcaaattactactttgaaaggttatactaacttatatttgcttcagtggtggccagttgtgcacacccttgataacactaattattgttattttcaacctttattaaattttaggaacaaaaggcatatctttttctaaattatagttcttaatttattactgtttgaatatttttgcttatgtttaaaagccatttgtatttaccttttggggaatctccatattcttttttctcatgaagttcttttttgtttgctatatatactattaatattatcctaataatattattaataatttttacatattatacataatttaacactatatattaatatattgctatttatcagggacactattttttctatgtatttacagtatttccctagttatttgtttggctcaaacctgtctttttaatgctaagattagaatgacctgttattcctagattacaagcatatttttctaagaattttttcagttattttaaaattttatttttatttgactcttgaacttctctagaagtatttaggtgtcatctataacattagaatctaattttattttgtccaaatttagccagttttcctagtaccatttgataaataattcattattttaagcatttaaaactcatctttagcatgtgttagattccattttgtttgtctgtttcagagttctcagttctctttccttgttctgttagtgtgtgcaccatcatcaggtgggttaaatcatagtgtcttttaatgtgccttaataatgtgttccttcatcactttttgtgaatatttttctgtgttttcatagaaaaatgcaaaagtaaaaatcattttttggtcaaattaagaactactcccattttaattttgatgaaaattaggagagaatgacgtattcataatcatgagtccttctatccaagagcatgcctggtctcataattacaccatttagtcaagttttatagtttccatcaggtaagttttttaaattatatctttttatgtcacaatgtttattctatattagcatagaattttttcttaataattcacatttataattatcagcattatagttcttgcttttgtaatagttatcatttttggccttattactaaacatctttcatcattctaatatatttctatctggtatttttcagttatttccagtcaagcagtcatatttgtaagccatgataactttggtccttctgtttaattattacacttttcttatctgtaatattaactagaagttctagaacatccaaaataattacagtgatgctatgcttccttttttcttcctgaatataatagaaatgcttcaagacatggccaatattttctactgatttctgatagatattctttatcataccaaataagtagctttctgctctgagttttcctagaatttttttccctttggttaggatcaaatgttaaattttacaaaacgctttctcatcatctattgagatgtccatgcatttttttcttcctttcacctataatgtgatgaactaaaaatacttctaggatttaggttccaagggggctgaaaaggaacaactctagtctacagctcccagcgtgagtgacatggaagatgggtgatttctgcatttccaactgaggtactgggttcatctcactggggcttgttggacagtgggtgcaggacattgagtgcagcccacagagtgtgagccaaagcagggcaaggcattgcctggcccgggaagtgcaaggggttggggaattctcttttctaaccaagggaagctgtgacagatggcacctggaaaatcgggttactcccaacctaatactgttcttttccaacggtcttagcaaacagcacaccaggagattatatccggcacctggctcggaggttcccacgcccatggagccttgcttattgctagcacagcagtctgagatcgaactgcaaggcagcagagaggctgggggaggggcagccaccattgctgaggcttgagtaggtgaacagagcagccaggaagctcaaattggatggagcccaccccagctcaaagagacctgcctgcctctgtagactccacttctaggggcagggcatagctgaataaaaggcagcagaaacttctgcagacttaaacgtccctgtctgacagctttgaagacagtagtggttctcccagcacagcatttgagatctgagaatggacagactgtggccttaagtgggtctctgacccccgagtagcctaactgggaggcacctcccagtaggagctgactgacacctcatatggctgggcgcccctctgagatgaagtttccagaggaaaaatcagacagcaacatttactgttctgcaatatttgttgttctgcagcctctgctggtgatacccaggaaaacagagtctggagtggacctccagcaaactccaacagacctgcagctgagcgtcctgactgttagaaggaaaactaacaaacagaaaaaaatccacaccaaaaccccatctgcacatcaccatcatcaaagaccaaaggtagattaaaaccacaaagatggggagaaaccagagcagaaaagttgaaaattctaaaaatcagagtgcctcttctcctccaaaggaccgtagctccttaccagcaatggaacaaagctggatggagaatgacttgaccagttgagagaagaaggcttcaggcaatcagtaataacaaacttctcccagctaaaggaggatattcgaacccattgcaaagaagctgaaaaccttgaaaaaagattagaccaatggctaactgaataaacaatgtagagaagaccttaaatgacctgatggagctgaaaaccatggcacgagaactacgtgacgcaagcacaagcttcagtagccgattcaatcaattggaagaaagggtatcagtgattgaagattaaatgaatgaaatgaagcaagaagagaagtttagagaaaaaagagtaaaaggaaacgaacatagcctccaagaaatatgggactgtgtgaaaagaccaagtctatgtctgattggtatacctgaaagtgacaaggagaatggaaccaagttggaaaacactctgcaggatattatccaggagaacttccccaacctagcaaggcaggccaacattcaaattcaggaaatacagagaatgccacaaacatacgcctcgagaagagcaactccaagacacataattgtcagattcaccaaagttgaaatgaaggaaaaaatgttaagggcagccagagagaaaggtcgggttacccacaaaggaaagcccatcagactaacagtggatctctccgcagaaactctacaagccagaagagagtgggggccaatattcaacattcttaaagaaaagaattttcaaaccagaatttcatatccagctaaactaagcttcataagtgaaggagaaataaaatcctttacagacaatcaaatgctgagagattttgtcaccaccaggctgccttacaagagctcctgaatgaagcacttaacatgggaaggaacaaccagtaccagccactgcaaaaacatgccaaattgaaaagactattgatgctagaagaaactgcattgactaacaagcaaaataaccagctaacatcataatgacaggatcaaattcacacataacaatattaaccttaaatgtaaatgggctaaatgctccaattaaaagacacagactggcaaattggataaagagtcaagacccatcagtgtgctgtattcaggagacccatctcacatgcagagacacatatgggctcaaaataaagggatggaggaacatctaccaagaaaatggaaacaaaaaaaagcaggggttgcaatcctagtctctgataaaacagactttataccaacaaagatcagaagagacaaagaagaccattacataatggtaaagggttcaattcaacaagaagagctaactatcctaaatatatatgcacccaatacaagagcacccagattcataaagcaagtccttagagacctacaaagagacttagactcccacacaataataatgggagactttaacaccccactgtcaacattagacagatcaacgagacagaaagttaacaaggatatccaggaattgaactcagctctgcaccaagcggacctgatagacatctacagaactctccattccaaatcaacagaatatacattcttctcagcagcacatcacacttattccaaaattgaccacatagttggaagtaaagcactcctcagcaaatgtaaaagaacagaaatgataacaaactgtctctcagaccacagtgcaatcaaactagaactcaggattaagaaactcactcaaaaccgctcaactacatggaaactgaacaacctgctcctgaatgactactgggtaaataacaaaatgaaggcagaagtaaagatgttctttgaaaccattgagaacaaagacacaacataccagaatctctgggacacatttaaagcagtgtgtagagggaaatgtatagcactaaatgcccacaagagaaaggcaggaaagatctaaaattgacaccctaacatcacaattaaaagaactagagaagcaagagcaaacacattcaaaagctagcagaaggcaagaaataactaagatcagagcagaactgaaggagacagagacacaaaaatcccttcaaaaaatcaatgaatccaggagctggttttttgaaaagatacaaaaaaattgatagactactagcaagattaaaaagaagaaaagagagaagaatcaaatagatgcagtaaaaaatgatgaaggagatatcaccactgatcccacagaaatacaaactaccatcagagaatactataaaaacctctatgcaaataaactagaaaatctaggagaaatggataaattcctggacacatacaccctcccaagactaaaccacgaagaagttgaatccctgaatagaccaataacaggctctgaaattgaggcaatagttaatagactgccaaccaaaaaatgtccaagaccagatggattcacagccgaagtctatcagaggtacaaggaagagctagtaccattccttctgaaggtattccaatcaatagaaaaagaaggaacccttcctaactcattttatgaggccaatatcatcctgataccaaagcctggcagagacacaaccaaaaaagagaattttagaccaatatccctgatgaacattgatgcaaaaatcctcaataaaatattggcaaaacgaatccagcagcacatcaaaaagcttatctaccatgattaagtgggcttcatccctgggttgcaaggccagttcaacatacggaaattaataaatgtaatccagcgtatacacagaaccaaagacaaaacccacatgattatctcaatagacgcaaaaaaagcctttgacaaaattcaacagcccttcatgctaaaaactctcaataaattaggtattgatgggacgtatctcaaaataataaaagctatttatgacaaacccacagccaatatcatactgaatgggcaaaaactgggagcattccctttgaaaactggcacaagacagggatgctatctctcaccactcctattcaacatagtgttggaagttctggccagggcaatcaggtaggagaaagaaattaagggtattcaattaggaaaagaggaagtcaaattgtccctgtttgcagatgacatgattgtatatttagaaaaccccatcgtctcagcccaaaatctccttaagctgataagcaacttcagcaaagtctcaggatacaaaatcaatgtgcaaaaatcacaagcattcttatacaacaatgacagacaaacagagagccaaatcatgagtgaactcccattcacaattgcttcaaagagaataaaataactaggaatccaacttacaagggatgtgaaggacctcttcaaggagagctacaaaccactgctcaatgaaataaaagaggacacaaacaaatggaagaacaatccatgctcatggataggaagaatcaatatcatgaaaatggccatactgcccaaagtaatttatagattcaatgccatccccatcaagctaccaatgactttcttcacagaattggaaaatactactttaaagttcatatggaaccaaaaagagcccacattgcatagacaatcctaagccaaaagaacaaagctggaggcatcacactacctgacttcaaactatactacaaggccacagtaaccaaaacagcatggtactggtaccaaaacagagatatagaccaatggaacgaaacagagccctcagaaataataccacacatctacaaccatctgatctttgacaaacctgacaaaaacaataaatggggaaaggattccctatttaacaaatggtgctaggaaaactggctagcgatatgtagaaagctgaaattggatcccttccttataccttatacaaaaatcaattcaagatggattaaagacttaaatgttagacctaaaaccataaaaaccctagaagaaaacgtaggcaataccattcaggacataggcatgggcaaggacttcatgtctaaaacaccaaaagcaatggcaacaaaagccaaaattgacaaatgggatctaattcaactaaagagcttctgcacagcaaaagaaaataccatcagagtgaacaggcaacctatagaatgggagaaaatttttgcaatccactcatctgacaaagggctaatatccagaatctacaatgaactcaaacaaatttacaagaaaaaaacaaacaaccccatcaacaagtgagcaaaggatatgaacagacacgtctcagaagaagacattcatgcagccaacagacacatgaaaaaatgctcatcatcactggccatcagagatatgcaaatcaaaaccacaatgagatgccatctcacaccagttagaatggcgatcattaaaatttcaggaaacaacaggtgctggagaggatgtggagaaaaatgggaacagttttaaactgttgatgggactgtaaactagttcaaccattgtggaagacagtgtggcgattcctcagggatctagaactagaaataccatttgacccagtcatccctttactgggtgtatacccaaaagattataaatcatgctgctataaagacacatgcacaggtatgtttattgcggcactattcacaatagcaaagacttggaaccaacccaaatgtccatcaatgatagactggattaagaaaatgtggcacatatacaccatggaatactatgcagccataaaaaaggatgagttcatgtcctttgtagggtcatggatgaagctggaaaccatcattctcagccaactattgcaagggcagaaaaccaaacaccgcacgttgtcactcataggtaggaactgaacaatgagaacacttggacacaggaaggggaacatcacacactggggcctgccatggggtggggggagtggggagggatagcattaggagatatacctaatgctaaatgacgagttaatgggtgcagcacaccaacatggcagatgtatacatatgtaacaaacctgcacgttgtgcacatataccctagacgttaaagtataataataaaaaaaaagaaaaaaaatttctaatgttaaattcttcttgcacttctagaataaaccctataacgtcttgactctattttatcacatgctttaagatttaggcttctaaaattttgtttttaatgttgcagcaattttgccattctcctcctcatcatcatacatcagcaagctttattagacataagctgaatgcatgcaatattttggaattcatttacatcattttctaatcctcacaattattcttaagaaaactataactatcctactttagaaaaataatttagaatggttaagtggtcaaatcacaaaatatttttgtgtaatagggtaagaatttgaatagagttctatttaacttctaagtctacaattttaatcttttcatgtatccttcatatttagtgaaaagattaatctgtacattatttcatagtggtctatttgtcaaattttattatcagggaaatgcttcctatcttttccaatgttattaaatattttaaatagcatagaattagaaattttctccatatgatatgatatccatatcataggtaaatgagaatttacctgtgctattattcaaaaacatgcatttttgtttacatttttctctattaaatttgtttttacacattttattggtattttggggaaaaaaacccttactttacatatctattaaaatatttccctcaattggtttcagtttgagaatttctttaacttcttggattaaatactcatttcatttattctctaaaatgatgattgagactgtaaacaaagctcacacttttgcctcattcccatattcaatgtcctgctaaaatgaccctacccatgcaccagggataaatagtacagtcaatagacacataaagcttgacagctacatactggaaatataatccttgtctgaagatcacaaggagcagcctcagcctaaccgtgatgcccatatagcatggcgaaaaaatcctttcttgttgtaagcattgaaatattggtgttttttctgaatttttaatttttgtgggtacatagaaggtacatatatatttatggggtatatattttgacacatgcatataatgtgaaacaatcacatcagggtaaatggggtatctatcacctcaaactgtgtcctttgtgttacaagcaatccaattatactgttattttaaaatgtacaattaaattattactgactgtagtcaccctgttgtgctattaaatactagatttttttcaacttttatttttatttcaatagttctttgggtaggtgctttttggttacacgaataagttctttactggtggtttctgagattttagtgcacccatcacccgaacagtgtacattgtacccagtatgtagtcttttatccctcacccccctcccaaccttccccctgattccccaaagtccattatatcagcattatgcctttggatcctcatagcttacttcccacttgtaagtgagaacatatgatatttgtttttccattcctgaattattatacttcacttagaataacagcctccagctccatccaagttgctgcaaaagacattatggctttttatggctgagtagtattctgttcatatatatatatatatatatatatatataaattttctttatccactcattggttgaagagtacttaggttggttccacatctttgcaattgtgaattgtgctggtgtaaatatgtatgtgcatgagtctttttcatataatgacttatttttctttgggtagatacctagtagtggagtgggattgctggatcaaatgatagttctacttttagttctttaagaaatctccatattgaatccaacagcatattaaaaagataatacatcatgatcaagtgggttttatgccagggattcagggatggcttaacatatgcaagtcaacaaatgtgatacatcacataaacagaattaaaaacaaaaaccacatgatcatctcaatagacgtagaaaagctatttgataaaattcagcatttatttatgataaaaactctcaacaaaataggcatagacgagacttacctcaaagtagtaaaagccatatattagaaacacacagccaacctcgtactaaatggggaaatgttgaaagtattcccccctgagaactggagcaagacaaggatgcccacttttatcacttctattcaacatagtactggaagtcacagccagagcaatcagacaaaagaaagaaataaagggtatctaaattggaaaaggaagtcaaactgtcactgttcactgatgatatgattatataccagaaaactctaaagcccatccaaaaagctcctagatctgataagcaaattcagtaaagtctcaggatacaaaaggactgtacacaaatcagtagcactgctatacacccaaaatgactaagctgagaatcaaatcaagaactcaatcccttctacaacagctgcaaaaaacaataaaatacttaggaatacacttgaccaaggaggtgaaagacctctacaaggaaaactagaaagcactgctgaaagaagtcagattacacaaacaaatggaaacacatcccatgctcatggatggtagaatcaatattgtgaaaatgaccatactgcctaaagcactctacagattcaatgtaattcccctcaaaataccatcatcattcttcacaaaactaaaaaagacaaccctaaaattcatatgtaactaacaaagatcctgcatagcaaaagcaatgctaatcaaaaagaataaatctggaggcatcacattacccaacttcaaattatacgacaaggctataattcctaaaacaccgtgacactggtataaaaataggcacatagaccaatggaacagaatagtgaacccagaaaaaaagccaaatacttagagccaactgatcttcaacaaagcatacaaaaacatagactggggaaagacccccattcaataaatgttgttggaaaaactggcaagtcacacgtagaagaataaaactggattttcatctcttaccttatacaaaatcaactcaagatggataaaagagttaaacctaaggccagaaaccataaaaattgtagaagataatatcagaaaaactcttctagatattggcttaggcaaagaattcatgactaagaccctgaaagcaaatgcaacaaaaacaaaaataaatagatgggacctaattaaactaaaaagcttctggaatttttttattgcaatataagtagcctaagctgactaattcaggaatcttgaatgattatttttgaagtcagagtaaaagacagaaaggtataaatttaaagatgaaggacaaaatagatgtgggatagatagagtgaattcaaaacacatgcgaaaggtgttcagaagtgtatattaattggattggaaatacatgaagagtgcagattaatcaggggagaatttcattctttacaattatacatgtttcctttgaggaatgtgtcaccatttatgtgtcctcttaatttatttcaacgcagttttgcaaatttcttcctgcagttcctgaatatttttgcattatttaaatgaaagatgttaattttaaatatttatatttttaaaattcaccaaaatcgattttcaaattggtatgttcagattgtaacttttttttttttctggactgtccttcaagcttctatttgcagactctcaaactttttaagtatgatgttataatcaattgacaagtttgttaaagttagaaactcctgggccccacctctttagttgacttggatgtaacctacaaatctatagttttaataaaatatcagaaaattctaatttaaagtagataagtgtccacagcttgaaacattttgctttcaagtggtttccaaaggtttcagctagtttttttttctttctttcaaatggtgagaacatcccaacattagaatcagaatttccctctacttttcagacagtcaaatcctcacccttcaaaaaggcaaccagctcttaaactgaaaattaaattaagctttgtaagggcagaaacccttttttttttttttttttttttttagacaaagtctactcttctaccaggttgaagtgcaatggcacaatctcagcttactgccattctgcctcccgggttcaagcgattctcctgcctcagccacccgagtagctgggattacaggcacgagccaccaggcctggttaatttaatttttgtatttttagtccagatgaggttttgccatgttgcccaggctggccttgaacttttgagctcaagtgatccgcccgccttagcctcccaaaatgttgggattgcaggtgtgaaccactgtgcccagctaaggaagttttatttcttgtttacctccagtcctcagtgtttagaacgacgagtggtacaaatcaatttttgttgaatgaatacatatttgcctttatataggaaaattatagttttcaaaataattttgaaatgtggcttgagataatccatcaccttcctcctttaatggccccctgtccttggatattcagaaaaccaaagccccctgctgtggtctgaataagtcctccaaaattcatatgatgagaattaatcaccattgtgatagtattaagatgtggagacttcaggagatgattaaaccactaaggcagagctctcgtggatgggattagggccttcatgaaagagcttgagggagctgattcccctcctgtcccttctgccatgtgagatgcagcacttgtcccctcaggaggatgcagcagccagaagccgtcctggaagcagagagcagccctcaccacacacggagcctgccacaccttgacctggccttcccagcctccagtactgtgattaacaaatttctgttttttcataaattacccagtctcagtattttgttataccaacacaaacagactaagacaccccctcattttctgaatggaaaggtattatatatgaatgaccatttcagagtctcgatctccataaaaaggtgcacaagtgtcttttttactctctacttctaagtaagtaaaagggaaaactcatataattaattaggattgaaaaaattgttcttttactttctgtgggcatgttgtaataagtattaaaaagtcagttatttaaaaataaaaaccaaatcatagtttaatttctgaggacaatatctctgaaggtatttgaaactgtattgcacaccatcatctctcagctgattagaaaaagaaaatacttgattttaaaaataaaaatgcattttatcttaattagccaacattccagagaaagaaattaaaaattgacctcatctgggcacggtgattcacacctttaatcccagcactttgggaggccgaggtgggaggattgcttgagcccaggagtgaaaccccatctctaccaaaagtacaaaaattaagtggtgtagtggtgggtgtctgtagtcccagctacttgggaggctgaggtgagagaaccacctgagccaggaaagtcgaggttgcagtcaaggttgcagtgaaccatgattgcccctctgcactccagcctgggtgacttattgagaccctatttcaaaacaaaaaaaaataaagaaacaaataccaaaccaaaaaaagcccccccacaaaaaaaaaaccaaaaaactaccacacacacaaaccctcatctatacattcgaaattactgtctgtcacatgcacacacctctctgttccccactgtaatttctgtcatattcacaattttacttaggttcaattttctaagtgaacttctgggttctttttctcaggaaaaagtcactattatttattttattcaatatctatagaacaaacatactacaaaatgatatatagtagatatctaaaatctatagtacaggtcatacacagtgaacaacgaagtactcagataatcaagtttaccccaaataaattgctgttatttttctatgatttttacatagtcgaggtcatactgtgtatacaattttacacgtactgtttgcttaatttaaaaataacttgcattaataaaatatttataaacataatttaaggaataataaatattacactgattgaaggtgagtgtttttgatgttatatttcttgtccatacattaatcaaaaattaaatactgggtcaattgtttttttgagacagggttttgctcttcttgcccaggctggagtgcaattgtgccttctcagctcactgcaacctctgcctcccgggttcaagccattctcctgcctcaggctcccaagtagctgggaatacaggcacccatcaccacacctggctaatttttgtatctttagtagagacggggttccaccatattggccaggctggtctcggactcctgacctcagttgaaccactatctttggtctcccaaagtgctgggattataggtggtcgattgttttttgaagctactcctcattaataatgattaaaaatataataatcataagtggtggccttgttagtctgctattgctataaaatgctgtgtaaatctatgctcagcatcttatagtaatgaactcttattctcatgcttagaggtctgtaagatagctgccccacccgacttattctgggcctggtttggagttgtgctggcttcctagagtagttcattctcaagttgaagtctgaaagctcccagtggagctagtgggaccatattattcctcctagagtcttaaacacggaattgatatactgtcacttccactgatattcatatgttaaaagcagctcacatggttaaactcaacatccaagggtaaactctccatggggactgggatggagagagcaggagagactgttttctaaagtggcaaatgtgtcaatttatcctcttattcattatggcagggacatgctcagagtttatgtaaaaatcactttaaatagttaagggataaatttaaaagatgaggtgcttaaacccctaatttgtaatactcaaaattatttgatttgccaagaggactttgctgcattccccaagtctggtggaaaacatatggtgcatattttgtaaaactggtaacacattagaaattaagctatgtcttcagaatgaaaaaaaaattgatagtagtttcaagtattcttatagttcaaatatctccatgcactgatcaataggcacagctgtacttaaaagcagactcttctttgataaggtgttgaatgatggggtacatgtctgagaagaaagctgagaggaagtttgaagaaatatttaggaaatgaatgctcttttaagggaaaggttttcctttgtgaaaatgaggtagactgtaatttgggttgatctaggatggatggtttggtaggctgaataacaacctccaaatatattcacgtcctagtagacagaacctatgaatgttgtcatatatggaaaaaagaacttcaccagtgagaataaattaaggttcttgagatgagaacttattctggattctatgggtgggccctaaatgtaatcacaaatgtccttatcagggggaggcagagggagattttactaagaagagaaggcattatgataaaggaagccgagacagaagtgatgtactttgaagacagagggaggggccatgagccagggaatccaggtgaccactagaagctgtaaaaggcaaagaaatggattctccactgaaacctccagagggtgtgtggccctgccaacatcttgatttcagcccagtgaaacccactgctgaccctggccaccagaactgtaagagaataagtgtatgttgctttaagtcaccaactttgtgataatttgttacagcagccataggaaactaatacagatggtgcctgaaaaaatttgcaaagtttccaaattgaccaacatattagaatactctgccctgcaaaaataaaaatcatacaatcttgcataatgtgcaatatttgattttgattaaatgagtttctgtaagataagagtgactggccaggtgtggtggctcacatctgtaatcccagcactttgggaggatgaggcatgtggatcacctgaggtcaggagatcaagaccctcctggccaacatggagaaaccctgtctctactaaaacacaaaaaaattagatgagtgttgtggtgtgtgcctgtagtcccagctacttgggaggctgaggcaggggaatcgcttgaatctgggaggtggatgttgcagtgagcggagatcacacacacaccactgcactccagcctggcggcagagcaagactccatctcaaaaaaaaaaaaaaaaaaaaaaaagaaaaaagataagagtgtcgtcttaggcactactcacttgtggacattgtttggtttgaagagtaggaaggagggcttcagtttgttatgggttgaattgtgtccaccaaaaagatgttgacatcctaacctctagtacttgtgaatgtgactttatttggtatattagtcagggttctctagagaaacaggactattaggatatatgtatatataaagtggagtttgttaagaagtattaactcacctgattacaaggcgaagtccctcaataggccatctacaagctgaagagcaaggaagccagtgtgagtcccaaaacctcaaaagtagggaagccgacagagcagccttcagtctgtggccaaaggcctgagagtccctggaaaatcactggtgtatgttcaagagtcaaagagctgaagaatgtggagtctgatgttcgagggcaggaagcatccagaactggagaaagatggaggccagaagactcagtaagtccagtccttccatgttcctctgcctgcttttgtcctggctggctggcagctgattagatggtgcccactcagattgagggtgggtctgcctctcccagtccactgacccacatgttaatctcctttggcaacaccctcacagacacatccaggagcaatactttgcatccttcaatccaattaagtagacactcagtattaaccatcatgtttggaaacaggctctttgcagatgatgcaattatgatgaagtaattagggcgggctgtaatccaatatgactggtgtcctcataaaaaggggaaagttggaaacagagccagacatatacagggcaaagatggtataaagacacagagaacaacatctataagccaaagaacacctgaggccaccagaagccagaagagacacactgaacaaattctcacatgtcccaaaaggaaccaatcctgctgacacattgactttgcacttctagcttccagaactgtgagacaatacccttctgttgtttaggccacccagtctgtggtactttgttctggcaagtcttaggaaactaatacagagccatcaacaagaatttgtgcattacagcactttttttttcccccaaccgaaaccataccatgggcagcaaggttctcaggtcctcttaattatcagtcctgaaggataaggccaagacttctccctggaatttgtttaataagttttgttttattttgtaagtttatacttaaattttaagtgtatgaattcacaaatagctaattctatgtttagtttggcgagtagctttgctaagaaatctagtcaagtttctctgtgtttctttctacgcttctctgtttttcattttctttttctcttttaaagcattatatcagtaaagctcatatttcatggaacatgacacagacaggattgcttcttaacaaaaatggattggcatgggctatcagtaaagcttctttcaagactgaatttgagcagagctcatcagataatctgaagatcacagaaggctaatcacagagttagaaagctcttcattccatatcttcatttcccatccacctatgtttccaaaagccaaaaccaatgtatgtgttttcaattttagtggcagagtggactcctttgatttgggttgagcctcctcgcctgctgagtgttatttcactttctgtggtcagaaaaagacagaagacaaactgaagtttttacctctcagcagtcctgaatacagccggttccacagaggctgaagggttgagatgagggatttctcttgagagtcaggcatctttacctgcattttttgttcccatacctctttgttatcagatggatgccctctcagtctaaggactgaggacttagccctctaagaaacttctgagaccctagggagattgtctgaaaggatatgctctgagcagctttttcccaacaacatgtggaatgagaggtgggtccacggactatgcacttcttctgccagccagatgcacagtggaactgcggtggaagctgcctgcaaagactggcttttcctttagtcttactcatagagagttcttttcttttctctctttctctttctttcttctttctttttctctctctcttccctcttttcttcccctcccatttcccttcccttcccttttctcttcctttccctttccttcctttccttccctcccccgccccttcccttccccagcctcactattttgcccaggctggggtgcagtggttattcacttgcttgatcatagtgcatcacagccttgaactccggacttcaggcaatcctctggcatggctgggactaaaggcatgtgccactgtgccaggcttagaagtttatttctgaaacaagcagtgctgaggtgacagcggatagaatggaagtgggctagtgagtggaggagagatgcttataaatgtagttcctctggtgtgaagaactgtagatctgaaatgtgtaaagttattgtcaccagttttagtcacacctattgcagagaaatgacattttcggagggtttaaagaataatttgatgggatttagagcagagaaaaattcatgtcatcttgttcattctgccactgctcagaagtcaggtagctgcaatagctaagagttttgttagtttgccatgtgccagatactgttctatgtatttctcctgaaataattcatttaatccccctaaaaccttttaaagtgggtgttactattataactacttttacagatgagaaaactgagtgagacaga

SEQ ID NO: 426 - DNA, 20001 bp, Homo sapiens
atggctctgtggcctgattccaaattccagggagagaaactcactcaaccttggtccaatcaactcttgctaagggatgagctcttgtgtctggaggcctttgtccaagggtatctgttgctgtcagatacccttggaagttcctacttgagggccaaagataattttgaagggcagaaaaccagccagctaagttccattcagccaccaacttgacaggtcagggagaatctaaccttcttttcaaatcttccttcctgctttagaaaatgtccttagccttctaactttctgtctctgccaactcttccctttgatataaccgcatcatattactgagaaggaaaaagcagaaaagccatccatttagattttctttctgttctaagcatgaagttaatccactggaacaaaaacattattgatttttatctgttatagtcttctccctgaaacaacaaatgtgtactactattggtataatatttggcttgttttggatgtagaccttaataaaaattacggttcattattttttcatattgcctttgcatggctcctttagactcagtggcacatgacacgtttggaagttgaaagactttatatttgactataatgcttttgatcaacagagcaaagcctgaaacaaaacccaaagccaaaccaggcaggggtgtggggacaacaggagaaacaggttctggggagagtccctttccttgatgttcattcaaaaatcagtgagagtttgttgagtgcataactaagttctgggcatttagctaaagataggattacagaggtgaaaaagctggacttctatttcccacatggagcttatagccgagggagaggcaggcagagataaaggaaaatgatgcaaataaatgcatatttgcaagctttaacaaaggctatggaggaacagtgctttggcacgatgagagtgagtatgagcaactcgggcaaccagcctgagggggcagggaaggcttctctgaggaaggctatttccttgagatctgaagggtgagtaggtgtttaagtgggtgaagtggagaggtagaggttgggaggtggggcatcttccagacaaagggaactttgagtatagatattcattatgccattcctgtaggaacccataaaatgtaaatctacacacacacacacacacacagacccacagaatcatggaggaatgagccatcaggcagctgtgctctgctttttttgccatctgcaggtagaagaggctacttgaggctttctgccaggcctctgaccccatgtgaatctccctggatcattttaagaggatcctgaaatccttggtcctgtggagtacccccagggctctccctgtgtcagcctcaactacagtgtatcaaggagctctcaaaagagcctcagcaaacagaaaacaggacactttatcagaaagaaaattaatttggagctgtctttagttttaccgtgtctctaaagggagaagatgggattctttgggcataaggagacgcccacctggaatcttcccatctgagctctacccattgaggtctgcccatctgagagctgctcagtgaggtctgcccatctgaaagctacccatggaggtctgcccatctgccagcccagctgagggttgcccatcaagatctgcttatctgaaatctgcccatctgaggtctgccagcccttctgagaaggccacctggaggaataagtttatcatcccaggagcaggaatcaacgtgggataaaatagaggacatgagcagagggcacctggcttctccccaggacaccttcttggccgtttctaatgaactgctcctttctgtgtgtcgcaggacttggggtgcacctctctatcacagcctgctatataatgctttacctacctgtctgtctccccaaatagttgctgggttccttgagggactatatctttttcagtttctgttccatgcctactgtctggtatctacatgatcagcattcaatcaatatttcttaaaggcaggaatacattaattattaatttttactctgctatcagtccccaggcattttggggctgaacagtgttacttaaaaataggtaaatgggattaaattaatggtattattcacatggccttgcacatagctcaatcatgacatgtcgaatgggcggttatcaatatctctgtgttaatcctctgaaacttacatgtagcacaatttatttcttaatggcattgattttgtaacaaggcagcattttgggggagcattcacacatccctaagctgattatttcagtgagtcagagatcttttcaattaccattctctttgtacataagagtctatatttctgccccctcattaaagaaaggatgttggtcctttggttggcaccaaccgttgtaggtcaggacaattttttatttttattttttgtattcaggaaacaaaggctaaaagtccttcagcaatggcagttgaggtttctgtatctcctccttacataatgagtcctgccagttaggactgcacgaggtgggaggaggtggcagctagccaggaaggcctgtggcattttgataaacagacatcaatatttatcagagctgctccggtgtgcttccttggctgcaggaacagggagccctccctgggcttgtatattgttttctctgtatgagataaatgtttggggccattaaagaaaaaaaaatgtttgtactctgctccccagttacctaagctaatttacctcactaggaggtcttgtagttcattaataatatacaaatacaaatcaagggaagaaattgccttgttaattgacttttgcgatggtaatctaagactcattgactttaaacattgcccaacaactgtgtttataccacactggaaggatcaactttggagaatgcagaaagctacccaaagcagatacttgaaatcattgctgcttggctttgtaaacagacacccatctccatttgttctctttaggcatctggaggtagaagacagaaaagagactaagagcggggaatagactcaaccattctagaatacagcccggatgtgttacaggatcctgccctggagtcctcgcgcaatcaatgtttatgctgtgctctgctgggctgtgctgggctggcctgggctgtgctgtgctgtgctgtgctgtgctgtgctgtgctgtgctgtgctgggctgtgctgggttgtgctaggcggtactaggtgttgctaggctcctgccccatcacaaatggttgcaacaagattgattagaaagggtaccattagattcagctgactggttcaattaggagaaaggttcatcactcttaacacatcaaatctccccctatgtcagtctttcactgacatcaggggctgggcttctgtctcctcttctcttctctgatcattgcctgtgcagaagacatggaacttttgtctgttcattaatagagtccagtggtaagttttcccaggccagccctggtggtcaaatgctctggattcgatgcctatccattctctcctcaccctgcaaccaccggtccccaattcctacaagtctggagctggtttcaagttcatgaatgtgacctagagagtagcaacctcccagcctccggcataacccatgttctctctgactctgcttgggccacgtggataataaatctggctcctccttgaagcagccactcacccatcagcatgggcagccatgcaaattttcctgcagatttcacaggggagacagagcagtttgtaagttgcatgctccacagcacacagccttaatccccttgtttgatttttaaaattctccccaaggcgcaccttgattgctttgcctctgggactcttcctttctgacctggccctttgacatcttttaattcctctcattcatgcctttcttgattaaaagaagaagagaaaaaaagctagatctggagtgtgaagcttgagattctttttttctgttctgtaaaatggggatgataataattcctacctcataaggtgagagggagaattaaatgagaattaagtaaatataaactctaaagtaatgttttgcaaatatgacccatgaaatcaatttaatgggttgctacctgcattaacatgaagtaaaaaagaatagaaaatatcagagtgtattgcatgtagtaagcataagttttgtgagtcttttcttctgattttgtatgtgtatgtgcatgtgtgtgtatgtgtgtgtgaccactggcaatgtaaaatggactctgctgtgagttatggtaaaaaaaaaaagtttgaaaaacatttctctaagagttacatggtttaggtatttgtcgttaaaatttgtcttcagctttgaagttgaaagatcattgttgaaaagatcagagatcctcatttacccccatttaggagatgacgtgacctcacacaaaagacacaatctggcagcctggggatctaattctgttcaggcaatttttattagctcacaaacgtttattttaaaaatttgatcacgcctgtaatccctgcacttcgagggccaaggcgggtggatcacgaggtcagaagatcgagaccatcctggccaacaagatgaaaccccgtctctactaaaaatacaaaaattagctgggcatgatggcgtgtgcctgtagtcccagctactcgggaggctgaggcaggagtatagcttgaaccagggagttggaggttgcagtgagcagagatcgtgccaccgcactccagcctggcgacagagtgagactccgtctcaaaaacaaaatacaaacaaaaaaaaatttgaattaattagtatcatttgaaaagcaggaggttggatataaacatctagatttttcatttctcatggaaatttggagatttggccacatcatgtatctttcctcatttatctcctgtctgggctctggaaacttgccaggctttgactcttggatgactgtatggggcacagttcctgctccttccttgccctggaatctttctcaatcaatgtttgttttaaagaatcacaaagctggaacgtccctacaggttctctgggttcaaaccctcatttgtcagtggaggaaagaggattagggaggaggaggtgacttaccctatgtcatgtggatcaccagtgatgtgggtgggaaaagagcccaggtcttcttcctcctggtttagtgcccctgttcagcccttggggacaagtggccatcatcctcctcctaaaaattgagaccttcttaagagatgtgtttgattcacctcaaaggtcatcagcccttacttttctttcctgtctcagccaaggcaaatgtttaccttgcaaaagtggaattagatccagagtggttcctcttggcttacatggtatttaaatgtctctgtctttgtcctctgtgacttttcctcatggccttgctgtggttgcagctgttttaagagatgcctgcacaaagtcattcacctaagtgggagttcaaaaaggacacttattttcaatgttggctggttacttttttaaagccttttaccgcaaggtagaggaaaaacagcttggggtgcattttttgtcaagcatggtcacagataataccagtattaacagtttgacatatgtgtaatcccctgactgtcccagagaaaaggtgcggggtagcagccatgagccatttgcagagggggatgccacactgcactgggcactgggccaggattagccgatattttcaattgttttaattttttaaaatttattttgcattagaaaatagccaagcataggctgggcgcgatggctcacgcctgtaatcccagcactttgggaggccagggcgggtggattacctgaggtcaggagttcgagactagcttgaccaacataaagaaactccttttctactaaaaatacaaaattagccaggcatgacggcacatgcctgtaatcttagctactcaggaggctgaggcaggagaatcgcttgaatccgggaggcggaggttgcagtgagccgagatcgtgcgattgcactctagcctgggcaacaagagtgaaactccatctcaaaaaaaaaaaaaaaagaaagaaagaaaataaaatagccaagcatacacaagagcagacaagatggtaaaatgaacctccatacatctatcactcagggactcagcatttatcaagattttgctacatttgctttctagtctcgtttttaacttttactttgatgtataatttgtacacagtaaaattcatcaaccaatttaaagtgtatggtttgatgaatttttaaacttttattattttgaaataatttcatacttacagaaagttgtaaaataatacaaagaatttccatatacccttcactaagattccccaagtgttaacattttatcattcttgtttttatcattactcatcaaactttatccacatacacattgttaatatttttctgaatacacacactgttaaaaaaacaattatgccaggtgcagtggctcacacctgttatcccaatactttgggaggctaaggtgggaggatcacttgagcacgggagttcaagaccagcctaggcaacatagtgagaccttgtgtctactgaaaaagaaaaagtagccaggcgtggaggctgaagtgggaggatcacttgagcctgggtgatggaggctgcagtaagctatggttgtgccacttcactctagcctggatgacagagtgagaccttgtcttaaaaaaaagaaagaaagaaagaaagaaagaaataattattcaatgatacttgtcaaaacacactaaggaacactttattcaggaccataggtataggggccactgtaacagggtcttgcagtgagagagagagattgaacttaattctgaatacaacatgggcaggtgggagtttacagcccagaagcactgtggggtcaatggatggaaaattactaagaggaaacagcaagggtaagggagattctagctaaacgaacctaacactattcttgctaaagataggccaacttgatcagacatcacctgcggaatgctggaggttggtcagatgtcaaggataggggtttcttgctaaactgacttagtgaggttctttgctaaaactggaccttataggaagcacacagatgggcctaggaggagaatcagaagcctgaataaagtttggctaagcaaagaatctttgtcaacatgctattattatttttctgaaccatttgcaggttaatgaattttcacaaatgtttatgtccatgttatcagcactcaaatcaagttgtagaacatttccagtactccagaaagttcccttgatacccttttccaaaggcaatcaatgatcttattttttttaatcaccatagatttgttctgcctcttcctgaccttaatgtaaatggaataactcctgtctttatttttgctgaattactttaaagcctatcctaggcctcatgttatttcatctttacatactcagtaagtatttctaaaagttataggcattttcttaagtaatcatgatgccattgtggttatataaaatgtcttcataccaactgcctatgattatttcctttttttttttttttgaaacagagtcttgctctgtcacccaggctggagtgcagtggcatgatcttggcccactgcaacctctgcctcctgggctcaagccattctcctgtctcagcctccggagtagctgggattacaggcatgtgccagcatgcctggctaatttttgtatttttagtagagatagggtttcaccatgttggccaggctggtctccaactcctgacctccggtgatcttcccacgttggcctcccaaagtgctgggattacaggcatgaaacatcgcacctggccaattatttccattttacaggtgagtacacgagctcaaggaggtggaaaaatgtgctcagggtcacccaggaagtgactgcagaagcaggcaatctccctgcagagccttacttgacactgcttagtctctgctgctgttctcagtgcgggtccccggcggaggttttggctgcctgggggaccaaggagtggctgacatctctgacgaccctttcttgtgctttgtgtggtccctctcagctggggccctataacacatggcaatccataaatgcactcacagtggccctttgagccccccagcccacaggcacactcacttatgccactatttttagagatgccgcctgctgcctttcaaaagaccaaagaaaggaaatagccctgcagtggctaaacagatggagacctggtggatgtgtttgaaggctgctgagagcttctcattcccacagtctagacttcggaaaggtgcagagacaagttaagccatcaaaatgcagaaaagacatattcctttcatattttagatcatagttgcaaatgagtcctaataacacacaaatccctatttgtataaaaacatgtaagtaaaactgacggtaacctgttcttccaggagacagttaggtagaaacaagcctaaaaggatatgtttccccccccttggaagcccagcacagaactcactgggaacaagtaaattattatgagcctgaattaactgctagtaatcacaattttaatctgtcttataaattgtaaggtccatgtggcaactagataagtcaaagacttaaatgtattcacaaatcaaaccttacacacttcccagaggatgtatttgtttgataaaagcatccttaatcttgtttctaaaacagagctggatgaagctgtttgaatggaaatggattttgatcaaaaatatatttcccaattacttagaaatagcttctctgctctccacatgacaggcctgttgactattgcaaggttttcaagtgttttctttcttggcacagtgatcaaaagaaggacctttggagtagggggtcagggaggggagataaaggggaatggttgggactatagcatctcttcttccttccctccctcccaataagctacctggctcctttttaatctgttttatggactaaacttcagtgtaagattacctttggaaaaccactggcttcatgtatctcttctttctgtagcatgtgagatgctaagaaaggtaacaggaagctgcataattcctaccttgtcagcaccccgagggcctagggagtggccttggtcctacaattgtcgattctggcctgatgcccatggacttgtcactgtgttgttcttccttcctcctctccacttacttcttggtatccagagaggaaaatcatgattttaaatgggaacagaggcctgagaggatgttagacgttctttttttcgtcttcttcctcctccctataattgttattattattattagaggttgagcctccctaatccaaaactccaaaatctgcaactttttgagcgcccacatgacaccacaagtagaaacttccacacctgacctcatgggatgtcttgcagtcaaaacgcagtcaaaattttgtttcatgcacaaaattatttaaaatattgtataaatgtactttcaggctatacacataaggtatatataaaacataaacgaatctcatgtttagacttgtttctcatccctaagatatcttattatgtatatgcaaatattcccaaatctgacagtctggaatctgaaacacttctggtcccaagcattttggttaagggttacccaacttatgtaaagccacaagtccactgaaaaattaataaagtacagaagagtagggagaagtaaaaaaacaaacaaaaaaaacccccttcaacatctatatcctagagacaagaagttgtatttctgacttagaattttttaggtgcattttaacaacatagctcagacagtaggcacaactttttagcctgctttttgtcacagacccttttcaacacaagcgtttgacttagtgtttaatatctcactaggggatggctacaagatttccatccaagtgtgggtttgaaggaggaattttattctttatgtatttctgttctatgaaattcactttaaatttctcctgacatctcactggggagctcactcttccctttctctatggcataaagtaaggagtgcttcattgtgcattaagcctgtgctctgggggatagagaagtcagccaccaacacggccatctaagaatgtgcttcacatagactctaacacaaagactgtttgcatggagcacagtgtgggggatgatgaggtccatgacccagaagagtgccctggaattctccctgttagtggtgtgagagcttttttgtactcctgcagcaattcacgttcttggagtggtttcaggaaagcttactgccctctcttctcatgagtactaggtgtgcttcaggcccccaaagtctttcccaaatctttattagtccctccaaaggacccagaagagatcaggtgtggtggttcacgcttgtaatcccagcactttggggggtcgaggcgagcagatcacttgaggtcaggagttcgagaccagcctggccaacgtggtgaaaccccatctctactaaaaagaaaaaaattagctggggtacatgcacctgtaatcccagctacttgggaggctgaggcaggagaatcgcttgaacctgggaggcggaggttgcagtgagcccagatcgcaccactactctccagcctcggtgacagagtgagtctccgtctcaaacaaacaaacaaccgaaaaaaagaccctgatctttcctctaccatcagaagccaggctctacgatctagcactatagaatgtaatgtccgaaaaggaaccaccagaatatttgctggatgttgtctttgcaccagtcattgtgccaaggaattatacagctgagatttcatttcctcctcatggccacctcacaaggcaggaagcgttccttccactttacaaatgaggaaaagtgagactgactcacagagagcttgaatcacttgctcaaggccaccagatggcagggacagaactgggactgaaacccatctccctgccttgagtgccttatcctgtaacctagcctcgtggccatggtttccgttgcctgactttttttgctttagccagttagggatctcttcctccattctcacctggatgctgtccccattaaagaaaggaaggacttttctctgcctgcctctggctggaggagccagcttgccttctcccaactcttcctagcaccaaagacagagaggcacacttcaccccacaaaaaggccttacgatcttcccagagcctgatggttttcagaaaaatgggaaagaaagaaccctctggagacagggcctttttattttatttcatttcacaaacacaatgaaaaaaaaaatcctgctaataggattgccaactcagcaggcctaggcaagcaattctaagtaaatagaaagcatcctggcacaccttgagattgattacaagtcaggaacaatgataggcaaccagaaactaatcaggagagttgccttttactaaagggaggggatggagagagagagagtgccagggcacagccattacaaccaagtcctatcgattttgtgctggtttcccagggacctccatggctcccaggagcagaggtagcagccaagttgttctctgggctgcctgaccgcaacagctctgatgataccagcctctgggcagttgcactgccagccaaggaggggcttcctctggtccaggtgtaataaacacctggtccaggtgtgataaatcccttactccactggcctcaccagaaaggcacaatgccttctcggccaaaagaggccccgcctttctaaccttggcctggcaccagcagctctaacatgaggttgatggccttgaaactgctaccggccatctccccagctgggctgatctcacctggatcttccaccttgtgtccttcctgggtcttatctctcatctccgtcaggcagctttctactgttaagggagctggccagagagcaggctaggatctgatgggggaggcagctgccctgagggaaggcagaaagatgcagacctggctgtgccctggggcccgagtggcccacagctcttcctcttccaggtcacaagtgcctccctggaaagtgatctgtggttgctcaattcttacaggtgtagtctaaactcattggatgacattcagggctgtcgtgaacttgctgttgaccttaccttctcttttgctttccttccacacttttctccccaccccagccatttagtgtctaattactactccttcctcaagtcctaggtcatattgcctcccacctggctcttgggaggccttcccgcgtgtaatccccacttgctctgttggccctataaatatcaggtaactgtcatccacctactgctatatactttttttttttttttttgagatggagtcttgctctgtcgccaggctggagtgcagtggcatgatctcggctcacttgaaccgcctcccgggttcaagcgattcctgtgcctctgcctcccaagtagctgggattacaggcatgcaccatcacacccagttactttttttttgtattttttgtagagatggggtttcaccacattggccaggctggtctcgaactcctgacctcaggtgatcctgcctaccttggcctcccaaagtgctgggattacaggctactgctatatacttttaaacccagttcagtgccatacaccaaagaaagaaaggcctgatacaggtgttttgggcatcccttgggggaatacaggcaaatcttaggggtagcaggcattggatccgtattgaatctcaaatcttgttacagaggtgccacactgtttcaattttcttttgttattttaaaggtctccctgagcctcgagaccatcattagaaacacttggcttcattcatttatcttcattttatgacccagcagtcactactaaaagtactgacccctgttgatgggaagcatcaaccacttccttaattttcactgtctccattcctcttagcaaagggcaggactgcggtgttggaactgtcttttgcatgtttggctttcacagctgcatttgtagtccaatagtttcctcctgttggtcacaatgcaaccgaattcatcctctccagccacgtttattcttcagacccatcgtgctctctgggcacctgcctttctggttggggaggagagagcagaggaatgcccaggtttgggaagaacagtgggacctgtagagaaattgccatccagaaactatggacgggtaggagttggaggcttttgagaagtcagtcagcccatttctgtcttaccacttaataatgctgagaggttgcaggagtttgtattgttttaatttacgaagagcaggaacctcttagtgctatggaagtaattgaagaggcaacatggctatgaaaattatcaggcaccaaacagcagtgatactgatggggtgaatgcctgcatcccaactgccccttctcaggatgagcctcagatacataggagcaggactgagtttgggctatgtgaccccatccctgtgccacacccatgcacttgagtggtccagtggtgggcacctgacccaagctgagccaattagagttcttccctgagaattttccaaattcgaaccatttggaggtaggaggcattaggatgtgagacagaagctgtgagctggcatgttctcaatcgttcagagaaaactgggctgcagtgagagagtgtaaaatccacatacagaggaagtcagcttttgaatccctggtttcattgttcctatggctcagctgcagctctccccttctttttagtttgagctagtttgagatgcatttctgttccttgtgactaaagtgtcctgactcacagaaaccaaactatatcaagcatctgacatggcaggagctctttgtccttaaaaccccacacctgcaccttaagaaagaccattgcttctataggagatgtcatgagagaatgcagcaacttcaaactgtctgaatcgaagttacatgaggcccgcaggaagagttttacaactaaataagtgcaacatttgggtttccccaactgattctgttctctaagcttcttcattgctgcttctgctctgctatccttcatctagccttgacacgtgtgtgctgagatggaggagcactggactgcgcgtcctgattctgcccttccccagtcacatgatgtcaggcaaaccatggacctctctgagagtttattttctcatctacaaaataaggataatagtaatgcccagctcatgactttactgggaggcccacaagggagtgaagtttcaaattcaagtgctgtgactttctcttgtaaaacaaaaagcagatcacatggccttacaactctttgatcattcgattcaattcaattccacttaataaatattgctgagtgaccaccatatgccaggtctgatgagagctggagctcttgtaatgagcaggacagatgagggctgtcttcatgcagctgacattctaatgggggacagcagaaaataaacaggtaaaccaagaaatgaacaactaagacagttttgaatggagagaagcccaaggaagaaaacaaaatgggatgtagagtgagtggggtatgtgcttgagaggagagcagggcaggctatttcaaactgggacagttttagaaattctggggtatgtattgaccatggatataagccatctcgttaggtcccatgcccagcatgcaggtgttgggcccagggtcaatgaaggatgtgtgtgaatggctgaagaactccgcatgcacactgccttgccagctttggactctgcaacctaaagaattgatatccagactcaacatttgttgaatcttaaaaaaaaaacatgttaactgaacaattggcttgagcaggggaaaaatgctcactctgggctcacattttcttcgcttatttcccttggtatttctttgctatggataatacccttttctttctttcttataatttttttttttggacaatatcttgaaaagcatccaggtcaagattgatatgacattggctctttccttgcaaaattaggccttgctcagtctgggggcccagcgtttcagagtttcctgctgctgacatcttcagaaaagacttccactttgaggtttaaaatttttcttccatggcaagtctaaatgggaggaatgtgccttaggcattgtactaggcatgttatatcatgtaattcttgtttttttttttttgagacggagtctcactctgttgcccaggctggagtgcagtggcccatctccgctcactgcaagctccgcctcccgggttcacaccattctcctgccttagcctcccgagtagctgggactacaggcacccgccaccatgcccggctaattttttgtacttcttttttaggagagatgggatttcaccatgttagccaggatggtctcgatctgctgacctagtgatctgcccgcctcggccgcccaaagtgctgggattacaggcgtgagccacagctcccggccatatcatgtaattcttaaagaagtgaacctgtggagttttaaagaattggccaaggacatcaagcaagttacaaggtgatcacacgtacctctaagtcctgcctgggttcactccacaaaggtcattcacaaattacagcaaacattgcatagtgtgctttaaacaaagccaccttacagaagctcttttgcacccattatcaacgatctgcacaacagctccgtgaggtgttgtggacgcttttattatgacttgtcagtacctcttaccctctttttcagctttgctctcccctctcaaggaacagcaccttcctcatttcagtgaattggttctagggctacggtggtatcttgctcctctggctgcagtgattggcccaacaatgtacttgtggcccacacagggccaatcagagtcgttctttgggttcttataccttgagctagaggcgtatactcttcttcctgggcagccactgcacacgtgagcctgagggtagctgtgttccagctttgcacagaaagcaggtttgggagaatgaagccagaggccaaggagagaatgcggaatcctggagtgttgaaggcccttgttttgattcctcgcgtcctccagtgtgagtgagttcactttctaggacatgcattcaaagaactcccactgaggggccagcaggaattagtttctgaggcagcaactaggggcagcagttgcacacaggttgttgtttttttttttgaagctgtagaagaggaaagcctctgtggacgatatgcagaaaggtatctttctctgcgccagacctctttatgatgcaaatgacagaaaatcccagcttaaactggtttagacaataaagcaagtttaaaagctaaggtagggcaaggcacggtggctcatgcctgtaatcccagcactttgggaggccaaggcagttggatcacttgaggtgaggagttcgccgacatggtgaaaccctgtttctactaaaaatacaaaaattagctgggtgtggtggcatacgcctgtagtcccagctatttgggaggctgagggatgagaattgcttgaacctgagaggtagaggttgcagtgagccgaaattgtgccactgcactccagcctaggtgatagaatgagactgtctcaaaaaaaaaaaaaaaaaaaaagctaatgtaatttagaagtctagagacagtctaccttcaggtgatgcttgacccaggctctattgatgtccctgaacgaatttcttcacccctctaatctgccttcctcagttttcgcagaatgaccttgagaaactttaggcttctcttattgcagcagcatgcctcagtttcagatcttcagagaaaaagggttttaccccacccccatggattttgcacagtgcagagatgtgcttttccttgatgaccgaggctggggcagatgcccagttttgattaaaacactggctgggggagggtgctgtgttgcagcgaggggctaagcaatcctctcccagttccatggcagagaagggaggagaaaggattctctaaaggcaaatcagaatactgttggggagagaagcaggaaatggagacagtagatgtagtgatgtggcaggtcaggtctcactaatgcaggcctccatgacaactgtttcgtactgactgagtagttaagttaaatattaaaagtggaaagagtcagtgtccttatacaaagactggaatgtaacaaaagcccaccaagagttttgcctaggtctttcctgggctttaaaacatgacaaaataacaaaagaattcttaacaggacccatttaggatgaaacaagttttattgagggtctgaagaaactccccaggcttccacaaacaagtttactgggggtgtaaaggaattccccaaacctttatgatttagcaggagacaagataaggataatcacttcagcacctgggcccatttagattaagtaaatttactgaggctccagaggaaggtcttcaggactcagaccttagttatgcattaaaaaaagttaatcacttatgtctttagatgaatgcacacttacacacttacatgtagacatgtagcttagaaggtatataagctctggaaaactttgtaattttgagttggtctgacaataatttccaggccttctccctgttacctgttgcagaaataaaaactctcttcctccccagttcatctgcatcttgttactgggccacaagaaatagcagcctgaccctcagtttggtccaggaacagtgacacatggccactgcagctcttattgctaaggtcactgtatgtccaggtgaaggctgggattggctgagatgcaggaggaatgagggcaactcagcttgtgtagacaaactgaagtgaaggttttaaacatggctgcaggccgggcatgatggctcatgcctgtaatcccagcactttgggaggttgaggtgggtggatcacttgaggtcagaagttcaagaccagcctggccagcatggtgaaaccccatctctgctaaaaatacaaaaattagccgggcatggtggcacacacctgtaatcccagctactcgggaggatgagacacgaattgcttgaactcaggaggcggaggttgcagtgaatcgagatcatgccactgtactccagcctgggtgacagagcaagactgtctcaaaaagaagaaaaaaaaaaaaaaaaaaaaaaaaccagctgcagatgaaacacactttggggtgatttgtagcacctggtgcgcactttgccaaacagttcccttcatgtggggacctagtagatgatgtgtgacacagtctttctgctgcctcccccatgtggcagagtgggattcttaaccctagctatctgacacccccaggatccactgcccatcaaggtcaaagccatgtcctctctcctgctctcctggccctttttgcttcacctccctggcccagacgctaactagctgtgcacttgcacaacaagaccctgtctgctttttgcaaacggcaggccccttagggatagaaattggggcggggggaggggtgtttttgaaaccctcatgctgacaactgaggctccatcagtgtctgctgcatcaacatctttagggcttaggctattttttttgttttttttggtcttaaaaagctggctgaatggattctcctgactgcgtgcttattagaaagatattgcatcaaaatgtggtgcagagttttcacttctagaaatctgacttttccaaatgcctgaacagctgttccttttgcattatgcataacagggaataattagagatgacctcagtgtccatcaggtagggcatctctccgatagcacacttagcagctctttttaaaaaatgagctagtcacatgtcttcccatggaaagatgtccaggatatgtattcaagtgacaaaaaaaaaaatcgcagaacaatatgtaatccaaccaccccccttccctggcaaacgatgtacaaaaatcactgagaggctacactccaaattgttaatagtgattctcattggagaatgggattgaggtagtaaaacattcatgtttcacttcatttcctattttttatttatttattttttgagacggagtcttgctttgccgcccaggctggagtgcagtggtgcgatctcggctcactgcaagctccgcctcccgggttcatgccattctcctgcctcagcctcccgagtagctgggattacaggcacgtgccaccatgcccggctaatttttttgtatttttagtagagaaggggtttcaccgtgttagccaggatggtctcgatctcctgacctcgtgatccgcctgccttggcctcccaaagtgttggaattacaggcgtgagccacggcgcctggccattttttgttatctttaacagttaggcagtcaggcactcttagataagatttggaaggcgtaagctgacaagcacagcttggagggattggactttattggggctgtgttagcagaggtctcctgtctgattactgactttgtggagagggtgcagagcaccatttgctagtttgcattagagcagctgtgatgtggttctgcagccgcttcagcaggaagcttttcagtttagcaggtaactttctgatggttaatgagccagctactctcttgtagactgattttgctactggattctgtgactggaaattgtacttttattcagcccttcctataattctataaactatttgtgataaacctcttttgtttaagctagctagagtgggttttttttttttctttacacacacact

SEQ ID NO: 427 - DNA, 20001 bp, Homo sapiens
attgaagtaattttttaaactttttctgaaaacactgcagacctttattttttcagagccaaggaaacttttttgagcatctacagcttctaacatgagtaaggtatactcttataaacaaaatttggagcatatttttttctctctgcttggtttctctagatttggaaactgtgagtattcttaagttatgggaatacagttatttggatcaatgcaataagaatccattttcttttgcaacaggatgcaattggagaaacaggttgttttaccaagtctttgactggaaatgtgtgcttccctttaaggaattgagcttgacttgcaaagccaataaaatccccttgggaaaactggcctcataccttgtcaaaacagttcctatacagggttcctaacctgtggtgagtaaacagtgtcatttctaacaggcccaggagccccatgttgtcttgggacttgaagaagagagggatttatccaactcataggtatttgagggtacaaacccatggctaggctcggctttaaaaggtcttatctgagattccttgtggaatggagttccatcaaagccaatttaaaaagcctacatgaaagataattattcttgttacactttatgcaaatgatcaagccaagactaaagtttattttgaaaacaactcagtcctatcatgatttgttttgacaaaaatgtggattggagagaaaaaaaattatgtttcaaaacttatatttgtcattgaattctaatctcagttgtttttaagtttttgcttacattttagactaagactgcttattcctgtgaactaaccagtggtctctgggtgcagcttagaagaaacagaagggatgggtaatgtaaaaatctagatcaacattctagttctgagcaattatcctgcaaatcctgccaggtgataggagtaaatagggtgcctattacctggaggtttctttgtttgggaaaataaggccagtggagctaaccaaagccaagccccatgaacccaactcttagcaagcaaaactatagccaccagttatctgggcattccagcagcctcaggatttttaagctgtccttacccccttgtttcattttgatacatctcttctaataacccggtttgtctcttcttgacttcaggctgtcagactccaaaaggtcatgcaattggagccttggataatggctcccattcaccaagttcctttagataagcctctgagggagatctgactgctgttttcccaaaacatcgccccctgtcagcaggaagcagttaagattggtcttcatccctatgctaatggcagtgagatatacctcttcagaggggggacataagagtggcaggaggcagccaaatgcctaggccgacaggtgcaggtccccgtgaatccccacctccaagccaaagacagtttaaagcctgaaagccaagctacaagtcaacccctcagatcagattgagaacttgtcttcctgtttggcatgctttcctctgattgatccccacccttcacctattttacgtatacctgctctttcctaactggttttctacactgccatacccagctttgagtggtgtcttcactttaaccttttctgcatactcacaaaccaatcagcatgcagtctccattctgagtccataaaaggcccaagacccagccacttggtggggactttcccaccttcaggtaggggaaccacccccgccccaccatcccttctttgctcaaagctttcattttgcttaataaattctactccacttaatctctggtgtccacacacctaattcttcctggttttaagacaagacctcggacctagctgagctaagaagctaaggaccacaacactgccacctcccaggcttggaggatagcacgaactccagaactcaccagcattggaagagtccataactctcctctgagcagactgtgatgcttcaggataagaccagagctcccgtcttttccccaagtgagcccgccccaagcgtgctttgtttttcaaagcctcaggagcaagaaatgcagaattaaagccaacagctcagctctgaccgtgatatcaggttgtgtttgtcccctaaccatacacaaacatgccctgcccttgcacacccagcgtctgcctgggctgtgttctgagcccttgcagtcagctcagcccacggtggcaaaacaaacacacagggcaattctgcagagaagagctgcctaggggcatttgggcccagattttatttgaagaaatgtgggagaagccacggcactctccccagagttcctgcaaacacagcattcatggctgtgaggactgggatggggacaagccacctctccagagccacctgccaccttgctcctgtagggaccctcagctccaagcaaacctgtttaaaagcaaacctccaagcagacaggcacctgtcaccacccacaagcctgaccttctccctttcctttggctctgctgaccccttcctgtctgtgcagttccacaacccctgctggccccctgacactgtggtcttcctggtccaatgctgggcaatggggaccctgagataaggaagacggagtgccagcacccccagacctcacattccaagggagaagtcagggacttatacagactaatatgattcaaggcactaagagcccaaacaatgggacacagcctgataaacagcctggagagtagggaggcaatcagggaaggtttcctgaaggaggagagacctgagcagagtggagagttggccaagcagaggaacttgagggcattgtcagcagaggggatggatgcaacaccaccttgaggagatccttcttccctgcaccttctcacctccaatctcaacacaaatttctctgtaccacccactggtgtggcccctggtgtatgctgctctgtgtagcagtgtgttcatctggctgcttggcatgaccagactgtgtgtgtgtgtgtgcgtgtgtgtgtgtgtgtttgtgtgaagagagagggagagatttatactctccttctaccctctgtgctgtccccagaacactctccattaaagcttgttgagcaaatatcaatgacaacatctccagcacagccattgaagcctcatgcttcatcccaagcctggggtccagcgcaggctctgccccttcccagctgtgcttcttcaaccgtgagatgtagctaatcatggcatcagcctccagggttcttgtggtgactatgtcaagtgatgcatacgtgcagagcattcagcaagtgcctggcacacagaaagtgttaaataaatggtagctattattattcttggtggtattctaaagctcccacagccactgtgccaatgccctggctggcattctggaggccccagggcacagtgaataaaagctcccatttaaaggccaggtcttgggggtgagtcctgccctggctatgcaacctcaggttggtgcctaggaggacccgggtctcctgtgaagtggccgactaaggctcttggaactttcccagaacaacgatctaactccccactgccctcctcccccaacgactgaccatagctcccagatctcccatcagttccctgctttggagtcgtggacactggcccagggggactggcctctgtgccccgagagcctctctggccccctccacacactgactcccagcttggcagcaggcagctgtagaatttacaactgtctgtccagccttggcctctgcccttgaaggtgggggatgagcctggccctgctgctggccagcgctgctccatggggagttcctgctgcctcccactttgctgctgagccacttcctaaaacccacagaggctgaggagctgccaagtcctccaggaaaggctgaggcaagtggtacctgggcaggcagggtggcatggtggctgtacacacgtgcttttggagtcttggatccaaatttcagcattgcccttccaagtcccagaaccttggacaagtcactcagtcactcagagccgctgtttcccagctataaaaatgggaaaataccagtgctctccctttgggctgatgattgtggaattacatgatatttgccctcagcctagtgcctatgtcaaggaacaatagatgtcttcttaaaaaagaatgtgctattagcctaaagctgccaatcaagttccagaagcaaacagtgcacaaaatgggcatctcctgaatcacaagtggccgcctttacagcttgacttggggacccaggaaggtgagagacagtaaacagaccggaggagatgctacctgggcctgcaggaggagcaaggggtgcaaatgtagggtgcaggtcccaaaggacccagggaggggaggaggggaaatacccactcctgggcgggccctgcagagggagtctgtgcactcagcacagagaaaggccctggcagtgggtttcccttgggtggggggatccctgatgctcagccctgcagcggtgcagagcaaaggggcgctgagggtggcccgatggcaccttcttatctgagtgatgtagctgggggctcagctggcctgtggagtgcctaggaacaacttgccagaagccagattggtattgagtgcactgtggctggagctgccattcggttggactccagggggtaaagggaggaaacatggctgaaatggcggggggaacccaggggctgccttgctgggcatgaagtgttttctggagcaccggagtgattagaactgcttccctccacaaggcaactcctctgtttgggctttcacaccgggggagatgctcttttcctctttcctgtgattttttgtggtgagtagacactggccttctcgactggaacctgaaggtcaagaaagaacgagggtagaaaggaagcctcggttcttagggaccacccaagggtcttaggatgaagcccctgggagggaccccctgcacaactccctctggatcccgtgatcatggagcgggagaacagctggtgaaggctgcaggggtttcacatcccaggtcttggccaatttgcttccaccacagacatgattctgagtgacagaaagtgtgctgctggcacaggaggccaacaggacgtccgggagttgtgaggctccaagattgagagggctatggcctccttactctttgagtcactactgaatgctgcctccttatagaagcctccccgcgccaggtttctctatgacctgtgctctctgtttcttccacggtgcaaattaccatttgtaattacgtatcaatttgctcctttgttctctagaatagaagcttctggaagaaaggggcctggtgtacctattctctatggtatacttgacatgccactagggggcaaagaggacaaaagggcttcagagaaaggcctagacatgcgttgctgaaagcatttgacatttgggctgaggtggtgggggagaaggcaacagcaatttctaggcacgggaagagttatgtcatgcaaagtgtaacctggcacagagcaggggagagactggagaccaggagacaagtttggaggccactgccatgggttagctgaaacagggaggggacttggagagtggggcatggcccaccagagaggagataggagaatcttccagaccctaaagccaacagagaagagccagttcatgcagacaggagatacagcgggaagtcagagcacgtgtccattcattaacggggtagtgccatcatccaggagggagtggggctgcagggatggagacatggagtggtcatcataaggaacgtgtgcttgaagctactgcaattctaaaacaaattggagaaacagattttcaccatagactttcattctaccactctggagttccaatttggcccagattctgatcacccaaagcagaaacatagaggagaaggacgctggccaaatgccctcggtgcctttgggggtccagtcagtctcccctccagtggctttgtgttcactgtcagcagagcacacacctccctgccactggaggccacagcaagtccctgcaagacccacagaaagctgaaccttgttagctttcagttcccaccagcacctctaggaagcccagcggaatgggggagagctcctgtactccccctgcactgccttctgctgctgttcgtgtcaaagatgatgataaaggcagggaaaggggatgaaaggggagtgagttcagagacagggacaacaaggagtgctgtccatagagccactgaatccacttagagaagagcccacagccttcaggctggcccctttcaggaatctgtaatgtgcccccactctgtgagtagcagaccctcctctgagtgtggaattacatggactcacatatcactgcttaacccactagggtccttcccatccacacaaccctttttatagcttgcaatgactgaaggtttagctagttccaagagaaatgccaaggagctggtcttaaacaagttccccttgtccttcactggcaacttgcacttccaactcgggttttctgactccctgcttgaacatttctgggctggcctcctggccatcagctctagatcattcgcctcccaagcctctctacttcctgtctcttcttcccattccatggaaaatgcaaaccttctgtgtagagcaaaggcctgtcaatcaaagtgcaactcacagacaaaagaatcaccgcagtgggtggcttcagaactgtgtggctgccagagctgcctgagtcagtggagactgtgaacctccactcgggtgaggagcaggctccctcctgggctcctgctctgggacaatgggtggggaaaagggaatgagtgtgtattctgtgccttttcattccgagctttaaacacatcatctatgtcgttgatccctcaccaccatcctgaaaggcagactctgttatccccactttacagatgaacaagcagatgctccaagaagtcacatgactttcccaatgccatcctccttaccagggacagaggcaggatttgagtagttttgaccctaacactgcttctctttcccaagcatttgacaggaagctgtctgcaatgctagcagctattaatgtcatcaggacacaaaatctagtaaggcgacaaaatatttgaaaccaggactgacctggagaatttcagtgtcaggaggccacctgtagggattggtggaggtcctgaacctccctgtgacttctggagcagccagcacctcgagccatctacagggtggggcagatttcctccatcaggctcaggtggcatctcctagcttttgcccagccaggacattgctagctgacatctccttcattcccatctcacccccactcattactgccaacatcattcacatatatcctccctcccttctgttctccttgctaattacacacatgtttctagatactctctcaattctggttgtcttcaagccaaatttagggctctggcaccaatcgttgctgccagggggcttctcagagactggaagcaccaagtgtgatgtctttgcctcaggaacatgtctgcaatcatgtctgctgagctctaaccccagaggttgtgattcttgggaactatatcagggcccaggaatttgcatcttaacaggctccccagggaattctgatgctggtggtctgggcattgcacttggagaagctctgaatgaaaccattgcagaatgaatgcaaactttttaagtgaaaaaggaggtggaaaatatacttagagaggtggtggcggtgggaagggatgctgggggtgggagggtgccgggaattaacatacatggagctccggctaggagctggttacttttgatatctcatcacctttgggccctacaacagccttgcaacagacaccttatttgcccttttcacaaaagaaggaagcaaaagtccaaggaggttaagagacatacccaagttttcatggactgtcagtaaagacctggaatttgaagctacatctgcctgattccagaagctttcacaacctgccttgccccactgatgactcagaaggtaccagctaccggatgcttttatacagggctgggcacagagtcagctttcaaaacatacctgctagatgaatgaagaacgagtgaatgaatgagaaaatgaaataataaaactgctttgagatcatggaaagtagcccaagaggttccctctgtgacctcatgctcaaacttcctctcccactgtttctttaatctgaaaggtgactccactaaatttgccccgttgataaggccatgcagctcacctgcacctgttatcagcaacctgaatccaaacaggaagccaaggctgagataagatcgaggaaggcaacgcctggaatcattacaaggctggaattagtttgttgccataagtaatctattgagcacctcctaagtgccaagctctgtgccaggccccaaggataacgcaggaaaccaggcagtccctgcccttgaatgtcttacaatctactggggaaggaaagtgggtgttgaagaaataattacgaatgggatgagtgatacagaaaggaagaagtatgaggccaggcagtcacagcaaaccttcctgaggacacaccctgtaggctgggagctgagcaatgaggagctagccagttcttgaagctaggggagccacctaccgctcttcacatcacaactatcccagagcaaaaaggtgcttgcttttgtgtttcttgcccctgctcaaaatggctttccacaggcgattacccatggtcaagctttgctttctctctgcttctactctcctgcattaccagggtttttcctccagcaataatggccaagccctgcacttttcactcaggcctcctgctgcctctcccagctgccttcagccagtgtctgccgaagcccccttgtagcggcctaggcagttgatttctaaacttttttttcttttttgtgaaaattatttttatagagttcgaaagtacacgtgcagttttgttacatggagatagtgtgtagtgaatgaagtgtgggctattagtgtaaccatcacccaaatagtgtacattgtagctattaggtagtttctcattccccaccacctcccacctttctgagtttccaatgtgtattattccactttatatgtccatgtgtacacagtttagctcccacttataggtgagaacatgcagtattttactttctgtttcttagttatttcacttaagataatggactccagttccatccacattgctgcaaaagacatgatttcattctttttatagctgcatagtattttgtggcgtgtgtgtgtatgatgttggctacgggtttgttgtatatgactttgcttattttaggttatgttcctttgatgcctactttgttgagtttttataatgaagggatgcagaattgcatcaaatgctttttccatatgttttgagatgatcatatggtttttcctcttattctgtttatgtgatgaatcacatgtattgatttgtgtatgttgaaccatccttgcatccctgaaataaaacccacttgattgtggcttattatctttttgatgtgctgttggattcagtttgttagttttttgttgttgttgttgttttgttgagtatttttgaggatctgtgttaatcagggatattggtctgtagttttctttttttgttgtgtccttgcctcatttaggtatcatggtgatactggcttcatagaatgagttaaagataattccctcctccttgatttttttgggacagtttcagtagcattggtatcagttctttgtatacatggtagaattcagctgtgaatccatctggccctcggccttttttttttttttggttgagggatttttttattattattactgattcaatctgactacttgttatcggcctgttatttgctctctatttcttcctgattcgttcttgtgaggttgtgtgtttgtagatgtttatccatttcccctagttttccagtttgtgaagatagagatgctcgtaacagtccctgatgctcttttgtattcctgtggtatcagttgtaatgtctccttttcatctctgattttacttatttgaatcttctctcctcctgattagtctagctagtggtctatcaattttgtttattttttcaaataaccaactttttgtttcattgatcctttgtattttttgtctcaatttcatttatttcttctctttgtaattcctttccttctgctagcattgtgtttggtttgtttgtttgtttgtttttgttccttgtggtgtgacattaggctgttaatttgtgttctttttatttttgttctgtaggcatttaccgctataaactttcccctaagcactgcctttgttgtatcccagaggttgtgatatgtcgtgtctccatttccatttgtttcaaaaatttttaaattttcatcttaatttcattgttaacacaaagatcattcaggagcaggttgtttaatttccatgtatttttattgttttcatagtttctctgggaattgatttctagttttattccactgtggtctgagaagatacttgataagatttcaattttttgaaatttattgagacttgttttgtggcctaacatatgctctatctatacagttctatgcactgtatattctgcagtcattgggtaaaatgttctgtaaatgtctgctaggtctatttggtctagatgcctaattaagtccagtgtttctttgttgaatttctatctcattgatctgtctagtgttgtcagtggggtgttgaagtgccccactattattgtatttctgtctgtctcttttcttaggtttaatatttaatagtatttgttttatgaatctggctgcattggtgttgggttcacatatatctatgattgttataacttcctggtgaatacattcttttatcattatataatgactgtcttttttttttcttactgttgttgatttaaggtttatttttattttatctgatgtaagtatagcttctcctgattgattttggtttctgtttgcatggaatatctttttctacccctttactttgagtctatatgcctttaccagttatgtgggtctcttgtaagcagcatatgtttagatatatttttaaatcaattccaacaatctatatattttaagtgcatttgatccactcacaatcaaagttaatactgatgtatgagtatttgctcgtcataatgttgtcacctaactgcgttgtagtctcatttgtgtaattgttttataagacctgtgatttttatacttttatgtgtttttgtaatgttaagtatcaaccttttgtttacatgtttagaacttccttgagcatttcttgaaggactggtctagtgataacaaattctcttagtgtttgcttgtctgggagatactttatttcttcttcatttatgaagcttaatttagcagaatacaaaattcacggttgagagtttttcctttaagtctgaaaattgaaccccaatttcccctggtttgtaagggttctgctgagaaatctgctgtctcatggagtttcctttataggtgattagacactttcctcttggtgactttagaatttttcccttactttggcttcagatagtgtgatgactatatgtcttggtgaagtatatcttgcaatgtattttattggagttttctgagcctcttgtatcaggatactaaatctctaacaagactagggaaatgttcctcagttatttcctcgaataggtttttccaacattttttcttctgactcaagtatacctatgacttgtaggtttggacgttttacataatcccatacttcttgaaggctttgttcattttaaaaaaactttttatttttgtctgactgggttaattcaaaagacttgttttcaagcttggagattcttttttctgcttggtctagtctattattaaagctttcaactgtattttgtagtttcttcaatgaatttttcatttccagaagttctatttgtttttgtcttttaaaatatctatgactttggttaatttttcatttatattctgaattgtttttctgatttctttatattgttttcaactttctcttggatctcactgagcttctttaaaatcagtattttaaattatttacttggtatttcaaatatttcattttggttaggatccattgctaaagactcagtgtgttcctttgtgggtgttgtaacagttttttcatactttcacaattgtttctctgcccttctcatctgaataaactatctctttttattattttttaatttactttcatctggataggatttttccctccttgatgttgtgtagggtcgtttggctttggttctgagtgctttcattggccatgactctatatgagttccttggttatagatagccattgtgtggtggctttctcatattctggttgtagtagtaatatactggacatgtaagcaggctcacagcctcctgcagagccagggtggcagaggtctcaggaagtatacctgttctccagtgcacacgtgtcagcagcttctgtgtgtggtaagattttgtgggtaagagctggcttcaagagaagcagatggtatatgcttgattttgtttactgggaaagtctctctgttgcctcaggcaatgggctgatctgtggaatgtaaagtggcctgaattgcctgctcagccccagatgcagggagaggggaataaagctgagtggagctggactgccaagcctaccacttggatactccaatggtgagcaaaagcactagccctgatgggggtggtgggggagctcccggtgaaatgcaccaaggtctccatggtgggggtaaggaggctaccccagatccacagcctgagcaagcaggaacatggtccactaccttgtcactgattgctaagctttcaaggattttgtgagctggctaaacaaagctatattaaaaattaagttagacatacaattaaataaatcatactatattttattaaagtcaaaggtcataaatactcaaaactcattacttcctaagtattttactcctattatttatgttctggaggaaatttacatctattgtatctgtatagtatttaacaatggtatatgtacagtggtatatgtaacagtggtactgtgcatctcttcccaattctgcattcagtgacatgaacttaatagttacaaatggccatgatgggagtatttataccacaggaattggtgtaagttgttttgtttattgtctgaatttaacaaagtgttgagaaaaatctaataatataattaaattatataattaaacttaaaagtgtgtcctatatagcagttttctagcattagacaactattatcggattcagcaaagaagttgctcacatcactgagtgaagtttcaacatatatcttaactatttcatttttgtctcatgaaaataccaaccaatcaacattcattagttgtacattcattggaatttttcaatgatgtgactgattttgctcattaaaatagtcatcaggcatttattcatagtctgattttgtcacagtatggagttgcaaattataaaaaccataaattttccatgaaataggaagtcacactgaagatatgactttatataggtatatagaattttcaattaagattattggatatttttattgtttataaattctgtgctgcaattctttttttttttttttttttttgtgagacagagtctggctctttcacccaggctggagtacagtggcatgatcttggctcactgcaacctccacctcccaggttcaagtgattttcctgcccagctaatttttgtatttttagtagagatggggttttgccatgatggtaaggctggtctcaaactcctggcctcaagtgatccacccacctcggcctcccaaagtgctgggattacaggtgtgagccacggcacctggcctgtaattctttatgtcagttcaatttatgataaacttatgttcatatgtacatatactttcttttttcaaaaactgggttgtccttagcccttctgccctgttttctctcctgtagcctgaagtgtttggagaattccacccaattatgttgaggagctacttctctgcccaggcaggtctctatccatttctaacattttccttcatgggttcacaaaccagttttcattttaaaggtaagccttccctctcctccacttttaaaatatttaaaactcacaacatttaaataaaggaaaatataggtaaataatggggaagccccatggccaagagcaaatctgaagcatcgtggctgcaggcccttcatggccagcatttttccctggctctgaagtacattggctgggaattctggagtactggcactgtgacccagacaccatacctgggcctctgcatctgccatcttctttcagacttttcactgggaaagcctgaggggctgtccctctcctgtattgtttgcttcaaggtccagctcacttctttcagaagtttctagacctttctagaaaagactgagaaggttcaaggtgtacagggctaataatactatcacggagctgaatctgaggtaagatgtctgccacctaccatttttattatcccgggtaccacaggattctctcattgtaatgtttgattatataattgggtctccctagacattgccagaaatacctgaagtcttatgtgggtcaggagtccatggtagtcagaagtaagacatttggcttttagttcagtgactcaggggaacatggaacagatatgagttacagctactgggcacctgacactttgctcagacatttaatgggttcccacttaatccttactgaaaccccatgaagtggatcctatgactatgcctgtaaacagatgaggacaacagggctgagagagttaactcaatgtgctggagtcccacaggtgatgagtggagactcaggttacaaacttgttctctcccctggtcctgctgacttgctgcccagtttgtcacaccctctggcctatgacctctcccactgtggccacaagtgcacttctgtaggtatcaggaccagatgggaccaatgacttgaaagaaatcactctgccagatatcagaaaatctgatcaaaatgtgagcaaatgaaagcaacttaatcattttctctgacttagtttttctgtttgtaaaataggttgttaagaagtctaagcgagaaaatctgcagagtgcctgacacacagttctgtagggtcaactttaattaatcctacatgagatggcactcataaaccacaaagaagagagactgccacatacggtgtgttcaataagtaattttccttgttattactaatattttctgacctttattagaacaatactgaacctcctgcttctaaaatacccacccgctgtagaagttccagtagctgtcctgcttttccaggacacactgggttacaaatcaggcatctgtggaccagtttaggatcctacctataatctttaatattatttgtactggagtagaagtgtgttctgagttccaagtaactgacttatacgttgtttgaaaacaaagcccatttgtagctatgaatactccatggccttcaaacacttgcagcagggtcagggggtgcacagaatcctttgttcaaatgacatcttatatgttaacctaagatataaaacaggttctgcaatgagcaagtacagttgaggaagagggggtagaggtggcctagagcctgcacccctcaccagagtcctgccaagcatggtataagactcatctcatactattatcagcttgaacttctaaagacaagccggattatttggtttattgagaatggttatgtgtccatcatacggggctacttacgacacatgaaatgcctttagctggaggctctgtcttatttttaatatgcctctgttaagcagaagtaatcatttcatgatcatggcaagttaatggggttactttgctgaaccctgagatattaccaatattacttcccatggatcaaacaaagtagatcaaagtcaaagttttcaaaatcctcctgcaaaaggaaatttctccaggcaaaactttgaggttttcacagttttgaaaagtagccttgactctcttctagtcacgacaatataaaaatccttttatttgtgccaggcaggaatatatttctcctcagaaactattttatagattacaggtcattttctactttcttttttattcctgtagtaattatcttcctttaagaaaatgttagcacagcgttcagtaggcatgttgaggcagataagccgtgcaagccaacccagctatagaacagagttgtttctgcaagccttctaaatcccaggacccacatagttaaatgtcagggcagcattgcattcaagaagccatagtcttgtggccaaaaaagtaattaaaaaggaattccaaaccctaccaggcctcctcaaaactgggacagggatccaaattcagtctacagcaacaatttcttctctcaccagctccctgcacccacccacctgctaggtttctggagcgtctctctctccataggtcttctgtgcttttcttcacaccagccctgcactgaggtggcaattataggactatcttggttgggcaaaggaatggtggtggggaggaaagtctgaatagcctctcttcaccttaataactttggcctgaggtttgctgtgttctaaattatatcctcattattgcctgattttgtgcaatagtacaaatagattatacaacctggcgtacttcactgaaccagctagttcagtgaagcaatatttagttctgttactttacaagttcttagtagcccaaatggcaaagaaaatcagatcccagtaacaataagagaattattatgaccactctttctcataggataaataagagactccatgtattcttctatttgcacgtttaatccattgtcattaaggttaaattaaataaagttattactctgaaaatgcaatgaaagacttctggtttctagtctaacatgtaaggagattggaataaaccacctgatactaacacgtaaaaaagctaaacaactagaaaagtcaatgaatcttagatctgtcagaaaagtaagtgcacagggcaaaaagctgtcgcccaaattggagagacaggcaggtggatacagagaatcacaacttatcagagtagaaacccacaagcagaaacttctctgtgaacaagtgcaaggataggaaaacctaattgtaactgaaagtgttgaaggaaaaaactcaccaactaagaattctacatcctgcaaaattattattcaatagtaaaggagaaataaggactttcttagataaacaaaaattgagggaatttgttgccagtagacctgccttgcaggaaatgttaaaaggaattcttcagagagaagggaaatgatataagtcagaaacagggatctgaataaaggaagggcatcagaaaataattaagtgaaggtaaaatgaaaacttttgtttttctaattcttttttttttttttgagatggagttttgctcttgttgctcaggctggagtgcaatggtgcaatctcagctcaccacaacctctgcctcccaggttcaagtgattctcctgccttagcctcccaagtagctgggattacaggcatgtgccaccatgcctggctaattttgtatttttagtagagatggggtttctccatattggtcaggctggtctccaactcctgagctcaggtgatcctcccatctcagcctctaattcttaattgatctaacagataacagtttattcaaaataatatcaccaatctactcgataatgtatgcttacattatataaatatgtattcctatgtatgcttacgttatgtaatatatatattcctatgtatgcttatgtataagtgagaagaatgacagcaatgatacaagagatggaaagcaagaattaggaatattttgttattataagatacttacactacctatgaagtggtatagtgttattcgaaagtcgacctggattagctgtaaagggatagggcaaactctagggcaaccataaaaaaaaaaaaaaagaagcataactgacatactaagaaaagaaagaaaatgggatcatatggaatgttcaattagaattacaaaaggcagaaaaaagtgtagaagacaaaaaaaggagtgaagaaaaagggcactaaatagaaaacagtaataaagatggtagatgataattcaactatatcaataatcatttcaaatatcagtgtctaatacagcaattaaaagacagagattgtcagagtgaatccaaaacaaaactcaactatatcatgtctacaagaaacccactttagctatgaagacacatatatattaaaagtaaaggaatggaaaaagatataccatgttaacactaatcaaaagaaagtaagaacagcttattaatttcagacagacccaactttagaacaagaaaagtaatcaagcaggaaaaagaggagcattacatagggataaaaggtcaatattccaggaagacataacaatctttaatgtgtatgtacctaacaaaaagagtgtcaaactccatgaggcaaaaaatgactgaactataaagagaaatagatgaatccattactatagttgcatacttctacactcctctaccagaaatggacagatacagcaggcagaaaatcagtaaggacatagctaaacataataccaccatcaaaacactggatataatggaaagctatagactacttcatctaaaaccagcaaattatatattttcttaagctcacatggggccttcactgagatagaccacattctggggccataaaacccatcttaacgtatataaagcaataaaaatcatacaatctctgctttcagtcaacagtggaattaaactacaagtcaataacggaaagttaaaaaaatcccaaaatacttggagatgaagcaagactttcaaataacacatggatcaaagaagaaatggcatgagaaatttaaaaaaacattttgaagtaagtaaaaagaaaatacaacttagcaaaacttgtgggatgtaccacaagcagcatttagaggaaaattaatgccattaaatgtatatatcagaaaagaagaaaaatctgagattaataataatttaaccttccatcttaggaaatgaaatgaagaacaaattaaatccacaataagcagaagaaaagaaatactaaaaactagagcagaaatcaatgaaattgaaaacaataaatcaacagagaaagttaacaaaacccaaaactcattctttgaaaagatcaataaaatcaataaatttctagctaagctaactaagaataaaataaagaagacagaaattaatcatattagaaattaagttgggcatgctggcacatgcctgtagtcccagctacttgggaggctgaggcaggaggatcacttgagcccaggagttccaagtttcagtaagctatgatcatgccattgaactccagccttggcaacagagtgagaccctgtctctaaaaaaataataataataataaacattacctatgtaacaaacctgcacattcttcacatgtatcctggaactttaaataaaataacaatttaaaaataataataaaatacaaaagaaattaaagaggggacatcaccttagatctcatagatcttaataggataataaaggaatattatgaataattttatatccacaaatttgataacctatgtaaaatgaagtaattcctttgtctcagt

SEQ ID NO: 428 - DNA, 40001 bp, Homo sapiens
actagtaggcacatcacagtgcctacgccattcacacaacttcatcctatcccatacacattttaccatctcacaccatcacaagaagggtgagtatgacaatgagacaatgagaaagagagagaccacgttcatataacttttctctttctctttagaaccaaaacaatgttctcaaaagccatctttttacctttaattggtggcctattatatttgtcccaatttatatagtttcagacacccctcatcttcctacaggctctgctcctttgacaaagcacctcctctttttcactgactcttcgttggcttctttggccttaaatggaaatttttttatcaagactctgctattgtgcctcttcattctctatacaattggttctaaacctcactgtgcttttagaataactccaagagacctcaaagtgcacactgtggaatactattcccagagtgttccagtcattggctatagtgtttatttttagatctatctagcaggctttggaaatttatatttatttatttatttacttttgagatggagtctcactctgtcgcccaggctggagtgcagtggtgcgatctcgactcactgcaacccccacctcccaggttcaagcaattctcctgcctcagcctcctgagtagctgggattacaggtgcccaccaccacgcctggctaatttttgtatttttagtagagatggagtttcaccatgttggtcaggctggtctcgaactcctgacctcatgatccatccgcctcagcctcccaaagtgctgggattacaggcgtgagccaccgcacctggctggctttggaaatttatgtctaaaatgcaggtgaaggatgagagtaggagacagagatcaggaagtcttacgtaagtctggtagtataaaggtcagatgaagtactcaggaaggactggtcatctcctgggctttctgcccccagatcacttgagatgtctgtagaaaggcacatttcctgacctatgagtcttatctttggggctggggcctaggaatctgcatgtttagtaacctgccaagggattttcatcgcacactaagacttgagtagttgctcaaaatgattccatccccaaagtccacgttcctttccaacttctccccagcaccccagtccagcaggaccaacgaggtaaaccccaagctccctagagacccacctgcttagtgaagaagcagaaggggagcaggcgagccccttccctccatcctcctgaggtcagaggtccttgcggatccccattcactctcccagtgtgaggcagagaagccaggcaccaactgttctccgagttcggtggaaccaaaagcaatttagggcaatgtgttcacagttctccaccccaaaataggagcctccatggggcttgctttaatgagattttactttattagttcaagagttaatgaagaaactgctgataagataaatcaccttaggtgcggtgttttgaaatctaaccatttctcttagaaattgattttttttccttttggatatgcaaactaatgatgaagtcatagtagggatgtaagttttggtgcctttggagggtcaggacgtctgaagggagaacatctggctgagtggacagctcttcgagccttaccttattttacattctgtctataacagaaacccatcgctgtaaaatgtacatacagttcctttacgcattaatactccattgtaccaaccctattgatttttccaagtagacaaaggctaaggatatgtttattgattgttgctcagtgcattttaagtgtattttgtaataaagagcattttgagactgaaacaaactttcccttaaccaatgggcaagttgaaattttaattaaatgttactaaatattttttgtaaaaaataagactattcacaattctacattcaatgtccatcagctaatgtagagaattacaatcacgtgccatgcatgttacaactagacctatggagttaatataatgtaggagtaatgggaattactaatattgcaaaatgttgctcaggcaccatgtgaaactgttggaaagacaagccaactcatggaacttctggaactgaccattggaacacaaaaagacagaaggagggaagagaagccaaaccctgaagagctttggtggaattacctaatttggggtaaaatagaaagaaccttctctttccccagcccctttctggagcagcctccaaaaaggctgagagtaggtgctgagaaaacatatctgtcagacggatggccagataggaagccctgtttggttagtgctttttctttaaagagtagctgcataataatgatttctcttttcgtttactcattgtctttattcgagtgggggcagctaagatttgcttggggacattaaaacatcatttggaaaatcaacctttggtatttgccagctcatattagtggatttgcagtttgataaaccacttggatagagggggtgccatccttgtctcaggtacctcacgtggcttgaaacggtgtccacactggaagaagacatgtcctccatcaagggcatccatgaaaattaatgagtggtccaaaacaattcgtaaggagggtgagtcggtttaactccaaatgtggtttcagagtggagtgtggcacctgggtcccagtcaccagtgggctgccaccactggttccacctccaaagtaatttttaaatctgtccagtctttattctccactaacaccatagtctgatctaagatatgacttctcactcagaacagcacaataagcctctcaactggcttccagcttccactattcccactgttcgatccactttctatctaacagcctgagacattctttcaaatgtaagctggattatactcctcttccatcatttctctagaaatgtgctgttcaatacaatggccaccagccagccatgtgtgtctatttaagttattttttggtcttttgctattttattcggaggattattgcatatatattcataatgagagtcatctattcttcttctttatgcttttaatcagatgttggttttgtattgtatttctttataaaacaatttgagaaattatctatatttttatgatttcaaatacctatctaaatttaaatgagttaaaatttttaaaaatgaacaatcctttccttggttatactagccatgtttcaagtgctcattagtcacatgtggccagtggcgaccatgttgggcagcacagacatctagcatttttgttttacctgaaagttctgtccatctgtactgctcttgaagatgcagcagtttctccctcaaagtagtaggtggtgcccagagctcctgaccaagcaagctgtatggtctctaagaactttgggctttgaaggagtatggcaagcttaatttggggagctactacttttttttcccttttctcttctccctattcaagcgggctccaacgattcttgcctccattgaggttggtggcagcacctcctgacttttgtctaaaagtctaaatccatagagaaggacaaggtttgaaaggaaaggaggaaattaagtcccatgtgaagaataaggcctgaggagagaagaattttccccaaattaaagagaaatttccctaggttggggaaagagagagagagatgatcaggtcccataagtagcctagactagcaccccaaggaagtgcatcagagggcaagagggaatggcatgggggacaccaggaagctgggtcctgggcagagccctccagcctcgcgaaagatgttggacctcaggcacatcccaaagaaagcagagaagctcgcctgaagaaagcatctgggccaggagaagggacctctctctcaaggaggtaaggagcataggaggtgatggaggctcaagaggctcctttacaccatggccctgggcaaggccccagaacccagatagaactcctgggggaaagagccctcacagagttaggtattccatggaattattgggttgagggctcagagttggtgccacactgattgagggtgtaaaaggatgtagggtgtgaattttactctttcacagaactagagctagagttcagagctgcttatggatcaggcggccttagtcttagtatccttggacagtccccgcctgttattcttaagatttgcttgctaccctcttattttgtgtagaaggcatctgagcccagagaggcaaaggcccttgctcccaagttcccacagcagatgactaagagcttaggcattgacatcagactgctggagtttggctgtctgcgccaccacctcttaagtgtacaacctgcagtgggtgtctcatggctgccatgacaaaataccttatactgggcaacttacaagcaatagaaatgtattgctcacagttctggaggctgggaagtccaaggtgcagggagataggaatctatctggtgggggctcactccgcttcatagatgctactttttcactgcttcctcccatggcaaaggggcccacaagctccctcagacttcttttctaaagacaccagtcccattgatgagggtggattcctcactgaggctccacctcttactaccaccacattgggaattaggtttcaacatagggatttgggaggagggggacaaaaacattctgaccaagattgtggttatttgacctctgtaaggttttgttttcttaagggtgaatgggacatgatcatgacactaatgcccactttgaaaggctgctgtaaggtataagttacacagtgtgtatgagcctcagcagactactgagtcgttccataaattaccagctggggccacaggctggctctcctggctcctcattcaacattcctgcctcataataaagtcaaagcaactgctaatgagcagatcagaaagtaaagttgtaaaacttctgaagtcccactttttctcaaattacagcaactcctttagccaagggtaaaataccctgacccacttggttagaggtttgccatcaaggccactgccgcgtctagctgtgcagccagcagaaaatgcgaaaccgtccaagcactttggcttccactccaagatgatctgcatgacatttgggtcaatcaatctagagataatgattcctgctgcagagctgtgtgtgtccaatcacacacacaaaataagggttcccaattgatttttgtgaactggtttcattttctcggaaagcatttcaggtcaatggtgaagctagggtgctgagaggaggtggcgtgtctccacctaattttgcccaggaatgtctggctctcactgtgctctgtggaataaaattggaatcatcaagccctttgaggaattacaaggacattttaaagcaggacttttaatgcgggggaataagcatagagcatctgcctggaggagatacacacatacacacacacatacacacacatacacatacatacacacacatacacacacacatacacacacacacacatacacacacatacacacacatacacatacatacacatacacacacgtacacacacacgcatacacacacacatacacacatgcctacgtatacatatatattcacataggtttgtctttccagaataagtttctcacagcagcacagtgacagttaggaatctgtgggtactcttttcctgggctatttttccactttaatgtgtgaacttcatttataatatcctcaaaattaaagcacaaggaaacctaaatgaatagttaaaggggtaattaaaaataggcaactgtccttgtttctctcctaaactggttgatttatgccttgttgtggtttttttttttttgagaacacaaaactattaatttatgtgtgaaaagaacagtgaattaatcctaaagagccctgcagcctttaaagacctgaatcatatgttgagctcatttaaaacttgcataggaaattaaggtagaataaagccctttaatttgaaaagtgcatctatagttgccatccctaggatatctgcagggtcattattcagaaaggttaaggaggactttatttttttatattcactatgtatttcccagttacagctcaccatggtgcatttcaacttataaagagaaggagataaaaggggggaggggagctttttattcactttccacttaatttccttgccgccacgccagtcccagcttaatgaatgtaattgctacctttgatgaaaatactattatcaagatcacacattacattggaaaacagtttttctttaaacacagctactgcagtctctaattatgcatgtaacaagtgtctcccaaacaaaagagcatgttgtctacaattgctaggaattggagcaaggcaaattcgaacaaaggacagattagatttgctccccgctccacaaagcccgtccctctgattaatttcctgcaaaaactaaaacaattctcttaaaaggcgctcgcccccttcttcagaatgatccatatgccatttgggtctttctataggatgataatggcctctgatttgaacccgtgttagaaaataagaaagggcttttatgaacttcctctttcatatgcaaatggacagcacaagatcttgagggataataagccccccaaaaagtgactttttagtggctataaaagagctcatggtaggggaaagtctgcattgagcctgttcaacccagttattttatcagcttcaagaaatgaggcatctctgagaaaatacctctgtgcctgttgagacagtggcaacagcttttctggggtggcctttcctaaaagacagtttcttgacttaggaatagaattttaaaaatggattctgattaaacagcaagtatgcttgttaaagtcttgtcttaggagaccctaggttttaattgcgctttgctattcatttgggagactgcattgggcaagttatcaggcaagttgggcatgatgtcctgggtcttcatttctttcacttacccagtgtgagaggggagcgagatgatcctgaatgtgcaactgccacaatgtccccattctacccccagcactattcaaacccagaaggaaaaaaccagcttagtccccaaaacaatattagttatgaggatgaggtctagagtcagacagcctgggttcaaatctcagttcataatttacctcctgtgtgacctggaaaacaatcatctttctatgtctttatttccttgactttatttatttatttttggtgtttcctttattgtttgtatttatttatatgtatctcaacttttttttagattcatggagtacatatgcaggtttgtcacatgggtatgtcgtgtgatgctgaggtttggggtacaactgatcccatcacacaggaagtgagcagagtatccaagagttagcttttcaacccttgccccattgcccccattcccctctaatagtcctcagtttctactattatcatctttttttttttctttttttgagatggagtcttcctctgtcacccaggctggagtgtggtgatacaatcttggctcactgcaacctccgccttccagtttcaagcaattcttctgcctcagcctcccgagtagctgggactacaggtgtaagccaccacacctggttaattttcagtagagatggggtttcaccatattgaccaggctggtcttgaactcctgacctcatgatccacccacctcagcctcccaaagtgctgggattataggtgtgagccactgcacacggcctattgttatcatctctacctccatgtttacccaatatttagctcccacttgtaagtgaaaacatgtggtgtttgcttttctgttcccatgttaatttgattatatttcctcaactttaaaatgaaattaacaccaaaaggacagtgagaattaaataaaagcatacttgtaaaatgtttccaacaatacccagtacctaggaagtattcaaggaaggaagtattcaatcaattttacttgttactcttattatttaagacctggaagaccactggtgcttgatgaaatgaatttcccaaagtactgcccgctgtctccttgaggcctggggaaatggcaaaagggaagtgtcatcttggattgaaccttatgtctatccaataatgggaaggctaccagaactcaatttaaggaggtcgcagttaggtctggagctgttttggtaaagctctactgcattagacgtgagttgattcttttcagaggctcctgccagatatggtccagagagaatcagcagagcaaacgccaaatgaagcaggctacctgcactgctctttctcataggaaagaggctctggatgcataaaaagagaaacaccacactcctggctcctcattatcttaggattcattacctgcatccagatcatttccttagggcagtgaaagccatcataaagctatgctcactaaagaaccgagtacctatgaaagtagcacccaccggaatgtccccttctgctgaactctagctgtctttgctcaaccctgatcatctttactatctgtctcactaattgtcagatgttccaacaatactttgcaaagcccatataaattgatggcaaaacgaaactgcaaattgtgccacagttgcaggatttcttggagttgtgaaaatgacgctggagagccattagaattctatgaaaagccattgacaaatgaggatctggccattcttgagttaaagaaaaaaatgggcaagagggatgacacagtcgacactcaaaagagaatgatttgagtgctgtgggtgaagatatgcccttgtgaaaatgcatgaagcctttggataattttgcaaaaatgacactctaagaccatgctgtgaaaatcaaccacaaagaatggcccacagagtgagccatcatacaattttgtactgaaaaacgtatgcccccctcccaattaacattcgattcattctttgttcagtctaagattataggtgcaattatagccttagtctaaaaatgagatacatcttttttcataaattttaaggcaaattgtaagtttcaagacgaactctacatcaaacctcttttgtttccaccatttattacgagagggtccatattttaaagagatttgtttaaagtggaatttttcctgcaccaatttgctagttcagcaaggacttcatgtaccgtaggtgatatcttgggagccgcaggagacagtgcacacccttttacattaaggcctcaatgctgcagagctccatcccttacatactttgatcagtgtgagcaggacacacacacgcgcgcgcgcacacacacacacacacacacttcacctgcagattccacacgaagtcaggctctccaggcctgtgttatcctggtagggagggctttcccagttcaggcggctttcccatagcacaggactctatgactagtgatcagaaggaaaggggccaggagcacatcacagaatatgaagaccaacctccgcaaatcccaccctcgcccactgccccatgagtcatagagagagtgatggggctgagagtcagcagagagtccagaaatgcccatttgcatccacaattctgttctctcaggagtcttctggccctcgaagctgtgtacctgccacctggtcccggccacagccctggaggaggccccggagcacagcaatctcaatttctcagaagcagaagtggaggtgctgggaccagcccaagggtacccagtgcatgcagagaaccagggcagcctgagcacagatggagggctcctcaaagtactccccggaaagccccacacatccatcactcttcccattcctcatgctgcctggaactctggaaattggctgctgagatcgctctaaggagcctcaatggggacacggcattacagacaagagagctttaaggcggcatctctgagtctcgatggtctcacaaatgaccggccatttcctggtccactggtcagagaattagcatactgtgcatgggagctgcctccatctgtcttctgtgctcctcattaccagtggcaaggtggaatcggcacctaacctttgaatccatgaagggtaatgccccaaacactcctgagtagatgcactcccctgtgacggccacatcgagggactctggaacgtcctccgtgggcccatgcaggccacatctgtgtctgaggcccagggagcaggtggactccacgaagagcaaggggttgaggaaggagccctggcctctgctggttccatgcactgtttgtgggggactcaggctgtttgcttgtcttacctggcctcatcagtaaatcaggggtcttcctggcaggtctgagaggtcttctgagctccagctccagggctgccttccctagaagccttttttaacccagtcctcaccttctcccagtcctggaaaaccagccacgactccatcaactcccctctggcctctcacaggctctgacccagctccccctgcccttagctgcattctctggctcagtttcagcagcttcccctgttcactcagtgggagaaagtgaccctggcttcttccctgtatttgcttctggccacagctgcagtctgggttggaggacagaatctccaggggaaggaaaggaagataaggctgagagaaggcagggtccctaggatgccctgtctgccagagggcaccttctgacattggctggctcctggagctgtggcctctatcctgcaaggtggctggtgtttgttgacaatgcaaactgagccacctgcggctcccaccctggacaggactggggtctgtgcaaaaggacattagaccactgctgggtgccccaaacaattggttgcaaggtgctctttataaatctaccgggtatggttttttattgtagattgcacagaaaggccccatggtgggccaggaaggccagggctcaaacagagctgggctggaccacgctgtgggatgtcaccttggacaagttctttctagaattcaaagctcagttcattcatcggttaaatgggtggttgtaccagatcgtggctacgaaacttcccagccctgaccgtccagaggactccaaaaatgctggaagggactggagaatgtgccaactcaggggctttccagccttgttttgcagagtggtaagttttggactaaagaaactgggccatgtgattcaaatgcccagcagcttggggctgtcacagtgagggtgtgactgcagcctgaccagaggccaggaaacgccatctggctcccaggcagctctgtccaccctgtggggatgctgaaggctccctacatctgaccttctctctatagggaggagaagggggcccatggttgaggcaggccaaggaaggggcagcctcattgcttagttaatttcatctacttgtccatccatccacggctgcattcacgtcttgcgcgctcagggagctcctgcttttccctcaagactccactctgtttttgccctgctgtccccctgcccatccccaggaataatgaggcccacctccccctgcctgaaccaccatcgtcacacaggccatccctctacagtggcacttggaaggcttcacgaatgacagtgagtctgtagacccccggaggcagggctttccgtcccccagcacttggcatagcaggtgcttaatcaaggtttgcggaatgaattaatgaatgaggggaagaagtgagatgaggaggcatggagatgacattccagggggaggggcagtggaggcaaaggccagtggagggaaacaactcagtgtccagggacctgggattaatcagcactgatgaacatggggacaccctaatgccccattttgttcctcatctcacaggtacttgggtatttgccttaatatctgtattattcattggactgcgagtcccataagcccatctgactatccccagggttttgcctgtgacctagcacatagtaggcacttaataagtgatccttaaatggattaattggataaggtaggagggcaaaaagatggaaactacagggcccgtatggcagctccacaaccatcagagaccccatggcacggcaggtgcttaaccaagttttgctgaatgaattaatgaatgagaggaagaagtgagataagcatatgtggtgagcaggtgtgatgagcagatgggccccttaaagggttgctataagaaaggcaggatgctcagttaaactagaatttcagataagcaataaaaagttgtgtttcttttttgtttttttttttgttttgttttcatttttgttttgagacagggtcttgctttgtcacccaggctggagtgcagtggcgcaatcttggctcactgcagcctcgacctcccaggttcaagcgatcctcccacctcagccccccaagtagctgggactataggcatgtaccaccactcctggctaatttttgtattttttgtaaagatggggttttgccatgttgcccaggctggtctggaactcctgggctcaagtgatccacccacctcagcatcccaaaatgctgggattacaggcatgagccaccgcatccaaccaataatgaataagtctttgataactatgtcccaaatattgcacaggacgtatttattaaaaaattattcattgtgttctgaaactcaaactcatgtttttggtgtttttatttatttgcatatttgttttttgtatcttatttttaaagtttgtttctttgtttattttttactaatctggcaacctaccattccctcttttcacttagccataatcatccctggcttttatcatcagtatgactgtgacctcagagtcacaagatggctgctggagcgccagccttcatgcttgcgatttaggaaagcagaaggataaaaggagaagggacgaaaggacacctctctcccatctgagtcagctctctgtaagagatttcctccactaaatatgggtttgtgctagatttgttctttgataataataagaaattattgtttattttgttagatgtaaaaggtattatggatatatgagaaaatgttctacctttttggagatgcatcctaaaatatttaaagataagatacgatgtctgtaatgtatttttaattattttccggaaaaaaggaagcaaatatggcaaaaagttaacaactattaaatctgtatgaggggtatatatgatgccaattacccttgtctctggaccttttttatgcttgaaaattttctttgtgggttttttgttttttgtttttttttagatgtagtctcactctgttgcccaggctggagtgcactggtgcgatcttggctcattgcaacctctgccacccggttcaagtgattctcctgcctcagcctccagagtagctgggattacagatgtccaccaccacgcctggctaatttttgtatctttttaagtagagacggggttttgccatgttagccaggctggtctcgaactcctgacctcaagcaatccgcccacctcagcctcccaaacattctctaatagaaagttttgagctgggcacagtggctcacatctgtaatccctgcactttgggaggacaaggtgggaggatcacttgagccccggaacttcaagctacagtgagctataatcgcaccactgcactccagcctgggagacaaaagaagactccaactcttaaaaaaacaaaaaacaaaaataaacaaaaaatagttttcgttttgttctttttaaaaattattttatttatttatttatttatttatttatttatttatttatttatgttttgagacagagtcttgctctgtcacccaggctggagtgcagtggtgcgatcttggctcactgcaacctccacctcctgggttcaagcgattctcccacctcagccccctgagtagctgggattacaggcacatgccaccatgaccagctaatttttgtatttttagtagagacggggtttcgtcctattggtcaggctggtcttgaactcctgtcctcaggtgatccacccacctcagcctcccaaagtgctgggattacagggttgagccacctcgcccagcctgttcttgttttttaaaggacagattacccataatcttgcccaacatttgatttcttctcattcccttacagaatgggaggctgggaaaggaagtctttgggctgggtatactgatgcctgatacaatcaacattcagtcagtgaggaggaagggcagaatggttgtcaggcaggagctcacagcctcggcccagggctcaatttctcaacccctctgcacagaggagcaggggccacggtgcctgaagcgctgccttgccttccttgttggaaccagcccctcctgatctcacccaaactcctagagaatttcttcccttagtacggtgactaaggcacaaccaacccctcaccccagggagaggagacttgctgagctcccagtctgtgcatggtacagcttgtatgatctctgtgtcatacaggtaccctgtatgatctttgccagggtaatttaacctccttggagccctgtgatcacctctctaaagaatacacagcccagccccttccttccctcattagatggagtttaatttcccagcttactggctggggctactgtcagggagaaaaatccttgaacagagatcctgagctgctgtgtcaggtgaggcagcctatgccacttgctttcctttctgccttgatgccctagttgtcacctgccggaaactgatagtacctggcgtagtgttcagtgtatagaggaagaccttgaagccatggatacatatacgtgttattgcactctacatatgtggcacgtagtaggcctgctatgaagatatgtggggagagcaggtccactggtctgtcaactgactgatgaacggatagatgaaatgtggcacatccatgcaatggtatattactcggccataaagaggaataaagtactgattcatgctacacaaagatgaaccttgaaaacagcgtgctaagtgataggagtcagtcacgaaggagcacatactgtttgattccatttagatgaaatgtccagaagggcaaatctatagagacagaaagtagattagcgcttgcctagagtcagttgcaggatggaggagaaatggggagtgattgctaatgggtatggggtttctttttggcgtgataaaaatattctgaaattgactgtggggatggttgcacatatctgcaaatatatgaaaaccaattgaattgtacaccttgcataggtgaattgtatggtatgtgaattagagctcaataaagctttttttttttttttttttttttttttttttttgagacagagtcttgctctgttgcccaggctggagtgcagtggtacgatcttggctcactgcaatctccaccttttgggttcaagcgattctcgtgcctcagcttcctgagtagctgggactacaggtgcacccaaaacactgggctaatttttgtatttttagtagagacaggatttcgccatgctggccaggctggtctccaactcctggcctcaagtgatccaccctcctcggcctcccaaagtgctgggattacaggtgtgagccaccaggcccagtcaataaagcagttttttaaaatgaaaaaatcctggcatggtggctcacaactctaatcccaacacgttaggaaggccaaggtgggcacattgcttgagcccaggagtttgagacagcctgggcaacatggtgaaacctcgtctctatagagaatatgaaaattagcctggtgtggtgacgcacacctgtagtctcaggtacttgggaggctgaggtaggaggatcaccagagcccaggaggcggaggctgcattgaaccatggtcacactgctgcagtccagcctggacaacagagcaaaagcctgtctcaaataaataaataaataataaaagttaaaaaatgggagatgtttatatccatagcaacaatatgttgcccaggaggccctgtggccactagcgacctggaaaattcccagcggcagccggaattccagaagccaagtccagctagaaccatgggtagggagctgggggaagagccctgtgtggcttctgccagcggtgaatgactcgagctaatgtgcctccacttacatgtattgatcgtttacctccctctgttccccacgctagatctatgagcaaggagaaaggaaaaaggagttcaggtttaaactcttatcactaaagtgagtctccttctacattaaaaaactatccagaccctgtggcaggaatgggctctgttcttggggcataaatttgtgtgtgtggaaaaaagacttattggtgaacttagcagtatttttcgttgaactggcagttgctaaccattacaccagtatttatttgattcttaaagagtacaaaaccatggaccacaaataaagaagatggagtaatagtttgtggctgggccactagctttaaacttgaaatgaagtgtccagttttgagttactgtgtccaaccaccatttgtacagtttgaaaagtgggggcatttttccagcctgtcagtgtgactgtagttcattcccatgaatgatatcgctgaaggagcagttgttctgctatgagcacctcactcatgaccagaatatattaagtgtattaatctgtgcctcccggcgtaatttaggaaggccctctatttgacacattcctgtacatccttgttttattgcctgctcccgcaggtaacaatgtctcaaaagtcttgctcctgaatgaagttaaaattacatgtcacccaatagcatatgcagttttgtggcttattttgctgtcaaaattaccaccgtgcaacaacatgaggcgttaatggggacgtagcgtgatttacctctcgggctctgggctcggtggtgagggaggactccttcgtccacgtggccacatgcgaagggaagccctggtcacctctgcccttccaatctgccttcagtacccaaattgtgtctctgaccatggcaggtctttccagagatgaaaataagaggtacttgagattctctgccaaataattgctaagcttgttttaagtcatgaagggaaaactgcaaatttcaagcaggttagtcttccaccaacaaacagcattcataacttgtttcccagttagactggtgactactatccgttaagaatgtgcccaagacttaatgcagaaatgtcttaattttaaggctaatgggaacagctctgacttacaatttgacgcaatgtttttctaccctgccaagcctatgtctttggaatgtttattattttaggtaacaagaaagccacaaagccaggttgcatcttttagtgagattatggattccccatccaggaagagtatggaatgtagcttaagccagcctgcgagcctggactagaggctgcgctaggaggttaatgagtcctaggtacttttgcttgtgtgggtcccttcctccataagaaaaaatatatatattttataacttcttgggtatcaagacaaatataatcaattgggcatggtggctcatgcctaaaatcccagcactttaggaggtcaaggcaggaggatcacctgaggccaagagtttgaaaccactctggacaacatagcgagaccgtgtctctttaaaaaaataaaattattgtttaaaaacgatatattttccaagtgggagaacagaaaaaaataaaaaatacaaaaataaaaataaaacaaaaagatggatataatctaggctggacttattattatatagacattactattatattcatttttaatttctgattttaaaagaaatgaaaatgaaaacatttctgtgggccctaggcactgtgcctgctgtgcctgatgggtatggctgccctgacctgtgctgcaggattgaagtttccaatctttccccgggagtttatttcaaggccaggacaatctggccagggcacctcatggagggactcagccaaaaggcatcccacttccccaactcggcacacagtgtttgccaggcctcccccaggggcgaccccagggcctcttctttccctctctcgttgatttgtctttattttaaataaataggccaaggcctctgctatggattttcccatgcatttgagagctggggacaattcatgaatgtgagagcagaacgctccacctgcgggtgtggctggccacgatgatgggaaacgcgttagtaatgggccaccatggctgacccccgacctcatcgaccgccgcccctctccccagccaggttctgctgtccaggcagctgcagaggagtttaaagggcagccatggtccctggtcagccagcctgccattaataacgtttgcatctgtgacaatgacaaacctgcagtacttgaggagagtttattaaggtcagtctataaataagaattaaaaattttaaaaaatcggttgacacagatgaacagacagatgaagaaagtgattaggtgaaacaataaatataaaagtggataaggagctcccagagctggcctggaaatcagagcccagcccagtcttcctccgacctcgcctgaagtttagatttcatgaagacactcagaacttgtaggttttgtgaatctaggccctggctaatattttgtcatttaatgcctgttctctcagctaataaaaagaattgcagccatttctctatgtcaagcccataactgagagctggtaaaatttaaatgtctcatctgtcctccagcttgcatgcagatgcccttccccgggagcttggctccaggcctgtgggctagtgacagtcccccggcttgcccagctggctcttgctgtctcgggatggactgcctgagcaaactggccagggggattggaagcaagaagtgtgtcttcctgtagctttgtcccccatctcagagagtgggattctcccccgcagtccacaggtctttggggttttggtgcataccatcccagtccactttctcaacgaagtggctcctgctctgtaggccttttcaacgatcgtggtgatttttaatcgtatatttaagcaactcttttcaaagttattttgcctccgttagctcatttggccctcacaagaagcccaggagagactcagagcaaatttgattatctcatttggaagatatacggggcacagagaggtcaggttagtctgaggtcgctccgcgtgtaggtgcagaaccaggtcactgtccactaaatgtacgaagagagggaaagaaagcagtgggtaggaagtccaagtgctgcaaagaaatgaaacttagccagctttccacccaccaggaatgcatattagcatgaaagttaacttgtcctcacttcagtgacaaccagggagcactatggtagctctgcagggctgtcaggccagaaacaaccttcagaatcatcatattattaggatgtggtgctttattccaaataaaggagtaaatgtcactgtgtctcatccttcagaaaagacaattagatggaaatactcaactcattctcagttaagcagaattatcaacaagccagaatgtcacaataagaaagcaggcagtagacaggatggagagttctcctaaatgctctgccctctgttagtccttagattccccatgactcaattcaagcttgagggtcttaggggtgcaacacagattgggagctgtacagagctcagaaccacaggcaagaaagaaggaagacttcagagctggagtctaaaagagaggattctgccattcaattccgcttatcaaatgtctggtattatgtcccccaagccagaccccagaccaggagcaccagagtggggacagagtgaagtgaccccagtccctgagcttcaggtggaggacaggcaagtatgtgactaattgtgagatgcaatgtgagaactgtgtcagtagtgtagacaccattctgccatgaagatctctaccacaggaaaggaattctaggaaggcttcacagagcaggtgtcccaaaagaactaagcttgaaggaaaagtgggaaaatcccatatgggaaaggaaatggcatgccaggtgctataggctgtgtcccctcaaaattcatatgttgaagccgttacccccagaacctcagaatatgactgtattgggaggtagggtctttaaagaggtgataaaattaaaatgaggtcattagggtgggccccaagataatctgactgatgtccttatcaaaacagaagattagaacacagatgggtacataggaaagaccttgtgaagacccagagaagacggccacctacaagccaaggaaggaggcctcagaaggaacaaccctgctgacaccttgatcttggacttccagcctccagaactgtgagggaataaatttctgtcatttaggacacctagttggcagttatgttttacagccaccctagcaaactaataacaccaggaaagcaaagagccgggcacagttctgggagtgggaatgtgtctgagtgtttaaagcatggcggtgctttgaggagtccaggtggccagaaggggacagaacgtgcttgctggaggcaccaggacgccagagttcttgactcattaccaaccgttgtcctcatgggagtgccacggcagcctttcctggctgtgccctgctccactcctgtctcccaggggaaggtgggcactcatatcctttgctttgctttagtgcaaacttaaaggcagcttccagctcagaatctccaactccttccctggggtctccccagtggcaaccacgtgcctcccacatgtttgtggaggacggagccaacagacacctgtgtgagttcagggttgcctgctctcttccaacacccttggcttgctagctttccaccctaggagcttcccagatctcccctagtagatggctgctgagggaaaccactcaactcaaagccacggccagctggaagatgttttggaaactctcagctgacattgcagcctctgtggtgtgggagaatgtggtaggctgaataatggcccctcaaaaatatcaggccctaatccctggaacctataaaattttcatatacagagaatctttgcagatgtgatcttgacatgtgggattatcctggattctcacagtgggccctaaatgcaatcacatgtatccttataggagggagggagagggagattttatacacacagaggagaaggcactgggaagacagagccaagagacttgaagatgctggccttgaagacagtgtgatgcagccacaaaccgaggaaagccagcagctacgagaagctgggagcggcaaggaagacttctccccagagtctccgagggaacaaggccttacccacaccttgatttgatactcatttcaaacttctggccttggtaatggtgagagaataatcctgttttaagccaccacattcctggtcttctgttacagcagcacaggaagctcatgcagaatggcaggccagggatccaggtggggctctgacacctgctggttccaggcactttatgctttctccgatctcagtttcctcccctgagctcccattgtgtaatgcatcattgccattgtgacagccaatcctggcctgcctgcatatgcatccaggtcaaggggcacccacagcactctaaccaggcctggcaactgcagcgttgccccacacgcagcagaatatcatgaacttcggccttgctatctgagagtctgagcagcccagatcatgggtgttcgcctcgacgttcccatttgttgcacccaatctgatgataaacgtggagaccccaggaacactggcctggaaaggccctgaaaactgagagatgtagctgaggcaagaggaaagaaaggaaatggcattttccctccaaaaggcctaggccttcttgaatgagccatagccagggagccccagtgtgtgcctgggaggtgtccaccagcagtaatcccagaggccattgcccctggtttcacccacagcaatgggcagcagtgatgggggccaagtcactgaaaaagaaagggaaagtggaagtggggctaggggtaggaaacgtgtacatctgggtgggtttgccaggagatggggaggcttcatgtttgaagggaacgtccagatgccacctgctcaggggagcaggctgctctggagcccttactgcaagcctgggaatgggtcctggccagaaaacatgcaggtgttgcaaccaggtgcagggaaatcttcctacagacacacctgtgcttcctggcagcacatcctcttggggtcctcatctggctcgcagccaccctcctccttgatctcactaactgccaagtcaccctctatgatatcatcctcactcttcttcactgctcctaacccagtctgaaatcgtgtactttgtcgtgatttattgtcgatctctcctcataagaatttaagtgcctgggccaggcacggtggctcctgcctataatcccagcactttgggaggacgaggtaggcaaatcatgaggtcaagagatcgagaccatcctggccaacatggtgaaaccctgtctctactaaaaatacaaaaattagctgagcatggtggtgcatgcctgtagtctcagctgcttgggaggctgaggcaggaaaatcacttgaaccatggaggcagaggttgcagtgtgccaagatcatgccattgcactccagcctgggtgacagagcgagactccgtctcaaaaaaaaaaaaaattttaagttcctggatagaccaggctgtgacttcagtgcctcgtctctgccacagagaactcactcaggaaatattgaacgaacgggtgaatgagtgagtgaatgagttgatgaatgagtgagtgaatgaatgaatgagagagtgacgcatgaatgagtgaatggatgagtgagcaaatggatgaatgagtgtatgatggatgaatgagcaaatgaatgaatgagtgactgagtgataaatgaataagtgaatgggtgaataagtgagtgaatggatgaattaatgaatggatgggtgaatgaccgaatgggtgaatgagcgaatggtgaatgagcgaatgggtgaatgagtgagtgaatggatgaattaatgagtgagagaatggatgagtgagtgagtgagtgagtgaatggatgaataaatgagtgggtgaatggatgaatgaatgagtgactgaataaatgaatgagagagtggatgaatgcgtgaatgaattaatgagtgatcaatgaatgagtgaatggatgaattagtgaatggacggatgaatgagtgaatgtgtgagtgagtgagtgaatgggtgagtgagtgagtgagtgagtgaacgggtgaatgagtgactgagtgaataaatgaatgagtgagcgaatggataaattagtgcatgagtgaatgagagggggcactcaagcccccacaccgatattcacagatattccagaagctccacggagcctctgggagctcagaggagtgagggaggttcctgtcctcctctctctgatctccaccctgaggtccagggccagggagactcatcagctgccatcgtaccacaggcaggttatggtgatggccgtgcctgggggccagacagggtcacggaggtggaggtgggagagatggccctgggggactggggttcagtggtttctcacagtgttcaaatcaaagcccaaaggcaaggacttgggcttctttcaaagaatgggagccttatttaatccataatcccaccatagctgatgatgcctgcagaccccactctcagctccacgtggctgcccccctctctctcgtggagccagatgtcccacggtcccacccacctcaggggcatgaaggtgcccctttcatttcttctctacattccactctctcagtgacgttttaatccattcaaactggaaggaaatctttgctaatcaccctctgaaaatctttagttgttaaaattctttttgttgttgttgttgctgcttaaagtttcattatttttaaacaatccaattttacgggcattgcatccttaatgtgccctaattatgggggatgttttggtaaagcagtgggatgcttcattctggaagtttcaccttctccaggaaggggctgctgagggtttttggggattcctacatcgtaatacatcataattgtgcatatttttactaggggctgtgaagatgctttgttacaaataattaaattcagcacaaccggaactgcacccagaaaacgcaaaccttgcataaaagcaataaaattagcagcttccgatgaatcttcagaactacctgtgttagaatccaaccaatcccttctcttcagtcagtccccaagaaggagcagaagaatgcaactcccatggctccatgtgtgtgggatggagtcaggaaacctatgtttgacttctggctctgctttttaaccagaactgtggccttgggtgagttcttttctccctgagctttggatttcttatctgtaaaacggagaaaatagcaatgcaagctgtgagagtccaatgagataatagatctaaacatgccttagaaactatgaagggccagatatactactcagagacccagcctctcctgaagaatgaatcggaggaactggaggccttcttacccaaaactgctgcctgccagccaagccagattgttccatccaccacaggcactctgtcccgcccttggccctaaacaaacctaacattcctgctgctattttggggcccccactaccctcagggccccaaggtcaaacaagctggcatctctattttcactcctgttaggaattggagagccataaaatggatatttcagaaagcccagtgcatgggtcatggggccaataccagcactagcaagcttctttaattttacttaaaggtaaaattcagtcacataatgggtgattctttgaaatccaccactaatgtttttggtgaattcttttatgaaataatcgcataatttcagcaggttgcccagggtctagaaaataaataaataaataaatagtcatataagccttcgatccacatttcttaaataaaatgattgaccggaggcatttaaaaaacacagtttgagagtatccatggagatttggttggaaaatcttaaactacaaattctacaaatggctcctccttccttaaacctgagcctggtctctgttcaagcaagaaggcaggatctcagcgtctgcactgcaagcagtccgaatacctgagtggggactctgtcaactggcccattctccatgtgtcatggaattctcagcccgtgcggatttatcctcagcctcagacagggcgttttgggtttaaatatgcatatgcatattgacagggccactttccttaaagaaggggagggcacagaacaggccatagccatctttgccatctatgggtgcccatgtgcccgccatctggagtcatactggagccatggtcacctgggcatactggcagattgtagaaacacatgttccactgctttctttcgatagtacctgccgcttgtttattctttggtgtgaataaagataacttttgttcagagagtgagacaacttaccagagcccccttcagatgccatgagacgggcctggggccttctggaacaatgaggggacacaggccatcgtcctgttgaacactctggggagccactctggggaaatgctgctgttggaatatgaccagggcccaccgagagaagccttgatgctgaaagcaagagttactcctgccatcaggagggcagatggaatggacagggtgggctctggggtgggggttctgctgaggggtttcctgccctggctgctgtactcggccagtggatgccattgccagatctcctgctccagaagcagcagctttcccccatggtagagttggttcccaattccctcaagacaaaaggcactatggcaactagacatgattgttgcgattaatcactcctgacgtctaaagggttttgctcctgaggtcatctggcacagtggcaaagcacacagacccgagggacagcactgccaccttcttctagctgggggagattggggacatcactgtcatctctaaaacaggaacagcaataatgataattacaatggtaattatatcatagggtcatcatcaagattaaatgggatcatctgtgtcaattaccaagcaaacactaagtgttcaatatatttttttataacttgcacttatgttaatcacattttatcctcatggtaattttgtaagtttgtaattattatgactattttactggtaaggaaattggtgctctgagaggtcccatgactttcttgtggtcactgagcagcaggaagtggaggtggagacagtcccaacatcctcacgtgaagcccccatcactagcggaaccaccttgaatctttcatgcataccagcacttcatttccccaccaaaccacccccagagcccagcaaaccaatcaacatgatcatctagaccagtgctgtcaatatgatgctgtcagtatactggatcccagtccaatataagattgttcttgcaattagagctcatcaggggatgagctctctgaggaggtaatgagatccttgtccctggaagtgtttaggcagaggccagatgccatgggtcaggtatttccccactagttgagaaattggacaagatgacgctaaggtactactatcaggttctatgatacgaagacatcaaagcttatcctcaaggaaccatttccagtggtgagctttcagacaattagtgggctaaataataatctaattattgttatgtgtggccacttttaattaaaattaaatcaaattaaaaattccctcctcagttgcaccagctacttgtggctgggggctaccgcattggataatgccccatttgcatcacctctgcagggtctcttggatgatgctgatctctcctctcagctctgcctttttctccatgtacaaaaaactttatttgggtccaaagcagagcctgtttcatcagcaccagccaactgggagataggagtgcttctcaagctgcatccaatctgacagcaaagacagaaatgttccaattttgaccagaaggaaaaaaatcctgccagggcaaaagggaaaattcactcatcaagtattgtttaaattatttgaaaatatactgcatctgtttaatgtttaaagcaaaagaaagtggcaaagtaaccgagcatgagatagctttcaataaataatcacggaataaataggaatattcgcatgggagccctggaaatgcacgagtagtttggtaccaataaaatgcaaaggataaaaataaaatacaatacagcggcaaaagtatttatataaatcatgaaaatgtaggaaagaaaaagagccagctgctccagctcacatttggaacaaggtaatatgagaaatataagtctgccaccaaagactgtattagaagctgggaaataacgaacatgattgcattgtagtttttccaagggtgaaatttacaaacgatttactgtaaatgtttacccagtgtacaatagagaaatgtgatcagagataatttatcttaaaattttcaccacattcttatgtattccacttgagaaaggggcataaggtttttaaatgcgctattgtatattcacctcctccagcttcccaccctctttatttatttatttttctttttggcttaccttaagctactggacaaagttgtctctttgatcctctgctaagaaagtcaagaattgtggcctgcagtgaggtgctaattgatgaccaatcagatcaatgcctatttcattaatcaagagtttcagagcaaaatccacatgaaggaaagaaactttcctctcgttccctctatggaaacagaagcttgactgatggattcccctccatgagtttgcttccactgaatatggtccaaactctcatttgctggacaaactattctgcagcccagttcaaattaaaggcaaagtctttggagctggaagacagaggttcaagttcagcttccccaagttgtacaatgtctttgtcaataaaatggggccaatgaatgcagtttttggaagctcttttctatcatgaagcactaggtgagggtcaggttattattgtgacagattttgctgggcatggacccccaattcccttatcttcatcctacccaccgcctctccaaccttctccccaaatgaccattgctggagaggaaatcacatgctcaacaaatcactgcgacatgttggtgactccatatgtcactctttccagtcccacaaaaaaagagaaaattattgaaggaattgtctagttgtctcgtctagagaagagaagacttggggagctttgttgatgccttccaacactgacatggctcctgtggggcagcctgagtaggcctgttctaggtagctccaggaaacagaaccaggatctatcgggtggaacagatcccagtccagtataagattgttcttgcaattggaactcctcagcggacgggctgtcttggaaggtaatgagatcctcatccctggaagtgtttaggcagaggccagatgccatgggtcagggatttcctcactagttgagaagctggacaagatgacgctaaggtacgactatcaggttctattctatgaaggcgtcaaagcttatcctcagggatccatttctagtggtgagctttcagacaatgagtgggctgatatttctcagcaagtcacctccaggaaacactgaaagcctacatgtaggtgacagaggctcaacctacaccccatgtccccaacctcattaagcacagcctcaacaacaacatgcttttctgcaggaagatgtaggtggaagcgtacagggagccttttcccagcttgaagcaccactggggcaaaggagctgttcatcttccaccagggtctgagtggaagggtcccctgaatacaacagcctttcttctctgaaggttatctgctaagcaccaaactttgagagctgccagccatgactgccccagcgagggcagacacaggcccaaccgcgatggaaagggaggccgagttctattttatctctggctgcgtcagcccctttaaatgtcctcaattcccctacttggaaagtccctggataacacgttatttaaatgaacctattccacatcttccatggttacttacttttctcaatgacgaatcttaaaacggattgtctgtaaaagatcatctgtactttaccaatatccaggctccccctccccaaaaaaactgtcagaggtacaccacgtgtgtgaaactagtcgatttccttaattcatccctggagaatggataagtctatcaatctattaaattggaaagccattaggaggcctggtttatgcgtttcaagctgttaactagaagttgattgattgttgttcctctgataggatatgctgatctaatctcactgtgctccagtttgcaataaattacacaattcatttcctccatttagagagagaaaatcacacctccaggcatgcctgcttcagaggcaaagagcaggaagcctattttatggtgccatttagcctgcaagctttcagcaatccttgcctccaaaaaatcgaagcataatcaaggtgtatgtttggaaaatttattgttataattttccccaagtaatctcctccattttccaggcgctccaacggcataagtcatcatctaaaagagaaaatgaatagcagtttaaaatttatcggtctttgattctcaattatacgtgtttatgacttcatctgtcttcagtgacttcaaccttttccattatggtggaatattatttgtacgggatccattaaattcacaatccagccctaatggtaggctgtagcgtttccagaagaaaatttttgaaaggtggtttgcagaaagcgaagctgttatgacactagaaattgctttattgatagcctcgcctctcgcctgaacattttgcaatttgtaacctggcccatatctatatttcaggctgacgttgataagaacccttctgccccccacaccagattacactttgtaatgacatggagaatgcagggtggggagggggaccgagaagggcagccaccttcttcctcctccctgtccccagctgtcctcctcctcctctccattgagaaggaagatggtggaaggggattgtgtcttgctgtgctcctggtctttgctggccttgatccccatgatgcctcaggctcagcctctccatgaatgtcgaccagggagtctcttgtaatggaggtctcttgggcccgaccctgtccagcacccgaccctgtccagcaccatggtcctgaacctctgacacggggagagcctgggccttttctggtggagtggaaagaattgagctagagatgtccagtaggctggacacttctctctggatctgatcttttggtgacagaatatactttggggagaagcaagttcaagttaaattcaggcttaagccccaatcttggcctctcctcacacacatgcagactcaatgtgctccctgccttccctggcaacttgttctttgaggggaaagatccaattcttagaaagaatctcccagctgagtccaaatgcaccatgattggctctgagccagacctcagcagttccccccatggcttgcattcagcaggggtgtaactctcctcacatgccagcgccccagctctgagcactctccaccgttcccacgtccttcacaagcagcaatcagaacaactgccacgccatgctcacgaatccacctgcagctttgcaaagagtacatcatgctttctgttaaagatgaaacaccgaggctcggaaagggcacagccgttcctcgagatcatgcagctacagccagggcttaagtgcaggtctgctgacaaccaagttcttgccctctctacactgaactccttgttcagtatctacttaaagtcagttcttctttccttatttttctccctccctccttccttcctttccttctcccctccctgttctctttctcttcctccctccttccctccctctctttctcttcctctctccttcttatctttctccctccctcccatatttgttgagcatttacctcagcccagaaagtcacaaaggtaagaaaggttacaaagcccagaaggctacaaagcagctgctcttgaagaccttgtaaacaaatgagacagacagacacaaaattaagtgctgggggcagcaaggcaagccccgtaatcatggggcaaacagagggcctggaggaccaggccatggttccttctgctgaggctgctatgaaaagcttcacagaggaggccaagtttgggtcgggcactgggggatgggcagccacttgccaagagaagggtagaaaggcagtcaggtcaaaggaagaggggagcagagacgtcagctttccctgggaggaaacagtgaggaagattctccatgccctgcaatttgactttatgtgcttgggggtagagtcgttaggaagcaggaacacaggccacagagatagagccctgggctctacaagcccatcagggaggggctggggtctggctcccaacccaaacccagtgccgggctggggaacagtgtgtggctcctcttgccacaagcactactttggggtttgacctttcaccatgcttccaagtccccaccggctggaatgctcagaatacattctgtcagagcttggtcccaattgctcatgaatgttttccaggaaacacaggccccacctcaaacctgcagaatcaggatctctgaggttgataccaaggggcaagcccaacgctttctaccagctctgccgctgttccatgttacaaaagagaatgacagtcctcggtgtccccacacccccctctgccagcagcccaatggtaccttctcccaaggagttgctatttctagttaatagttccaagaaatttgcattttgttccattgaattacagaaaaaaaaagtttccaagaaaatccaagtatgagaatctgcataacgctaatgttagagtgttagaactgaaacagaccccacacaccacgtaacttcaagccagttacactctacaaatatagaaaaggaggctcagaaaggttggttgacttgccgagggtcacacagtaagcagaagagccaaagctagaagtcagaacttatcctgagttttgcagttatcaaggacgacgtgcattgaggaaaaaagccctagaaacacagcaatgttcttattaatgaccctagaaaagggcctggtgcagtggttcacaactgtaatcccagcacttagggaggccaaggcaggaggatcacttgaacccagaaattcgagatcagcctgagcaacatactgagggtccatctttacaaaaaattaaaaaattgtggccaggcgtggtggctcatgcctgtaatcccagcactttgggaggccgaggcgggcagatcatctgaggtcaggagttcgagaccagcctggctaacatggtgaaaccccatttctactaaaaatacaaaaaattagccgggtgtggtggagcccacctgtaatcccagctactcaggagactgaggcaggagaatcgcttgaacccaggaggtggaggttgcagtgagccgagatcgcaccattgcactccagcttgggcaacaagagcaaaactccatctgaaaaagaaaaaaaaattatctgggtgtggttgcacacccctgtagtccccgatacacaagaggctgaagtgagaggatggcttgggcccaggaaatcaaggctgcagtgagccgtgattgcaccactgtacttcagcctcggcaacagagtgagatcctgtctcagaaaacaaaccaaaatgaaacaaaacaaagagcctagaaaggggctgccagtgatgtaagcaaaggagttaattatagatggcacctaaatattggaccacaaaggtccacttggggtttccagtaacccataaaatctagtagaaatgagacaatttgtgggttaactgaaacagtagggacgccccacatggatcacgaagaccagccaaccctctgcagggctggcctgatagcatctcttcaccattgatgctattaggtggactgctgtggcattgccattggctctgtgtttcagagacccggcagtcccagagccactgggagcacagccaccattccccaacgtgacctgtgtgtgaggtgaggaagcttagggccattgccagctcctccctctcttggctctttgagagtgttacacttggacatgcagccaaggtcctcagtctcttccagcctagtggagatgagggggaactggctgccctcacatatgggcgagactcaaaactcgtgacagtgacttttagttcagccttgcagataatcacatgcagaccgatctactgtttataacacacctgcttctgccacagaaagtagtacatcattgagaataaatagatggatagggaaataatgtctacaaacatatacagaaagtcagccttcccattttggattcattgtcaagtaactggctaaaggctggacctggctgttctgagaaaaaggtgagacccacggagttttggcggaaaaagaaaggagccgcaggatagcccatcacgtgtaaggtctcctccctaggtctctgtgtgaggtgagggatctattttaaggtccttgttgaggctctctagggtgctctactgcttcatccctctccaggagaactgcccatccatgccttcatggggacacccctgcagctgccttcgtgctgtttacacagttagcaggtgctctttcgctgctgaccggactttgggtgaatgcctgacccagtgggcgcctctctattggctggcgtggaccaatcagaatctctgttgtaggtatctggaattgggacattgtcagcctagaggtgatgtaggatttctttccctcagatgcatagaaagcagagacattcggggtgttggcagagcaaagaatgaccaagttgggtttagagaggtggaaatgagcggccacggggccccaggaatgcagagagccttggcttcctggtttctggccatcatgaggacaatcagactcttaacccagcaggcttggtggatttctctgtttaataaatccctcgttattgaagctaagtctgagtgagctttgctcctggcaataaagccatccttaagagggctccgatttgctaccgatagtgtttaagatgtcaggagaatggctgtgggaggtggaggaaggggcatgggaacaaggaggaagtaagggaagttctcctgttcattctccttccttggacagccacacctaggaggcagacactgggtgtattcttaaggaggaacacattgtttttcagaggacaagagtgtctcttggggcagtcattttttaaatggacctggaaaaaaaactgtgaagccagtaaagctttcctgcactccccaggaccctccacttctgtctttctgtgccctactttgtgatcccttcctctcccaccaatgacagggatagtgggttggatagtgtccctccaaatttcatggccaccagaaccccagaattgggctttttttaaacattgggtctctgcagatgtaactggttaagatgaagtcatattggagtagggcaggccctcaatctaatcactggtgttcttgtatgcaggggagaagatacacagatacatggaggaaagaaggctgtggagccatccagtcagactggagggatgcagctgcaagcccagggacgccaaggattgccagcaatccccagaaaccaggacagaggcagggcacagactcccccttggagcctccagaagggaccaaccctgctgacactctgatttcagaattctggcctcctgaactggaagagaataaatttctgttgtttaagtcgccccgtttatggtaatttgctatggcagcctgaggaaatgaacacaacagggaaaaggactgagggtctccctgtaatgttggcatttttttaggtgacaatagagaagagggcagagtttcataccaacgtatgaattactaatatcgactctttatgctccactgagaaagcaattttggaataagtgtaatcaaaatgcaaacaagtaagcctgcctgttctgtttacacttatgtacgcttttgacaaaaggaaacatatatttatttggcacccaatacgtgctaggcaatgcgataggtgctttcatatctaacatttcacttaattttcacaataattccgaccctgtgagggaggaattactatgcccattttgctgttcaggaaactgaggctcagagagcatgaacaactgactaccaggcacagagctatgggggcaaaagtggctgcgcagagtgtaagtgcaggagtcccaggggtggagctgaaacagccaacctttctgtcggcctgagccctctaccttggagtccttcacgtcttcatgcgtctccctgggctcggcaaggctgtgccggtgaaggatgctaagatcattgccactctggaggagcaagacatctgacccactgtcacatggcaggggccctggcagaggggcatggtagcctttctcagggagagggatgtggcaaggcagcccctggtggtgaaccttgcaggggtggtgcccggaaatgacccatttacctgtgcctctcttcacagcatgccacgccctcccacacatactttctaacgtgaccctgatacttccctggatgatgtgaacagccccactgaacaaatagccgaggacagagcagatcagagaggatgaaggccttgtccctggttgcacagctaagagcctcatgacaaggccaggcacagtggctcacacctgtaatcccaaaactttgggaggctgaggcgggaggatcacttgaggtcaggagttcgagaccagcctggccaaaatggtgaaaccccgtctctactgaaaatacaaaaattcaccagatgtggtggcacatgcctgtaatcccagctactcaggaggctgagacaggagaatcacttgaaccggggaggcagaggttgaagtgagccgagattgagccactgcactccagcttccagcctgggcaacaagagcgaaactccgtctcacaaaaaaaaaacaacaaaaaaaaccaaaacaaacaaacaaaacacacacacacacacacaaagcttcaggacaggccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcgcgtgcctgtagtcccagctacacaggaggctgaggcaggagaatggcgtgaacccgggaggcggagcttgcagtgagtcgagatcgcgccactgcactccagcctgggcgacagagcgaaactccgtctcaaaaaaaaaaaaaacaaaaaaaaaacaaaacaaaaaaaaaacaaagcttcaggacaggcctccttctcacgtgatactttactccactgccaggggaaaagccaaatgatctgttagcaaaatacttcctacctcaacaaaactcaaaaagtttagaataaatcagttaagggacaactgctgtgtggggccattgattttggctgctcagaccccttctcttcccacagccagaggggagtggctggccaatcagcgggccccatctgcttggccactatgattgggtgaggaagtggctacttgacccaagctgggccaatcacaggtcattagttttcggctggtgctgggagtgggtggggattggctcttgacaacgtagagagaaaagctgaccccagagcacgaaactgggtgggcagtgggtaggggagaccttcttcctggatccacctgtggctgagaccaacccatcagaatcctacctattacctgggcagcaaattccttttattcccgagctggtttgagttgcatttctgaaagaattgcaatgaatacaggcattctcccacagaactggaccacatacttctgggtattagttgagataaactaacagacccaaaaatgagtcatggccccaacaaacaagctgatttcacattcatgtaaatagtgcagagcagttcgggtggatggtggggtagcagttaagggagggaagtcaaggctttgttccccaccatcactgggacagagggcagagaccctcacaatcttgatgtgtgacctgtctggaaagacttgaccgctgaggcatgtcctgagagtaggtctccagggccttctgggagtagttctgtgaaagcccctcgagagagaaagagccctctccactcattctcctgcaggtcatctctgcccagcctgctccagccctctctcactgcagcaccttgaggagttcacctaggtggtctgggacaatggcaggctggtgggcatccccagatcaccaccatacagtctgaggcttttgtgcttttcttggttcagcatattgagtgcaaggctgagctttggggctctgggatgcccactcatctccaacagcctccctgagccccgtggaaagtgcctggggaccagccttcctcccttgggttgctttgagggcctgtggctttgcagactcgaaacagtcaatcttatgtgcagagcctgctgtccctctctacttcccaccaggccaggaagttttgaccaggccctttctatccaacaaggaagaccgtttcccatgatgcctgtcatttgcctcctggccctggcatgagcaccagacctccacccccaaagccacaagaagcagatggctatgatctcgtgttgaaaccaccgggaccctcaccagcaagaaccctggatgccagaatattgtggcttatctctcagcctggcggcacagtgctttatcagcatcatcctcttggttaaatatctacaacattaattattacaatttattaaatctggggaaataaagtcttactgcaatccccttgccacttccccatgcccccaccaaaatggagtatcttattttgctaactgcttaaacataaaactccagaagaaaaaaattgtccccacagctcatatttttcatcatttggtcattaaatagtgatggatataaacctataaagaacctaaactgaaccttttaacaatccatgagcaatactatcatttctttaatagaacctgctgacggtgccgcgcgcagacaccatttgtcattttcagcacgcaataatcaataagttggcttgaaaataaataatataacagtcacaatatattatctttcagactggccttatactaaccataaaatgggactaaaacaagacagaaacttttacatgaatgttaaaaagttagagacatcacagtgaggactaatgcatgaattagacccatgccaaggtcccaaatttgctgtgagttctgttgagccaggcttctgctgccgcccactgcctgcagttagagtaaggacgcagcagccaggtggcgaagtcacagtcagcacagtgcatgggggccaaaggtgacagcgttctgtcacaggctatattacccaggtgcagacttcccgacgtcattccaggtaccccagagcatggcttcaaacagaaccacctgacgggtcatgcacccagtgccagggctgggtagaggtttgcttagttccaagaggaggccatagcccagattcagcttcagagattttcattccgtgggagagaaaaacgccacaaagaatccaggccagcaggtgacattggtggagagtgggttccggaagcagcaaggtaatggctgcagatcacagtgagcttgccgttatctgggatagggtgacccttagcagccctcagcaactcagctttgagtctgctggccatctggtgctgctcttcaagagcaacagaaaaccccctagtttgttcatttgttctttcatccattaattcattcatgcatccattcattcatttaacaaaaaaggtattgagagcttacgtaagttccaggcgctgtgctaggtgccaggaacacagcaatgaagcagacaaaattccctctgctcccctcccagagcttatgtgctagttggcgcactacaatagacaggatatgtaaatccatctcaggggggtggtcagtgctagggaggactgaccccctagtgtaaagcagggcaaagggacaaggtcaagtgtgtgcccttcagagcaggtctctcctggttcccaggtgcccaggccttcactcagagtgccccatccagcctcacacctgcctttggctccctagcttctctggtaaccagtctccatggcgtcctggtgacaccctatgctgccaccagaaaccattgtatgggaggagccccatgccctgctgtgaggcaggcagcgccatccccactgcacagctgggagcccaaggctcagaggcagcatgtctttggtaagcaggttgaccaaatgtccctgtttgcctgggaatttcagtgcttaaaccagcacagtcccaggcaagctgggatggttggtcatcctcaagcaagtggtagag

SEQ ID NO: 429 - DNA, 20001 bp, Homo sapiens
tgtataggttatatgcgaatactaagctgttttatatcacagacttgagcacccacagactttggtgtccatgtgaggtcctggaactaattctccatagatattgagggatgactatatacttatatctaataatcaccaggatatatttttaagtgataaaagcaagatgcagaacagtgtatgtatggtgctaaagttgtaaaagaaaggtggggaaataggaagccataactgcaaaaagaaacactttcagaaggaaaacgcagaggctaataaaaataatccctgtatgagaaatagtggaagtcatggggaagcgagacttctttaagagcatataattgggcttctgagctgtcaatattaaaaaactgaaattaaatcaatagacaaaatcaaaccttaaaattggaaataaatggaatcaaataaacccggcattgtattaaaagagtaaaataaccacacagatatgacttcaattgacttttgaactcaacacatgcgctgtacacattagtgggacatattctagagtcaaaatgccattctccactaaagagaaaccagagttactctcagaaaaagataatttcattccaggcctgggacaggaaaagtacctctcactctgtcagaaaaactatcaatcaaacatttaaagtaagggagcatgctaaaaggatacagaaaaggactaaaaagaaaatttgaaacatcattctatttatggaggaatcaaaaggaaaatatacttaggaataaatttaagaaaatatatgcaaaaccttttcattgaaaactacaaaacattgctgggagaaattaaagaagacctaaagaaatggagagataaacctagttcagctagggagatttactattattaagatgttacttctctaggacatagtttatagagtcagtgtcatccctatcgaaattccagcagacctgtttttttttaaatttttttgagaaaaagctgtttataaaatttatatggaaatgagctagaattaccaaagcaatttttaaaagaataacaaagttggaaagttaaagtacatgatagggtacttactataaagttacagttgtaagaacagtttgacattggcaaagggatagacacacagatcaatggaaaccaatagggccagacgcaaaccctcacctgtgtggtctgtagattcctgacagttaccaaggcaattttggggggaaaggaaaatcttttcagcaaatggtgctgtaactatgggatatccgtatagaaaaaaaatgagcatcaactctactcagaccgcttatgaaactgaacttgaaatgagtcagagatttaaatataaaatctaaaacttctagaagaaaacacagggggagttttgtggccttggtttaggaaaatatttcttagctaggtcacaaaaatttagaaataaagaaaataaagaaaaatgttacaaattgaccattatcaaatttaaaaatttttagtatctaagacatttctaagaaaacaacaagtcaaatcatataatgggagaaaatattacttactgaatactatatatatatatatatagagagagagagagcgcagtaaagaaaaagagaatacaactcttttgacagatagacatatatatacacattataaaatatacattatatataatgttacacatattacatatatacatatatatatctgttaaatacaagtatttaaaatatattcagaactcttaaaatttaacaataaagacataaataaatcctaaataaaatgagcaaaagctttgagcacatattttaccaaagaagataaggacttgaaaagaagcttggtaggaatagtcatcagggaaatgagatgccagtacacacctgtagcatcgctaaaattcaaaacactgaaaaccaagtgctggaaaggatgtgtagcaactggaatgtcatatattgctggtgggaatatatatttgtatagccactttggaaaactgttgggctgtttcctaaaaagttaaacaaactctataacataaccattttgaacgtaggtatttacccaagagaagtgaaaacatatatccacataaaacttgtacacaagtgttcctagaagatttattcgtaataggcaaaaagtggaaagcacccaagtacccatccatggacaaatggatgaaccaactgtgacatatctatacaatgtaataccacagagcaataaaaaggaataaaccattgttacatggaacaatatggtgaatctcaaaagcattacatgcagcgaaagaaaccagacacaaaagaatattactatattactcaatgtataaaaagttcaagaaaaatcaaacaaatccatgctacagaaacgagatcagtggttgcctgggggcagaggagggaggagaaatggatttcaaaggaacagaaggaaaagtttgctcctgatggaaatattctatatcttgattatggcagtggctttataggtagatacatctgctaaatctcatcacattgtgcacttacaatggatgcattttatcatacatgtattacacctcaataaaactgagagaaaataatggcacaagaatcagcctcaaggaactcccactggccaaatttgagataatataagcataaaaaatgattcagttggtagtaaaacatggactatatatacatattttaaactgaaccataatctgactaggcctctagccctaaccataccttttcagggaatacaatggacacaggaaatattaaactatgaaatggggatgcagtcatcacaatctagactgagggaaggtctgcagggcaaatgattctgtttcttcaacaaataagttgcatagaagagagagagagacttatgaattaagagatttatcaatgaactgctatctatggtccctccacaaatcttgattcaaacaaaaaactttaaaataattatgaaccaattaataaattcaaactttggatatttgatattaaggaattattattaatttttaaaagatgataatggtactgtggtcatatattttaaggagatagtttagtttttagtgacacatgctggcatttttatggatacaaggatatgtttaggattcgtttcagaaggctccatgggggacgtgggtggttgaaacaagtcttggctgaaagctatccatatcttaatgcacctgctcctcacaacacactggtgaggtggacctgatgggtgtactcatcttacagatgacaagctaagagaagttagggaacttgcccaaggtcacccaaagcccacagtgatttccaagcccatgctgtgggaattctgccagctgttgggtgtctcagtctcaattatgtattcttgaactggagacacgagcacaggatgggtttgaggacccaatgggtcccctttgagacaaatctgagctaaaactccatcaatcacctgccctccatgagcccctactctgactggtgggccacagtgactttttggatctcctggaattaatgtcagttcagaacccgtgtccggcagcctctgataaacctgtctatttcctcttccccaatgcacagctaccctggtaaaaggccaaagttgaacagtatcagtttttggcagtgtacctgggtccttcctccaagggacacagcctcctttttattcaaggggttttgggtctgtaaactggctcaagtctggggattaattgaggggccatgactctgttttttatgatttgaattagacgtttattcacttgacctagaacttttctgtttatacagatcaagtaggaatttagtaggcttcctatatctatttcatttaggatcaccatggtggatcaatttgccaatgccaaaggtctgctctagtcagactgctgtattctgactgctgctggaatgctgctatcccctatagtcactacgcccacctgccttttggggttgagtgctcctgccacccaggatccaattactcccttgtgtgagtttcccagctcagtgactgcagtttctgctgtgaggtctggcctgcagagaagagcgatcacagagctctgcaaagatgccagggctcccctcacaaatttatttcttatacttgtggtgagaggtgtgttttctggatcctcccggtgtgaatagaacttaagtgacaagtccatgctagtattccagtctctctaagcctttgaattccttcctccacactaactcaagacagctcctgcacttctaactcactcactgtgggccggttctggtccacacttcagccaaccaagcaaacaaacttttagagcctcttctacttccctgaactgcaacatgaaatgcagaatctgtgttcagtaacctcatgtcaataaatttggatcaacttcatcctccttccacatctgtgcagcactgtcccttaccttctttgcttaggcagctggtgggaaagtcaggaaagaagcaaacaccgctctatagaacagtggggccaaggaaaggaagccaactccttctcaaactgcatctgcactggattattctaaaaaatgaggaactggtttggagagggatgcacccgctcataggtgagtttgtgtgctgcgcaggcagctggactgctgcaacactgcaaaggaatacagccgggagaatctatgtcctcttctgactacaggagttggtgctccgttccccttcctcttcctcaatagatctgggaacagtgagaaaatccacaagctgaccattcagtagggggcagccttgagacagaaaacaagccagagctccctactcagccctgcgggtttgggaagggttcccttggaggggagaagggaggctcacacctgaattaccaggaggccaccccgatacccttctagaagcttcctgtctccagcatattagatagtaagtccctcaaggacagcaaccatggttgctagcagataattaataaaagtatactaaatgaatgggctccatttagcaccattaaaataaggggacacttatattttcttctgctggtgagggtgaggtgccatgagcatactcatgcattgttttaattttaaatgttcatactccttgactctataattctacttgaaatttagcccaaagtaacaattctaaatatggatgagggggagagaggaagagaacctgtgtccataaagatatacaatacagcattattcataatttagaaaaactaaaaataatttataggctgagcagtgtggggagaattgaataattttttttttttttgagacagggtctcactctgtcgcctaggctcactctgtcgcccaggagtgcggtggcgcgatctcggctcactgtaacctctgcctcccggcttcaagtgattctcccatctcagcctcccaagtatctgggactacaggcgtgcaccaccccacctggctaatttttgtgtttttaggagagacagggtttcaccatgttggccaggctggtcttgaactcctggtcttaagtgatccacccaccttggcctcccaaagtactgggattataggtgtgagccaccgcagccggcctgaataaactcttatgcaatcctgaaaacttataattaagagtgtgtgtgtttgtttgattgttggtttgttttaatctaggcaacaagggaaagaagtgagagaaatattccaaagttgggttaggtcttttgttagggtcatatgactttgggtggttttcagtattttcaatttttaattaaatatgcttatattacttttattttgaaaaatatgtagtatgtttaggaaaggagagagggagagagagaatagaaaactgacctatatcaaaccaaaacccatcattttctctgatattttagaaatttataggacacagcgtcaagtgagacaagtacgacccaagtggattgactgcacttcacatttttagaagcttttgttttatataacctttctttggggcatgggaatgctcaccttgtcaaaaaatgtcccacttttttttttcaggctgttctattcattccatgctaaattgcttgctgtattaaatgcttaagggactatattttagtaccacttaaagagtgttaaataatcctcatatttatttcctttccttactgaatgcctttaaaaaagtgtttgaaatatgaggttggggagtttatgcataaaaataattataataacacttagaagctcttattctagaagcaaaagcagcccttagcaggctcctgagatacctgagttcggaacctgttgttttcttcctcgggatgttagcacgctgggaatcactggtgtgggatgctgtcaaatgcacaccccattgaggctttaggacctggaggatgtgctttatcttcatgatgggaatgtcccatgttacatgactgggtatgactgttgtggagctggttctaacaatctaatccaatgtgctcatatggaatgtttggtctgctcgttttgttaagaataattgttttcactgaaacaatgtatcacttacaaacatacaaaataagcaatttgaaatttactaaatacaatttattttatggtcaactgacaggtttaaagtaccatgaactgtctactgtttatctgaattttttaaaactagatgataaactcaaaaatatttgagaaaaatggagacatttaaaaggatatttttggttgtttttaagcttttaccaaaaatcagtctctctctttctctctctctgtgtgcattatataatacattacagcctaataaatgaaccctgtgaaaaatatacttctctagatataaatctaccttacagtagatagaaacgttactttcaaatgtaaaccctggaaataaataactctgaatcacagagacagaatacttacaaaacctttacatgaaatatgcacatatgagggaatatccattttacaccagttgtaaacactgatctctgattcttcttttggtaacctgaaaatatggctattgtttaaaactgcagctttgaatctcaattttgtttaggggcaagtacatagaacatggcaaaatatattataatggatactaagtttgcacatcaagtcataaactctggcatcttatatttgaagctaaatctgcccttttttcatacattatttggttgttgtttacatacagtttttaaaaaaaatattgtattagtcggttctcaggctgctaatagacacatacttcggttttttataaactgggtaatttataaaggaaagaggtttaatggactcacagttccacatgcctggggaggcctcacaatcatggctgaagagcaagggattcttacgtagtgggaggcaagagagaatgagagccaagtgaagggaaaccccttataaaaccatcagatctcgtgagacttattcactaccaagagaacagtatgggggaactgcccccatgattcaattatctcctgtggggttcctcccacaacacttgggaattatgggagctccaattcaagatgagatttggttggggacacagtcaaaccatatcaaagattttaagaccaaaggattcaagtggccatggctaacatcatctagttaattgcttccaatatttacaaaggaccacgtgggcccctttgctgcatgctggggtgaggaagggatgcagtgtgagtgagatgtgagatacagtttcagctttctggattcagcacctctcatctcctttctgtctgacttttactattcacttagcacatgttttctgagctcttgcatggatcacaccctgttgtcacattggagtcataaaagtgagtgaaacaacaatgccaccctctgtttcttagcttttgttaattgagtctacctgtgctcacttgcagagtttcagttttgtaagatgaaaaaattctggaaatctattatacaacaatgggaatatacttaacactattgaattatacactcaaaaatagttaagatggtcagttttatgttatgtggggtttgtttaaccacaatttaaaaaatactagaaaaatattgaattaaaaaatatatatttattcttttgacaccccccctaatttaaatgctggagtctaatttttctctccttgaatgtggaccaaacttcatgcctcacatttactaagtagaatgtggtggaagtgatactatgtaattttcaaggataggtcattgtgaatatgccttctgcctggctttcttgctcttagatcccttgttctgagggaagacagaggccatgctgtgaaggcactcagcagccctgtggagaggcccatggggaaaggactgaggcctcccaccaacagccagcaccagattgctgcccatgggagcacacctcctccagccctggtcaggccgtcagatgactgcggtcccagccaacctctaactgaatcacatggaagatcccaagtcagaagagtccacagattcactcctggattccttactcatagaagtcataagccattgagttttgaggtggctttttacgcagcagcacatagtctacatcaggcaggggaaagtgcaagttgcttgcaggggaaaatcagggccattgtcattgactgggcctagagttcaagtcctttttctgacacctgccatcctcattcccatttcaaactttacaattcccctttgaaaaatgagcagattgccatctatttttgtcttgaactcctggccttaagagattctcccaccttggccacccaaagtgctgggattacaggcatgagccactgcaccttgccatttattttgtaaagttgatgttaacgttaaacagaatggtgaatgtcaagtacagagtgcatagtaggagctcagcaaatggtagcttttattatttgagttcataggacacatcaaagatgggagatcatatttgtctcatcccaaagttagtgtagttcttttatagtctaatgtagtccaatgtagtctaaacccagatctcttcttcagttagtggagcccaagaatattaaagctagaagggatcctggagctcgatctgtccaatgccttcatttagcaaatgtctacactaagacctgggctggttacaacagtttacccaacattcacaccaggccaggcaagactaagacctggatggctgacttgtagcctagtgcactgtgcattgcatactgatgacgtcaaaggcctcgttttgtgttaggctgatctgccagtcatattctctgtggctggagtgccttcattaactctgacagagaggctgttaattagtcccagaagccacgccctgctcagcacctccaagagccacactctgcatggaggtgctgggactgagcccatacacagcttctcagtcaacacagtgtggccagaaatcaaatgagccaagggaaaacggacaatcagtctagtctctgcagggccagccttgtaatcatattactatgtagatgcctctgaagactgatagacttatcacctcacctccttccctctaccactcctctcctcagcactgtagcctggacaaacgtgaagataattcacatattgaaaggtaaaagcaagtatcaatacacttggccaacttcccagaagctcttcttgaatgttctggttaaaaagctaaactttgatcaaaagcactaagaaagagtgttttgtagacacttttaaagaaatcagaaaatttaattaacttaatcatttctaaatccaagttcaactcaacgaaagaatttttgaaatttagtgtcttctagatttttatttctgaaggaattgaatatgatttcttttctctttttcttcctccctcccttcatctgttccttcctttcttcctttccttctttttttttgtttcttaacatttagatctcaataatatttatctggttatttattttaccttgttatttattcacccatatttcccacaaggttcatgacatgctcctgaatttatttatcttcttactggatgacatccatcaagagtgtttttaaagaaaatctttgagaaataagctttctcagctttctatgtcttagaatatatttacagtgtcctcgcagttatataacttataacttagctgcctatgaagtaagttcttgtttccaagactgctgatgggaaattgagtgtcaatctgatccttgttagcctgagggccatgagctctttctacacagaagctcttaggtttttaaatttgtctttgatggtcttaaattgcatgtgtgtgggatttgttcttattcataaagtctagattctatcagcctttgcaatctgagatctttaagtttttgcttctgcaaaatttttactcatttcaaaatacaaattttctttctgtttttctcttttttttctgggacatcatatatatatatatatgccctcttttcatcatatatatgctctttttacatatatatctacactattctttgcatctcaatttttctattgtattttttcatctttttattatttcctgatgccttggggaattttctcaatttgaatttctagatcactgatctattatttgactgcacccactctttcatttattcttgtgttttcttattcatttcaactattacattttctacaaagagtatttccatttagttcttcttgctcctgcttcatgttaccaatatcctcttcaactcttgttgcatttattttaaagtcttgatcgctctgccccatttgttcttgttcgtccagtacatgttgttcagtttttcttttctctttaatttgatggtatcctcaggcatttggttaactttgcctttggaatcatttcccccttgggaatatcagcttttaaaagaggtaatatttatcctggagtatgaggccaagattatagcttgccctgctgctggtgagttaaagaagggaggaaactagtccctagtctacccagggactagagcccatgaagacacaacccgaacttgatgccctatttgctgttcctttataggggactctaacactcatggcctctctttgcctccagcccatttctactctctttagagagacattccttcttcattttaatcacccagtgtgcaaagggtgaagggccatccggaatgcccctgcctccggcaggagggctcctgctattccaatatcagtctctcacccttgaccctgtagtgctaggttgtcactgctgtttttctgtctcacactggtgatggggaagacaatgaccaacctagggcagtgcagcaaagagaaaatagcacaactaaccagctcttgccccatttagctccccccttcctcccagcccactacctgctcctcctcagcctcattgctgttttctccccacaacaggccacaactccatctggtctctgggggtcctcatgggctttttttcccttctccaaagccatagagattagtcctcctttcttagcctctttaattctggatggggaagggagctagtaatccacactaactctcttatgtttttctaatggtgaatggtcataaaataatattagctaagtctctcttcaagcttttattctcaagataagctattcattcaagtaaagccttcttcattgattagagtgaatacattgattgagctgcagtctgtcaaaaattccaacattcttcctgaacgtcagtccctgcttttatttaccaaggaatatgcctgaaccattcacaatgtattcattcaatcaacaaatatttattgagcatctactaagtggcagaaactgttttgctgtttggaataccttagtgagcccaaaagtcaaagtccctgatgttgtggagcttaaaatgaactataaatataatgagtaaattgaagtatgttagaagatgctaagtactaattttttaagtagaagagaggaaggggtggtgagaggtgtggattgcaattttaattgtgacagacttattctcagtaagaaggtgactcttgagctaagactgaaaggaacaataaagagtggaaggaaacactggctcctactcaatgttaaggtcaacaaagagcttctagagttacaaagaaagcaaagagacaagcaggaagcaaaatgaccagcccctcagtgctgactttgcaactgcggccatgaaggtcccacactcctcctctctttgtcaaaatcttctgatggaaatgagtagaatgaagactggtcagaggaactgaaagtcaagatggaaacagactttttaaaagagaacactaaggtgttctaagacatcaagtcttggactgaggtcatttaggtaccaggatcttggtggaggtgtggtttctgagtgctcatattacctcttgctgcctgcaggactccagccccacagtgtggattgcagtccataacctactggtgccctcagctgcacacaccacaggtgtgaggaattagcattcccggaggtgctcctgagttttgagcacaggtgagtgactaggaaacatcatttgtagggtgcctctgaaagtccctgcaagacagaacattggctatcccaccagtggccaactccataaagcagctgtactccttgctcccttgttctcttactcctgcttccagggatcacttcccaaacaagctccttgatgcaagcctttgtctcaggccctgcttttgggagaatgcagactcaggcaggaactcgactggaaagaagtagcaattggatttgaatataggtagctcaactgtacagcctgtgctgtcccccactgtgacaccactgcttcatctctgagcaagtatggtgaatttcagatcttcagatggtggaagaaaggtgacctcgacattattcttggatgagatgctacagtcagctacttaaagacaacttgaatcacccaggaggggcagagtatagtgacttagaggagggtaagccatattgttcccaagacaggaagagcacctggtactccttggtagctcatgtgcctggaccatggtgtataatatgatgggtattcactgagagttcataagagcctattgaaaggcacttactgctttcttaagactggaaaagttgagaacctgaaagatgtggtatatcaaacctttatatccttctatccttggagacaaggtggagaaatagagtatggatactagttttattaggtaaattgtgtgaacaactggatgcatttaatgctgttcccctcaatattgatggaaagacctctatcaatatagaaggaactttctaagctgatttttaactctattttgtttatcattctcatttttatcaacttttattcagaaatttctcttaagtcactgaatgctaagaactagaggataaatataagtcacatattccctgcctcaagtaaagaaataaaagagattggaagactagggaagaaaatgagaagtaaaataacacttatcaaggatttgctaaatgcccagacactgtaacagctttacttacattatttcactaaattctcaaaatgataaatcatgaagacaatgaggcttagagaggtccagctgtgggcctaagatccacacagctactagacagagagtgaagattccgggctgggaccaggtgattccaaagtccatctgttttcccgtgctccagagttcctcaaagggtgacttatccgtgacctccctgcatctaaatcacccgggggtgctgtcaactgcagattcctgggctgcctcccagacttaccaaatctgaatattaatgaggaatacaagataaggggaagaggggacttggccacagacttatctaaccagctcttcctggcccaaatccagtcctttcgcttacacgctgaagcttttgaacctcagagcatccccaccttcccttggcttggccatcttcagacggggttattagacccccggggttctcaaggaatatacaaccaattatggttttaagaaaacgtcaatcccacatttaccctttcctaaaataggtcttgaaaatggaggttctcctttcttttccccttctttatctaacagaaaaaaaaagacgcatctcttactttggtatattgctctggggtgtgaagccagccccacatgaggaatgactggaaaagtccatattgctgttgagaaagtgaatgactttaatgattgggtgattgggttccaatttctttttcaattcagatgttttccaaatctttgctttttttttttttttttttttgagacagtcttgctctgcctcccaggctggagtgcagtggtaaaatctccactcactgcaacctccacctcctggcttgaagcaattctcctgcctcagcctcctgagtagctgggattacaggtgcatgccaccatgcccggctaatttttgtatttttagtagagacggggtttcactatattggccaggctggtctcaaactcctgacctcaagtgatccacccaccttggcctcccaaagtgctgggattacagacatgagccaccgcgcctggctccaaacctttgcttttaacagaactgaaggagaaaataatagagctgtcagctgagagatcattcatttaaaaaaatttttaaattggcataatttttggcatataacccaggagcatttcaaagaattgctatcacaaaactccttttatctatgtatttatgttaacaggtgttctcagcacttacatctacttgaaagtgtaagattaactctgccacactttgctcatgcatatataaaccaaatgggaaaatccccatccattttagtaagagttatatttccaataaaattttgtaaataattaataattacttaaaagttacatatgggccaggcacagtggctcacacctgtaatcccagcacttttcgaggctgaggcagaggattgcttgagaccaggagttcaagaccagcctgggcaacatgataagacccccatctgaacaaaaaataaaaaaaactacctgggcatggtggcacacacctgtggtcccagctacacaggaggctgaggtgggagaacgcttgagcccaggagccatgtctgtgtcactacagtccagcctgggtgacaaagtgagaccctgtctcaaaaaaataaaaaaggtatatatgctgtgttgatcaatttcatattaataatacttttaatagtagctttagccacaatattttaatgaagacttacggtcataataaaattttttaaaatttaaatttaaatatacatgctttttttgcaaaaaaagaattatagattgatcaataacagattttcagtcatactaagagaatattctaagcagaagtggaatgataatgcaagtttagacaaaaaaataaaaatataaaatttctatatgttaaaagatagcttatacacctcttaaatgtatcatggtggatatcaaatcactatggtatcagattccattaggttcattaaaaagaatgataaaattattttattttaaaatgtgaatacttataatcttctggaagttatacctatttgcatcttttatatatacgatgaatgcatttgggtgttgaattaaaactatttcagaggataggttgtttttcaatttttgggggagtgggtaaatgagccaaatcagttggagacaactggcttagagtctcaaatgttcacagcctgtggaactcacattgctaaaataataatgaagccctagggatggccgactggggaatgagggagggagatttaaaacatactcagacccaaaggcaggtttttgagactagagaagacaaaatttatgccagagtccaggtctctaaatgcagttggaagattaattcaggaaagatgaaaaatgatcccagagaaatgaaagtttctaacttagagagaccagtgatataaattgagttatatcaaacataaaattttaaaggtagaaatattctaacagaattctaatagtattcaaaggagattttaaaaagacatatttataccctacatttaaggaagatttaaaatatctaagtattatatttcatcaaaattaaacgcacacacacacaattttcatcaagttgtagaagacaaaaaccaagatcaactgtctaaattatccaacctgctataacacaagggcctatttctacccacttacttttttcctatcattttcagcttatcacatgtacaagaatgccaaagtccaacctccaggaaatgaattcttttctttttctttttttattttttatttatttattttttcctattaacatttttttattttattttattattattatacgttaagttttagggtacatgtgcacaatgtgcaggttagttacatatgtatacatgtgccatgctggtgtgctgcacccattaactcgtcatttagcattagatatatctcctaaagctatccctcccccttccccaaccccacaacagtccccagagtgtgatgttccccttcctgtgtccatgtgttctcattgttcatttcccacctatgagtgagaatatgtggtggttggttttttgttcttgcgatagtttactgagaatgatgatttccaatttcatccatgtccctacaaaggacacgaactcatccttttttatggctgcatagtattccatggtgtatatgcgccacattttcttaatccagtctatcattgttgggttggttccaagtctttgctattgtgaatagtgccacaataaacatatgtgtgcatgtgtctttatagcagcatgatttataatccttcgggtatatacccagtaatgggatggctgggtcaaatggtatttctagttctagatccctgaggaattgccacactgacttccacaagggttgaactagtttagagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgtttttttggctgcataaatgtcttcttttgagaagtgtctgttcatgtcctttgcccacttcttgatggggttgtttgtttttttcttgtaaatttgtttgagttcattgtagattctggatatcagcccttcgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtgcttgcccatgcctatgtcctgaatggtaatgcctaggttttcttctagggtttttatggttttaggtctaacgtgtaagtctttaatccatcttgaattaatttttgtataaggtgtaaggaaggcatccagtttcagctttctacatacggctagccagttttcccagcaccatttattagggttttccacagacaattttcttgattaaaagaatttcagccacaactccaaaattttagtgattcagttttaacctaagtacatagaatgctggcaaagctattttatggcctatgtataaattgaaagccctactattccaaaaaggtaaacttaatggatatcaagaagcatatatatcttttgtgagatgagtatgctgcatacacaaagaaaatgtgtctctgcccctgaattatctttgcttttagaccagtagagaaaacaggatttttatatttgtaaacttagatcaaaatattactccaaaacattctggagagatccacttaaaaatattaattatagctgccattataacacagccagcaataatgtgacttgtctaacgtacttggccctgaattttcaaataccaaattgctgtctctgaaaaatgcataaattctattctgataaatcaagggttatactctgtgtaaaatatctgtctaaaacatattcctatgagtaagctatgaatccagaaattgggccttaacttccagtgcacatttcctggtatagtgtaaaagaaataacaataaatatctttacttccctgaatattttctctgaaatactgacattaaagcctacattatagtgtaagtcagtgtaaaaatgctttaacactgagtcttttttttttgccatgagtctctttatcctcattcacttgtgtgagtgcatgtgtgtgtattcatgagtgtgtgtgtgtgtgtgtgcgcgcatgcaagcattctcctgtacactgggtttcagaccacagaccagatctttcagcactgacgttgcttaaagaaatctgactacagatttgaaactcatcaacttcttattactgacccttcttttgcagaaatcaagtctgactcttccttgggtgaaaataataagtgtctattacacatgacaaaaaaatatgactttcggtgtgcactattttgacttgggaaatatacttttcccctgttttaaagatagattttccatagtggaaaaatataaaaatgatttagatgaatgtgtcagaaagtgtgagcattgggttcatattgatctgatcaagacttacgagcagaggtgaaatttggtccagaaagcagtttggaaggaaatgcactgggcatggttttagaagctcagaatttcaaggacttttggttctttaatggagcatccaaattgcagctccatcacaaaatgagggtaactccaatctgacattctgggtttacgtgaggattaaatgtctcttccatagttggatgatcaataattacttccattccttcactcactgttttctgctcttcatttcacaatctctatgaagtataaacaatttagaagctaagtgaataaagatgcctttgttgtaatactttagtcctaacttcctaaatacatgctaagtagagagtgctgcatcaatttgcaagcaatgaagctgagggtgatagttgagagaatgctggttgaggggacagaagatgaattccccaagcccagttatcttaggctgccaagtgatcctagcaagtcacttagtttcagattccccatctatcaaataggggatgaaaatgcctattttacataagtccaggcagagcatttgaaagtgtacataaaggcactttaaaaaatccaaagtatcaccgaaaagatgtgcagctaaacatttcctttctgcctccctgtgcctatacattttctgaatatttcaggaaaaggtatgatttaatatcaggtgaattgatcctttagtcaacacttggttattcatggttagagaataaatgtcacatatagatagtgcctttcagtcaataaggttaacctccttcctcgggtgtcattatactaatcacacatctcacaaggaattatggggtccatagggaagatgcatttaatcaagacttctctgtggctagaaagaaatgccacagaaaccttcaggctgccaggtgttgttcaaaatcattttaatctgaattactgccaaactcaaagattcatgcaaaacctatcacttcagcttttattcatatattttatatgtacaaggatttcctccatgtttaattttcctaattcatgtatttagaataaagctagaaaatagtccattatatggttagaaacttgtctgttatctctattgtacattaattttattactactcactatcaatgcttgtaatgattcccatgaggtgcctgtttgtgtgtgaatgtctatgagta

SEQ ID NO: 430 - DNA, 40001 bp, Homo sapiens
tggtgggcaaaagggggtccccgagaaaaagggggtgtttgagcagcccccatgcactctgcgtgtgctcctggaagaataaaggaggcctttattctcgttgcaggcttttcacttctcagagcccgagacccctcctgggaatttgccagggcctgattccccagcaacgtgccccaaagtctgacaaacccaacgctgctctgggatgtaaggaaacagaaggaagggcagagacacagagggttgccccagtcctgggagtcctgcaatgctctgccacgaccagtgttggtccgaggctgggtcactgcaccctgccccgcaaacccaggtggaggctgaagccccaggtgggagccacctctgagcagggtggggaggaggtgagcactgctgctcaccctgcggctgagtgagagccccaggactgcaaagcttggcgggcccttgggtcatccgattcagagtgttctaaggtgtgtcctgtgggacaggtgtctataggatgttaacgggtgtaagcttaaaagatgtcttctgatctacttatttttgggaaccattgagttaaaatgtttctgggtagtgctgagcactcaagaaagagtggccttctccgtaaatgtgggttgtacattggatatcagtttgttcatggactgcactacgagctgtgccctctcctggtggaggggaaacaagcttcctctggcctgtttcataagggcactaatcccactcaccggcgggttctgccctcatgaaataatgacctccaaaggccccacctctgaatactctcacctaggcaatgagtttcctcggaacacagcactgctaaagagaggaggcggggggggggggcctctgccagctctggacacccttgaagggacaggagcgcagagtctagcaggaggccttggaggacatcagaccagcctgagggtcatcagtgccagcacccagatgcccagaccccagaactgcagcagggaacactgtgtcccccaaaagtagggctggcagaattaggggtgtgggggaggcacggtctgtctgcaagatggatcacagaggggccctgcagctgcagagggtgggggcactggcctggctctcagggagccccatcccctcctcagccttaggagccccctgtctgcggctggggcagcagccagaaagggcctggtgggggtgtgtgggcgagcaggggtgggtcctcctggcctagtacctccatgcccaggtgagtctctacctctctgagccctgggagggtgccagcgtttgggggaaggctgtgcgtaaatctcagcacggggtagtccctgttagctcaggcaatatcctgcaacccctcataggacacaccttagaacactctgaatcggatgacccaagggcccgccaagctttgcagtcctggggctctcactcagccgcagggtgagcagcagtgctcacctcctccccaccctgctcagaggtggctcccacctggggcttcagcctccacctgggtttgcggggcagggtgcagtgacccagcctcggaccaacactggtcgtggcagagcattgcaggacccccaggactggggcaaccctctgtgtctctgcccttccttctgtttccttacatcccagagcagcggtgggtttgtcagactttggggcacgttgctggggaatctggccctggcaaattcccaggaggggtctcgggctctgagaaatgaaaagcctgcaacgagagcatgtgttgaggacaggaagccagaggctggggtctcctgagacactggggcaggggatcctggagcgtgcagggagaatcagcatggcatcctctgagctgggcacacactgtgctgggagggcaggggtgccgcgggtattgttcctttagagacacagtgtgaaagtctgtgtttgtgagctcatgtgaaagtgtctgtgcacatatatgtgtatatgtgtttgtcacttttgcacgtgtgcctacatgtaccttcgtgcatatgagtgtgcatgagtgtgcatgtgtgggtgtacgtgtgtacgtgcatttacgtctctgtgtgtataaacatgggtatgtacgtgttttagtgtaggcttgtgtgtgttgtggatatttgtgtgtgcctgtatgtctctgtgcgtgtggggcttgtacatgtatgtgtgtacctgtgtgtatgcatatatgtggacaggatcacatcagagttgagccattattcagctcgcagtctgtgcaggtacctggcaccgtccctgtctcctgggcttcagctgtagaatgccagccctacagtagaatgtatcatacagcattctttatccatgcttttgtgggtcctttatttttaattcttatagtaaaggtcacatttcacagatttcggcttgtttgacaacaaacattagtcaacatccttcagatgtttgcagattttgaagaatttcttatttcaccaacattttccagagtctctgtgtgtactttccctaggattcctgcagggaacctcacaggggtcagggatcagggcggccgacacacgggctcctatgcatttcacagacctgcagtgaagccgggagctgcgtgggaaggccttgccctggcccctagttcactgctgaccatacacctgccccagggctgattcatctgccccaccctgatcacggctcaggacacacacacagggccctacccaacagagacagaggccaaggcgctgccaggctgggagcatagcctaccagcccctagtcggatgcggttctctaagtcctcaatgaacttggtagctggggaaacagacaccagaagaagctccactgctgtcctgatcctgaagaaggatgagcaaggacacctcaggcagtgccacggggtcggaggtggccgctgctgggggcctgtaacaccaggctccaggaggggagacagcacagatcatctgaggctccctgcctggatttgtgaggtcagcagcgttactgttgccccaggtcacaggggaggaagccgcacctcactgagtcatgcagcctgtgagtgggagaacagaattcaaacccggctgggctccatcagacccaggtacgagggcttcctcgctgcctccccagcctcgtcatgagctcatttttagtgaggcatgaaagcaaggccacacccgggaacccagggccccaggtccacgcagagactgccctggcctggggcttcatcctgtacctcaccccaactctgaccctcccaggagctgctgccgcctcgtgcccacgaagttttgttctcccatctgcctttgaaaagatgtcatatttcaggagtgttcttttcattatcactcgtctcctacaaataacaatttcatgtttttatgtaatgctttcatagctcttaaaaacagaaagaggcaccttgatggcaaggtgggtgtgtggctctgtttccattgcactccctgattagcaatcagggcctccagagtggctttgattaaaagacaagcgcatagaaaaagcttccaactctcctcctcctaaggctaccaaacattcaccagcaaaggaaattggacttccactctgaccaagctggtattgacagtgcttggagagaggtgggggagagaggtgggggagaggtgagggggagaggtgggggagaggtgggggagaggtggggggagaggtggggagaggtggggggagagatggggagaggtgggggagaggtgggggagaggtgggggagaggtggatggggagaggtggatggggagaggtgggggagaggtggatggggagaggtggatggggagaggtgggggagagagctgggggggagaggttgggggagaggtaggggagaggtgggagggagaggtgggagagagaggtgggagagaggtgggggagagaggtgggggagagaggtgggggagagaggtgggggcagaggtggggagaggtgggggagagagatgggagagaggtaggagagaggtgggggagagaggtgggggcagaggtggagagaggtgggggcagaggtggggagaggtgggggagagaggtggggagaggtagggggacaggtaggtgagaggtgggggagaaaggtgggagagaggtgggggagagaggtgggagagaggtgggggagagaggtgggagagaggtgggggagagaggtgggggcagaggtgggggagagaggtgggggagagaggtaggggagagaggtgggggcagaggtggggagaggtgggggagagaggtggggggaggtgggggagggaggtgggggagagagatgggagagaggtgggggcagaggtgggggagaggtgggggcagaggtgggagagaggtgggagagaggtgggggagaggtgggggagaggtgggagagaggtgggagagaggtgggagagaggtgggggagagaggtggggggaggtgggggagggaggtgggggagagaggtgggagagaggtgggggagaggtgggggagaggtgggggagaggtgggggagaggtgggggagagaggtggggggaggtgggggagggaggtgggggaaagagatggagagaggtgggggagaggtgggagagaggtgggagagaggtgggggagaggtgggggagagaggtgggagagaggtggggggaggtgggggagggaggtgggggagaggtgggggagagaggtgggggagaggtgggggagaggtgggggagaggtgggagagaggttggggagagaggtggggggaggtgggggagggaggtgggggagagagatggagagaggtgggggagaggtgggagagaggtgggagagaggtgggagagaggtgggggagaggtgggggagagaggtggggggaggtggaggagggaggtgggggagagagatggagagaggtgggggagaggtggggaagaggtgggggagaggtgggggagaggtggggggaggtgggggagagagatggagagagatgggggagaggtgggggagaggtgggggagaggtgggggagagagatggagagaggtgggggagaggtgggggagaggtgggggagaggtgggggagaggtgggggagagagatggagagagatggggagaggtgggggagaggtgggggagaggtgggggagaggtgggggagagagatggagagaggtgggggagaggtgggggagaggtgggggagagagatggagagaggtgggggagaggtgggggagaggtgggggagaggtgggggagaggtgggagagaggtgggggaaagaggtggggggaggtgggggagggaggtgggggagagaggtgggggagaggtgggggagaggtgggggagagaggtgggagaggtgggggagagaggtggggggaggtgggggagggaggtgggggagagaggtggggaagaggtgggggagaggtgggggagaggtgggggagaggtggggggaggtgggggagagagatggagagaggtggaggagagaggtgggggagaggtgggggagaggtgggggagaggtggggggagagaggtgggggagatgtggggggaggtgggggagagagatggagagaggtggggagaggtgggggagaggtgggggagaggtggggtcctccacggagctgtgcgcagcttgctttcgcctgtgtctactagatcccacggaatccgcttggagagtctcaggactgagtgtccagcagctcacttatagggagagcccagacgcaggccacaggtcggcgcagggctgagcccgagagcacgatgcagagccagcgtgaggaggaagctccgcagcggccgcccctggagcccggatgcagggaccagctctgctgcctgacgccgcggccgacatcagggccacttccggtccgcacccagccctcgctgcccctcaggaacgaccctgccgctgctaccacagaaacccgagtgcctcagcctctgcagagtctgttcacgctgttgtgacgaagaccatagactggcggcttctaaacagcagacatttcttcctctcagtcttggaatccgggaagttcaagaccaaagtgccggcaaattggcggccggtgaaggccggtttcctcatcctgcgccctctcacagtgggagggaagcacgcggtccctcgagcctcgttcataaagggccctcactcccctcgcgagggctctgcccccctgacctcatcacccccaaggcctcatctccaacagcatcctatctcgggttagggttccagcacgtgagcctgcgggggacgttccagcacgtgagcctgcgggggacgttcccgcatgtgagcctgcgggggacgttcccgcatgtgagcctgcgggggacgttccagcctgtgagcctgcgggggacgttcccgcatgtgagcctgcgggggacgttccagcatgtgagcctgcgggggacgttccagcatgtgagcctgcgggggacgttcccgcatgtgagcctgcgggggacgttccagcctgtgagcctgcgggggacgttccagcctgtgagcctgcgggggacgttccagcctgtgagcctgcgggggacgttcccgcatgtgagcctgcgggggacgttcccgcatgtgagcctgcgggggacgttcccgcatgtgagtctgcgggggacgttccagcatgtgagcctgcgggggacgttccagcctgtgagcctgcgggggacgttccagcatgtgagcctgcgggggacgttcccgcatgtgagcctgcgggggacgttccagcatgtgagcctgtgggggacgttccagcatgtgagcctgcgggggacgttccagcatgtgagtctgagggggacgttccagcatgtgagtctgagggggacgttccagcatgtgagtctgcgggggacgttccagcatgtgagtttgcgggggacacagacattcagaccatggcagctacctcggccaccaaatactctcctccaaattgaactctcccatcggagcctctgatggacagagcctgagttacttcctgcctcccaagccgacgggggaggtgagttctatgtaccgcccaagggagctgccctcaacacagagaagcctcccagagggtggccacgggccgtggcctgacagtggcactgcttcgtctgaaaagggctggccaggagaggatagctgaacagctgggcctgcaccagcagctcttccagagtggaaggggcccatgggaggtggcccagtgcttcaaccctggttcctctctgttttagttttagctcttaaattgggtctttgatcctctttctgttaatttttgcatattgtgttatgtagcagtcaaacttcatttttttgcatgtggatatccagttgttccagcaccgtttgctagagaaattatttttttcattgactggctttcacaccctcttgaaaaccaatgggttacataggcttatttctgaactcccacttccattccattggtccgtatatttatcaataggccagcatcacattgttttaattattgtagctttgtagttaagttctgaaatcaggaagtgtaagttcttcaacttcattcttctttgtttttcttttgcaagaactattcaaggttttttgcaattccatatgaattttagaattagctctttcatttttgcaaaaagggttcttgtaagattgacagggactgcactgaattcataagtagctctgggtactgttgccatcctaacaatgttaagtcttctaatccatgaacataagatgcgtttccacttatttatgtaatctttaatttatttcagcaatgttttatagttttcagtataccgtgctttctcctccttggttaagtttattcctaagtatttcataatttttgatattgtaaatggaattatttattttattttactttaatttgattattacatctcagtgtagatctctttgagcttatcctacttagtttgctgagctccttggatttgtatattcacatatttcataaaatttagaaaagttttggccatatttcttcatatagtctctctgcccctttatatcactctcctcccctcagaatcaataatttcaatggtcctgtctttaaattctctgattatttcttcttcctgtttaaatctactgttgaactcctctagttatttttttttgtttaagatcttctactttttaattctagaatttcaatttggttcctctttataatttctatctctttactgatatgctctattttgggggatatcattctctcattttcctttatttctttgccaatggttttctatagcttttcaaacatatttaataatattctccataattgaaatgtgcttaaattgatttgaagtcttcctctagtaagtttaatgtctgcttaatttctgcttacttttgcttacaagcaagccgttcttttttgtttttgcatgtcttgttatatttttgttgaaaatgagacatcttgaatattatagtggggtaaatctgaaaatcagactgttcttctcctcaaggttttttgttgtcccttgctgtaggttgcagttgcttgtttagtgacttttctgaactatttttaaagactaccttctttattgtatatgatatggtcagcaatgttttgacagagatttccttgaatgcctggaacacctcccttggccccagaaaaaaattaaaggaaatactcccctggtctttgcaaatcagttctgtatcgcagcacccctccacttagccagtccattcaactctgccttagccttcacttcctgcttgcaatgaacccaaagataagctggaggtgaaacattaggtcttctcaggtcctttctgagtctacatgctgtactggtcatacacatggcattctatattatatgcaagagattttcaaaccccttaatccccaaagtaactctcagattatcccccaggcttttggctcatctattgtttgacccaggtgtcagcagtttgttcattgacttttcaatgttggtaagaaacactctctgctgtccacttttctgtgctgagggagttctaagttaggcaaaacaatggcccactgttactccttaagggacaccccaagcaagtcaaaacagacaaacatgattgcttgggaatcagatccaccctcccccagagcccgggatccacactgaagcctggaccaccatattcaagaccagcaccacacagggtgaggatgaggcagtgctaagttcaaatgccacaaggctctcccaccatctttaagtcacctttttcttgataaaacatttgtttggttgctgtaaacctttgactactttccagagttctgactaggttatctcaatagttctctgtgtctctctttctgtttttgatgtttttgtagagggacagcccttggggctccctgctccccgacttttgctgacccttaccctcatctttcacctcaaccacaagctgcttttcaaaacttctgtactagtgatactgaaaagaagcaggtaaagttgtcctttctgttaccttctctatgcagaagtgcgttaactcatcctctcctcacccagcttgatgggcaagggctctcctttctcccattttgcagaccatgagtttgaggcttaccagggtcattgtggctgaaagctgcagagcagcagagagaggatttaaagtccagccagccatctggccctagatcctatttctcacaccaatgcaccacagttctataaggccaaagtctaggagctgctgtgggattacattctcccccaccttcttccttctttcaccctgaggtccccccttttgaaggctaaacacacaagcacaccctgggggtggggctgagggaaggctctgcgattctgatcaggtcacagtggacaaggtcttctgccctagtacaagaacttgggaacacagggagttggtgtgctgttgctccaaacacggaacatttctaaaagttgacatgtcaattctgtgcaatttttctttcatttgttatgaaaacattctgttgctcttaaggaagcaaacagttggtgtttatcttctaccacttaccacaagtgtgatttgaaaaacaaaccgattttccagctgctcagtgattaaaatgtttgacaatttatgtcttcatgtttgatttgtggcccagaaggtgagaagtacaataaagatgtccttccatgtccctgagctgagctggcatcctccacgtcctcagcatactctgaaagtcctttgtaaaaaatgcctcttggagtaatttaagatggagctgaaaagtggccctttaattgagttgagttgcagcacttctgaagccacttaaaccgtagtaccaaattaggaaggaaacatttctagaatgagttgtgttctgttccaaaataattccttattgaggtcccaaggcatgatttgcatatgatgagcaatcagaaattgtagtgtggaaaggaagcatttggatagaccttgaggatatgtggaagcccttcatggttctgattctttttctctttggtatttgtgttgttctagaatcacagcacatcataaagtaagagaaaatgtgatcgatgggtgggagggtaagctgatgctttaagcctttctcacctaactaactgcaggtagacagcacgtggtacagaaacaggtccctgaaaatgggcagggagaaatccttctgtaagatgaatagcccttaaatgcagtattcaagcttgttgtttgaaggcaatgtctgattaagtccttttgttgctcatttatggaacaaacagttcacctaattagttaaagccctatttctaaatgcatagttccttccgatgggagcaaccaagcggccttgccactaggcttagcgacgctgggcagtcactgggagctgaccgtctgcttcaaggccccgactctggagttccattccagccaatggccagaccacaaagccaggatgggacataattctttagaataaatcaagaactaagaaaaaagggagtttaggggaagacgtcagccccacagggcagtgtccaggaggtttagcaaagacactgtagggatagtttgaggaatcagaggacacagcacaaatgtagaaatcttgcacagctttgatcccctggccagaattgcaacacaccccaggccaccatatgagattccagtgatgctcaggggagtgacgccttccagtaacctcccagggacgtggtggggaggtcactgtgaatgcagaaggccactgagtggagcatcacaggagtgctgtggatcaggcactggtgggtcatacaacccttcagacactggcacctgcaggctctgcagcccacagggtggccagtgcctggtactcaccattctgagctaactggcactgtcactgccccctcctcctgctgccactggccagcaggtccagagggcagatgttcaaagagcaagcctgtgccttggagttaccctccctgctaccactcactcacactcctatgggcctacagcaaacacgtgggcactcttaacctcagctcacagcaaagccttggcatccctgaggcccagagcgccgacctctgccaaggtcacctgtggccaagggcatggtgagagactttctctggggctttttcctccttctggacgccatgtccctgagctgattcacacgggagattcatacattgctaaataagactttgacctagcgccgttccctgaagtttcccaggtctgaggagcaaaacaaacaaatgcaaaggaaaatacaaagcagataaagccatgaggtagagaccaaggacacaccctccacacccagcaacgtggaggggctgcccaagcccactgaggggcgtcggttgccatcaataataacttcacacgctgtccatgctctcaccttggtctcatcccagaaagtaacttcattgatatgtgaaatctgatatccaactatattgcaattgaggaaaaatatattcctttcagcccccttccccattataaagactttatgcccaaatcagtttaaatttactttttaattatgtacatagctttcttatgtgaagcttctgactagaaatatgtatctcattttattttatgttattccattgacccaaacacaaagtcatttttcttgaatactgaatgctcatgtacctttttaattaaagcttaaaaagctcttaattaaagtcataaatcaggggcagcaatttctacctaaattgtcttgcaagccttcctggttttccttctgcttcacggtgacctgtgaggcaactgcggggtgaagatgcctttcacatttaatctgtggtaagcagcttgggcgtgggggagcgggcgggcagtcctatcacggcgtctctgtcaccagccaggtgcctgtggtggccagcagggccaggcggtctttgtgagcaggcaggtggtcctatcgtggcgtttctgtcacctgccaggtggctgtggtggccagcagggccaggtggtcttcgtgagcagtcgggtggtcctatcgtggcgtttctgtcaccagccaggtgcctgtggtggccagcagaaccaggtggtcttcgtgagcaggcaggtggtcctatcgtggcgtttctgtcacctgccaggtgcctgtggtggccagcagggccaggcggtcttcatgggagcattattcacggaccctcatcccgtctcatgcctctcctgccttcctctactgtggtgacgaggacagggctcacctgtccactcatttccaggatggcgggcagttttctagaagcttttgtatgccaagaattggccatgtcttcttttgaaaagtgtctgttcatgtcctttgcccacttctcagtggggctgtttggtgtttgcttataaatttgtttaagctctttatagggctagatattagacctctatcagatgcatatagtttgcagatatttcctcccattctatgccattatccttagcaaactaatgcaggaacagaaaaccaaatactgcatgttctcacttagaagtgggggctaaatgatgagaacacatggacacaagaaggggaacagcacacactggggcctacttgagggtggagggtggaaggaggaaggggatcagaaaaaaataaccattgcatactaagtttagtacccgggcaatgaaataatctgtacatcaaacccccatgacccgagtttatctacgtaacaaacctgcgcatgtaccttgaacctaaaataaaagttaaaaaaaattttaaaaagaattggccatatactgatattttcaaaaattaagtggctcttgccaatacctcatcggggtacaattagcacttgacaaattgcctgttctgcacacactgcacagtttgataagttttgaaatctgcgcacatcaaggcatcattaccacagtcaaggtaaggaacagatccagtccttcctcaaaagaagcttctttttaaatccctcctgccttccccaaggcctctccctccatcccaggaaaccccccttctgcttcctgtcactataaaccaatttgcatttgataaaagtttttacaaattgaaccatacagtatgcactgtttttcgactggcttcttctactcaaactattttagagtttcctccatgttgtcgcattatcaataatacatcattctttatgtatctctgggtaatattcccttgaatgcacatgctcattgtttttctttcacctgctggtgaacttggagttgcttccatttgggggatattcctaataaaacttctgtgaaagtaagttcatatacaagtttttatatgggcacatgctttcttttctcttgagtaaaatacctagcagttgagtggccagatcgtatagtaggtttatctttaactttttaagaaactgccaaaatgttttccaaagttatattagtttatactcccactagcatgttaataatgtgtgggagtttcagttcacccgcattcccaccaagagctggtatggtcagtcttttgcttttagacactccagtgggtttatggtgggatatcgtggtgattctaatttgcatttctccatgagtaatgatgttgaacatcttctgagtgcctatttgccatctgcttatcttctttagcgaagcatccaaatctcttacccattgttttactggactgtttattttcttatttttgggttttcagagttttttctaaatcatgaatacaagtcctgtgtcagaaatataacttgcaaatactttctcccagtctatggcttactgttttgttgtcttaatgatgtccttcaaaaagtagatattcttacttttggtaaagcccaatatatcattcttcttcttttatgggtcgtatttttgatgtcatatgtaagaaatatttgcccagcccaaggacacaaaaattatctcttatattgtctcctttttcagttttctttttgggtctattttaagttaaattttgtgcatgttaagtttttctttgtagttgtatccattgttgctctatgtattttggaactctgttattaagtgcatatgcatttaaaattgttatgtcctctggatgaattagtcctttatcattatgaaataaactcttttatgcacagtaatattctttgctctgaaatttactctgatattgctacaatcagaattactccaactctatttttattagtgttagtatatctgtttccactttttacttttaacctatccatgtctttatatttaaagtgtgtttcttataggcagcatataccatagtttcccccatccacggttttactttctatgattttagttacccacattctactgccatccaaaagtattaaatggaaaattccagaaataaacaatccataagttttaaattttatgtcattccaagtaacatgatgaaatctcatgctacccccttgaatttaagatttaccatctatttcctggaatacctctgaaatggataagtgcaaccagagaaaaagaagatacataaacaccagggaacaaatggaagaatcacagcagatttctcactggacacagggcacgctaagaccgtggagcaagattgttaaagcactgaaaaaaagaaaaacccgtcaaaccagaattctttactaacaaaaataccattcaaagactttgtcaggtttacaaaagcggcaagatcatcaccactatcagagccatgtacatatacaccatggaatactatgcacctatcaaaaataacaaaattatgtcctttgcagcaacatgaatggagctggaggccattatcttaagcgaactaatataagaacagaaaaccaataccacgtgttcttacttatatgtgggagctaaacattgaatacatatagatgtgaagatgggaacagcagacactgggtctaccagacagcagagggagggagcgaggcatgggctgaaaatctacctgctgtgtgccgtgctcaccacctaggtatgtgtctacatctattcttaatgtattttcttaggattttataggctctaaatgtggaatttataaattaacctcgtgagaagacagctcagccttatttgactattccattctatacatttgtatcatgagctggacttcctacttttgaaataattaatggaaggcacatttttataatgaatccatgacaagttagaattacacaaagcatgaatcagttatgtattttttatttaagtatcacaaaatgttaatcatgaatatatcttgcctctataattttttaattgcaaaataatctatacacacatgcacacatatataatttaattttaatttaatttaattttttaattttggattcaggggtacatgtgctgggttgttacatggcatgttgtataatgctgaggttttggatagggatggtcccaacacccagctggaggcagagagctagtaagtgatggacccagaattccggagctagaaattctagctccagaatccaccattctgtgccccttttctgccatgattaccagtgtgaatgctcagcctcagtgtccttgtttgtgaagtggttataagataccaaccttagggctgtcctaatgagcactgagtgacagaatgagagcaatgcctctgactcactgactggccacagaatgagagcaatgcctctgactcactgactggccacagaatgagagcaatgcctctgactcactgactggccacagaatgagagcaggtgcctctgactcactgaccggccacagaatgagagcaggtgcctctgactcactgactggccacagaatgagaacagtgcctctgactcacttactggcccgtcatcactgctccgagggtgggagctgctgctgttcatggaataattgtcccaatcctttctggagggctggggcatggagacaatgccaaggttttaagcagcaggaaaaagacctgaacagaagtggtgattgtggctgaagacaggaagctggtttgagaggcactgcagagggagctggaaacggattggagaggaagatgaaggagaggcaggagttggtggccaacccaggacttcctacacaacgactggatcaacagggatataagatccacggtggagagtactggaagggaaatgagattagtccaatttgtctgagggaaatgaaaggtctgtgtccaacagagtgaattgatgttgaggatatgacctcggcgtgggcagctggaaacacggccccagaagtcgggggtctgcccggagccagcactccccttccatgagctgggcaaggggtgaaatctcacagcttggaggcagttcttcccgaccagggtggttcctggagctttccactccccagttcccccgggtgcatgtgccctcactccagaagggcctcatgcaccagagaggaaatggtcaggacagtgtcctgagtgtcagctcccaagagctcatcttcagcagacgtttgtggatgtcttccaagagtccgctatgaggatgctcaccacggtgtcatctgcaacctcgaatcaaatcactggaaataccccaggtgtccaacagcagccagtgaactaactgattaactaatagacctggggcaggggactccaagcagtcactaaacactaggttgtgggagaatatttgatgtctgtgcagtgtttgcaaggtattatcgagaggaaagggttaaaaaaatacgtacaatgagagccttttctgatgcatgtacacaagtcacagaaaggcacgcagcaggtggacctggatccccacatcacaggggcgctgtctcattaatgtggcttagctaatttctaaatttaatacaatcgatgagtccttcattagtgaggaaaggagtgaagaaaaagtatttttaattggtcatttaggaaaatgatggaggggtcacggccacactccagagaggtcagtcaagggggtacggtaggaagaagctgtgggctccgccgctgaccacggcactgttggagggagaaacagagccaaaggtcaagaaggccatgccgtggagcagtgtgctagtgaaaatgatgggaaaatttgcatttgtcagcaccgatgcccctgtggtgaggctcatgttccataattcctgacaagcgtctgctgggaactctcttggcagccttttccttttagaggctgggttggtggtgtcctgcttttcacagccagctgtctgccaccagggcagcagctgctgagcctggtacgcacgtccagtggtcacagagaaggaaacggtggcactgccgccgcgccgctgtcctccctcctctcccctgtgaacagattgtttagggctcccaccacctgctctcttgaggtctacccgccatgatcccctccagggccagcttgggaaaggccacatcctcagcagccatccacagcctctctcctgagccatctccagaaaccacacggaaggagctggaggtccttatgctcagggaaataagccaggcataggaagagaatgccgcaggatcgcatgcttctgagggagctgagacagtggactgcttggagggatagcagatccagtggcggccagaggccgggataggaagggcaggggctaagaaggagaaaaaggaacatgcacgcagttgttacccctgaactgtcacctaaacatggtaaagggtgtagattacatatgcagattctgccctaacaaggacaaaaactataaatggggtgaaaaggcactgaccacaggcccacctggaatctctgcccttcctcaagtcagacccaaagggacttttggaaatcccgagtctcacaggcatgagctgctctgcagggtacagcatccctcaggcctcccctcctctgcagctcagtgctgtggagtgaacccaacccagccacaggaaactcccattctagcctcactcacgccacaggacacccctgtcccagccccactcaccccacaggacatccctgtcccagccccactcaccccacaggacacccctgtcccagccccactcaccccacaggacacccctgtcccagccccactcaccccacaggacacccctgtcccagccccactcaccccacaggacacccctgtcccagccccgctcaccccacaggacacccctgtcccagccccactcacccaccacagtgcccccatcccggtctccagtcagtggagcacctaaagggttgcacagggtggtcatcactggggaaacgcgtctgaattgggtcattctgcttgaatctggtgggtgtggtgtcctccttgggtctgatcccagcctcaggcatttctttggaatgagagggatgttcactgcattgttctttctggacactgatggagactgtgatatcacctgaaagccgactgtcagttctgtgtcactgccctgcagctggtcccacctctccccatctcaccctatctactcaaccatgctggaaacctgtaacatgctgcccaggcacactgagacccttcctcaggggtgttcgcggagctggtgcctggcttgactttttctgactccatgacctggggataagtgagtgtcctgtggacaagaccaagtggagggcatgttgcaggtgcaccagtaagcagactcctccggagcaggtggtggcaggtgaggacagaggctgggatgtggaggagaggggcccctcctaaggattgagggcctacggttttcttggaacctcatcccagcacacggagcctcatggtttcagggcccgagcggaatggaagtcgccctcccaaggggagagcatggctgtgatggagtgatctgaacgtgtttgctgtgaccctcccagaatgtgtgatgctcccttcggtgacacaggcttttgccaaattttgggaatttgtcaccaccacactggatctgcaagaaatattcaaaaaagtattaaacatgcaagcaaaacaaacaccagcctatccaccccgctctgccaggcctgtgtgagcagcaggagctgccagccaagtggtttggagaaacctccattcctctaacacggtggccatgaccacacaaagctggggctcacaggcagatcctgtccctttgtcctcagaatgctagatgatcacaattgagttccacacacccagcacctccattgccggccaggccaatggcacagggccaatccccagctgccaaaatgaaaagattttggaacttctgcttggtaaatccccttacagcagcagcacattgtcagccaagcgttggcagtcgaatcagcagtgagaaataccttcaaacccacattttgtgagttcctccagggccaactagggtagaatttgtgaaaggacaggatggtggcccaaggtccagcagaccctgagctctcagcttatgcttcatgctgagaaaataaagtcaaccaaagtttcaaccgaaggtccctgtggaacttggcctcagaggaaagccaggaagcataattctacatttctgtgctctcagaccatggagcccaactttagcattgctgggtggaagctggagggtgacagagggagaaaggaacatggctgactatggaggatgacaggggaaaaggaatgtggcctgatcacacacacagcacactgccactacaacctacaactaacatttagaaacccactgcacaaaggctgtctataaccaaggaattcattcagagcctaagccccctaaaatcatatagaaccaaaaccaaagggccctacccagcaggggcaacagtcacacccttggaggggggatcccattcaaacaaaagtaagttcaacaataagaggtaacagcttccactgatgagaaggaacctgcacaagaggtcggcatccagattcaagaaactcaacgaactcctgaaaaatactgtacaagaccatccccaaagcatttagtcctcagaccatccaaggtcaatgcaaaagaaaaaatcttaaaggcagctggagaaaagggacaaattacacatagaggaaaatctaccagactaatagtggacttctcagcagaaaccttacaagccagaagagattaaggtcccatttttagccttcttaaagaaaaaaaaatccagccaagagtttcatatcctggcaaaccaagcttcataaacaaaagagaaatgaagtacttcccagacaagcaaacactaagggaatttgtcaccaccacactggatctacaagaaatgttcaaaaaagtattaaacatgcaaacaaaacaaaagagtaatactgctaccataaaagcacatataagtacaaagctcacagactccataaagcaatgacccaattgaaactacaaagcaactagctaacaacactatgacaggaataaaactttacatatcaatacgaaccttgaatgtaaatggcctaaatgagtggcaaactggattttaaaaaataagaccaacttcctggtgccctcaagagacccatgtcacatgtaatgacacccaggggattgaagtaagggtatggagaagaatctaccatgcgaatggaaaacagaaagagcaggggttgctattcttatatcagataaaacagactttaaaacaataacagtaaaaaaaaaaaaaaaaagacaaagaatataaaaaagggataaagggttcatcctacatatctagtcacccaacatcaaagcagccagttttataaaacaaatactactagaactaagaacagacatagacagtattacaatgatagtggaggacttcaacaccccactgacagcactacacacatcctcaaggcagaaaactagcaaagaaactctgggcttaaactagatgtatgaccaattggacctaatagacatctacagaatactctatccaacaaccacagaatatacatttttcccttctttgcatggaacattctctacagttgaccacatgctcggtcataaagcaagtctaaatgaattccaaaaaactgaaatcacatcaagcattttctcagaccacagtggagcaaaattagaaatcaataccaagaggaattctcaaaaccacacaagtacaaggaaactaaacaacttgctcctgaatgacttttgggtacacaatgaaattaataaagaaagaaagaactgtgaaacaaacgaaaataaagacacaacatgcaaaaagctctgggatacagcaaaagcataagctgtgtcaggagtcaaatatgctgaggtcaccccaggaggggagttccctaggctcatttctagaaagcttgtcactttctgtgagtgtcccagcatttcctgttcaccgcaggtggagggccccactctctatgtgttaagcctgagcaaacacacacaccagagttccatatttacctaaagccagacccgcaccacgtggccccacaccactgctcaggttgtgctcaggtcaaatcagaacatgcggaaatgttgattttcaaagaaaactattagcagttcaagcataaagctccctgcctggagtgcagtaaaaagaagggcaccagaagtccccaggggctcccacaagactcacaggagccacttccttgtgggaacacagccctgttcatgtttgctgctgctgaaatcatccaaatctacttccggatatggcgaatctgcgtatttttataaatttcttcgaaaggcctatatctgtatacatgggccacaaaggcttatatccttatacagactagagtggtaaatttctagaaatgtccccaaggaggaaagaaatgtgccctcaaaaatagtataaacaaaagcatggaatttgcaaaaataatggaaatgtgcaatattttatttttctcactatcatgtattaataacaaaaattatgtgtggtgtatgatatttaagaaagcagcagccacagacctgccacgtggaccagcacatgcgagatgtttgcagacgtggccggaagtgtgctgctgtttggccacaagtctcagctccttcccccccacactcacagtctcactggacaaggggagcaagacacctgtttctagactataccagagctgtgctaccaatgccaagaccctgctgcttctccccctgtaggaccagtggccaggaacacagcctctcatcttaagatcaaaagtcactgagaagaaaccaacaagcaaagaaagaagagttgccaccatccctcagtggaagaaactcaccttaacccttgcattttatagattcagtcaatgttttctgattgagccattttggaattggaaagggctaatatcataggtgaatttcacataaaaatctgtcagcctgataatttttgagaaccgtattcagggaatagaggttgggtggcaatatgtgaatagcctttgatttaattcaatgaacatttatcagatacttccatgtgctatgttatggggaagtaaaataggcaaggccactaccctatctagagagtattctagaaagtgcctccctgatggaggtttaagttttaatgttatgatttcagagatatttgcatagctaaaggagagttcatgatttctccccaaagaatgtgtttttttttaaaaaaaagtgtacacaaattacgtgtttataagaaaccataaaagagcaaataaaaatattgcataattgtaccacccctttagaaatagaaacactctttttctattgtttgtcattctataattatatgcaggcacaaatatgaaagaatcatttcgatccacacatagcagcttttcttacaaatgcaggaccacacgtgtagactgttctgtgatttcctggactggccaaatgctactacaataatgctgcacagtgaacagtctcaaaacatcactggcttccaacgatggtttcattctagtgtgcatggctctgcaggcccatgtgcttcagcctgacccaggttgggccctgctgggcagctctactcacagccgggtttgcatttgttctgtgggtttctggggctcagattagctgggcattctcatctcctggcaggccaccagcacaagagccagaccatgccacaccagcacactgaaggcctcttcttgagtcacacttgcttacactccatcagacaaagcaagaagcatgaccaagcccaatacccatgggtggggacgtgagctcactgactccagcaccctgcaaggccacatgaaagagggagtgaaatgaccacccactctacatgcccacgggtgaggacatgtagagcgagggtgaggagaagaatctaaaagtgacctgaactgagcctgaatgctttgctccaaccccacagtcagtattgactttctatgtcccaacctcaaactaaataccttttagcgtccaagtctgcttataaaaaactgggaggggctggtgacacctgtgccccgtctccactcaggcgtttttaggatgaatgaagtttgtttaggaactgtatcttgttcttaagtgaaagtacatgaaatgtagaagatgcattaatttttacaaaatagaaagaaatgcaaaatataaaaatgtttttaaacatttttttttttttttgagacggagtctcgctctgtcgcccaggctggagtgcagtagcaggatctcggctcactgcaagctccgcctcccgggttcacgccattctcctgcctcagcctcccaagtagctgggactacaggcgcccgccactacgcccggctaattttttgtatttttagtagagacggggtttcaccattttagccgggatggtctcgatctcctgacctcgtgatccgcccgcctcggcctcccaaagtgctgggattacaggcgtgagccaccgcgcccggcctgtttttaaacattttaagttgagcatagccatacagcccaacatctcccgtgagtggagttttgtgtgtacactgaaggtctgcacatcacccctggtgtttagatgcaggcttaaggctggagatcagcaggactcattttcaggaccctgctgatcaaaacgggatgtagcaaagaaaccagccaacaccagctgggaccaggaattataatacatttgcctaagacactccccccagcgccatgacagtttgccaatgccctggaacctacctcacgtggttctgggaactccccaccccttttctagaaagttcatgaataacccaccccttatttagcacagaattaggactaggtataaccgtagccagccgggaatccacgcatgccaccctgcctgtgggtaaccctgacgtgtctgtgcagcagccgttttcttgttctcttttgttctaataaacttgctttgctttcactttactccgttgacttgctcttgaattctttcctgcaggaagccaagaatcctcccgggctcagccccagttcgggggtgtgcctgtatcaggcttccttgcctggacaaagctgccggtggagaggcagcacggagaggggccctgagcccataggaggaggtccgacacgtgctgtggtctttagccggccaaaggctttcccctgggctgtggtgggaagctcctccagttcgtaatagggcaggaatctcactccctcttcacatcagccattgtctctgttccatttcatggcgtgcatttcatactacattcagccatcgtcacaacagctccacttgaaagtttgtttggaaaaaaagtcaaagaacattcattatgcatgagcttaaaaagactcagcacactcctaaaatcgatacaatgcacctcttctttccagcttataaattatggcagcacttcagtctttgcagagaacattgggagcccacatttgagtggaagagggattgaattccttgcttttccaggagtctaaagctggctggtgcctctgtggcccggcagcagccaggatgctaaaaatggtggcttcacacagtgaccccgggctgcctttggaaggactttgctgaggaaaacacagcaaggatggtcaggaagctcttctcccatatctccctaccccgtgaaaagagaactgttcactgcagctcagctcactttacattccgccccttcctacccgccagcacagccctgccttcaggacactgtttccaggtgggtttccccttgagccatttggtatttccttgttgctaatgagacaaaataatgaactgtgctcccagcacctgtcattcggttgtccagtgctcaaaaccattttgccacaacactgatgtcattgagaccgcagaggtgagtgcatgaggacctctgtagcacacccagctctcagagggacactttcctcaacccgcctggcaggtgggccggggtccctggagggcttccaggggtcggccagagaggatgccactgtgcctcccacctctgtgcttcttccagcaggagtccccagattttgtggactgttgctggtgaaaagtgccagggcggtcttaggtcccagactgactgtgctaacacccacttctcgtcctccttcttctcttcctcctttttccttaaactgtggaacaagcccaccctcttctttttaaccacctattgtggtgtcatccctgagctgctggctctgcagagcccagagtccatccccccagccccagcgggaggcaccccctgctaaggagacccttgtcgcgctaacacgagaggctaacagcagcgctggggttggtgggggctttggccacagacaggaccagcccgaggttccttctccttccacatggagcctcggggatatcctgccagggtgtgtgccttgaggggagaggggagggactgagccagcccacctgagccatcggcagggccaacttggcaggagcacaagctgcccctccacctgctccttttcctcacctggctggccgaggcctgtggcaaaaggaaacagcagtgatgttaacaccttcctcaggaaccgctgtcgtgctctgttgagaacatggcggggatgcctcttggcctggctctgcgcccaggtctccatgacccagccccagggaggacctccacttccaggcacagtcaggcttcctgccctcaggctgggactcggtgaacacactcccatggtgcccctggtcctcaccaggcaccaacacactcagaactcactgcccttcatttccgaggctctgccttcaacctcttctaccttagaaattgaaattattgtcttatactattacgacttaactaacttatcttctcctgtgctgtgaaactaagtgactggataaattggctgcatggtaggtgctataaaaagctctcggaaaatgaccttctctcctgagaacttgaggggttctcagccaacccgtctgcacccacgttggtcctgttcagctttggggtctcacagagcctctgccagcagcgccatcccagtgagaggcgcttacccacctcttcccacaaaccatctgttcatcaaggtggtgtttacctttcaggcatcctggaatcacctggtgtggaggaggccctgggcagggcggaattccacgtctggatccagtgcttccttgaggggagcgtgggaaatttgcttctcccctctaagacgcgcctgtaaaatacagaccccagtaccttccttgtggtgtgttctcagggctgagacaccctgcttagggtagcattggtcacactgatggcatccaatccacgccagcctcgcagccttgtccctctcctctccagggcttccctgtccttccccctccccgggtaccagacttacgggggcgaggagcttgcttttttgacctggactcaccaaccaccccttccttgccacctggaggaagcccactcttctgacctctgaaccctgtgctgctcaggttcccgagatccccggctgggccgttgtttgcaggcattcccactccagctgagagccggcccctagcaggcgttcccactccagcggagagccgggccgctgtttgcaggcattgccactccagcggagagccggccgctggcccaggttacttcatgcctgcctcttggcatttgcctctgagtgccaagagaaagaggtgggcacgtcacctctcctgattagagaggttaacaagttaacctgcggggttgctgtgttcacagaacacagagctacatccaggccactaggagttggggcctctggccttgccttagtgcccaggccagggcaaagcggtgtgagcgggtcctttccacccacggtgaagcactccaggctgggaaggggacagagcacctcacagaacgcctgagggtgcctcccacctctgtgcttcttccagcaggagcccccagattttgtggagacataacgaccctttatcagaaagagctttttttcttctttttggctaagttcgggaaacaattactgtcctgccgtctgctgacggtcacagtgtgatctgccatctgctgaaggtcagtgtgattctagcaaacctctccaacagatccacgggctggctggtatttcctccgttctgaaattttaaaaactccaaggtgtctgggttcaagactttcttctccttctcagtccaaatctcctcctcctcttctgataacgagccgactctcgtggctgggcttccccatcctgccctttgctgcaggcctttgcggacccccagcaggctccctcctctcctccgtctcccttcctctgcctcaatgcagtcgagtccccggcaggtctcatcctaggtgccacttcttccaggaagctttccctcccagaccccaagcccaggccagctgtccctgtgtgttccagagcctccatgatcacctgttgctctctgtccccctgctcctcggaaggccctgaaaagcaggtgccaaccctgccccccgccagcgcctcccatttcccttcaggcccatcctgtgacgccagcattccagggcccacatcgtcatcctggcagatggagtgccgttagaataatgagcagacatcagggctaacgggcccacctgtaggggcatcctcaggccagacaaggcaggccacatgtgccatgggtatctaggcattctcagcaccgaatcctggcactccagcctgacctgcccttgatgtcaacagctcatcaacctggacacactttatgattcacctccatgaaccacagactgcattcttggtttgttttgttcttaagatggtatgaaggtgagaacccccattagggtttagtgagatggtctgtgtgaaccacgcagtggctgtgaattttgcttctttaccttgtgttttgcttttgtaataagtttttacccataattagaagttagatctatataaatatatctattcatacatatatgaacatataagtgtgcacatgcatatatgtttgcatatgcacgtgtgtacatacacatgcacacacattttcagatgattatatgtgtgtgcacgtgtgtacatgcacgtgcacacacatgttcagatgatatatatgtttgtgtgtgcacacatgtatatgtacatgtgcacacacatgttcaaatgatatatgtgtgtttgtgtgcacacgtgtgtacgtacatgtgcacacacatattcagatgatatatatgtttgtgtgtgcatacttgtgtacatacacgtgcacacacatgtaaaggtggcccagtaggggttctgagtccccctgctgctggctggacagaggccctgccccagcttcctccagggctgccgactctcaggacagcccagagtttggtcttctcataccactgccagccacacactgggcagtaagatgctgtttgagttggaacaatttcctctcttcggatcatgccttcctgcctccaatgcccttgagaaaacagataagaagagaaattgtagaggagctgagcagagcaggtgcatccaggcaactgtagcaaaaaatccagacaggccaaaaatccaggattatattattacaacagcctgactttcacaataggagaaatgtgttttggaaacaccccgacaaccgccacttggtttggtgttgtctgacgagctaaatcaaagaggatgctgtggcccctctgaaatctccttggttatcctccttcctgggaggtgaggcatgacgtctgagccctctgagacaggctgcacccattacctgttacctgctgatagtttcagtctgagtttccaagcctggcccctcctgtcaaaggttacaggcctgacttagctctatgaaacgtggcacggtgtgcgtgaacctttctgctcacagtttgtcactaagcttcgggcactacacttggtgcattactgaatattttgggtcatccttttttttctccgtcttacaaaataggatttgcatatacttgttggcatttggaatattaacataatgttcagaaatggtaaaccataaatcaacagaataacatactactatatgtcactagcccagatctgataattgccacttcgtgttatgttgcaaagaacactaaaatatatttgaaattcctaagtgaacattaattatcagtcatttatattagaagtcagaggggattttaatttcccaggtgccatttgttaaaacctgtgatactgactaagatggatgggccctgagtttaccaacctgttttgcaataattattatggccacttaccttggggcagccaggtgggtccccaatccagcaaacatttgccgcctcaccgggagagcatttcctcaaggtctgtgttttcacaagtcctgcagggacatttggctactttccacgttgtaattgtttttccttattgacacttagattaattcaccttacgagtgtgaaatattctactttcgagtgagcccccgttgatttacagagtcacattgagtcctgtcccctcgccatattgatctttcattattttcctatcttagaagtttcccatgaaacttaggaaacttaggaagttaataataataaacttaggaagttaataaagacttcctaattacccttaattagctttattacttgtcattgcacatttaagattattatttaaatgttttatgtaaggattaattcaaggagaggattgctaaatcatgcccaggtggccccacaaagaatgagagtcagaagaactcaagccacgtgaggttctgtccttccagctgggccctgattgctcctggaaccccagctgtcccctgaggcagaggccaggccgggccaggaactgactgggctcccgcggacgtgcagccaggcatttgctctgggctccttcttctcttggcctcaccttctaagtgtgccctgggctcagaaggagatgggaagcaaaactcagcttcctccgtggacccctgaccccagagcctcatccatcttggcaccgatggagctgcgccagctcccaaattccgggctcccgcttccagtagcaacagcaaagcctgggactgtgtgtggtgcagcagctcggggctggatgctgtatctgagcaatgtaatcctcaccttgtgagggaggcagtaacaacatccctgtttacaggcgaggaaacagaggccaacaggaaacagaggggcagggatccgggccctgagaccctagagcctggcagtcccccaggaagtcacatggccagcccttatccttgggtccatccaggttggctgcctcagcaccttctccaggagccaagtgcctcctcacctgcccttgaccacctctgcccaacaccctcccaaaactcgcggtgaccaccacgctcaggctgacaaagccctgagcaacttctgcccccgccagcaccactgcacaccccctgacctgggaactcctgactgccgagcacagggcaggagcggggcccatgggcagcttccagcatccccacggagcgcaggttccttctgagccagagggggctcggggaggctgcaggaaagccgtgcaaggtgtgcaagccatcgcctgactgataagctgaggggtcccgtaaacctcaatccaacgctgccagaaatcccaaatgctccctctcccgtgctcagccagggccctggcttctccctcaaaccccacgtgacgtggtcttttgtttcctgattacgtgaccacttccacgggacactgaaaccactccaggcagggaactgcgcacatcatctttacagtcttgaccctcagcagagtgactggttcctgagaaaagctcacccagtgctcgaatgaatgaatgaatgaatgaagagctacacaagtgagagtggcttttgggtcctgtgacaatgggcttggtgtcactgagccttggtcccttccagcccatggtaaaggaggcttctgtggctctctccaggcccacgtggtctgatgccctggcagtgacagaagcagcatcgtgcttagctcctgtcaaaaacaaagctcagatacttgcttttgcctccttgttcatatacatttgcattttgatcacttaagacctcaaggagactcgaaaggagagcactcctaggccccttcatctctccctccttcatctgcattagcaaatctgcatataaatggcaaagccaccctggcaagggctttctccaacaacatcctcagaatctccttcctgatcactgcagctgcactgatagcaatttgcacttgcctgttaccaaattagacccagcaattgagctgagagctggcagcagggcgggtcccactcagggagactcctcgtctattcccagggccagggcccctgctggcaaggggagggcagggaaagggccctcggagatgtaccccagcgggccggggcagacatgccccttgggccctcgctgggacgcccctgcctgcggctggttggagctgtctcccaggcaacgcgtcccagtgcatcgggagctctttccagatgaggctctgaatctgcaacttagcagaagaggcgttctctgctgtttttatggggggtacttatcacattttcacagacaacataaacataattttaagtatcaaacatctttaatgtctttattcctcaggaagtgacagtaaatgcccctctattaagggctgtttcctgtaaggcggagataaaaccaataagcgcggtttacttcttaggcgcgagcatcaatctcagccgcccatccttcctttagagctaatttagagttattgcacctcgagcgaggccgtccaaattgagcttaattcacattccagcttcaaaaacaaggtctgtgtctcgctgtttccctattgttatatgggctctcatttctgtgcttttgatcccaaattctaagaactccctttagaaagccttgctgggaaggtggtttggtggggaccaggttctggaaggacaggtcggcagggtagcctggagtggaaacacccagcaatcagcccacacgcggagcggagtggagggcgggtcaactcacttccgcagttgagactgactctgcctggaagtcaaggggttggcaccagccccctgtcgcctgcccaggtgtcgtcccccaccacaaggcggtacctggttcctcctccaaaatgcctgttcgcagggcacatcaactgcctattatttattggtaatccgtctattaggcacagacgtaacacactttaattcggtgttgcttctcttttgctctaaaaatgaacgcaggcagagcacaaacctcattccaggggacgtgctgcacgggcagactcagaaactcagactcccttcaaactgcacgaattcccacggctcttaagagagatcatttccacagccatcatttatcccagataacttgaggaattcatcgctagctatttgcatttactggctccacgaaaggctgagttaattaaaagttccttggggtcctaaacgatatttcttgggaatgagattctgggactgaaattatgatctgtgtgggaggaaccctggtccctccagagtgcgcttgcctgaaagactgttatagacctaaataaaccacggaggcccccacaccccagaggctggacgggagccgcagacggtgggccatggacacgccccctccagcaggcagggggatgttaggtgctgaccttgggcactacctgttgaccttgcacaggtcctctgggctcatccttgtatccactcatgacccggcacctggggaggcaactggcattgcccacacacagacggcagtggcatagaacgaaaagtcacacatggtggactcagcccgacgacggttcagaccccagccctaccatccactagctctgtgttttccagcaaatcattcatttccacatctgccactgaggctgaggacgcttccctccccgctggccccgagtctaggaggataatgcatggaggcctggaaagcagagggggcacagtctgttccttggtgtgctcgaatttcctgggctttccaggagccctgagatctgtggaaggggaaccacaggatccctagcaaggcctcccttctggacttcagggaaggttgagggggtccatgtgcatgcactggtgcaagcagggctggagacaggctgcctcatccctcccaggggagcacccatccggcgtcctccaacaggaggcgggagagtccccgctggggggaccaggagttcagatgctccagcgctcactcccactcacatggaggcagcagacacacagcagcactcacaagcacacacacacgcaaacacacacatgcacacccccactcacacagaggcagcagacacatggcagcactcataagcacacacacacatgcaaacacacacacgcacactcccactcacacagaggccacagacacagtaccactctcacactcacatacacacacacatgcacacacaaggaggcagcagacacacatggtaacccacatacacacacacacacaaaggcaccagacacacatggcaccactcaaacacacacaaacacacacagaggcaactctcacaggcacacgcacactgacatggaggcagcagacatgcacggcaccactcacacatgcacacacaaggaagcagcagacacgcactgccctcctgcacacacacacactcacacaccctcacatacactcactgatgcatacagcccacgtcagagtccactgggcaccagcagccttaggtcagttgctgtccttgggttgagccatccttggcaccctggggaggggcagacgctgtggacatttggggtctaggggctgcccccacaaaggtcaaggactccagggcagagctgaacaccctcagccccagcctggcatgggctggcccctactctcagggccgcttctccaagagcccctggccagtgcctgcctcttcctggccctgcttccctctgagaggctgggtctggtgcccccagagcatccaggtggagcggctagtgagggtcagccagcctggccaggaacagggccaggagcaggatgcatacgccctggaccctatgcatccagcctccccatgctgcgtccaggagcgtcactggcctcccgggtgcacagccgtctctgctcctcacacagggggctggggcgcagagggcagctctgcaggtttgctgaaaatgatggcagggcctggacagcacctcacctcctggccttgcagtgtccaacgcctccttctgcacccggagtacccagcaagggtgcctcagggagctccacccatgtctgtgggcctcgcggggccaaccctgcccgtggatggaacaggagcctgtgtcacgaaacaggagcctgtgtcacgaaacaggagcctgccccaagtggttcccgcaggtgcagggcaggcctgggcgccctcgctacgctagtccggctgtgcttccttgtgcggtgtcagggtgagcccaggcaggccacagctctcccgcctggcttctcggcctgtcctggtttgcttctgtttcctctgttgcatttacccacgttccttaggtcatggaagtttccggaatcctcctgcaataaaagctggagcagtgctggcttctgagttggttgagatgagactcattcctccctgaacacagaagccgcacacacagccccaggcaaagtctctggctggcagccaagctgtgccctgcacttggtcagctggtcaaggtcgtgacctccctggccagtgccttttcccagggtcccggggctgtttctggggagcggagtctgactcagagtgcaggtgtcctagaggaagccagcgaaaccagcaaggcctcgctggagcagagcctgggtgtcgggttgttcagctcagggtcccactgcagcgctgagcctagaaattctggaacaaggggaagagtggaggaggagtggccaagtgccctccaaagggggaagcaggggattcacctctgctgaccaatgcagggccgcccaggaagacaatttaattccagtcttttcccatgaacgtgtttccactcacccgtgagcacagagcctctgctgatgagaaccctgcacagggagccactctggccggggcccaggtttaattaaaacacagccaacatggtcaggttgcctttacctgggaaaagcaggatccttggtacctacggaatcttttttgcaaattgacatttaatataacattaaaaacaaatcatgcttacattaaaggtagtatgaagtattaatttcactttaaaacatttccagagaatttctctaagaacaggtcccggagaatattactccactcattttattctgtttatttgtagctttccaggggagagttttctttcacttttctctttagcttacaccatttcctagaagcccatttttatgctccaggttctatcctgtttagcctttcctcatatacccatagaatacaactccctccacccctcctcaacagacacagactcccgattgtagaaatggggctcatggggcctgtcgagcccaggaaatcctggaaatgggtccctgaaacctgcaggccaggtgactcatcagaggacgtgacgcttctcagaagtctcgctggaacccgcactttccctggtccaggaagaggcattctctggaatctgttcttgtccttgtaggtggttctcagtaacacacaaaacagtgaccaataagagaagatgatggaaatgaggcagacctcagaggccacccacaaacccccgggacccctgatcccaggtcccaccctcacctgcctcagcctgagccagccctgagcctggagaacaggaaaaaaggccagactaccacacaagagcatgtgccacacgggagctacatgccacatggtatccacatgccacgcaggagacacacaccacacaggagccacgtgtcacacaccacatgggaccacatggtatccacatgccacacaggagccacgtgctacatgagagccccacgtcacacaggagccacatgccacgtgggagccacacaccacatgggactacatggggtccacctgccatgcagaagccacatgccacacaggagccagtgccacatgggagccacgtgccacacaggagccatgtgccatgcagagtcacacaccacacattggccttgggagccttaccttggaaggcagagggcccggccggatcaggtggaggtcaagagccagggctacacatggatccctgcagtctcagggccattctgcctgaaggctgatttccctttcagataacaaagaacaacaaagcttaaacattttttaaagttttaaagctataaacaaaagcaaagcacacgtctatttcttttttttttctttttttcttttttcttttctgagatggagtttcactcttgttgcccaggctggagtgcaatggcacgatctcagctcaccgcaacctctgcctcccagattcaagcaattctgcctcagcctcctgagcagctgggactagaaacatgtgccaccatgcccagctaattttgtatttttagtagaggtggggtttctccatgttggtcaggctggtctcaaactcctgacctcaggtgatccgcccacctcggcctcccaaagtgctgggattacaggcgtgagccaccgcacccggccaaacacatctatttcttcagtagcaagggtggagctagccagagcctgacatcatgtgcacagtagaaaggagagcacaatttgcagacaagtctaaaggaatgacgggatgggcacacgaggcacctgctggacacagtgcagccaacaccacagcagctgcctccacggcctgcaaacattctggaaggtcatctgcgggtgtgcccagcacgagctggacgtgcaatacccacctgcctccatgggctgggaacgttccgggaggtcatctgcaggcgcacctggctcgggctggacttgtaatattgaccaatcagcatccactgccttctccccaggaaaccccttcgtttccagaggctgctgtgtgttccctggttcactgggcccttgtggtttgccgtttattccttcccaccctgggatccatctgttatttgatcagaacaaagttttctgtctcctctcacctgattccaatcaggcatccaatgtgtcagccccaagtgtggggacaaaacaaccgtggtagcccccccagtccagccttcccgcatcctagggccaggcgggacctaccttcttcttcccaagctttaaataactttgaagctaaacttaattaccactgcaatgaaccgaatgtctgtgtccccccaaaatccacagattgaaatcccaacccccaaggttggtgttgggaggtgaggatgtggggagaggattaggccacggggatggagccgcatggatgggctcagcgctcttctaaaaggcacccagtgagcagttctcttgccctctcccaccgccccaccccccgcgaggacacagggagaaggtggctctccgcaacccagaagaggccctcaccagaatccaaccctgctggcaccctgacctcagacctccagcttccagaactgtgagaaagggatgtccgtggtttagaagccacccagcctgtgggactttgtgagagtgcccccaacagactccaacaccgttaaaatggtcaatggcaacttttacacatgataataaataattgagcatgacatcaactttgaacatagcaaaaccttaaaaaatgtgtaaaacaagacccagagtgtcattttttctatcaatatttgttgagaaactgctatgtgccaggccctgctgcaggggctgagacaccccagtaaataaaaccagacataagggtggggtctgcaccctcctggagggcacagaggtgggggcaatgagtctagggagagcctcgagcagggtgaggaggaaggggcgctgtggagataggaccaacgtggtgcatggaccaactgccgcccaggctccccagaagctgagtctgccatggaagttaatggagaagctgcctttgctccacagcaatgtgggaatagagggagggcctgggggcagaggaagaagaggcagcctcagcaaaggtcccagccaatcccctggggaagtccagagctggacagcccttcggagtcttccagaatcagggcaagtggatgagacctgggacccccaatctgaccaatcactggctgcagtcacacctgtgatgaccaggcagtggcctgacctgacaggaggggcacaggcacatccatccagggggagccagggctcaggcggcatccaccccccagaccctcacaacggagtgggcaggtgcaggtgcagctctccggcagggcagcagcaaggcccaggcctccaggcagcgactttcttgccccctgcccatttttgctttatgtaaggtggaggagcagggtggggagtggaggctggggtggggagtggaggttgggtgggtcggggtgtgtccggggtctcagtttctgagcacacattcttttaagggctccttttctttctgctcatggctcttcctggcaggtgcaggtgtgggtgctcatgattcctattttacagatgaggaaattgaggaggttcaaagtgttcaggtctgtctgttgagccagaacgtg

SEQ ID NO: 431 - DNA, 72569 bp, Homo sapiens
cacatttaaagcagtgtgtagagggaaatttatagcactaaatgctcacaacagaaagcaggaaagatctaaaattgacaccctaacatcacaattgaaagaactagagaagaaagagcaaacaaattcaaaagctagcagaagacaagaagtaactaagatgagagcagaattgaaggtgatagagacataaaaaacccttcaaaaaaatcaatgaatccaggagctggttttttgaaaaggtcaacaaaattgatagaccactaacaagactaataaagaagaaaagaagagtcaaatagatgctgtaaaaaatgataaaggggatatcaccactgatcccacagaaatacaaactaccatcagagaatactataaacacctctatgcaaataaactagaaaatctagaagaaatggataaattcctggacacatacaccctctcaagactaaaccaggaggaagttgaatctctgaatagaccaataacaggctctgaaattgaggtaataataggctatcaaccaaaaaaagtccaggaccagacggattcacagccgaattctaccagaggtacaaagaggagctggtaccattccttctgaaagtattccaaaaaatagaaaaagagggaatcctcccttactcattttatgaggccagcatcgtcctgataccaaagactggcagagacacaataaaaaaagagaattttagaccaatatccctgatgaacatcgatgggaaaatcctcaataaaatactggcaaactgaatccagcagcacatcaaaaatcttatccaccacgatcaagttggcttcatccctgggatgcaaggctggttcaacatatgcaaatcaatcaacgtaatccatcacagaaacagaaccaatgacaaaaaccacatgattatctcaatagatgcagaaaaggccttcgacaaaattcaacagcccttcatgctaaaaaccctcaaaaaactaggtattgatggaacgtatctcaaaataataagagctatttatgacaaacccacagccaatatcatactgaatgggcaaaaactggaagcattccctttgaaaactggcacaagacaaggatgccctctctcaccactcctattcaacatagtattggaagttctggccagggcaataaggcagcagaaaaatatgcaaaggaactgaatagacatttattaaaagaagacatgcaaatggccaacatatcaaaatactcagcatcactaatcattagagatacgtaaaaccacaatgagatatcaccttgcacctgttagaagaatataactaaaaagacaaaagataacaagtgttggtgggaacatggaggaaagggaaattttttttttttaagatggagtcttgctttgttgcccaggccatagtgcagtggcacaatctcagctcactgcaacctccacctcccttgttcaagcaattcccctgcctcagcctcctgagtagctgggattacaggtgcacgcccctacgcctggctatttttttttttgtatttttagtagagacaagttttcaccatgttggccagactggtcttgaactcctgacctcagacaatccacacacctcggcctcccaaactgctgggattacaggcatgagccaccacacccagccgagaaaagggaacttttgtacactgttggtgggaaggtaaattggtaaagccattatgaaaacagtatggagtttcctcaaaaaaattataaacacaactatcatatgatccagcaatctcacttctggatatgtatccaaaggaaacgaagtcagtatgtaaaagggatagccacattcccatattcattgcaggattattcacaatagccaaaatacagaatcaaactaagtgtccctcaacagatgaataaataaagaaaatgttatacagtcatgtgtcacttaatgatggagacatattctgggaaatgtgttgttaagtgatcttcttgtgtggacatcatagagtatatttacataaacctagaaggtatagctaactacacatccaggctataccgtatagcctattgcttctaggctacaaacctgtagcatgtgactatactggatactgcagacaattgtaacacaatggtacatatttgtgtatctaaacatagaaaaagtacaataaaaatatggtatgaaagataaaaatggtatacctttatagggcagttaccataactgagcttgcaggactggaagttgctctgggtgagtctgtgagtgagtggtgagtgaatgtgagggcctagaacatttctgtacactactgtagactttatgaacactggacacttggcctacaccaaatttataaaaagactttttctttcctcaataataaattaaccttagcttattgtaatgttttaactttatatacttttcaatatttttaaacttattgcctcttgtaaaacttagcttaaaccacaaacacattgtacagctgtacgaaaatattttctttattttcttctataagcttttttctatttctaaattttttattttctctttttacttttaaagtttttgttaaaaatgaagacataaacacacacattagcctgcacagggtcagggtcatcaatattactgtcttccaacttcacatcttctctcactggagagtctttagggacaataacacgcatagaggtgtcatcttctgtgataacgccttcttctggaacacctcctgaaaaacctgcctgaggctgttttaaaattaacttttttttttgtaataagtagaaggagtacactctaaaataatgataagaagtatagtataggccgggtgcggtggctcatggctataatcccagaactttgggaggctgaggcaggaggatcacctgaggtcaggagttcgagagcagcctggccaacatggtgaaaccccatctctactaaaaatacaaaagttagtcgggtgtggtagtggcactcctgtaattccagctactcgggaggctgaggctggagaatcgcttgaacccaggaggtggaggttgcagtgagcagagattgcaccattgcactctagcctgggcgacagaagcgaaactccatctcaaaaaaaaaaaaaaaaaaaaaaaaagaaagaatagtatagtaaatacataaccagtaatatagttgtttattatcattatcaagtattactgtacaaaactgtatgtgctatgcttttatactgctagctgtacagtaggtttctttatactagcatcaccacaaacatgtgagtaatgagtaatgcactgcactacaccattatgagggctacaatgtaacaagacaatagggattttttagcttcattataatcttatgacaccagcgtaatacatgcagtccatcattgactgaaatgtcactgtgcagcgcatgactgtatacacacacaaacacacatgcacacacacaatggaatattattcagccttaaaaaagaaggaaattctttcatttgcaacaacatggatgaatctggagaacataatgttaggggaaataagccaggcacagaaagacaaatactacatgatctcacttatgtgtggaatctgaaaaagttgaacttgtaaaagcagagtagaatggtggttgccagggaatgggggtggggagtggtgagggaatggggacaaattggccaaaggttacaaagtcttttttttttttttttttttttttttgagacagagtctcgctctgtagccaggctggagtgtatggcactatcttggctcactgcaacctctgcctcccgggttcaagcgagtctcctgcctcagcctcccgaatagctgggactacaggtgcccaccaccatgcccggctaatttttgtatttttagtagagatggggtttcaccatgttggccaggatggtctctatctcttgaccttgtgatctgcccacctcggcctcccaaagtgctggggttacaggtgtgagccactgcgcccggccacagagtcttagttatacagggtgaataggttctggaaatctattagacggcatggtgtctataggtaatgatgtattgtgtactcagaaattgctaagtgaatagatcttaaatgttcttaccacacatacaaaatgataactatgtgaggtgatgactatgttaattagcttgattgtggtaatcatttcataacgtatatgtaaatcaaaacatcaggttgtatatcattaatatatccaatttttatctgtcaattatacttcaataaagaaaaaataatgctactataggcaacaaaatggaatgcaaaaggcatacacctttaagtatttacctagttatttttaatagcatattcaggttgtaaaagaacacaagctcattgttattaattttaaaatgcaaaaaaattataaagaagagagaaaaccccataatctcatcatccaaaggcaacactattaatttaatatttttatgaatttttctttctctgtgcatttctctatattttaaaaaatactgtctaatattctattacattatactgtgaatatttactccattaaatattctttgaacagttaacttttagaggttttatgatatttcattgtaggatgtgctataagttattcaatttctcacttggggacgtttatgttgcttctagtttttaggtatatttaagaaaaaattcttctacaagtgccttattaattatgttgaactgcatcaataagaattttctttacatacattctgagaattactgggttaagaagcataaacatttaaaaataacttgatgcctgttgccaagtaattttccagaaagttagttccaatttttccttccgctagctgtgcatgagaatgctcatctcactgcgctctttaatgtcagagtaggaaataaaagctctgccaatttgataggtaaaaggactgtttccttaaatgtttttccttttgaaaaattaagtgtactttgttctttctctcttttaaaatcaatatagtagaacatttggaaaatacagaaaaccatggggaagaaaataacaattgcatgtatatcacttttgaatatacagagtgttttcacacattttctattgagtccttcaagcaatttcatgaggtatggccattagtgttgttcctactttacaggtacccctactacaggtcagagaggttaagtgagttacctacatcatacaggtagtgagaggtggtgctgggtactagatctgccctttggatgtttgatctcaagatttacccactgtactggttttcctggggggactggagatgagaggataagggtatcaaatacattcctggttactcagagcaaagggttcattgtttggtgctggaataattagtgggggtggggtccagaagcagtagaaagaaagcctaggaccaagagtgaagggtcctgggttccagtcccaccttgcccatggatttgatgtgtgatatggaagtcatgtctccttctgaatctcagttccacaatttcataaattaggatgggcctgaaaagccaggatagcattagctgctgagcctttcatactcggctcagcctcatccacctctgctataactctagtggccgggtcttcattttgcctcagcagggagagaccggtttccagaccacattggagggaagcaggcactgggaacaacagagcgagctctcccgctatgtagtgattcttagcacaagttggggaggtaagcctcaggtggtacagagaccctgacagccctagggattaatgtagcaccctggggtcctttcgactctgcttccacagtgaaagtttggaaggtcatgagctatatcacaagaggttggccctgttgtgggcattagctccctctacattcatagaactcttctgatttataacagaaggcctaggtttgggaggcagagcctgggctttgtaacatgtaggaggtagcctcacactttctggatcactttagcaatgaatacattgttatctgcactgttgtctggctttcttccctgtttgctctaaacatacaactttgattctctagccttccttaaaattctggtttcttgactccgggtgctggcaggctctgcttctggccctagatttcacacccctgatgtgaaattgcatcctcttcacctctcaaacaagttctctcctcttggtttggacatttcttctccctctcctgttagacttcctggttaggacagatttactgggtctgagagagaaacaaactgagaatggcagtcttgagaatgcctccttccacttctgccttctagttcacagcaggtctagatttcattttagtttacgccttgtaatcataaattgtcaatgaaatggccacataggatggtctgagatattacatttggggttttggttagtcttggctttacgcaaagacacaacatggcagctgggtggtgtgttagtagatgtataaggctagggatccagggattcccatatcccagcacttgaaattcccaagggaaccttatgcataagacaatatgctgcaaacagccattcatccaacaagtgcttattgaatacctgttatgtgtcaagctctgttctaggtgttgggatacagtagtgaagaaaatagacaaaaattcttgtcctcatggagcttcttacattgtagtgagaatgggaatagaacacaagagtgggggcagctcagggcaccaggaaggagggtgaggggtgtaatttgtataatcccagaggcagactcgccacatttcacgatcacatgaatgaccagtctggctggctctgctgtagtgccatttggaaagatggctgttgttttctgtttttagattattcataattatagcagcctttgtgccaggtcttttttttttctggcagcatatttgtgccagaatatggcctttgtgccaggcactgtgcaatatattaattcttcctcatgttaaccctgtaaaggggatattatcgcccccattttatagaaaaagaaactgaggcatgtcaaggttaaataatattctcagtgtcacacagccagattgtctatctgcctacaaagatgtgttctgaaacagtgtccattactgccccagccctggagaaatgccactaggcctacacaggaaaacggaggcaaagccaagcagaaggatggcatgaaaccagttacatattgttcagagtcctatttaacttactcttttctgcatcaaagccaccaaataaaaactgtttataaaacagttagaggaactctcttacagaagcagctggtgacagtggtcagttgctaggtgttgctagggcaacttagctgggagtctgattgtgaagtaattaagcagggtgtataaattacctcagctggttttccccagaataggcagttctctgcatgaaaggaggtgactaggttctcttttcttccaaagtcaaaaccagataggaaacctttgaagatgcataggaacatgtcatggtagggtggtgggctcctcttcagatcccacatagcagctggggccagccagggcgagatcaagggtgaatgtaggtagatgccagcaagggaagagcatgatcagagactatgagtgggctgggagtgagggcaggagccaggaggcaggaccagagctgacagaaaccagagaacaggcactaaagcaggaaaaatacccccacacgtgccacaggaggccatgccttgccagtatgaggactcaccagaatttacaatgagatggaatgaaggaactacacagggctaggaagggattctcaaattgtgattgcaacctgtctacccctattaacagcaacatttattgagtaaagtgtcaggccctgtaccaagatttaatttagatttaatgtaagattagatttagatttacattttaaaatctcatttagatttaatgtaatcctattaaggtaggagtattatctaccattttacagaggaagaactgaaggattcgttatttaacttgtccactgttaatcagataatcaacagtgatttctggaatcaaacccatttctgtctagctttaaaacagagacctttaaccaccctgctaatttgtagttattccacttatggaggtttccatgtccagcttgctttaaaagcaccaaaggacttttcacactgcatgccctggccagggttggtgagcttgttgaaggccttaccagcctcctgagaccctcacactcacttttcagtgtctctggagccttgccgtggaggtagtgttcgtcttggcctttgactacctgggagaaaaaataaattatttccataaatacagtgatcagagtcaaaagaagtcacagtgtgtattagttatctattgctgcacagtagatcaccccaaaatttagctgcttaaaactacaaacatttattatatcacacagtttctgagaatcaggaatgcaggagcagcttagctgggtggttctggctcaatgtctctcatgaggttgcagtcatgatgttggccatggtctcatctgaaagtgtgactggagctgaaggatctactttcaaaatggctcactcccatggctattggcaggcaggatgcctcggttcctctctataggactgtatgcatggcttcatgaaatggcaactgattttacccagagtgactgattggagagagaaattgagagattgagagagagagagagagagcgtgagagcgcaagacagcgcaatgcattttttgacctagagtctgaagttacacaccatcacttctgccatattctatttgttaagagtgagtcactaagtacaaggggagaagaattaatctgcacctctcgagtggaggcgtataaaaatatgggacatatttttgaaatcatcacacagcataacaaagacctgggtggaaaaaattatatggctaaatgcagagatgtggagtggacaaaagtccttttgagatggctgctggtgctaggcaacacatttgtgttctgaacacaggggagcatgtgcttgcacgagtctctgatgactgccaccatccagataacaatgattcattccattttctctttgtctggagaaaaatctcattctgggcaagccaagctgtttatggatctttttatctattcatccattcatatgggacccagggcatgataacagctattcaaactgtggaatgttaattagatggaaaaatgtacacatcagctatctccatttcaactgagaaatctggccgaggtacataatttgcttcaatgtcatctgtgtcaagattttgaaagggtggcaatatatcactgtgttagacaaaaggcatgggataaaaggggaaggaactattcatggcaacatgggtttcaggatattaataagtgcaaatatttgcttctctatggaagcattaaagctcgcttcttatttcttggttctcatgcccaacgttatttgctttttactactgacatcgaagcagaatattagcttatcttttgggtctgaaatgtagcttttatgacagggaagtgcgacaaacaaccttagtactgactagtccccctctgtcttggctgtgatttagggagtctatagtgaagagattgatagccaagtgtgatattaaatagactttgagagacagctcctaatggtgtccacttgggccctggctcttttcctctctgccttccttcccctctccttttcatggtagaatagctgaccccattgagtagatggatgtcatcggccttgacatcatgcaccttgatcctagggcagtctcagttgttcccttggaatatagctcagatacctctcacatggaagacgatatcaccaaggaagtcagaattgcttcctaagtagaagggtgatgcagactccttgcagaggagacaggatagctcccccaaacttctggtgacttatagcaagcaggacagtctcagaaagagcacactccatatgttagactctgtgtgctatgtgtattcttcctcacacattgggtggtgagtgggtagaatttaaactacatacttctctaggccacaaatatcccacaagagggagaatagacatattttttctcatttctccattctctcatgtaccccattagtaggggaagtaggggtttatcttgtgggagagaattagtctggaaggaaacttctccttgggttgtgagatgtctgattttagacatagtacaggaacatccactgcagcccagagggggaagacctgcctctgtttcttctacccacaggcatcacagaactagaacctaccctcttctcccagaggagtcagtggacactgtgtaaacttgacaagagaaggagccactgacccacattacctgcctctgatttctaaaagccagatggctagagataatagctatgaaattgccttcatgtagtgggctgttgatcaatatttgttgaataaatgaataaactccaaggtggtacaaaggtacagcagtatgattataggtatttatttcatagccataatcctcatgtcaaagcatgaaaggtctgggttctgtcagagaacaccatcatgttctcttcagtttacatttcaaagccagagaaaattattattttcctcctcctcctcctcctcctctttctccttctcctcctctttctcctccttctcctcttccttctcttttccttccctccttctctccctccctcccttcctccctccttccttccttcctaccttccttttcttcttccttctttcttcttcctcactactatgttaatgaggagaaaacttctttttaaagtttaaattttttacctaacaatacagctaaccagggaggtgaaagatctctacagggagaattgtgaaacactgctcaaagaaatcagaggtgacaaaaacaaatggaaaagctttccatgttcatggataggaagaatcaatatcattaaaatggccatactgcccaaagcaatttacagatttaatgctattcctatcaaaccaccaatgacattcttcacagaactagaaaaagatattttaaaattcatgtggaacaaaaagtgagcccaaatagccaaggcaatcctaagccaaaaccaaaaaccaaccaaccaaacaaacaacaaagctggaggcattacatgatctaacttgaaactatactacagggctatagtaatcaaaacaacatggtgcaggtacaaaaacagacacatagaccaacggaacagattacagagcccagaaataaggctgcacacctacgatcatctgatcttcaataaagatgacaaaaacaggtactggggaaaggactccctattcagtaactggtgctgggataactggctagccatatgcagaaggttgaaactggacccctttcttacactatatataaaaatcgactcaagatggattaaatacttaaatgtaaagccccaaactataaaaatcctggaagacaacctaggcaataccattgtggacccaggaatgggcaaagatttcatgacgaagactccaaaagcaatctcaacaaaagcaaaacttcaaaactgggatctaagtaaacttaagagcttcttcatggcaaaataaactatcaaaagagtaaatagacaacctacaaaatggaagaaaatatttgcaacctatgcatctggcaaaggcctaatatccagcatctataaggaacttaaacaaatttatgagaaaacaacaaaccacctcattaaaatgtaggcaaaggacatgaacagacacttttcaaaagaagatacacatgtggccaacaagcatatgaaaaaaaagctaagtatcactgataattagataaatgcaaataaaaattataatgaaataccatctcacaccagttagaatggctattattaaaaagtcaaaaaataacagatgctgatgaggttgcggagaaaagggaacatttatacactgcttgtgggtgtataagttagttcaactattgtaaaaagcagcatctcagttcctcaaagagctaaaaaacagaactaccatttgatccagcaattgcattatagggtatatacccaaaggaatataaatcattctaccacaaagacacatacattcatatgttcactgcagcactgttcacaatagcaaagacatggactcaatctaaatgaccatcaatgacagattggataaagaaaatgtggtacatatacaccatggaacactatgtggccataagaaagaacaagatcacgtcttttgcaagaacatggatggaactggaggccattttccttagcaaactaacacagaaaaccaaataccacatgttctcacttacaagtgggagctaaatgatgagaactcatggacacacagaagggaacaacagacacctgggtatacttgagggtagaggcagggaggaggaagaggatcagaaaaataggcatctattgggtactaggcttagtaactgggtgatgaaataatgtgtgcaacaaaccaccatgacatgaagttgtataacaaacctgcttatgtacctcagaacctaaaataaaagtaaaaaaaaaaagtttaaattttttgtcagaattatacatgcacatagtttaaagactaaatcagtcctaccaggtttacttaatacaaaaacagcccctagccacctcacctatttccccttccacggaagcaaccactttcaccttttctagttatattttgatccttaccaccttaccttcaacaatatatctgtattgatgcttcctgatttttcgtttgtttcaggcatcatgtattgacctctcactatggaaattgaggatttagctctgtttttttcctcttgtcccaccaaacacatgcacccttcccattttcccatcctctcaataacataattgtagttttggttagatcaatattcaatgtttaaaatattatggccatgtatgctgttcaggtctgagccattatagtaaataactttttggtttctctggacttaattgccttttgttcatgtgtatgttggctatttcatgtacttatcatcaatttggccccaaactctccaaagattgtctaaatttcctttcattcacatcagatatcctttcaattcatcttcttaaagtagttttttccatagctttctgaactgctggttggtttccctagttggtacgaagctattatcctgagacattctttcatcatcaatttagggattccctttgcctctctcccctgtggtactcttatttcttgtattctattcttcctcttttttggtttaacctcgaatttgggtggagcacatcctcagtagcttcttgagaaaggggaagtgggagatacattttttgagaccttgcctatctgaaaatttatgtttggactttcactcttgattgatagtttggctaagattttttagactacatatttgttatatacgacctatttttttttccctctggaaatgtgtagggtctttgtgttttgaaagttcacaatgatgtgctttggtttgggtatttttaattattttgcagggcactccctttcagtctggaaactcattgcctatacatctgggaagactttaattggtattagagggtcttctgtttctggaattcctattgtggagatattggagctactgaattggctctttaattatcttaccttatattcttccttttccatcagtctgggtagtttccttagctcctcagtccttctgttgagtttctcattttcactcttatatttttaatttcctagagcttctccttgttctttgaaggtcccactccccttttatagcatcctattcttgtttcatagatataatgtattcttttagttctgtgagcatattaaagttattttattttatttttttttagacggagtctagctctgtcacccagactgcagtgcagtggcgcaatctcggctcactgcaagctccgcctcccgggttcacgccattctcctgcctctgcccccggagtagctgggactgcaggcgcccgccaccacgcccggctattttttttgtatttttagtagagacggggtttcactgtgttagccaggatggtctcggacctcgtgatccgcccgtcttggcctcccaaagtgctgggattgcaggccgtgagccaccgcgcccggctaaagtaattttttaatgttttccttcttgtatggcctgtttcctccccactcccgccccctgtcccatttcttttggtttctgtccttcatgctggagactttcctaagctgcttggtaattcttagatatctactcatgcttaggagccggggactaaaaatctgtagaggatgtttatacaccggaaacttttctgtagggttatccagctatgccatttgctagggaaaaccccaatgtcaattttcaaaaaatcttttctcttgaaccagccagatacctttcatagaccctaccactctgctgcctggaaggcaaaggcctggttgctgatgttctaggagcccggtgcaggtagcaagatgagagtctcaacacttcatatgtgtatgttcacttaatttaatgtggtatcttggccttcaactggttctgttgttcttcagtccagacaccctttattttgtgctctacagagaataaacctcctgtattcttgagaatggggcagggtagtcacctgcgggcatagaggcacggaaagaagctctaattgcttcttaaataattcttgaccaatctaacttgttttaccttctccatcctcggatccagaggcatcagtgccgctcatctccatgcctattatattgtgttaattctcagctttctccactgtcgggttaagattgaccgtctacagctctaccaagtcagtgaccatttaaccaattgcttaccatttctccaaattttgttgttgtggtctcttctctatgttccctgtccttgttgttcttgtttcttatgaggtttctgaccctgggtagctagctcttgctctcctgtgactgctttccctcttcccaccactgcctgctctctcgtgtcatcacagtgaggtctggggcaggccatagcaccttcaacaacttggcacagggagttttacccaattgcagtgggactgtctatggaagtgatcaagagccattttgggtaccaaagccagctcagagattaaacagaggaaaaagagatgatttctgtcaacagattaagagaggccatctgggaggaagtggtgtgtgaaccaggtcctgagaagaccattcatgtttcagttcaattaaattcaaattcacgtgttctgtgaataagcaggcattggattgggataggaagttgctatagcatagggattttaaatagggagttccagataatgcctgcatttgaatcctgggtccttgattactgactgtaatttgtttagattctgtaattctcagtttcccagttgagaaaatgggggtaataatagtacctttctcaggggttattgggaagattaattaaatgcaagagtgcatataaactagtcaaggaactatagcatagtatatacagacagtggctcagtatgcagactgtgccagaacacctggatctgagtcctggctgtgacttagtagctctgagaacttgggcaggttacttaaactttctgtgcctcagtttatttatctgtacactggagataatgtattgtcaggattaaatgaggtaaggtgtagaaagaacttaatacaatgcctggtgcatagacgacaataatacttgttaaaaggagtgtaacatgttagtaggacaatccttgaaccagagtgcctgtataaatcccacatctgtcacaaccaggtgtcctgggttaagttccttgatatttctttgccttagtttcctcatctataaaataaatataatcgtacccactttgcagggttgttgtgaggataaaatgagttaatacatacatagcatgaagtgcctataagtgtttgctattactattgcaccagatttagttgtctttcttttcttttcttttttcctattctcttttccctttctctctctcttttcttttctttctttcccctctctctgttcccttcctcccttccttccttccttccctccctctttttttttttttttctgttccttgtggagcagggctaacccacaggcagtgtaccaagagtagctcagatttagttgtttttcttctatttgcttttttcctagtgtattccaccaagggaggattctttcacaagtgtacctcacaggtcatgtagcagggatgtcctgggaacatgaattgaacccaggactgcctgatttcacatctgatcacttaaacttatcacagaccgctctatcctgttgcagaaaaagtgaggagaaaaagcaacttctgccagggtatagacaatggccctgtaagagggtgtggttcagccaggagctgagtcactcataatctgctcttcctgcattaaaaggtggtatcaggaggagaccttggaggcacttctgccagagacaggggctgctggattctccaggaggtgatgggagaagaaagccaggctcttctgtgggtgtcatctgccaggccctggccctaacaggtgtgttgctcggagcccagactgatggcagtgaggacaggaggctgcagacatcactcagtggcctgataattggatatttctataatgacaaattacagctgtttctcttgtcatcagtgtgaaaacacttccgaggccgtgatttcccaggagggtctgtggttgttatccagttaagattatggaaatgctggcataggggacatgaagcatggccggatgaagctgtgtttctgcaccactggcttctgggtatttggccctaacgttgaatgcagagagagtatcaggctcctgtcataacactatcactgttaattctgcatgagtgtcatgttgagatgagctggccttgtagtttgttatttggcttcagcctctactgttttttaatttgaccaaaagacattgtcagatgtaaacatcagtggaaggtccagcttttctttgcttggaaaatgctggagaattcacagtgaagagtaatcttggaagcttgctctccagccactggcctgttacctgagcactgatgttcaaacaggggtaagaaagttcaaagtgtcggcttttctgctttgtcctccaggaagtcaaacatctgctgtcctccaaaactgaatcctcattgacagaaattctagaagataggctgaagccatccttgtcctagggcttgttggggctccgaagaagaaaaaaagcccttggatagaggcagtatcatgttcatttaacctttccaagtcttgatttccttatctgcaaaatggggttgttgtgaggattggtggatagtgcttgacacatggcatgggcttacatgtaagtgttagctatgaagaatatgtgtttcagagctctcagggtttgagcccttcttggcctgcgaatcccatggagatggagatgcaaacctctcacaggagccaagtcattctcccggtcttctgtgtttttctgggtagatcggccttcatgacctgtcctggtgtccctgctttccccagtctggctcagttgctcgcagagaggactgtctgcctgcaggatcagacccacacaggtgctgagctcgttcttactcaggtcatccattcatccaatagtcccaagcaccagtgccagacaccgggtacagagataaaaagagcaaggcctttgccctcaaggagctcacaatctggtgggagagatgggcatgaaaacagattatagccacatattgtgaaaactctgaggtggacatagagacaagaagaggccctgtggctgcaagaaccaacagcctaccaaatggcatgctcccctgtcaacagggtggagctggaaggctcctggactatacttcccagccctccttgcagccaggcatgaccttgtgactcattcccaccaatgggatatgggtgggagtgaggttaccactctggccagagatcttaagaagtgggtgtgcctcttccagtccctcttacccctttcattagctggatgtagacgaccctgagaccctacgggttatggagccaaaagacgcatctctaattcccgcatgagggaaagctgcttgccaacaagggatgcctactttagactatcacagaatgacaaacctctattgcatcaaaccactgaaatttaggaactttttatctaagattatcctaatggacacaaatgtctaatccaacgggtggcttcagggaaggattccaggaggaagcgacaccggggtcttagctgcttactgggtccaggagctggcaagcaatgcgtgggggtagtgatagtgtcgagatgaggggtgggtggagggaggtgggagaagctgggaggatattttaggcaaatgaacaagtgaagcatggtgtgtgtgtgtgtgtgtgtgtgtgtgaaggagtggtctgtgtgtgtgtgcacctgtgtgtgtggtatgggtgacaacaggaaagttagtattcctggagtgtcaagggtgggggcaggagatagtaaataaagctgcaggaatttgtaggggaacctgtaggaccttgtgtgccaaggagttttaatgactcctgtagataataggagaagcccaatggaatggcttaaaatggacaatgtgatcagattgtgatttataatgactgctttgctggaagtgtgatgaatggattagataaggtgagtctagagctagggagaccagagggcagttatgaggtgagctgaagcctcgtccaggagaggcacaacggaggcacggctgggcagtggcagaaagggcaggaagactgagtggttgattggattggtggggtgcagagacagaagcattaaagatgatgcctgggtttgtaaagccatatatgatttttactcatacaagtgaataggaaaggaaaaggcaattaagttttctgtgaaaggaggtgggcatggtggcgtgtgcatgtagtcccagctactcaggaggctgaagtgggaggatcacttgagcgactccagcctgggcaacacaatgagaccctcatatctaaaataataataattaataataataataataattcaggattaggagaacttgctttaattttatttttaaaagctctccctatgtagcacatcctagctgccaaacaattttctaagccctttacatatattaactcatgaattttaacaataaatccttgagtatcatgggtacaatgactagcctcattttacagatgaggaaattgagtcgcaaaaggttaaacactttgccagctaataagtggcaaagtaaagatttggagccagggagtctgtttcctggttcatgctcctgaacaccatgctctgtttcttgtttcacatatggtacagtgtcccagttagcatccttcttgaacccaagggcccatgtggaatttggacactgatgccagcctggactgaacctgaatattcagtgaccccatctggacattgagatctgaattctggattttcccattcaagaatctgttctccaggcagactacaggcccgactccagacctgcactttctgagcttcctccatcacccctcctcagccccgtcccattgctgagacccagcatgacttgcagcctggtgctcacagctgtgacacctttggggcccccatacccccaaacactagggcacttgcccaaagccacaaagtcagcaagtagttaggtttggattcaaactgaagtctgtctccaaaaccacatcctttcaactattccctgtggcttcccccattctccccaaaggtctacatttaatcctcaggactccaagatcaagcccagggcagttccacttctccttggcaatatagagtaagaccaagaatgccaagtctccatccttggggatattctcatcctccaggaaagaagtagaagggaagcagtgcccaggctggctgtccgggtaagcccagcaagctgagctgcagctcatggactttggctaatttgttattaattccttaggagcacagaacaaccctaacaagatgcaaaaatcagtagctgagggaaagacaaagcagctttctgagcacaatgtgagggaggaaagtggtttttaaaagatgttgacaaactatttgctgtgcagactataaagtggagaataaatgactttgttgcactgattcagattttttttcctaagttgaaaagaggagagtagtaatgggctggggtaaggggcctgggtggccttgcaatgccaagataattattgtttagttagaagactgatgattttgttgttgttgttgttgttttgttttgtttgtttttttgttttttgttctgtttctttttttttttacttttcagaggcagaaagagcaattggggctgaaatgggtttctaagtgatggagagagataaacatctgttagcagttagcagtaatggcatcggctcgaaaaaaaatcctctacaacctggaacccagggccttccttcctgactcctttgtgcccagcaatgaggagaaaggctgagcacaaggacagagtgaaccctgtagagcaggggtccccaacccctggctgcagactaggaagagtcagtggtggcctgttaggaaccagctacacagcaggaggtgagcagtgggtgagtgagcattaccacctgagctctgcctcttgttagatcagctgcggcatgagattctcaggagcgcgaacctgttgtgaactgtacatgcgagggatctaggttgcatgctccttatgagaatctaatgtctgatgatctgaggtagaatagtttcatcccaaaaccttcccccacccccctcccatctgtggaaaaattgtcttccacgaaaacagtccctggttccaaaaaggttggggactgctgctgtagagggatggggtggggcaggagatccctgggtgtatggcctttgtgaggaccacagtgcaagcctgtgtctaggctgccaagttcaatgccaagacacatggtagccattcctgagacagcactatagcccccaactagaggaagaagttgggctggtgtcacttccctgaagtttcttccagaagcccagctaaatcaaagaggttgccagtggctgggagtctgggggccgtggagcaagtttaaatagcctactgggccctttgcaatcagtgcagccatcccccttcatccctctggcctcatttcatgtcattattccctttcacaccctgctagacacctgactttcttgctgtttttctaacatggtggggatcctctgctctgaggctttgctgtatttcctttgccctcattttccctttcccagagaattcgatggcttgaaatctcacctctttcaagtcttcaccactcaaacacaccacctcaatgtagcctgccctaatcaccctttttaaaatgcaaactaatccctgttctacttttttcttttttctatagcacctagatctttctgaaaaagttaaattatttgtttatttgttacatatttattatttttattgtgtgtcttccctcctctagaatgtaagctctgttagggtaagagttgttgtctgttttgttcactgatagattcccaccttttggaaaagggctgggacgtaaaaggctcttgataaatgttggctgaatgaattaatgaggcaggaccagtcttcagaggtcaaacattccaatgtgcttcttcacagttgggatgacagtgtgggtgacaacaggtaggttatcacccccactctaaatctgtctcccaactcctgttgtcacccacactgtctgttagaaaaccttgaaaaccatttgctctgcagcctataaagtggagaataaatgactttgttgaactgattcttttgttttccctaagttgaaaagaggagagagataatgggctagggtaaggggcctggttggccttgtaatgccacgatagttattgttcagttaggagcctagtaattaaaaaattttttttattttattttttagaggcacagagaacaattggggctgaaatgggtttccaagtgatggagagagataaatgtcaattagcagtaatggcacactttccgttacagtgtgggtgacaacaggcagttgggagaccgagattcagattgggggtgtgacttgcccagggagtgccagagctgggactggataccatgtctttgaactgcaaccagtgttctttgttcatgctatgatttgacagagggcagagatagcttcacctgtgtctgctgtatgcccctcacagctgtacctaggcctcctcattccctctttacctgcctaccagcccagtaaactgctggttccctttctcctgttcccccttcttctcttcactgtcctcccattcctcttggtcttcaggtctcagctttattattactgcctctgggatggtcttcctgatgatccagactagacctgaccctgttcgctcttcccaaagccctctgcatgtcctgatccttacacccaggaaacacactgaaatcacctggctcattggaacagagggagtgtcctgttgtctgtatttgccttgcccggggcatctgggcatacacagccactgggatttggttgggttggtatcttcagggatggagcgggaaaggggtactaggtgccctgtggtcttcaggatgagctaagtcatggttcacaggggagaggtgaggctgtgatgccagtgagtccttgcacaggcaaagtctccagggttggagaattgcaggggacgggggtggcagatactgagttcagaaagggagcaagttcgtgataagaaaggctagttatgggctaaaacagccactgtgggccggcggggagctggtgtaggggtgagtagcctgcatcactgaaagagagtgaagtgtctactccaccatcctgcaaccagtccaaggcacaggcttcatacccctgcagcttctgcctctgagttttctggtacctgggccaatcaagtagctctgttctcccatcttcactccatcatgtccgcactgggtgctgatgtccagcagtgggaggtttgtgtgtgtgtatgcatgcatgtgtgtgaggtgcttcagagtatgacgaattaagagaaatgtaagccaagacaggagatggggctgctggtatttgatgtcccacttttacctgatagcaagttggtgtttgtttctgagcccaggctctgagctttgcttcttcacagccaagcagggagagcaatggacgaggagacaagacatgggagaccttgtctttggtctgcctctcaccaagtgataagggagtttaaagtgtaaagacaggctcccacacattagcaaaaagaggttctctctctttcatcttggggcaggaggaaaaggggacctgcttcctgagtctgtacctgctgagtattatggtggccactgtacacactgactatgcccttgcaatttagttagtctttcttaagtatcaaaagtcaccttttattcaagaatttgtatatacaccaaaaagattagcaaagaagtaagcttatcatatttcacttactcaacagttaatctagttgtaattgtatttaacatcagccataaacaatatgaggcaccatttcagaacgggcggtgtgctgactgacaaccctgccttcctggggtagcactgacctcaagacagaagcaacttaatcaccattcagttccctgccatctgctttgtcctgattctgcatattctgctgaatcatttctgcttcccatgttggcccacaacctgtacagccccacgctggtcatttccttgttcagagtgaacacttcactctccccaaactctcaggcattcctgctttaggggatcaaaatttagtcttcaagttaatggagttttcattcgtgtgtttctagctatttctaatcctatgtgctactgcacagattgatgtaatggagaaagattgaaggtatgctgttctcttatatgaaatgacaatggctactataaaacacaatgtcagctcagttctcacttgggctcccagagccaagcccaataggccaggcaccaggatcgacagtggtcagtttccagacctcacttcatcttactgttttgccagggtgcaattctggcaaattcctattcctccagggcctgagtggatgggagggctaatattatgagtcaacttgactgggccgcatggtgctcagatatttggttaaacattatttctgggtgtgtctgtgagatgtttctggatgaggttaacatttgatttggaagactgagtaaagcagattgccctccccagtgtgggtgagcctcatgcaatctattgaaggcctaaagaggaaaaaaggctgagtaagaaagaattctttctctccctctgactgtctttgagctgggacatcagtcttctgcctttggacttggactcagacggatttataccattggctcttctagttctcaggcctttgcactcagactggaactacaccattggctcttctaggtctttatcttgctggctacagatcttggacctcccagcctccacacttgtgtgagctaattcctgatagtaaatctctttattatttatctatatatctgtatctatctacctattctattggtactgcttctctggagaacccagactaatacagtagggcaaagtcaattgggcagggctgggcaggcagacactccaatttgtgtctctcctcctttagacatacagaccaaaggtgggtattgatcagagggtcctctgatattgatctagcttgatcattttattttttatataatgttttattcttatgtcattttactttatgggcttggttatttttgcaaccgacctcctgcctggctctctgcagtttttctggatcacagctctagtccccaggaggtcctctgtctagggggcgctggcaggaaaaggagcatatgtcagggggctggggaagctggcagaaacctttgtctgtttaatgttttattagagtccatgtagcaacgtatataaacaagtcccatggtgagagaattcagaataaattactgcctgcaatttcccgtttggcattgatcttgtagattggagactcaagatggaaactgcctggtattattatcccaacttccatgttggagggcctacaaattcctcatgaatcctatgatgtcagaaccacatgaagccttagagaccagacagtctaaccccacataatattgatcaggctcagagacccagaaaggcctgagatcgcacggcaaagagaggtgcataatcttggctgtgatattagctcagctttagcaccccgagggacagatttttaataggtatgaaagattattttaaggcagccaaagtctgttattacttattgagggtctcagagcaattggcctgcattttccctccctgttgtttcttaatgtgtgtttatggcccagccttggcttggcttttttttttttgggtggagtctcgccctgtcacccaggctggagtgcagtggcatgatctcagctcactgcaacctccgcctcccgggttcaagcaattctcctgcctcagcctcctgagtagctgggatcacaggcacgtgccaccatgcccagctaattttttttttgtgtgtgtcttcagtagagacggggtttcaccatgttagccaggctggtctcgaactcctgacttcgtgatccgcctgcctcagcctcccaaagtgctgggattacaggcatgaaccaccatgcctggccagtcttggcattttgaattctgattcttttggcagtcaaaggcagctctgtgctgctgagggctgttaaggaagcagaaagtgcccagggctcaggcaagccaatttcccagtgggaccttcagttttatcccctattttataggcaagataatccctgacctgcctctgtcccacagtaacagagctaatgcaaaaaatctctgtaaatggaaagatctcttttgcaacaacaaagccaggacctgatagaatttaatgctgaaaggagaaacttctctctaaggtgacaactcacctcttgaaactgtttcccaaaatctcaccacccccaggctcctcatttctgccaacaccccagcaggagaaagaaattgtcctttaacaagctggctaagtgaatctcatgctgccctaaactgtgtgtgctccagtgtctatacatttccttttcactctattgcaagttctttgcatgttctatagagttgttttagttatctactgctgtgtaacaaatcaccccaaaacttaatggctttaaataacaataattattttttccttctcatagtttgtttgggacagaaattctggagcagcgtggctgggtggttctggctcagggtctctcattagcttgcctccaatgtcagccagggctgcagtcatctgaagccttgactggggctgagagaggaggatctactctcaaggtggatcactcactggcaggtgagttagtgctggtcattggagggggcctcagttactctccatagggcaccatggatgtttcacatcatggcagctggcttcctttggagcaagaggtctgagggtccaaggcagaagctgcaaggccttttatgacccagcctcatttcttctgtatcgtgttggtcactcagggctagctgtgattcagtgtgggaggggattacgtgagggcaaggataccaggaggcacagatcataggaggctggctacttccgtctacctctgactcctgatgattcatagctttcccattgaacatacacttgtcccttcccaaggcccacaaaagtctcatcatattatagtatcagtttgaactccaaggtcttgtcatttaattgggtccaggttcaaatgaggctccttgggtaaatttctcaaatatagtacctcctgcacagttcctcttgatctatagacccatgaaaaaagaaacatattatcttccctctacctaatatataatcgtagggcaggcataggataagcattatagatcatcctgtaaaaaggaagaagaaaggaaaatgggaggtacactggggcctcagcaattctgaaattctgctgggaatatgggcaatttcttggttagaactcagtcctactgtctgagaatggttctctatggctcttggctccaatctctgggctcagaggcagaaactgagtcatcttctcttttccataaaaaacagccagtgtttgcagctaagtagttttctcagcctactttcttatagtggtttaaaggtccaaagacctattttcttttctttcttttttttttttctgagatggagttttgctcttgtcgtccaggctggagtataatggcgcgatctcggctcactgcaacctccacctcctgcaaagacccattttcattgtatatggtcactgtcccttttaatccatgcagacaatatttcacacaatgtaataaccttataatctatgaataagactctataaatcctgttggcattcactccattagttaaaagtcacaaccacaagtatcagtgtgataggctactttgcatcttgagtttcctgtaaggctgctatgggataccacaattaagattaccagaagccctattgtttatgggtgaggggcctctttttttccctgtttgaagcaccaccttacatatttctgaggtcttaataaagggctttgcattcactctgtcagtttcatctttagatcatttttcctgccaggacactgaatttgatctttgcctggaggacattttaaaatttcagtatcatttcctatctggagaatttagcaataagacatttttatttttaaactcagcaagtcctggcccctttatgttcaatggttctttctttaacacatcttctcacttttcacattttattataagcaaccagaagccaggtggcaccttcaacactctgcctggaaatctcctttgctagatcatccaattcattaggtacattttctactttccattttactgtagaagatagtattgctgagttttccctcactgtatactatggattgaacatttatgtcctctcacatattcatgtggtgaaggcctaaccctaatgtgactgtatttggagacagagtcagtgaggaggtgataaaggttaaatgaggtcactaagggttgggcactaattccatcaggccagggcccttaaagaagaggaagagggctgggtaccatggctcacacctgtaatcccagcactttagggagctgaggcaggcagatcacttgagctcaggagttcaagaccagcttgggcaacatggtaaaaccctgtctctacaaatacaaaaaattagctgggtgtggtggtgtgtgcctgtagtcccagctacttgggagctgaggtgggagaatcacttgagcttgggaggtggaggttgcagtgggacaagattgtgccactgcactccagcctgggcaacagagcaagaccatgtctcaaaaaaaaaaaaaaaaaaaaaaaaaagaagagaaagagacatctgagctcttgctcttccaggtgaagacacaacagtaagacagccatctgcaagccaggaagagagccctcacaaggaatcaaatcagccagaaccttgatcttggacttcccagcctccagaactgtgaaaaataaaataaattttgttgtttaagctacgcagttgatggcattttgttgtggcagttcaagcagactgatagaccatattataaagattccctttgctctattttctaatatcatctttcttactttccattaagcactcatggatagccttcttgcagtgctggttgtaatcccaaaagacacaattccaagtgctgtatatctgaatgttgaaatactaaaagatcaaaatccataaagatcaaaatccccaaagtctaaaatcttataaatcacaatcctgaaagattaaaatctagagtgttgaaatcctgaaagccaaattttgggggaggaattactgtgtttttgattgtacacaggatggttgcgtcatgttaggtggaactattaccttgttattgtctttatttaaggagataaaaggaggtatgtgtgcgtgccaagctggcaaggggtggagttgtggacttaatttgaggtgtcatcttgactggaataaggaatacctacaaacttggtgaagcattattttgggtgtgtctgtgatggtgtttccagagattagtgtgtgagtctgggtggactagctggggaagatctgccctcaatactggtgagcaccatttaatcatctgggggcccagaaagaacaaatgcagaaggtgaatttgtctctctctgagagctgggagaggttttacttctgctgccttggatatcagaactccaggctcaccagcctttggactccaggacttaacaccaggttttacccaggtcccgaggcttttggcctcagttggagactaacacagctggctgccctgattctcaatgtagaaacacggaaaattcctcaataaatgatgatatgtcttttttgtacatctgcattgttaaaaataaaatctcttgaaatctcggctctttgggcaactgcatatgcagtggtgacccataattgtttttgaaggatcttatcaaaagacgtaagttgtccatcacagtatttcagacgactgcagttataaagctgggtgcacacaactaccaactatagtgacaggtgtttgtacatttcactttttgacctatttctttatgaatatggttaatctgctcataactgctatacccttgtgactgtccctagaatacatgagcacttatgcttacaaaaatatgtaggttattgttgcctattttatcatacaaagtggcctatgaagtgctctgtcatttttaaatatgtttcccaaataaaaccccttttaaaatgtaaatcaatgtcttttaaatactttttaaaattattttttctggaattatatttttgggattttaatctttcaggattttaatgttcagaattatggcatttgggattttgtctttcaagattatggctccaacccacctccctgaagccatcagatgccattgtctcttcaaagtccttccaacttctgtcctcaaagacactgctccatttttagtttttgttgttgcatcatcaccttccttccgggtaccaacatctatatcagttatctgttgctgctaacaaatcacctcaaaacttactggctagaagcaataataatcatttattatctctcatgatttttatgggtcaggaatacaggaccagcttggctgagtggttctggctcagggtctctcatgaagctgcagtcagatggtgtctagcaccattgaaaatgtttcttgactcatgtatccagttcccgggctaagaagccttgaacagctaagggctagaatagccagggcttctcaggcatctttatgtagcctctccatgtaatttctgcagcatgggaagaagggctcccaaggcatgtgtttcaagagagagccagatagaagtcatatgcttttcatgacctgtctcagaagtcacatagcatcacatctgccacactctattggtgagagtagtcacaagcccagcccggatacaacgggagggaacatagactccatctcttggtgggggaaatgaaatatgtcatagcgcatgcacacacacacacacacacacacacacacacacacacacagcctcattccttggtatccatggggaattggttccttccttagacaccaaaatccaaagatgctcaagtccctgatataaaatgatgtagaatttatagactttccatataacacagacatcctcccatgtactttaaatagtctctgattacctgtaatacctaatataatataaatgctatataaatagttgttattccatattgtttaggaaataatgacaagaaaagatatgtggaacctatagatatggagggctaagtatctatatatagtcatttttgggagatgtaatctgaaataaacactcagcacccagcatctagcgggtctttgatgattacttgttgctcgtttgttgttttactgactttgtggcttaataataatgaaagtggtagtaaaaatagtaatgataaaataactacaacaactattcactaagctcttattactctgtgaaggacttgttttaaaatttcccttttgattgaagtgtaacttgttgcaataaagctcacaaaacttaagtgtgtatctcaattaatttttatgtatgtttaaaaacatgtaaccaaagctagagccagacataggacatttgcaataccccataaggttcctgtacacctcctcactgccaacctcccttcctcctcccaggtaaacacttttctcatttctctccccatagactagtttgcctgttcttgaacttcatataaatgaatcatagtatatgaactctttttgtctggctcctctactgtgcaaagtactttatgttcattatctcacttaattcctgcgacaaccttacgagataatcaacaattcacgtgctggctatatgctgcccaagtgcatttcgtttagtctgcccaatatttttaaatgtttgagtctgactacttttaggattagaattgaatgcagtctctagtacttgttatattatagccaggcaatgttatttaccttactttcctggtacctacaggcattgggtttacatactttaaggggagcattattattgtctctagcacctgaaaaaatagttgttcaccaggggtgaaccacttgcataaaacctcatatcacagaaatggcagaagtgggatttgaactcaggtctgtcttcctaccgcactcctaagttgggatcagaaaagacaaatttgtccccaaattctatcgctttgaagtctgaatgcctttgtctgcacatcctcctctgcaacttcacacctctgcttagcccaggggcagtgcaggggctgttgcagccagcctcaccctgactccaggccagcctctgatgctcaccaaaacacctctgaactcccatctgatcctgccagtcccaaacacattcctcgtttcttgcttctgtatctttgctcacactgttttttcccgcctggcatgcccaaccctacttagtcatccttcaacgctcaactgaaaatgctactttctacttgttgctcccacatgccctggccaaacacttctttttcttctcaggacacaaagactcagtttttgaaatctgtacgtcaattaccaaatgatatatcaaattaaccccaagtgacttttacgaatgtaaccaaagtatcagtcccataaaaggctatttcatttatttaatctctgctaaatgtatcactactttttaattgattcttaaggaagagagatgagaagaatctgtactacccccactgggttccaaatgaacaagcagtcagaagtttattacttccagataccccacttactttctagatatcctatagggtttcaattccatcacagcaatgcttactgagcatccctgggcttgatcatatagcttgggtgtctgggaacaaaaagatgaggctgcatctctgggctaggatgggttggagtctggttgagggtgcctgtggagacaatggcagggtggagtggcagctggtttgcgggtatctggggatgctattagagttcagggttgttgactccagccctatctcttctattttcggatcttgggatagttattaacttctctgggcttcagtttccttatttgaaaaatgcatattccaggtaactttatgagtttttggacctcgggcaaatataattggatttttcttatcatccatgctttgaaaattggctcagaagtttgagatgcaaaattatattttcttatagcagtattcagataataaaagtaatagatgttatcttctattggacatttactatgtgccaaccctgtgccaggcaggcttattatatgcattatctcatttattctcactacgaccacggtcatcaccacttgacagaggaggagaaagctcaaagaggcactgatttgcttgatgtcacatggttggtgagctactaagttttttttttttgagataggttcttactctttcacctaggctggagtgcagtggtgtgatcatggctcactatagcgtcaaactcccaggttcaagggctcctgccacctcagccgcccaagtagctggggctagaggtacataccaccaggcccagctaatttttgtacttttttttttttatagagactgggtttcactatgttgaccaggctggtcttgaactcctgggctcaagcgatctgcccaccttggtctcccaaagtgctggaattagaggtgggagccactgctcctggtcaagttactgacatttgactgagcaaatgattggtaaaataatgggtgtcatatctatttcctgtttctgctcagcatctcccccttgctcctttgcctgttgatagcaaatctagcctatttgatcaaaggcaaagtcaatcatagtgctccatgctgctgacctcgggcttggcccaggagggtgcacatggtataaactaggcaaattagagtccttcctgggatctttcagattaaagcccgagggagagtgctcctcttgcttggatcatggcttcaggggaggggctatagatggtcatgttgtctcttacgatttagggaaaagagcagaggtggagtgagagtgagagagagagagagagagagagagagagagagagagagagtcaatcctgagtaatggtgtccctggttcagctcctgtgctggcccctggaatatgctgcagacactgtcctttgaaattgtaggagtcagctagggctgccataataacaaaatatcacaggctggtgtcttaaacaacagaaatgtattttctcacaattctggagactggaaagcctaagatccgggtgccagcatggttgatttctggtgagggctctcttcctggcttgcagacaactaccttctctctgtgtgcccacatggtggagagagagggctctgatgtcttttctgccccatataaggacaccagctttcttggattagggcgccaatctcatgactttatttaatctttactacttcacagaccccatcttcaaatcgagtcacggtaggggttagggcttcaacgtatgacttggggtggggtggtggaggacagaaactttcagtctgtaacgggatgaagggctatttacttcaagctgctgggagctgctggcaggaagccctgagctgcccgtctcctatggtaactcagctgaggagagctgccttgtctaaggtcacaccctcctttatggtgtggggtatacagacctggcattcctgcctcaactcagggcagccaaccaacatggggagatgaaaacttggcaccatcaccccagcttcagaactcccctggggtaggtggggactctgctgagtgatgcaatttcacacctcaagtcctcccttcgcctaaccctgcttccttcctttctgcaggctctccttaatgagctaacgtcctccacaggaatgttcgtctgcggggttgcttcctgggaaccagcctgtcccggggttcctgaagctgctctgcttcttcatcgtccccttcagttctctgagccactccagcaatatattctcattttttgttagacgtcttttgagtttaaattttgtcacttctaaacacttctgaaagattcctgatgacttcagtgaggaaactgctgcctctctcactctagcagggcccactgaagagggctagtgggatctgggagtgatgggtgaggaagacagtgccatgagtagatggcctggtggcagcagtaccagtgggagtcaagctgctgcccagtacatgggattgaactgcccagtgcatggggtagagctgcccggtgcatggggttgagctgcccagtgcatggggtagagcttcccagtgcatgaggtagagcttcccggtgcatggaggagagcttcccagtgcttggggtagagcttcccagtgcttggggtagagcttcccagtgcatggagtagagcttcctagtgcatgggggtagagcttcccggtgcatggggtagagcttcccagtgcttggggtagagtttcccagtgcatggagtagagctttccggtgcatgaggtagagcttcccggtgcatggagtagagcttcccggtgcttggggtagagtttcctggtgcatggtgtagagcttcccagtgcatggggtagagcttcccagtgcatggggtagagcttcccagtacgtgtggtagagcttcccggtgcatggggtagagcttcccagtgcttggggtagagtttcccagtgcttggggtagagtttcccagtgcatggagtagagcttcccagtgcatgaggtagagcttcccggtgcatggagtagagcttcccggtgcttggggtagagtttcccggtgcatggagtagagcttcccagtgcatggggtagagcttcccagtacatgtggtagagcttcctggtgcgtggggtagagctggctggtgcatagggtagagcctcctggtgtatggggtagagcttcctagtgcatgggatagagctgcccagtgcatggggtagagcttcccggtgcatggggtagagctgcccagtgcatggggtagagctggctggtgcatagggtagagcctcccggtgtatggggtagagcttcctagtgcatgggatagagctgcccagtgcatggggtagagcttcccggtgcatggggtagagctgcccagtgcatggggtagagcttcccagtacatggggttgagctgcccagtgcacagggttgagctgcccagtgcacagggctgagctgcctagcatgtggagtctcagttgctagtttctatgaacagcacttgtctgaagctctgtgccgccgagtccaacctgccccatcttctacttctctctcttcatacctcaccttgcccctcctttggctctgggatacttccttgtctttgcctttcttctccctctttttcagcctcgcatttacctacccctcacttacatgtcagtattctccagattctgcttacagacctcttctcttcttctatttattctctctgattgaatttcccagtgacttcgatgccactttttgctaatactcccaattctgtatctctagcctacatcttccctgaattcctaagctatacatctttgctgctgggagtttccacctggaattgaatagtgttgtgggttgtatcattttccccaaaatatgttgcagtctacctctcagtacctcagaatgtgacttcattcagaaatagggtctttacagaagcaatcaaattataaaaagattattaaggtgcacccaatccaatatgtcgggtattcttataaaaaaggggaaatttgaacacagacacagacacacacacacacagacacacgcatgcatcatggaatatgaaagcagagattggatggtgtggcagggtccaaggaatgccaaaaattgtcagcaaaccaccagaagctaggagagaggtctggaacagatttcccctcacagcactcaaccagccctgacaacactgtgatctgggacttccagcccccagaactgagataacacatttctgttatctctgttatttcgcctatagaaaagtaaaatggtactgttagtttattgtttgtgaagatgctgtttaacctgatagtggaaaaatagttactaatgtttacctgtgtataatgtacacatttgtatcagtcaggaaaactgcttaaggcattacatgcaggaagaaagtaatacagaaaacttgatgtttagaacatatttgaaagagctggaagagtgaagatcaggaaaaactgctgatggcctcagaaaatcaaaaagttgctaaaaaaactctccaccaatgatttcagctgcctgaagtactgatgtgggtgattcctaggaggacctatggaaaccacttgtaaaatcttctgccctccaatgtctgagtactaataatggctggttcctcttccaccttccaaatctcatgagaatgcttcttactggtggaataaaaatcagaaccctgctggcagaggaatctgggaaaatgtagtctttggtttccagctcctggtgacactagaagagctaaaaagagctggcatcgttctgagtgctaatagtcagtacacagcacaaaatgcctttggaggttttaaggggataacatttatgaattttctttgaaaagtaaactgtgccatgcaaatacaagatgttttatagatggagagggtttataatcttagaacattttaataaaacaattcattatttatgagtaaaaaatccagacactggcacactccagagctattgcaggttcagttccagaccactgcaataaagtggatattttgataaaatgagtcacacaatgttttttggtttcctcgtgcatataaaaattatgtttacactatactgtagtctattaagtatgcaacagcattaggtctaaaaagcagtgtatgtaccttaatttaaaaatacctttttagccaggtatggtggtatgtgcctgtagttccagttactcaggaggctgaggcaggaggattccctgagcccaggaattccaggctgtagcgagccatgatcatgccactgcactccagcctgagtgacagagaaaggctgtgtcaaacaacaacaacaaaaacacctcctcccccaaaaaaactacgaaaaacctcccccaaaatacaaacaaatgaaaaacattttttgctaaaacatgctatcacctgagcctcccagttagttttagtctttttgctggtggtgggggtgtcttgacttggtgttgatatctgttgactaatcagggtggtggttgctgaaagctggggtaactgtggcagtttcttgaactcagacaacactgaaagatttctctgtagcatgtgatgctgtttgatagcattttacccacagtagaacttgtttcaaaattggagtcaattctcccaaaccctgctgctgctttatcaactaagcttatgtaatattctaaatccttttttgtcatttcaacaatgttcaccaggagtaacttccatctcgaaagacctctttctttgctcatccacagggagcaactagttatccattcaagttttaagttttattatgagattgcagcaatttggtcacatctacaggctccacttccaattctagttcttttgctctttctactgcctgtgcagttccttcctccactgaagtcttgaatgccacagagtcatccctgaaggttggagtcagctccttccaaactctttgtaatgttgatattttggcttcctcccatgaatcataaatgttcttaatggcatctagaatggtgaatcctttccagaaggttttccattgactttgcccagctccatgagagaaatcattatgtatggcagctatagccttatgaaatgtgtttcttaaattataagacttgaaagtcaaaattgctccttgagtccgggcgtggtggctcacgcctgtaatctcagcactttgggagcctgaggcaggtaaatcacctgaggtcaggagtttgagatcagcctggccaacctggtgaaaccccatctctactaaaaatacaaaaaaattagctgggcatggtggcagacgtggaggttgcagtgagccgaaatcatgccattgcactccagcctgggcaacaagagcaaaactctgtctcaaaaaaaaaaaaaaaatactccttgatccatgggctgcagaatgaatgtgttagcaggcatgaaaacaacattcatctttttctttttgtacatctccctcagagttcttgggtagtcaggtgtgttgtcaatgagcaggaatattttcaaagggatcttttcttctatgtagcaggtctcaacagtgggcttaaaatattcagtaaatcatgccataaatagatgtgctgtcatcaggctctgtttttccatttatagagcacaggcagagtagattcagcgtaactttgtttttcatgaatgatttcttttttctttttttttattgacacgatacttgtacatatttacaggatacagagtgaaattttgataaatgcatacaatgtgtaatgaccaaatcagtgtaattagcttatccactacctcaaacatttatcatttctttgtgttgttcaaaatcctctcttctagcttttgataacttattgttaaccatatttacgctgcagtgctatagacactagaactccttctatctagctgtaatttcatatccattaaccagtctctctatatcctcccttcttccctgttcttcccagcctctaataaacagagttctactttttacgtctatgaggatttagcataattcccaagggcattaggattttcagaatggtgaatgaactttgtcttcaacttaaagttaacagctgcattagtccctaataagagagttggcctgtcctttgaagctttgaagccaggcattgactttctctagccatgaaagtcctagatggcatcttttcccatctgttgaatctacattgaaaatctgttgtttagctagatcttctggatagcttgcttcatctttgccatcagcacttgctgcttcactttgcacttttatgttatggagatggcctctttccttaaacctcaagagccatgtgaagctagctctgctagcttcaaacttttcttctgtagcttcctcacttctctcagccttcatagaattgaagagagttagggctttgctctggatttggctttggcttaagggtatgttgtggctggtttgatgttctatccagaccactcaaacttttctatatcagcaataaggctttctcatcatttgtgtgttcactggagtagcgctttcaattttctttaacaatatatcctttgtatttacaacttggctacttgtttggcagaagaggcccagctttcagcctatcccagatttcaacatgccttcctcactaagcttaatcatttctagcttttgatttaaagtgagagacatgcaactcttcttttcacttgaacacatagagtccattgtaggattactaattggcctaatatcaatattgttgtgttttagggaataggaaggaccaaggagagggagagagacaagaaaacagttggttagtggagtagtcagaaccgacatgacatttaccaattaagttcgtcatcttatatgggcatggttcatagtgtccccaaacaattacaataacattgaagatcactgatcacagatcaccataacagacataatcataatgaaaatatttgaaatattacaagaattacccaaatgtggcacagagacatgaagtgaacacatgctgttggagaaatggcaccaatagacttgccacagacctttgatttgtaaaaacacaatatatgccaagtacatgaaagcaaagcccaataaaataaagtatataattattttttataattggcactaaactatttttgtgttcattttctgaataattatttcaaaactctggttttaagtgagtgaatatgtttatgcacatctgtcaatgagttcccattcgtcctgtgatgagtttgtatgtgcaattttatgccttctctgtgtttgtatgtgagtctatgggtgaggaggcctctgtctgtgtgtatgcatgtagccctgggcttaggctggggagtgtgctcaaaaatcgattctattagcaaatctgtcctagctattcctgcagcaccttcagaatccagaccagaccccttcacctccctcctgcttcctcttgttctctttctcctacatccagttctatatcccaaacatctatgtccttctagaatgacctctgcatccactgcctctcctcttgtgcaggcttcatcatctctctcttgggtgattgcaacagcctcttccctatcacttttcctcccacctccaaacctgctcttttatttctgagaaaagtcatctttcctgtgtataaactgaatgcctattttattaattgccattgctcactggatgtagaaattagtccagaagtcaaatggcttcaactagaatccccattattacattactacagtgaacagaaacttgcaattcaagcctcattattagattagctgccagttgaggagggttatgccaacctgatttgagtcttgacaaagtgatttgagccttagttgcaggaggtgaggcatcaagacttcaaatctggtcttgtccctgttcactatcctggtggtagcccctacgggaaggcactgaacactctggatggcaaggtggcccttcagtagctggtactgagccaggctccacaggaggacaggcctcctgattagagaactttttttctgctttggactggtcttgacttttttggctttgtgactgtatctggagagggccttacagaaaatgaattcatcctcccagagctggaggaagttatcatatttttgaggcagcttctaaatcattccaaatcaccagaaaagcaattatgtcccaccacttctgcaaaggtcttgcttcttcctttcttccttccttccctttccaccattctcttaactgtgaatcacctccatgaggtcaatctgtctggtgtgatcttcactttatctctggtacagagagcctggtacagaactgacattcagtagattttgtcccggtatgaacatgccaggcactgtgctgatattgtgataaaaggtgaatcagacacagatcctgcccttgaggaggacagagacaaggaaacaaacaattaaaatgcagcaaggtaagggcaatgtgagaggcgaacgcagcgcagtaagggagctgagaggagtggaatcagactctcctgcagtcagcaattatttcttggaagaggagacaaccaagctgagtcttaaaggttgcaggagttttctaggtagaaacacggggaagggagagagaattctaggtagagagaccagcttgttcaaaggcatgcaagaggcaggaagtaccatgatgtgtgcagggagctgcaaaatgtctggagtggccggaacataggggatgaggaggccagtggtgaagccttgggtcagagagtctgttcctatgggcagggctgctatgtctcaccgtgtgggctgtttactttatgaggttgcccagccaagggggcgagtggggctaaaatacagctctggctctgtgtgacaagtgtgtgcttgtggtcacatcctcccagaggagactctgtaatttacacaaaggctcctgtgggctagcagcgtctttgtggagggccttgcaggtcttgcaaaggctgcatctctatgtagggcagtggttctcaagcttttctcattagagtctcccggaaggctgcttaaaacacagattgccacaggtcctccctacccttagggtttctggtttgtaggtcttgggtgaggcatgagattttgcatttcttttatgttcccagtgatgctgatgctgctggttcgggaaccacactctgataattactcatctgggtaacacgaagccactggaaagggttagataggagaagcagagccaagccacaggtaaaaggggtgttttctaggattaaggtttctgatagcccttgtgaacaagttagggcagctgatatatggagagtaggtacacactatcccccatcttgtcctgtcaggtgaggtttaacagccctattcattcaagtgggacttctatcccagggtcttccagtttaaggagattttgcccacagatgatttcaggaatggctgtatcattacatgaagctcactcttggagcatttaaatagtgagttcccaaatgatttaaatgtttgtttgtgctttattaattactctcttgagaagctggggacaagagaaacctaaagctaccaactaaaagatgagtcacacatggtgataaaacttctttgaaaactcttttatcagttcaataaatacccgatttcaaaattgtaagtgtgtgtgtgtgtgtgtgtgtttggagagggaggggagaaggacatggagccacagagtgtcaggacctcacacacatgagcaaatgtttgctgaatgagggtgtggcacgtggatagagtatggtgatggggaatccagggatggtctgaatgagggaatctgggctgacaggaaattttcaggttatatctggctctgggctagggtttagaatcttggcttgagaagccaaaccttcctggagcccagtcatctttttggaccctgagtatattaaacccatttatgcctagtgttccattattggaacgctaagcatctgggagttatttatatcctactgctcaaggtcattgccacagcctgatttttcacacatgtctgtacttcaaaaaaattgcaacctctggcattaatgggttaataggatgtccatgagcatggagagagaatggctgtaccctttcttcccttgggggctcaggcccagcttgcccttaggttgggggctggagctcagaggtggtaggtggtaaagggagcctatctttattttctagttggaatatagtctccaggataaactagctttgggacagaggtggggagaatgggtgccggaaaaacatccaacctggttacgttttgcctgttcctagacttagccccagcctttcctgagacctgggacaggacagaggctccggaatctctgctactcactgattgatgttgtccattagggagcctcctgctggctgaagggctgccacccccaactagctcaactgtcaccaaccacagcctgtcagcagcgtgactgggagaaggaaagccttgtcaaaggcagccagattccgcttcttggtgtcaaggagaaaaggagaggggaggggagttcactcagacgctgcaatcaagatcaggtcgttcttaattaagacagctccgcaggcagcacatttccataatttcccattaaagagatcctgatgtatgagtcattgcgggagctgtgattccccgagtcagcactgttctgtgtctgaggctcctcaaatcaaaaggctaatcaatttcaatcacccaggctttctgattccctaagaggtgcccagccccatgccagactctgtgcccagcctggagagggacacagcaatggatctggctttagtttctgctacccagggaaaaagccttgtttatttcctgaccttgggagagagtcatggattcagatgcaaatgggcagggggctattccaggtgggctctggtgctttctgtgataacgaccaggaaatagtgtgggactgaggaaagaatactggatttggagataggaagtctgagtttcattcagcaaatctttgttagagtcaccttgtccagaggcttgggattcaaagatgaatactagacaattagtgtcctcaagaagctctaagggcggggatagactctgaaccgaaaacttgagttcagtgtggtaagtgctatatcgggcaagcacgaagtgttttgggagtgcagaggagggagagcctaattggctgacggaggaggggtggtggagcggttaagaaggtctcatttttggcttcctcaattattgtgatcatataacctttagtgaaactcagtttcctaatatgtaaaatgggcataatataattttctcagggctgttgtgaaaattcttgagagggtgtatagaaaggtcttggcggaaccttctttgtacttgttcttatatttccatggttgacttttttctaagtatgagcatcttgagagcagatgttaactgtgaggctgccctggcatgtagcacagcagactcgtgtcacttgtcatctagtccttttgtattggtggcatcctgtgtatggggaaaagaccaacagaccacagtagtcctgacgcatgttcctctcttcccttctcagcttggtcgctcaggctggaagcaacaactccgagtgtctaagacaaggtaaagtaatttttattctttggaagaaggcatgcaagtgtgtcatacgattttaaaatatttttattccaaatagatcttaatacatgtttttaggtttggcatcactagtgaccgtgaaacatgaacatttctattttgcaggtgaaaatatatttagagatcctaagttacctaagatcacataggtattacattttgcagagctaaaattcaaagcaatatctatggatcttgaagcgctaaggtatttctgtgaaaccatgctgaagttcacacgtgtaacttcatgacttatacactgatgtatccccaccagttatctgctcattaatgacccaattttgacttcacaatagttaaaaaatattacatgcaacatgccagtaagttcagtttgatctctggttccagcaagatggcagattaggaatgcataaaactttccacataaaaacacctagaaatgctgggtaaggtattataataaccactcagaatgaatagctgagttttcaagaaaaagagatcccctagaggcccaaagtgaagaaggaactgaaaaccaaagcagtaaatacagagctgagtttgtagctggtgtgtgtgtgtgtgtgtgtgtgtgtgtgtgtgtgtgttactggtcttgctaattttggttatatcatccacagtaggatgagaggacagtcttgaccttgcttaaggcagactattagaattgagaccctggcatgaaacaatatgttatctcaccataaaaattacaaaataaatgaagaaatgatccatccagaataaaagtcaggggatataataaaagggataattagatatctaagagtttaagacaccaaaaatcaatatgaaaaagaatatataataaggatttttaacattatcaagataaaagaatgagcaaattgaaaacaacaaatatatatttttttgttttgtttttgagatggagtctcactctattctattagcaaatctaatagaatagagcatagaatagtgttgcaggaatagctaggactcaattctattagtaaatctggcatgcagtgcagtgatctcagctcaccgcaacctccgtgtcccgggttcaagtgattctcctgcctcagcctcccgagcagctggtactacagacatgcaccaccacgcccagctaattttagcagagacagggtttcaccacgttggccaggatggtctccatctcttgaccttgtgatccacccacctcggcctcccaaagtgctgggattacaggcgtgagccacctctcccggccaacaaatataatttttagataaaactataatcattggaaatttaaaaagtcattggatttgttaaacagcaaacacagttgaagaccaaattagtgaaatggaagcaagatctgaggaaattcccaaaaagaaggacagagagacaaaagtatggaaaaatatgtgtgtatatgtgtgtgtgtctgtgtgtgtataccagagagtaagcataagaatttcatataaatgttcctgcctgtgtgcgtgcacatgcatgtgtgtgtgcatgcgtgtttctgtgtatgaagttccaaattccaaatgcacagaatacagagaatggggtagagatggtatttaaagagttaaagagatattagctgatactcttccagaactgacaaaaggcaaggaactgcagattcagaaatgccatgaatcctgagacttactgcaaaaaagccttatattagaggggctgcagagctctgagaacaaaaagaaaatcataacagcaacgagagaaaaaagacaaattgctaataaaaggacactagattgacgacagtcttcttaactgcaacaatagattctagaagacaatgaaagactattttcaagagctgagggaaaataactgtcaactgagaattctgttccattatcactcaagagtgaaggttaagtaaaagcgtttttaggtgaggactgtataaattaccactaactgacccttccttaaagaactagtcaagagcacatttcagaaaaaaatgaaaacaaacctaataggaagaagtgggatgtagaaaaatgacaatgagcaaataaatcattacagttttgggtatatacaaaggatacatccctccttactgtataaaatgagaaaaataacaaccaattcctatggtatacaaataatactggtcagtgataacataaatgataaacaaatgtaaagttaaaatatattgttattagtaagagcagtaaaacaatatatatataaaacttagatattgttaaaataagtatgcatgttcaaaaattaagagtaaccactataagaactgatagatggtaggccttacaaatcaatagagggtagaaagagagggaataaataaaactcaatccaatggcaggcaggaaaaaagaaaacaaaaagaaaaactagagtaagtagaaggcataaaataagaaggtagaaacaaatacaaatatatcaataaatgaaataattacaaatgaaacaaactcaccacttaaaaaacagaagatcttggccgggcgcggtggctcatgcctgtaatcccagcactttgggaggccaaggcgggtggatcacctgatgtcaggagtttgagaacagcctggccaacatggtgaaaccctgtctctactcaaaatacaaaaattagccaggtgtggtggtgcacacctgtaatcccagctactcaggaggctgaggcagggagaattgcttgaacccaggaagcggaggttgcagtgggccgagactgcgccactgcactccagcctgggcgacagagtgagactttatctcaaaaacaaacaaacaaacaaaaaacccagaagctctcaaactggctacaaaacaaaatgctatttaggggagttatttcaaaaacataggaactgagaatgatgaaaataaagaaaataaaaaataaaaatggaaaattaaaaaaagaaaatatataaatgaaaataccgatcataagaaaactagtatagatatgttagtaagataatacaggttttatttttgttaagtaaaaagagggttattaaataatgataaaacaataaagcaggaagctaaaataattatgaatttttatgcagccttaaaatacacagagcaacactggtagaatcataagacagaattgacaagcctataatcataatgggaggctaacatttttctcagtattagtagaccaaataggcaaaatttaataaggatataggagatttgaagaacaaaattaatgagcttaattcaatggaaatatacagagctttaaacataatcatttaagaatgcaaattcttttcaagaatacctggaacagttctaaaatttgaccacacactaagccacaaagtgaagactcattatcaaacagctatattgtctgtctccaatttaataaagttaggcatcattaatgaaaaggtaaccagccaatccttcatgcattcgtaaactttaaaaattccaaataatttatgactcaaagaaaaaataattattgagacgagaaatgtttttagaactgaatgaccaaaacaaaacgaaataaacacgaaaacaaaactctacaactcactagacatgtgagatacaagtgaaacgtacttaggggaaatgtatacccttaaaatttaccaaatattagagagaggaagactgaaaagtaatgagttaagtgtccactgcaagaaatttgaaaaagaactaaataaatctaaaaaaaagaacataataaagacctgaaaatatatcgtaaacaaacaaacaaacaaagagaatatctgtaaaactaaagctagttctttgaaaaagctaatcagatagatgcacttctaataagatttaattagaaaaacaagagctatgtctcaaatatatattagaaggaaaatgagattttaactttaaaaatcatgaagaagactattagcaacatcattccaatgagtcaagcagcttccaggcatcattgactactgcagtagttacaagggtttatcacccagccatagatttggttgataaagacaaaacaagcctacagtttactacttacatagatagcaaaagcacgatcagtatggtgtcagctccctatgtactttgtccccaggatgacaccaaagtgaaagggtccagatgacagatgatatgagcagtaggttgctctgttatgggggaagcaattctagactatagataagcagttttataatgtgtggctgtactctagcagggtgggggatgattatggttgaaagctcatgcttcatcagaactaggcaggcatataagaaactgactcatgacaacctcttgcaaaatagggagtatttgtctgccatgctatgtatgttcttgggaggatggcagggcgctctgcaaagatttaggtcaaactgtggtcacactttgcctatgtgacttagatgaatctgtgcaaaaccataatggtggcatgctagaggtattttattctctttgtcgagattataaatgggagttcattcacgatttggctctctgcttgcctaatgttggtgtaaaggaatgcttgtgattttgcatattgattttgtatcctgagactttgctgaagttgcttgtaagtttgaggagttttgggactgagatgatgcagcagaacatagacctcagaaataacaccacacatctacaacctaaaatgcacatgagaaagtacacttaagataattttgaagaagcagcagatttggggaaaggtggtgggatacttccagacttttcataaaggcagtgtgactgggagagggatagacaagtagacgaatggaacaaaataacagagcccagaaacaacctcgcgtatatatggcgtcttaaaatatggcaaacgggccttatgaattagtgaagatggggagggctaatcaataatctaatggctatctgtatggaaaaaataaaattatattcctacctttcacctaatacctggaataaaatatactccagtaggctaaagatgaaaagcaaaactatgcaacttttggaagaaagtataagagattatgtttatggcaataagttaggaaagactttaagttataaaaagcaaaatcagcaaaagattgacaatgttgactaccttcaaattgaaagccaccaccataaatcaagggaaatgaccagacccagattaggagatttctttccagtcaaacaagaatgagtgttcagtatacctaaaggactcatttacattatcaagaaaaagaaaaagcctgaaaatcaggcaaacaatatgagcagacaatttacaaatgaccaacaaatatattaaaagatgctcctgctcagcctcattggaaaaagttataaatcagatcacaccaagttttggagaaaatgtgaagaaataggaactcatacacaaatgtgtgggggtacaggttgatacaggtcttttggggagcagtttacaaagactataaagctgaggatgcacgttgtgtcagctagggccctggcagaaacagttggcaccctcaaatttgataatttgagggcagtttaataatgggactatttagaaagatatggacaagttacaggaaaagcacaagggatggggcagtacccaggaattagtgtcagtgggacctgaccacccttaggcctgaagggcaaagctgccggagcagttactggaacctggagacagagagggctgtgaccctcagtagaggggcctcatcagcctgcgctgatcccatggggaggaaactggggaaataagtaccctgatcgcactttcttccacctcccaaacttcccattggtcttctgcattggctcaacacaagggacagaaggcaagggagccggctggttagtccacactatgcagctctgggggcccagagcaggatgggaatgaatggaaagtggactctggaagggtgaatggaagataatttatcatattcccacctgttgaccagctattcctcaaaggaacatgccctagagaaactcatatatttgtgcacaaggagatgtatacaaagattttgaatgtaacactgtgaataacagagaaaagtggaaacaaccgaattgtctctcatcatgttgttacataactgttaatgtaagctgtggtttattcataaaatggaatgtcatgtgcaatgaaagtgaatgaactagatatacatgtgtcaataactatacatctcaaaaacataatactgagtggaaaaatgtggccaaaagacacatgtgatatgacagtatttatggaaaaacggtacaagcctgtagcaaattgtataggtttgtagtgatgtgcaaaaaacgtgaataggaaggaaacactccaactttaagaaatgacaacctgtggagaagcagggaagaaaaagagatagggatactttagctgtatattttttattttttttaaagatgagcggaaacaaatatggcaaatgttaacatctgtttaatgtcagtgatgggtacataagcaagttatttactatttagtcatattgtctgtatgtttgaaatatctcataattaaacatttaaaaacaagaatgagggaaaggggtggatgatttgagagacatttaaaacattaaaaaggagcaaaatgtctcttacctaaagcaggatttgacaaagttttttctgtaaagaataaatctttttggctttgtgggctacacagcctctcacaacgactcaactctgctgctgccactggcaacatataagtgaatggatatggctgtgctctaacaaggctttatttacaaacccaagtggtcagttggatttggcctctaggccatagtttgctcacccctgatctagagaatcttcttgtcaggtatacttctttccccccaaagtgtattttattttttgtttttattttaattttatttttttgagatcgagtctcgctctattgcccaggctggagtgcggtggcacgatctcggctcactgcaacttccgcctcccaggttcaagccattctcctgcctcagcctcccaagtagctggtactacagatgtgcaccaccacacccagctaatttttgtattttgagtggagacagggtttcaccatgttggcatgttgtccaggctggtcttgaactcctgacctcaagtgatccagccacctcagcctcccaaagtgctgggattacaggtgtgagccaccgcacctggcccaaaatgtgttttaaataaagttctgtggtgtagctgtactccacattaaccaacagcatttttgttgtttagacttcttactaccggtcaaggtatacagctgaagagcgggcccttgtctgtttccaattttgttttgctgtgggcattagaggtctttctaggcttcacttaagcttgtttgtgtgcatactttggaagagctgaaagtgctgcaaccctagaggtactgttgactggagccaatcagaatgaccgaaacaacaaaggattagcagaaatttttgaaacacgcaggaatcattagtagaggcggttgcaacttggagatctggcgtgttgatgggattatctagttggtttcattttatgggcctaactagaggcaccttagtgtagtggttagggacttggactctggggctgagaacagcactcatctcaaaggaaacccaagcctgtgtcagtcatctagtgcagcatagcaagtcacaccagagcagtggcttcaaaacagttacttttctctcaaacctaggagtagatggttcaggtaggctctctcttggttttaatgggggctggggtcatcttgcagccttcctctaagtctgggccaggcctgggaacactcaagcaactggtggctggaacaacagacagccctctctctccacgtggacttcctgcagcctgcctcagactagtcgaggtgattaccctgaagtcagggggtgtcgttcttgccacattcaactgaattccctgcagcagtcacagaggctgtgaagatgaacacaggtgtaacatatatgtcaataaatgtaaagttcttcaagccagtgcttggcacaaagtaagtgccatgtggaagtgttaataaaataaaagaaaaaagagaggcaggtacagtggctcatacctgtaatcccagtgctttgggaggccaaggtgggaggatggcttgaaaccttggagtctgagaccagcctgggcaacatagcgaaacggtctctacaaataatataaaaactagccaggtgtcgtggcacacacttgtagtctcagctacttgggaggctgaggtggaaggactgcttgagcccaggagtttgaggcgccagcgcactgtgatagcaccacaacactgcagtctgggcgagagagagcgagagagacagcgagagcgagagagagattgattcctgaattttctttttctttccttttccctttcctttcgcttcccctttccccttccccctacccccttctcccttccccttccttctttctttttctttttcttttctttcatctgtcttactatgttgcctagccttgtctgaagctcctgggctcaagggatcctcctacctcagtctctcaagtaattagcattacaagcgtgtgccactgtgctaggcttaattctcgaattttccagcttgagacttaaatacttacaaatagacacggcctttctagctagtccatggaggggaacctgactcctcccagactccacctgctgccactactcatgcctttcttttcacagctctttccttcgctccacacagatctgccaacagcctatctgtacctacgtatcatcaaccatttggacttgccttgaacttactctctcagttactcagcaatcatggacagagctcctcctatgagcaggccatcgttaaaggtgccagagatagggagtgaggacgtcatctgcatcttctgccagcatctgtgagtctgtggcaggccagcttgttagcttacagatagataaaaatctcaggccattcacggttgactccatgcagtaggatatttaggattctataaaaactgacaagatgagtgtatgtgtgtgtataggggaagagggtgagatttagaggaaggacaatggatgtggcatgaggatgtgtgtgtacatttggtggggggctatcagaggaggcaccataggagaagtggtacttgagctggggctcaaaggtggcaggcgctttccaggcaaactccgcagggaagggcatttccagcagaagaacagaacatatgagggctcagaggaaggtttggtgattatatgcagtttgataagagcagaaagagtagagaggcaactccaggaatccttcccagaattcccaagttaccccttacccatactcatgtggcctctgggaatactgaagctttgaagtcaggtagagttgaacttgaatttcagccctggtacttagctcctctgtgacataacataagccatttaatctctctgtgctacaattttcatatctgtaaaatggggataatgatctttcttacagaagtaggtagggataaaatgaaatgatgtgtgaaagaaccttttggcattgtgcctagcatgttgtggttacttggaaatggtaattattactccctttatagagctggtgagtttatgtatgtgtgtgtgtgtgtatgcatgtgcacataaatatatgcacataatcacaggaagttatacgtggaagtttcctttcctccttattgtctaacacggtctccttaacactgaaatagcttatgtcacagcaaataacgggaagcaaattaatgtagagttaaaaataaaatttgagaccgaactatacctctgccacttaccacctaggtaattctggtgggtcacatcccctctctgaaccttcattttattatctgtaagatgggagatattaagacataattcatagggttggcatgaaggttaaatgtagttaataaatccaaagtgactggcatgttctcaagtactcaaaaactgttttttggtgatgcaaaattgctttgtgtggcataaaactctgtgtaaatgtaagagattattattttgtcaaggcaagattcatgttttcaaaggttaatggatatttcaagtcgaggtttcacttttctgctgactctgttgttggagatggtgtggtagaagaacaatgctttgattccctgtactatcaagggactaacgttgttctctgcactctgcacagagccccaaagcaacccacccaacatcacagcaaaatgctgcagggtcgttttgatgttccaggaggaaagagcatgttggttattgagtgaaatgtgttggaacatgaaacatggacagtatagtaaataagttacattagctgtgaaacatatataatgattctaagacaatttaaaatttgaaatggaaattttctataaaacccataaattaagaaaattatgagcgccatcttgtggcaagatcacccttaaaccatcataccagagaacactcctttccttagacagaacctctaacaaagtcaaagaacattcatccatccatccatccatccatccatctatccatccatccatccaacaatccacccacccacccacccacccatctatccatccatccacccacccacccatctatccatccatccatccatccacccagccacccacccatccacccatgctgccatctacctatgcattaatccatctaaaaatctgttcagtcatttgtccacttactcaatatttattgaatgctttctatgctttggttggagatatgccccctgctaacaagaagaccacaggaggtgatggcaaatacggaaaaaccaacagtcctggggaaccttgttggagcacatttaatccagttgttgttgttgttactgaagtagaggagacaggcagataagtcttcccgatggaagtgacaccaaagctgagatctgaaggatagtaagagtgtgttatactaaagaggatgtctcctgtgttcattctcctcttggggtggatgtagctgagagaataagagagctttagagtcccaattgaggttactttttatgtgctgttagtgcattggtggcccctccagccctcaccttggtagttatgacaaatcagagagtgtccagcagatagtgatcagggtggtgggaggacacttaaagaaattgggaaaagctgtgaaacgaagtgcttggtaagtggacagattctattgcataagattaatgctgcctattaatattagaaggtattaatagctgccattatgttaggtttttcatttaatagaatgtgttatacccacatcagcagggccgtgtcagtgtgggctgttggccaagatgtgggaatggcatcattatgtgtacccagacacgtaatggtattctgcgttgggaatctacttctatgatctgatataggttgttaattaataaatgtattacagaaaaagatgcccagcagcaaactggttacactggagaatggttggcccaaatccaaaggatgaatgtcctttgaacatcatttcatcctctgctccctttgtaggcacctggaattaatgctgagaagaactgatgtttgccttagcaaggcatatacagtggcttcagcaggcctgggcagggcctgcaattttcagaccgagtgctgctgagttcagcacaccatctcttaactttaaactgtgtgtcccttatcctttgcagcacccttgcactattgtttcccttatgatataaaagtatttgtgtgtatccatgtctttagtaacaatgaaaacccatgaaaggtagcccaaaaggggttgtatgtttcaagaaaaatggcagaaagcacagttctttgtgggattaaaaagtatgtgtatgtatttaatataaaccaagtgtgtctgcatataaaagcttgtctacctccttcgttcatatagctctcttggattttgtgggtatttgcttcaggacaggcaggaactgttctaggcagtggcccagagcgagcattactaaccttgactgtcattctgtcccaggtggcatcccctcctcagatcccagcgctgtccatatacatgctggtcacatttaaagggccatggatggggcttaagggcaaagctctaatatgtcaacaatttcttctaacgggatcttgcttctcttcttttgtatagctcaagtcagaagtaatgtgatgttttattgggatggccttggtgttttgttgtctacacttaattatatctaaaataatttgttttctctgtggccagcaatggatctgtgaattcaccagtctgggtcctgcctctcagcctttgccacttcacaactggggccggtggattttcagctgcaggcttggtcctccaggcctgtttttaatggttatggtgggaggagatcaagataacccagggttgagcattggactgtcctgctgcctgggtacaactaagtcttacctagatctgatgctgggtttctgcttttcccttctgacaaaatgctagcccttgaggacttgccttgagaaccttctaggactttatgttctactcctgtttaacactactgatcatttcagcattcttcaggagcatggattttgaacaaggaggccagaacaaagtaaagaagttagtctaaccattagaatacattagacacacccattgaccaatggggggcaagtgccactgtattagagaaattgatgatgtaatattcagagaataataaatagtgcttccagcttgaatgatgcatagtctctttttagaagaaaacaatgctgacaaataattttattatcataattaatttaaatatacacagatgctaaactaagtataatcttaaaaacataacccatgtataaatttaagtataagcaatactgtgtaaacattaacatttaacataaaagcttagacaagcttttatgaatttataaaatacaaacaaatccacaaaatcaatagaattaagattaatctttaataggatcaatgatgttggtttgctaaaacaaaatcatttcttgccatgtggatatggtcctggggctatggcacaggtttgtgtgagttggccacgactctgctgaatgtgctgcatgccgcatgatgactcagtgtgtcttccatcttcctctatcctaaatatcatgacacttttgtttctacaggatgctgtgaggtcatttgttcctcacttgtcaatgatcacattgtttgtgttgaagtccatcacactcatttttcactagtctgagagaattaaagcagttctatttgacccttatgctgtcataaacacaaatctacatgtggacatagaaattctgtggtttgagttggtcattcagttgacccacaagatatgaatattgattatttttatattttcatcaatatgaaaacaaattaaaaaaacaatatcagaatctcatgaactcagagaaaatgtccagtgggcttagtttgagaaatactggcatgaaaagcccaatggcatgactagctccctgatatggggcaggaattgagggaaagatcaggggcttaaattgccagagggtgacaaaatcagtttctacctgctgtaatctatatcccagcaaagttggtctgttctcagatttactggcaaactgaggcaacttaattgctcattcgcgttctgctcttcaactattattctgtatctggtatggtgctgccatgcctctctgatagtgaccacttgccgtcctgcccagtggtaggcttaggaattaggggtctaatctggctgctcattgtccagaagcacagactggaaactctagtctgaaaaatgtttatgctattctaatatttgagtgtgtatctgtatcatcaggagaattttagataatagccattaggaggtcccaagagaatggcctatatttctagttgtaaagggtcttttggagtaaagaaggaacactgaccaaggaaacgttcagacaactacaaggaatccatgagcttggttgccttttacaggaggggcagataaaaaggatatgggctgtaactggctttgataacgccccaacccaatgaagaattttgagttgttaaaacatgttgtttctagactccaaacactgacccacttgggagaaaatgaggcagcatggtaccagatctgtgggatctgttcccaaaatcctattgacaggcttggtccacttgcaggtcaccctccatggtctttggtcaacttttctgtggtcatcatagcttgatgggactttctctggcagttgtcccattcaaaccagttgtccacagccttgcctgcttcaagagtccaaggaccaaacctcaaggagtacctcagattgttccccaagtgctgccactgacctcatttggactgacgatgcacttaacaatttgactttccactcttatttttcctgaaactcaatactcccaattgagttctactagctgtatttgtgaaaagtaatcacaaacatttttttagaatacagtgaaatgtgaaggaatgatttattgtgtacatgcatatggcagaatatgtgtaagtggttatagatcagttctggaattagacaggcctgagttttaacttaatcttgccacataggagctgtatgaacttagacaaattacttaatctaagatgtagttttcttattcataaacatggatcataataacacctatttcatagcgttattgagaggactaaacgggatagcacagtgtctggcacataattggcactcaacaagtggtaatttattattattaattgagcatttatatatgcaggcctctgggttaggcccaagggatgcaaagatctccatcctcaagtagctcacaatagatctgagttcttcccaggggacactcagaaggggtccaacaatcagatttgatgtcaaatcaactgaatttgcgaccagagtaaacagaatttctcctcattgcccgaccctgattaggatgggattaattgtatagcctgcgttctagaattaaactgcatattgaggctgagaacatccaggtggggagacgggaggtcagcaagtccagtttccacaattttatggttcagacttggcctaatttggccattctgggaagtcttagaatggcagcagagaggctcctcagcccttgttgagagatgctaatgaagaatttgtgtctcaccaatggctactgcatgagaaagctagaaggaacctcaggccatcgtttcttactaatggtcaaaaacatatgcctcaagcatgattcataaagatatcattttagtctttgcctccttatttctgagtcagtacacaaatagcttgttttctgaagcttcagggaagcccagattgacacattagccagggagtaatgtgccttctttctgggctggctgtccataatgcattcaaatccagaaaaaaagtaggaatttgttcaaaatttatcaattgggccattttctcaatgacaaacagatggctcctttgagttattcagagggagaagatttttttttccttttgttcatctcagtttttatggtttaaaagaattagtgtttaatcccaattctaaaattgttaattagtttgtatttgcttcactaaatctgttaaatagatttttatcactttagctatatctctctggcagcatctggtgtcaactttgcagaaataatgttggttttacagccaaaaatcagaggttaaacctccaggactacagatgtgacagcattaaagggaaattcatcacccccaaagctttcattcccatatagtttagaatcagcccaaacatgaaccaatgttcttttttccctttcattctccaggagcactgtggctcagttcctttttgatttatgagtgtggttgttgctgatgagatctcccagggagacctcaatctgccccagctagaggcttggaaaacagtggaggatcttcttgctcaaccccctttctgttgctttcaggggattccatccagggctagggctatccatcaattcatttgacaatgggcatgtatgaggtgagggctgtgcgggtacaagctctgtagtgtcacctgccggcagggggcacaatagggcagagcagcaaaacgaaggcagtgtatgttacaaacgagctactctgaactcaaatcagtgcacctgggggaataattaaatgaaagacagcaaatcatcataaaggctggggaatttgagtaacagggaaaacctgttgggcagcaatcaatttaggtctctgtggtaggctgaatagtagcccctaaaaatatctacttctgaatccccagaacctgtgaatgttactttataatatggcaaagggtattttgcagctgtgattaagcagcttgcaacggggagattattctgggttctttgagtggaccctaaaggtaatcatgagtgtcctgataggagagaggcagagggagattccacagaagaggagaaggtgatatgatggtggaagcagagattgaattgatgaactttgaagatggaggaggaggccacaagccaaggaagacagacaggcaccagccgctgaaagaaacaaggaaacagattctcctttcaaagcctctggaaggaattagcactgtcaacaccccaactttagcccagtgaaattggtttttgggctatgtactaccagaactgtgagagaataaatttgtgttgttttaagtcaccataataatggtagtttgttgcagtaggaatgaatacagtatcttttccttgcttaatgccaaagagttccactgcagctgccagaggtattttacagggccaagaggagatagcagggatcagcatagtgcattgacttcttcaagaagagctccttcttctgaagtccatctgtaatacaggtgtgggcagctgcagcctgaagcagaaatgggactagcaactgggaagccctgtgtgattggcgaagaacgtttctgagtgtcatggaccctaggcaatagcagacagtgtgagaattctctgcaattaacatatttgcataaatattaggaagaggcctgattagcacagtgagcgtgactcagaggaaagtggagggcagaggtgatcagggaagaggctctgaagaggggtgaggacagagatgccaccctaggcacatccaatgctctgatggagagggactggttgtgaacagctaagttgctatggccttgcccttcagatgtagctgtggacagtgggaggggaatctgtgggcagacctctggagctaccatccccatttcactcaaatgactccaattttatttgttggacacattgggcttccaggtggaatttcacttaagaaaaaattttactggtggaaaaagattttggggggtaaattttaattttgatacaattttacatgtacagaaaattgcaatagtacaaagaattcccatttacccttccctcagattcaccaagtttgcattttggcctatttgcattatcatttgttctaagtattaatgttttttttcctgaaccatttgagagtaagtaggcattatattcctttacctccaaatatatcagtgtgtattttattagaacaggacattttgttatataaccatggtacaatgatgaaaattgggaaatttaacactgacaaaatgctgtcatctaatcttcagcccaaatccaaattttgccaattgcctttatagcaattttccccccggtccaagatttgatccagcattgcatttatttctcatatctctccagtctgctttaatttggaatatttcctgagcttttgaccttgacatttttgaatagcacaggtcagtaattttgtaaattgtccctcagtttgggtttgtctaacatttccttatgatgagattcagatcttgcatttgagcttgaaactcacagatgtatgttgtgtccttctcagaacatggtatttgaaggcacatgtggttgctttgtctcatgggtgatggtggcattgatcccttggttacattgttgtcctccaggtttctttactgtaagttataattttcccctgtgtaattaataagtaatttttgaaagatactttaaaactaggcaaatatcctgttccttattgaatcatcacccactagttttagcacccactggtaattcttacttgtgtcaaaagaaaaaattacaacaaatttagtttaaagattgaattgacttccatttgccattccagaatcaggcaacatctcattaagaatgactgttctaatgagctgagcagaggagattgactttataggctgaaaagcactgaagaaagcagaaacagagaataaaaagtggattggttgtttcaaagttgctctcgttatggggttaaaacagaggggacttccttatgccgactcaggtagactagaatctcttgttttttggaaaacttgcctatttcaaagttcagtttgatggcatggcactcagcacaaaatttccattctggtttggtctggtctacttggtcctgatgcaggaggctcgtccaaaacaggagcctcccataaactttgtttaactcttgaatctataataactgtgatgattgcaaaatggcgatttatctaactccatcattttttctacattaatttgttggcataattctaaaagaaagatctttctcttatctcccacttgtttattcacttatttaattatatcagcatacactcatagattcttattttattcaatgagttttttttttttttttttttttgagatggagtttcactcttgtccaggctggagtgcaatggcatgatcttggctcactacaacctccacctcccaggttcaagtgattctcctgccttagcctcccaagtagctgggattacaggcacgcactaccacgccaggctaagttttgtatttttagtagagacgggatttcaccacgttggccaggctggtctcaagctcctgacctcaggtgatctgcccgccttggcctcccaaatttctgggattacaggtgtaagccactgcgcctggccttcaatgagttttaagtcattattattgctatgtattttgatgttcacattgacccagatttggccaggagaagccccttcaaactggcctttatgttttttgatgtgctgcttcttcttcattttttttttaagcacttttttacttttaagatatcccaggtccttcttggctcaaacttgcaatcagccatttcttcaagaaaccctcaaattattgtaagaaacaatgtttagaagacctgggccggcatggtggctcatgcctgtaatcccaacactttgggaggccaaggtggccagattgcttgagcttcggagttcaagaccagcctaggcaatgtggcatatcccatttctacaaaaaataccaaaattagctgggtgtggtgtgcctgtagtcccagctagtgggaggctgattatatctgtaaatccagcacttttggaggccgaggtgggtggatcacctgaggtcaggagtttgagaccagcccatctaccctgtagggaaccattctcattagtttctggcttatcttttctcaatttcctttcacaactaagtaagcaaatacatgtaattttcttatttcctcttcctacacaaaaggtagaatattacgtatactcttttgcactttgcttcttcacttacaagatatttcctggaaatcactccacattgcttcatcttcattctcttttaccactgcatagcactgcattgtgtggatataatttagtttattcaataaatctatctatgagcatttaggttattaccaatattttgcaatgacagataatactgcagtgaataaacttgtacatatataattttgtatttctgcaggcttatttttagagtaaattcctagaagtgggatttctggaacaaaaggtaaatgcatatatagtgttgttaaatactgccaaattccttcccataaggctgtatcattttgcattcctaccagcaatgtgtaagagtgtctgtttctcctcagccttgccaacatagagtgttgccaagttctaaaatttttgcttattattcataggtgataaatgtcatttcactgtagttttaatttgcatttttcttataatgaattgaacaacttctcataagtgtttaggggcattttatatcttttttaggtaaattgtttgttcgtgacttttgctcattcttttttatttcttttcctttttcttttttagagatggagtctatctatgtcatctaggctggtctcaagctcctaagctcaagcaatccctcccgtctcaggtactcctcataagcagctgggactacacgcatgttctaccatacttggctttattcatttttctatcaggtgtttttgcctctgtttttggccctcacttttttttttttttgaggcggactctccctctgtctcccaggttggagtgcagtggcgcgatcttggctcactgcaagctctgtctcttgggttcacgccattctcctgcctcagcctcctgagtagctgggaccacaggcgcccaccaccaggcccggctaatttttttgtatttttagtagagacggggtttcactgtgttagccaggatggtctcgatctcctgacctcataatccgcccgtcttggcttcccaaagtgctgggattacaggcgtgagccaccgtgcccaaccggccctcactttttaagatttccttgtgtattatagacattagaacttcaattgtgatatatgttgcagatatttttctaaaacttttgtttaataccactactttaactagttagcaactagctataaatatgtatgcttgtgttaactgttaatgaactctgttgcttactcctgtgcctgtgtgggaaatgattataaacctcaaatgtctttaatttagcctagattaaaattaaatttaagtagactttccaacaaatggtattggagcaattggacacaaaggcaataaaaaaatacccaactcaatctaagtctcatgtcttatgcaaaaattaactcaaaatggatcacagatttagatataaaacataaaactataaaacttttagaaaaaacaaagaagaaaatctttgggatctagagctaggcaaaagtgctcagacttgacaacaaaagcacaatttgatagattagatctcatcaaaattattaacttttgctctgtgaaatctcatgtgaagaggatgaaaaaacatctgtggactgggaaaagttatttgcaaaccacgtatttgacaaaagactaatatctagagtatataaagaactctcaaaactcaacagcaaaaaagctaaactatccgattagaaaatgggtagaatgtataatatcaaaataatggcacaaccactctggaaaacagtttaacagttttgtttaaaaaaatgcaactgccataccacctagcagttacaggttcaggcatttcttccggagaaatacttaacatttacagagaaaccagtgcacagatatttatagcagctttatttgtaatagctaaaaactggaatcagtccagatgttctgcagcagttgaatggttaaactatctgtggtacatacatatcatggaatactactcaaccataaaaggaccgagcgcagtggctgacgcctgtaatcccagcactttcggaggccgaggcgggcagatcacgaggtcaggagatcgagaccatcctggctaacacggtgaaaccctgtctctactaaaaatacaaaaaaattagccgggcgtggtggcgggtgcctgtagtcccagctactcgggaggctgaggcaggagaatggcacgaacctggggggcggagcttgcagtgagtggagatcgcgccaccgcactccagcctgggcgacagagcgagactccgtctcgggggaaaaaaaaaaaaaaaaagaaaatgggcagaatgtataatatcaaaataatggcacaaccgctctggaaaacagtttaacagtttcttttaaaaaaatgcaactgccatgctacctaacaattacaggttcaggcatttctccccgagaaatgcttacatttacagtaagcagtgcacagatatttatagcaggtttatttgtaatagctaaaaactggaatcagtccagatgtcctgcaacagttgaatggttaaactatctgtggtacgtacatatcatggaatactactcaaccgtaaaagtaacaaactacctgtactcatatatgcaacaatttggatcaatctatagggaattttgctgcatggaaaaagctaataccaagaggttgcatactgcatgatttcatttatataacattcttgaaatgagagcattttagaattgggagacagactggtggttgcccagggttaggacctaggggaaggcggttggcgtgggaggaagataggtgtgattatgaaaggtcagatgagggatcctggtggtgttgaaatgtcttcactgtgtggtggaggcatgagcgtaacacaggtgataacaatgtgtgaaacaccccccaccccacaaacacacacaaatccgtacaggtaaagtaggaaatcaggataagatgtgtggattgtgtcagtgtcaatcagtgatattgtactatagtcttgcaaaacaaaacaaacattttgttaccatggggaagctggacataatgtacaaagactccctctgtattatttcttataactgcatgtgactttataatcatctcaataaaagtttcaataaaaaataagttaaagccaaagcctacgggtttttaacaaaaacctcgaggaaaacttaaagagctgtccacccctgctttgagaatgtagagtcctggataagcaattaagttttgttgagaccagcacttcttttttttttttttttaattttttattattatactttaagttttagggtacatgtgcacaatgtgcaggttagttacatatgtatacatgtgccatgctggtgtgctgcacccattaactcgtcatttagcattaggtataactcctaatgctatccctcccccctccccccaccccacaacagtccccagagtgtgatgttccccttcctgtgtccatgtgagaccagcacttcttaattggggtcagtaccaccccatgggggtgtgtttgaaaatgtctgggagtggttatggttgtcacactgactgggggatgtctttggtactcagtggacaggaccaagaatgctaaatatcccgcagtgcctgggacaacctgacacatggtgagaatattcttaaccccaaatgccagcagcattccactgagaaacaagattagatggctaaaatcttagcaactatttagatagtttgtgccttaacatttaagtgaaatctatgcttattctatatcttgtcatcataaaattgagtttctaagtctgtttattaatggacaaagagccttcccttaatattaaacatttttaaagtttaatttttaaataatagttttaagctcaagactctaaaattgttataggaaacatttattgcaatatatttgttgtaatgaagaatatttcattttttttggagaaaacagtctttttttatcttgtttaaagttgtgaactatattttctgcagaaatttgatcttcaccttacctaaccttaaccttaaccttcttaaccttaaccttaacctttgtgatgatgacatcactgatactgtgctaattaactcaattagtagaaacggacagtgtgaactactttaaaagagaagcatagctggagataggttttttttcaaagtttattttacaagtaaaatatagtgaatttgattacctcaaaaacataacagagaatctctttttcatgccatttctcagtaaggtttttagctcttctcatttaactttttcttttctttatgaagtcctgagataaatgagccatttctggaggaacaatccagatggcttttgcggtcaccatcctggagtatgaattgaggaggaaggcgttcttttcaaaatgagccacaagcaaaactcctcctggttggtcatccattctctgccctgacatgttgtgtgcagaaacccatgtgacagcatgagtgtgttgtgtggatatgtgcttcccaggacaggattatgtacaggggagttgtacagacatggagtgtacagatacattgtagagacaaatgttaaagagacatacagtgtacagaaattggattgtagagatatgaacttcacatacaggagttacaaaagcatggtatgcagattggattattgagatgcaggttgtctagacactggccctgaaggcataggttgtgtagacacagcctgggaccaagctctttggtcctggccttaaagcagggtgtgcagcatgagcccagtgatggttgcctggctatgtgccagaagtgggactctgatgtctgtgcagagggtgagggcaggacggtatattctgccactctactttgagcactggctttgaagctttccctccaatgccattcccacccccaagggactcaggaaatgacttctgtcttttctttgatagaacaaagaaagagagagttctaatagatgagagagagagaaagagagagagagagagagagagaaagagagaacaccagattcagacacagaaggttctcaaggatgaccatggtgaagtctgggcttcagcaggtcttacagaccaccaggggtcagtcttgggttctacaagaggaaaccaggaggtatttgctcagcactggttctcacctgaggaccattcagaggaatttattccactttaatatactatggtgttagcagctttgaaattctttaccgccaagggggccttaaagccaatgaagcaggagtctcaggaatgacccgtatgtcaggcctgcttgtttataatcctcaggaccacaataaaaggcaagtttaatcgcctggtgattcgggacttgggggcccaagtgtgctaacccacccgtcaggcccaggggtctgcctgagcttgggagggagggagtttggggctgggcctggttgggaagcctcaggcctgggctaggtccagggctgggctgggctgaggctggggctggagggggcttcaagtgaactttggttctgaggtcactggttttcctgttgtagtaactgacttcacagactctgtcaggatgaaggaagacacaatgctgccagtacagctgcttctacaggaagccccatccctgatagctaaggctagactcagcttggtacttagtgataaaaacaagaacactaccacagctattgcacatttactatgtgcctggcaccactgtaagcacttttgtgcttctttaatcctcataagaatcctaggaggtaagtactagtattatccccatggacagatgagggaagtaaggtttaaataacctaagtaacttgcctcaggtcactcagctggtaaatgccacagctggggtgaacccaggcactctggctccttagccatgctcacaacccacactactagataatactgcaacgttaagagcctttggagagtctatatgtcagccctcttgtggcagatgaggaaactgaggcccagacccaggtcacatagctggtgagtggtagagtttgaacccagacccaggtctctggctcccagcttagagctcttgtcacaataccatgcagccaccatttgcaccaaaccaagttgcaagacattttagctaaaatgcaagctttgggtcaaggaattggaaagggccagaattatcctacggtctcccggcctcatggggttgaatgcttcataactaagcccaggcactatcagcttgtcagagggtaggggccaaggacatggcccctccagctgcagacaaactgctgggcaggatccaggctggggtcagctaatagcccctacacttccacccccatttccaggccagggggacacatcctggacaagcgagaaaacctggcagaaagaaacagagaatttttcttccttcaggcaaacaggctcctctcagatcagaaactgtgacagggttttcatgggaggtacaggctgtgataggaacagagagctctggtataagcagctctgagagaaggagtaaatcatctcctgaaatgttctgggcagctgctcactcactaacaaaaataccctgcttggcacagctctggtcactcaaaaactactccagggacctggcaattttcaaggtgtggctctgctcttgaggaaggcaaaaggaactgttgggagaagagtgcagtgtgtgccaggccctcagagcggggatgcaggggagcccagaggaactctgagcagggctaggggtagaaaatagcagtgcagagctcaatggtgcctgcgcctcccagctccccagcaacctgcgcttgtgcctagctcagcaggtgtttgttgagtggaactgaaatcaataatgagaaaatcct

SEQ ID NO: 432 - DNA, 40001 bp, Homo sapiens
ccctgagactgaggcagcctttgtgccctcttttgctgggaattataatcttagtgtccaagagctggacagttagggtcaaagtctgcaacctcatttctccaggtcgctcctgataactcgattcctaggctcaacatgaaagcctctccttccttcctcaggcttttattttttaaaaaattgacgaatgagatgcattaaacgtaagtggttaaaaacagggaggcaaggcagatgcctccactctcctccctccctaggaagccctgatttggtggcttctgagctggatttgtggccagggttcccgtgttcggtttgctagccccagggccctgttgactttcactgggccagcgtccatgtatgtcactgggagaggatggactgggatgttttgttcacccgcctttggcaggaagcagagggtgcccgaagccaagaggctttcctttccaccaggcgctgaaggtggctcacagggatgggaactctgaatccagaggatggacagtgatatgtgctggtccaaaccagaaatccaagcatgactgctgaatagcaggacatgtgattactgtggggtgtttcctaccgattcttagacatttaccatcatttccaaaaagtttttccaaaatctcaaacttgccattctttcaaaaacttttttttaaaaaggaatacgtttgtgggggtttttttttttcatttatagcaaaactccagggacatctccttgtcagacaaggctctattgctcctacaagtagagttcattattttgtcaaagtgaattaaaatagaatgtcacttactgaatgttatatttctggctgtgacattgtatataaaaggtcctctttaaaaaaaaaaagagaaaatctgaaagccttcgttggaaacccatttaagaaaaagaaatatagacattaaaaaatcccatttgggtttcataaaattcctttcaaatgtgacaatctggtagaaatcaggtagttttcagttcccaaaatacaatcttgataaaaaatttataaagctatttggaggaaagatactacataaattgagaataaatcttatgagtcccttagagaaaagctgggaaatttccaaaactaagtggcaaacagtatttgcttcctgcaaataaataccctttttactatttggaatgaatctctttctatattccagcaatttatgtctatggcagctaaggatgaccagagacactggagggtgacagttaccaggactagacgctaaaaaaaagagctgagtggtcccctgcaggccgcatttgaatactccagggtccatatcttctgcacctcagattagttcctgaaaaactgaaaaccatcacctccatcttctggtggcaggtagaaatagacagataaattgaagaatgttttgtcttcttttttttgccagataaattcttcccagagcagagtacttatgactatctgagaaaagaatgaatgagaaattatgggagctatggattcattcccacgtggttgaacttagtgctttccctcgttcttaccatgcacccacctcctttgcttgatgaattcttactcaagtgtttcttctgtcaagattctccttcacatctatgcagggataatcaactctgggcccccaaaatacattgtatagatctctactgtagaacctaaacactgaaatgcacttacggatataagtggttctctaatccattagactgtgagttcctcaagagtagaattttgtttcattcaattctatgttcctaacatttagtgtgccacctagcacatagtaggtgcaggaaaatggttagttagatggttaataaatggttagttagatggatagctgaatggatgactgggtaaattaaaaaacaaatgaatgaataaatgagcaaataaataaaaacacaagtgaatacatgaattcaaaagtggagaaataaatatacatgaacaaatggaccaatgaataaaccacatgtctgttccccacaggtatgtatatatgcatacatatatattaatacatccttcacaacatgttattcattttaaagcactttcccccacattaaaattcatttttaatatccttgggaaaggtaccagtaaattccgaggtaattcactagaggagactcagggatcagagtagcattgtccactggtggggggcaatgttacattacctcttggggattgaccatgatgggtttattgctgaagtccccccacaatcaaggacgtgctccccatttcagccctgaacaactccttggcttattggattggagcctcttaagataactattgaattccaacaagatggttcagaacatgaccatggccatctgtgtatgcacttagtccctgacatctgccttcccccaaggataatgagttgagaggtccaaggcccaaagattgcaggaacttcagcttcagtgaagcctaaatttacataccagagcattgtgattcagggaagtgcacagggcacacaaagtacagcaggtcttgctccaaatcctcgctctggccctcctgtgctgcatggctagcatgacctccgtgagcctcagtttgctcagtagctgagtgaggataataatacctatgaagaaggcacctgtgataggtgcttaataaagtccagtttctttcctgcccaataaaaaaaaattgaaaatagtagtagttgaaggagagaagcttctctttgatatgaggcccttggcattgaccaccgaagatgaggctccagaagggcactgattccacttgagtggaatgttggcaacgctgaatcccaccaacagccccgtcgtttctccagcagtcattctggggttcctgcctcatctcccaagatagcctgtggctaccatcagctgcaaggaactgccctgctgagcaattaataagcaatgaagagtgtcacctggataagtattaaaaacaaggagatgagacaccttggctctcatttcagcataaagcctgttctgccatccttgtctcccaaaggtcaagatcttgctttagaaagtgagaatttagtaagaatgctgtgtcctcggcactgctcacctgtgtccagcagaggtgactggaaatgaggctcccagagcactgtttctgcagagaaaatccagccatcaaacctatgttggcctaaagaagcatctcaatcctggcgggggcgggggggggtcctttttcagaacaaggttgtcaaagccaggaaggattgctaaacagcagggtgtccccatgagagcagaagggctcaggagtcattcagatctgatccaagctgagcaaacgtggacaggtcacactagccaggctagcatgaggtgttgaccttgagaagagagtgcctccttaaattttgcaccctaaatgtctcacttgcttaaccctagtcctgggtcatagaatcttagcttcctcgtctataaggaaacttccctcgtgtatcatgtgggaagatgataatacctaataatagttaaggttattaacattattatgttcgctttacccaaattaactgatttagtcctcatgaggctataaggtaggtatgatgattatcttctttcggaaaacagccaaagtgaggagctgtgctattcaatagtaacttgctaatattctcacatctagtggctggcaggctgagatttgaaccatgggagactggcccctgcgtccagcctcattaccaccatgctacaccagccacagtgcagggtctgtgtgagaagaacaacatggttgacatagacaagaaaacagtgcaggggagagacactttgctaataaactgaggtggtgctcagtcacccacataacatgtaactgggaggatccaaggtgacttcaaccccaaagacccagcacaggcaggaacagtcctggcatgctctgctgcagcagattctggtcctggggtttcctgggcgattgacttctcttccagggctaccatcctgacatcattaatccaggccctgtgtggctctcataaggttcattcacatgcatattagataatacctgttagtgatgcccattaattaagcagagcaagttgtttataattaacttgagaaatttatggcttcagaacacaatacaggagctgatataaacacattaagtgcctacagcaatgccaagtttaattgctttcaagaagaatcattgatattaatgccgcagccatcgctagccatgtttgacagcagcttgtaaattcttcagtcctatgagccaacaacaccccaggttatttggaatgggaaacatcaaccctggcaaactgttcatgatacagtgctaagtgaaaaaagtaggcttgaaaactgtatgcggtgcctttccaatttagtgaaaaatatttttttgtatatgtatttcctcctactctgacatatatacatatttttatgaatatgtataagtataaatatatttccttttagtacaagaaatacaaaaaatgaaaaaattacatatgatgtacatataaaaaatacataaataagtgacagtgggtttttcccatctgatggaattacttactattttaatattttctttatgactttttatattttccaaaaattttataggaagaatttattactttatgccaagaaaaaagtgaagggttaaaggatagaaaaagaaaaggaaaaaaagaatagatttttcttttccaagcaaattgctttttgaaaggtaagcagacccttctgtaataattgtatgtgctacttggttggcattttaagatgctttttatttttgtaaaataaaattttgaaaatagcaaagtaaatgcatcattttcacaaacgtgattctcattgtggggctatgcctgcgctcgttgtacaattagggaagaaatgcagcacccttcaatttttaaaaatatcagctcccgaaaatactgcaagaggccgttggcagaactcccatactgcgggtgcctgcatgttcaggataaaacataacagccagtcattctggacaaggatgaattctcaaaggactcattgaataaacctcctgttgacaagcctgtatacttagaagaggggtgagaacccatccttgccaaatgattcatcttcccaaaatgtcacaagtgaagaaaagggacatttagctaaaagctgcaaatgccctttcagaaaatgcactcccagaatgtcagaggtatccgacccaacctgctccttccccagccaagaggaagtgctgagatcccgtggggtcacttgctagccagagacagtgctcactctgaacacagataggctcccctttttgttaacatttaatgaacaccactgactctgtgtcagacagtggcctcttaggctcttcttaataaagatttgtaagcccatggtctggtggtccttaaagcatagtcactagaatactcattttgttaggtgctccttgaaaattctcccatccgttaagtttgggaaaccctgattgttcttgccactcttggagattcctaatggtatcagcttatcaaagtcttggaggagtcccacagtaaaggaacttgcttatctttgtttgatgtagtgtttcccagactcatttgagcacagaatgcttttggttctgtaacatctctcaacatgttaaactagtgttcctcaaaagacagtgggacaagtcagcaattcatttagtttgaagatgcagaacaactaaatttggagctgtaccagctgggcaagttatttcatccatgtggcatgctgccaggcacagggtaaaccctgaacaaacattggtttgattagttgaatcagaggagacaattaaaacccaaatcagtgaagtaatgagctcaattgcaaactcacaatccaggccattttatttttataacacatgccaacattccaacattaaagtaaaaatgctatctgtaaatctttattcattcaacagtgagttcactctcttacttgaattagaaacatagaactgtggacctggatcatccaatctacccctcactttacaggtgaaactgatgcttacttaagccacatgatttgtctgaggtcacagactattaagggggtccaggatttaagtcttgcaagtctaaatttgggtaattctcagtctctgacctcccacccatgctctcattaccctccacactgccactctgaggtgacataatgcagcgaaaccaacaggacattcaaaatgaggcagatttggatttaaactctggctcttcaaaccagcagcagagtgacattgggcaagtggcctaacctctttgtgcctcagtttctccatctgttaaatgggaatcataactcacttcacgagctattgagaagatagaatgagataatgcatgaaaaagatcactgtcctaaactcagtgggtgtgggagaaattttatccccttgtttcatactattttgaagagctcttgattcctttttctcctcagaatgaaaacccaagttttctctgtagctgtttgtcactctggatggtcctttatatttgaacaacaagaacctttcaatatcaatagaaggaaacagaattaataagtgaattgcttgttgatgaaaaaataatgttgaattctaagggtgtgagaccgagaaaaagagaatgtgtgacttatcccaccctgggctctgttttccaacagggcttgtagatatagaaagcaggtcacctcatatggagggaccaagagccatcttttgactgttaccttgtcgtttgctctagcccagtgggacagccttactaatgggttctaacgtggacataggcagggccactggtgcaggcagcagtgcatttccctagaagagtcattaatttaaggctggcagagggcttgcttctcctgagagccaggcaagacttggagcattttgcagacagctgggccatgagcaggccttaccaaactctctggctacagcacaagaagcatttatttatctggctcctttgagacaggcatcttactttcgacatgcaaagaggcagcctcccctccacagtccccttgtcatcccaccctctccatgcctttactccaggcctcatctctcattcggtccattgtgccaacctcttaactggccttccacctcctatctagcccctttcctgttgattctctgcagccagagccatttttccaactgctgacctgccaccaatggcttcctatggtttctagaaaaaagtccagagaccttactctgacatttgggattctccaaatctggccagtgttcctttagccttactggaaattcctctcatatgtgcctcctttcctccaatcatactgagcttcttgacattttttttttctatttcataccctgttattttaagtctctaagtcattgcagtggctattttttctgagtggcattttccccttcttcttcatattcaatactcagttcaaatgtcatctctttgatttattcttcttatactccctaaaattaatcatcctctcccttggattgtcacaccactctcttcatactctttatgaacaattgtaaaaatttccatttccctctccagattatgagctcctttggtgctgggcctgtgtttattcatttcatcattccctgtgcccagctcagtgactgctcaataaaggaatggattagtggatggatgggtggatggatgagtagatgaatggatggaagaaaggaggaaaagaaggaataaaggaaggaaggaagggaaggaatgtgggagggagggaagaagggagggagaaaggattagtgagtgactatgtagatatggtagagagaatgtatcccacatagatttaaatgctggagtacagttaagaacaacagttttgactgcagtggggaggttgcagctgatgttgtgataaaacaaaaggaagttgaaatataaaatagaaaagcaagcttgtttcttccccctggagagctctgggctttggagaagtcataggaatcacagaggaaaaagagaaaaggaagtcattctctccctgccaagactcaggggacagaaagcaaggaaggaatcaggctggaagaaaaccattgcaacagagagggtgagtaaaagtctaaaccacagagacaaattgtgcattttgctacccaagtcacaaatattctcctctagcaccgataagtgctctggagaactccttgtgtctaagcatcactgagagagaattctgtgatttccatagaagcaagttacacctgtgggtgcaggtaacattggttgattaatttgtttgttaatatctttctcaaacactgactgtttgcaagtgggagctctgggttgagtggaaggcctttctcctcacacgaatggagctttgagctgagagaagcaacccatcttccctgacagtaggacctgaagagtcgaacacaacactgtaactgtgcttcactcatccacctggaatactaggtattgagacactgagagtggagatctcactccaattctaaagaattaaaacaataaaatgggacttgagacaaggaatttatttacaaagtgtttcctggctattgagagagggacatgcttgggccagacagattcggtagctaaaggacttaggtgttttggatctgtaattaagagacccaacacaaaccctaatttccagcctttcagatctgggaggaaagggattttgataaagacccctggcctctttattgtagaattcattagttcaactaaacacttatgaaacattaactgtttgccaagaattgattagggcactgggagcccctgctctcggggagccctgtgggagaagggtgtgccaacagccagtgtcatgtcatgtggccagggctctgatgagggtatggatgccagcagctggggcgcacggggtgagatgagggtgtgtgcctcatattatgtgggaaatcattaaaggcttcacaaaggaggaaggcttaggaggaggagagtttaccagaggaacaagaggaaaagggtgttccaggcagatggattagaggctgggggaagatcagcacaaaaagaccagtagggagtgtggaaacaatctggatgtgagatgctgggaggaagtgtactggaatgattgcagcaggagtggagagaggaggacggattggaaatacttttaggagatggaattggctgggctggatgattgatgggatgtgagatatggcccaggcagagtcaaggatggacttttgtttccaacttgcatgacacttgcacagtgatgggaaaccagtgcggaggatcagacttaggggcaatacagagaatgcagatttgagtgtgtgagtttgctgagtcttggaggaccttcaggaggaagtagcaggataaattgatctggagttgaggacaaagggcaaaatggagacacaggcttgggagtaatccatgggcagatgacagccattgggaaatacgtcaggctctgatgatgtcctgtgaggtcagcaaccacgagtggggaggttgcaaggcctggcgcacaaaagccttcgtttctgctggtccatttcttcaagtgtgtgtttgtcaggccaccctgctgccattgccactgctgtcacccacctcccctgcctcttgctgccctggcccatccctactctgagtggccacagcatagtcagagccgaaagataaaaagatggcaaacagagctcaggtggccagtgtcagcattgcaatggcaatgcagaggagctcaggcagcctgaacaatggggccactgtgtcacaggcctcctgggtggaggggctagaagtggcctgctgccaactgctgaaggaggtttcttctgtcattgaggcgttcagcatggcaggatttctgaactggagaaagaatgagtccttcaccatgggtctgagggctgcaggtggcttttcccatgtattgtttcaaaacacactgtgggcaaagtgtggcaggagagaagccagcctgcttcctgcatcctctcttcatgggtttcatttcactctccacaggaagacccaggcagcaagggctgggggcttctgtgccaggagttgtgggcccagaaaaggctggcactaggggagcgggggacccaagggacatttgcactgaatcctgatggccctgcctctctaagattcaagatgctcccatcttctgggtgtccaaagccgaggtggcaggagggaggcctgggcatgtgaagtggaagcctgtgccctcatccttccttcagctttcccacaagggggaccactaaggccagccctgggaggtgtgatttccagcccctgcctctgtatgtggagcatagattccttaaagcaatttcagatgtgtgttcgtcagactgaatcagttttctttgttcaacttcagacacattgcctactacttcttggaagagattgttgcttgagaagaaaaactacttcagttaggaacaagctttgctaagatttgttgaatttacctgtcctaaaaaacaaaaacaaacaaaacacacacacacacacacacacacacaactagctatggatgacaactcctttggcatctcccaggcaggtaaggcacaccgagcctaagggacatgcctctggtccctgctggtgattgtcagagcaggccactgaacgctgttaaccactgtgatggttaatactgagtgtcaaccgtattgttccttcaagaatttagggtgtgtgtgccttcactcaccccaccttctattcaccccaccatgaaccttaaagacacaggcacccacatatcccacagaggatacaatggcctagaattgtctattggcctggccaggatgggctctgggggctggaccaggtggaaggcaggatagaggctgattgtattagtcagggttctctaaagggacaagactaatagatagatgtatatatgaaggggagtttattaaggagtgttgactcacgataacaaagtgaagtcccacaataggccatctgcaagtggaggagcaaggaagccagtccaaatccccaaacctcaaaagtcgtagggaagccaagaggtcagccttctgtctgtggctgaaggcctaagagcccctggaaaaccactggtgttagtccaacagtcccaaagctgaagagcttagagtccgatgttcgagggcaggaagaatccagcatgggagaaagatgaaagccggaagactcagccagtctagtccttccgtgtctttctgcctgctttatcctagcagtgctggcagctgattagattgtgctcacctagattgagggtgggtctgcctctcccagtccattgactcaaatgttgatatcctttggcaacactctcacaggcacacacaccctcaatacttgaaggaacagtacggttgacactcagtattaaccatcacagtggttaagagcgttcagtggcctgctctgacaatcaccagcagggaccagaggcatgtccctgaggctcggtgtgccttacctgtctgggagatgccaaaggagttgttatccatagctagttgtgtgtgtgtgtatggtttctttttttttttttttttttttttaaggacaggtatattcaacaaacctggggtaaagcaggtggatctacttcctgtctacacacaccctcctgcctccctgcaccacacatacacacagtcagaagctgccaccattgggctcccttaacaagtagggctccagagtacaatacaagttaaaatctaagatcgaggaggggcagcttttatgggctcttactgtggggcagacactttgctgtggtattttacaccttatttatctttcgcagaattctctgcagggcaaggattcagagaggcgaagctacttgcccagagtcactcagctagtaagtggtggagccaggatttaaactgttcacttaagtgaacagttgaggtctggttcccagtgatagcctcttgctgtctccccatgctgcctctgacagagcgtgaccacaactgtgcactttgtctttgtctgacctcctgcagtcttggctccagccacacctgtgtttatctggctgacttgctttcagcgcaagcaagatttctaatgttctctcttccttcttggattcctgtcactcttagttttcaagtcagctcagtatccagagtgttgtcctcagaactccccctttagctaactccctgtcccgtaccgtttctgatgaactggtgatttctctgactctgtcttagacattatgttcactttccactttccagctaccagttctccacttagttcagggtcatattcacaactgtcctctccatctccagctggaggaagctggcacttacccaggggctgacctggcaagtgtctcaagtctgtgtcctgtgtgggtttaggacacaagtcagctaccaatggctgtttgtttttccatgtctgaagagaaacaccttggggtaatgggatagctgctgagtcagggctccagtgctgggtgagaaagttccctttggaccgaactagctgaactaatgttagaaatatccgcttattcccatttctgggccctcggcagtgcgttttctatttccccacatctatttctgcatgcattttatttccccacatttgtctctgagtttggaccagagagtttgacccttctccaatcctactcttatccttgttgagagacttccaagtatggccccggctgctgctggtccatgatattgtctcttgggccatggaaagaactagcaataagctgatgattgacactctccctacatgtctccccctaccttcctgcccagcctggtgcagctgcaggatcgggctgtgggtgtgttacagatgcatttggtaaccgtctcctctctcctctcacccctcgcccctccacgccatggcttccctctgcaatatctgcaactctctgcccaaggaggaggctggaagtactggggagctgaggcccctgggagcagccatcagccagtgatggacggtcattggaggataaacacccggcttcctattcctctggtggggcagccgtgaagtgtgttccgcattatcaggtgcccccagtgagcgtccccccagtttctcacaacagcagcttgctcatttgctcacccggagttgactctcctcttctccctgtcttatttcctcactcccctagatgaactgtaccaactacttgtactcaaatccttagagtctgcttcttgtggggaggggagtccaacctaccacagggtcctacagccaatgtccttgatggctccagcttccattcggtgccttttcaatgggaccacagttcacaaactcccacggtggtttcaggactgagggcacataccaaaactccagtgagcgtgggaggaaaaaaaaaatatattgtttaacataggcatctttcatggaagcaagttatggagctaataatactgatagtttcaatggaccaaattaaattatgcttcccatcttgtgtcttaattaaagggataaaaactgtttcacattttaattagcaagtaagtcttgaaaagactgaaattaatatgggagtcatcaccataggagagtagccctctgccaagattcataaggccagagagagcacagagaacggaatgggattctggcaggaatgagagcagccactgctggaactcaaaaactttggtttcttgaattttctgaaaggataaaagcaggaacctggtagaaggcatgccatttccttttctagagaggtccactttctccatgtgaatcttctttaagacacttaaacatcgcatctagagactatgagagtatagaggatggtggggacagagaatgcctgctaatgacagctctgccttgcttcgcccatctcctgggatgtgagttcctggagtttctggaagccttgttggcagagcctgaaaacaaggggttctgcctcacagttgtctcaagtccgtgtcctgtgcaggtttaggagaggagccagcgctgatggctgtttgttttccctctgtctgaagagaaaaacggtgtgggagcaaggcttgcatgctgctactgagtgttcaagtccttccacagccctgttggcacatttgtttattttttttagtttgactttaaaaaatttcacaagtaacacatacttgggaaaaacaatttgaaaatatatatgcaaagacgaaagaaacaaaacaaaaacgtaatcccatcacttcagataacgtgttgatttcctcttcaggtctggccccggccctggtcccgctgcccctccacccccatgtatctgtatgtattagcagttatatctgctaatgtatctgcagataacgtgggggtggcggggtcggggagtggggtctggcgctcacattctcctgcaactgctgtttctaaacgcttgctccaatctccatttgtaattcgctctcacgtcttcccgtggctcctgctggctcttccagcctattctgattcactccatttcaaccatgagcaagccccacctccttcatttcctagaggcaagttaatacaagtctgttgtacaatgacctgtattaaagggtttgggtaaaacggaattgcagctggaaaatggaagattagacaacattattcctgccactctcagctgagcccaaggtcctgctaccagatttcttggctctgccccctctccccagactctcctcccatcttctcacttcttggttgtcccatgttccccagaacacctttctcttgggtgcccaggggatcgtgagaggcgtttgaaccagaacagctccatcttgaatagggcctgggtaagataaggcttgagacctgcttggctgcacgtccaggaggctaaagcattctaagtcacaggatgagataggacgttggcacaagctgcaggtcataaagaccttgctgataaaacagacttcagtaaagaagccggctaaaacccaccaaaaccagcatggcgacaagagtgacctctgttcatcctcactgctgcattcccaccagcactatgacagtttacaaatgccatggcaacatcaggaagttactctgtatggcttaaaaaggggcggcactgataatccattccttgtttagcatttaatcaagaaataaccataaaaatgggctctgtctatggagtagccattctttcattcctttactttcctaatgaacttgctttcactttactgtatggatttgcctcattctttcttgtgcgagatccaagaaccttgtcttgaggtctggatcaggacctctttccaataacaggaccactctagagatcctattactttgttgtgctaagtaatttagttttctttttgtctcaatgtcttatatatagactagcccatggccttccctatcatagccaaaaggccagggattttctgaatcaaatagacatctactatagagatgaatttgccatccttctggaaggcagaaatagtggagtttttaattttatttattttattttattattttttccttcccatgaaataaaaaagcctttagtgactattctttaaattggtgtgtgagatggcatgcacaacctctgaacaatattttggacttagttcttagaagtgaaagtctaggtgaggaaatatgaccaatttcaaggcaatctgctgaatggccatgcagaagaagggctcaccctccctcctgcagcatgaagtgagagcctgtttcctcttatcctgactagctttggataatataatttacaggagaaaagaattatcccctttgacaggtacaagtcatgcctgcatgttgatgtaatttggaaagctgttttgaactgagtgtggtcagagcctgggaagcctgagccctctatggaaacccatgtgtcacctttttcccaacaggcttccaaatggaatcttaaattctgcacggccatttatcagagtttccaaatgccactttccaatttgcatcagatcttttctacatattaatatgattatgttactaaggtatatgtttttgctgttctaccaaatttgtgtttgaaacactaatgagcctacaaggtgagctagctccctggggaaaaggattcatttgcttctacttgtggatcatgagggcgtcctgagaggggcacgtggagtcagaatagtctctggcagtccactctttgtcttctgctacctctgctgctaaatgttgggtccggcccaattctttttttttctttgagatggagtttagctcttttgcccaagctgcagtgcagtggcacgagctcggctcactgcaacccctccaccttctggtttcaagtgattctcctgcttcagcctcccaagtagctgggattacaggtgtgtgccaccacgcccggctaatttttgtgtttttagtagagacagggtttcaccatattggccaggctggtttcgaactcctgacctcgtgatctgcccacctcggcctcccaaagtgctgggattacaggtgtgagccaccgtgtctggccccagcccaattcttgacctctaccttctcttgctctgggcaaggcctgctagttcttttttttttttttttccccactcaaagacaatggacttaggttagaggggttcaacccattgctttgcccaggagtttgtgtgtgtgtatgtatgtatgtatgtatgtatgtatgtatgtgtgtatttattttgagatggagtctcactctgttgcccaggctggagtgcagtggcacgattttggctcactgcaagctccacctcccaggttcatgccattctcctgcctcagcctcccaagtagctgggactacaggtgccagccaccatgtttggctaatttttttgtatttttagtagagacagagtttcaccatgttagccaggatggtctcgatctcctgacctcatgatccacccgcctcggtctcccaaaatgctgggattacaggcgtgagccaccatactcggccctttttttttttttttttttttgagacaaagtctcactctattgcccaaggtggagaacagtgatgtgatctcggctcactgcaacctccatttctcaggtccaagcgattctcctgcctcagcctcccaagtagctgggactacaggcatgcgccaccatgcccggctaagttttgtatttttagtagagatggggtttcactatgttggactggctggtcttgaacttctgaccttgtgatccgcctgccttggcctcccaaagtgctgggattacaggcatgagccacggtgcatggcccgcccaggagttttgttggcggtgggatccaggacccagatctaagttaggagtctttgcagaggtgattcaggccagtgagagcctgatggtcaaactatagtccaagttcttagagaaaacttttcccagtctctgaacaactacattgctttgtcctacaggggcctgttgtgggtgcctttgagtgtcattcctggagcaggcttccaactctgaacagtggtttggactctaaaacaagcttctggagcatatactgccacccattctgtcctctctgctcctgctcttcccaaggcctgagcatgaagacagatgtcactaccagttgggtcactaccggttggaccttagggatgcggggtttgttttgcccactgtaaactgaaggcagtgcaatggcttgaccatgggcctgtcctgctgaccatggggccccctgcttggtgtcagtgctgcctcagacctttacataagcctttccttacccagtcattcacgaggacctgccatcccttgaaggggagccacagcccccaggatgtcagcccagggtaggcaacctggactccccttattcatccccagcctgcttccaccccagaccccccttttgccccattctgaattcttgactccacattctgattttgattcagcgttttgagacttaggacttggcatgtgtgctttgtctttcaggatctaagctttctctggaactctgatgggcatctgtttttcagcttttcatgctccaagatgctgcaagtggcaattcctgtctgggctcagccctgggccctcagtcagggcctctgcaaggccaatgccaggcttccctcatgtgcaggggtgcttagcaggggtggcatggagaggaaaggtgaaagaatcccctcagctctgtgtcagagaagctgaatgcaacccgtggacagtgggtcgatagctaactagcccatccttccaaatcctcatgcccatccttccaaaggtacagatgatcaatgaagaaaaaaccagaggcataatctcccctttcctgccctatctgtcaggccacacccccatgacaggaacctcacacagcttgggcctgctcctgcctgccccagcccttctcagcagcagacatcaaagctcttcaccatcaagaccctggatcctctgtgaccagagggcatttgaaacttcagccaattctccaagttgaagaaggagggttttgagcttctatcatcagtatgcagttcctaaggagaggctcgggctcttaatcactgacccaggaccagcctcagcccaaagccagtggatggctggtgtttcctggtttgaccttaattcttatcagcagtagagcctgtatttgttttccagggtttccacaataaattaccacaaactgggtgtcttaaaacaatcaaaatctattctttcgattatggaggccagaagttcaaacccaagatgttggtagggttggtagagttggttccttctggaggttctgaaggagatgtttcttctctagtttctggcagctgcagcaatccagggtgctccttggtttgtagacgtgtcattccaacctctgtgtctgtcatcacatcaccttctcctctgcgtgtctcatctccccttctcttctaaggacacagttcattgaatttagggctcacccaggtaatccaggatgatctaatctggagatctgtctttgtttgtgttgctataacaaaagaccacagactgggtaatttataaataatagcaatttatttctcaccgttcagaaagaagtacaggatcaagtagccagcagattcagcgtctatgaggtctactgtctctgcttgcaagatggcaccaagttgctgcattctctagaggggatgaacactgtgtcctacatggcagaaggtggaagggcaaaaaaggggcagactccctccttcaagcccttttatcagggcacctaatctcattcacggggacagaggtcttatgactcaatcacctcctaaaggccacatttcttaatactgttgcattggggattaagtttcaaaatacattttggagggcactaaatgttcaaaccataggaagctccttaactaattacatctgtaaaggcctttttttccccaccaaatgaggtcccattcacaggttctaggggctctggccctttgctgatttcttgctccagcctgtgagcctggctaaccttatttagctccaaatctcactcacgtctgagttcctccagcaataccttctctatttgttgaccaaattctgccctgaatgtcagaattaattcgagtttattataccccattagacacagaataatgaaacactggactctggctggcaaaatcaggacacaggcagtggctcagggcaagggcgtgtgctctggcgtgagacaaatcttggttcttggctccaacactcactcccatttctgagtcttggtttcctcagctgtaaaatgggtttggatgatgatgcttttctcaaggttggtgcatatgtgcacaaggcccagggcatgaaggatggcataggggtttcttgcccgttcccttcctttctctttttcccatccaccctatggagtaagtgtctttgttactacagaaaaaagaggcagggtccacaatgtggtaatattgtaatgtgttaatgtcacagagttatgcttaagaggaaaagatttccctcccactcctggtacgaagtaagaaataagatagaactagaaatctatggcccaggaccctgagaattcagagcagggtgaaaagatcaaggcatttctggaaagagagagaagtggcacctcattagtcattcaagacagattctgtgtgaagtgtttactcttataatacagcacctgcagaactttccagaatttacaggcataactaaagggctgcaggcaggaagtgctcagtgtcttaattctgtctcctcctaatttcttcttgtggaccagcactctttgtcctagcttcctctcttgcacaccaagccactgctaagtcaaagcttgccttttgatcccatgatagcacagaaatcaaatactcccaacatccccttatcctcctatgaacaggccaatgcagcgccccatgtgccaaccttaaaagccacagttgcaatgactggcaggaaggatgatgattaacacagttattgagtgaacagttggggtgagggtgaagtttaatcattggttagttttaattgcagtctatctctgattatgagcatcacacagtgcatattttcagtcatgtctactttaaagcaaaattgagaaataagaaggcttatcattgtctgacagtcactatggatttctgtgatgggtgagtttagtttaagctagtcacagttgacaatgaatatgcaaacagattctaatgaagaccttttctcatctccctacctcattgtattatgccacattgcagagtgtgagtatctctctcccatgcgcaaccctgagtgcctgctggcctgtccccaggttgccttccccaatcttccaagattattcagagctcaaatcccttagatctaagcccaggtcagcttttcttcacaagcgagagagcatccactcgcacagccctctgattaattactcgagttctgccaagggcctttttgtggatggatgggggagagcatgtatccctttaaacatgcttaattaagctgggtgaaacactggactccttagcaacgggctgggccttgaagcaagtcttgtggcatatttgcacaagatgctctgtgtttgcccatttgaaatgggatcgatctatctggaggatgcctccatgtcttgtactaggacattcttccttggcacagcaatatggccctccctaggactctccttatagatgagctgtgattctactattcagagaggttggccggctgcctccaagcaagggatacaagatgtacaggtaatagtgatgctattcagaagtgatatttgacatatttaataacagggacagcacaggctctggccagtcagaacaagcaacagccataaaccacagatagagctgttctggtaggtacttgctgaatatcagctgtggaaaaagttagagtttacatagagcttcacatatatttccctgtttgatcatagccacaaccccgtgagagaggtttggtactttcttaattttagagatttcccaattctgaggttcagagaggtcatatgtcttccccacagctgcataggtcatcaaagagctggaagccaagcaccctcctccatgttctttctactgtaccacgtggcttgtgtcgatacagacccttgggctggaccaatcctggaagatcaagagctgactggtgagcccagggcaaaggtggtgggggtagggtgagaggtgcaatgctctgggatttgtagaaaagtcagggtggagccagtgcccctttctgtaccctccactcacatagcactatgatcctataggaggctcgggttaagaaagggctgcacagagtcaacacagagaggagcattcttgggaaacaaggacacggttgtttatttgggaggtgatccccggaagcacaatgatgaagtaggcaaggttagacatagaagacgaaaaaacaataaagtgaatgctctgatgaatgagttacagtcatgggcaactggggttgatccctggaagctttctgaaaaccatgtggcccttgcctcaaaatcgagccactggaggggcagggagcctggggcacttattcactccctgccatacccaccccgggcattaactcccccgcatgtcacggtggtgactggccactgagagcaggctctcaggcaggatgccagccaggcagagaggagggacatgcacgggggtgagagctgagatgtcctcatagctgcaggtaaactcaggtgggctggatatgggatggaggctccacagcatgtgttacactcatgaatccgaatgacagtagaaaacaggagacaggcgttcaccattgtgggctcattttctccaggcaagggaggaggcctccatgtttcaggtatatgccatgcccaagacaatgcttgatgttttaggaaactcagggaatgtgtccctccatccttttgctatgaaatgttagcatctggacttgcctctcccccatcctctgacttatttggggaacctctgcagtgggagggagcttgctttttgctctggtaggaaatgccatatcctccctaccaccaactgaaatctcccctcccttctatggcccccaacctcacaccaatctgcagctggtacctctgccctgccagagggtctggtggagacatctgacagatacagaatgttttaatttttgaagccattgatctagagcatgttaacaaatggcacctgttggtccaaacgttgtttgccatccatcttgtcttatctgagcactgactgcatctagatgggagctatgtcagtcctcagggacagattgctgtgcagggttccaccccacagccaagaggaattatccctccagcctaagaatgacaagggcagtgcctctgtgagtggctcaggggccaagaatgggagaaagtgggaggaaattgcccgggagtggctaagaaaaaagtattttcacctccattctaagggtcagtctcttggtacatctcagtgatacgctgaagagattggactgtcactgacaaacctcagtaggtaacttcattgctgtagtaagtgctgagccagggggtcatcagcagggggtggagtagcctttatcctgttgtgtgaacctgggcgtatcatttgtcctctctttcctttcatcacaccatctataagatatgcagagaagtctctgccctgctccatctcattaggctgctgaactgggttgtgcaggacagcattagaacaagtagaaggaaccatgggaatgcattttatttatgaatcaatgtaaatgagtcagagtgaagaaaacctatgcagggtgggcacagctgggcacaatgactcacctacagccttgaggtaggattggtgatgtcaacccatctgaatcaaggcacagtctgcctgcagaagggatggggcctagggagaaactgggcttcagagaggagggttgttagcctgttcccagctctgcctgagagatgggtgttctgctttggcgtgaggacaatttctagatcttggtaaaaataatctcacttcttaatagccctcttgccttattctgacataccaagcaagcctcagaagaatgttttggcctcctcaggactataataaggtgtcctggtacagtgggcattggttgggtttgctgcccagcatccacccctgcattgtggtgcccatatccaacttccctctttcccctacactcagcccttgtgcttgggaggcaccaactcttggcttaggggtggagcatgtgatctaggcctcaggcaatcagaatgtaacactcctctgctggtcgcaaggcttggctcagagttggctatgtgacctcattagggccaaggagatgccatgagatgcatgctgaggcttccagaggagactcttccactcctgccagctagacttgaagctgggaagatgggatcctggaggcaggaagccatctatccaccatgtggagcctaaatcaacaaggtagaacccagagaaggaagaaattgagtcctgatgataccatttgatgcctgaatccagctgtacctgaaactagatttattccctggaactttcagttttgaaagctgataaattccttttgcacttaagtcatttttgaattagaattcctgtctctggcaactgaaaaaatctcaactgaaatgcctggacaagagacagagcactgcagtcacctttaccaatcattaggctggcattcccactttacaatgtgacttttgaacctggttatgtgagtttgctgctgaaaaatgactttggggtgcactgcaaaatttcacttgctaaactcagatggctgagaacctggctggggtacaacccacccatgaaagacacttcttgagaacttggttggggtataacccatctatgaaagtcccttcccgagtggccatttctggcactgagtgacatctctgtggtcactgtggttggtaccttatttgtgtcttctaatcaccaatgtgtccctgtgaacccccatccttcatgacagggctggggaagacagcaagtactagctcacatatcactcatccctttattcattcaggcattctttatttatcaaataagtgaacaaggaaatggtaataaatccagttcgttgactgaggtgggagtaatattcgaaatactgcattttacaaccagtgtggtctaccacagaagctgtagtacctgaacatttccatgtgagggcgcctccgggggatgctggcctgcaccagggaccttagcccagcccagcatacacctacaggggagtcagtgccaaatgccatcagggaactgtttctcttcagggctctggccaggagacatgtgagcaaggaggttggctggtgcatgtctggggtcatcgagtgagcacagaagtatttcaatgttttaacagctggtatggctttactggtgagtactggctgcacatcaggcctgaacgaagaccaggttttaaagggctttgcatgccaagttgagaaagttttattccatcttgaagacaatggggagtcactggggtattaaggagattggcctgaccagatctatgagataggtgcctacttctagtgacagcacaggagatgtctggatgagggacaagagacaggtaatctggaaaggaggctggcaacagtgaggcagctaagggtggggtccatgttggaacagtcttttccttttagggaccactgaaccagatgcttggaaggccatggtattgagatgatgtgtgtggtctagttgagtttctgtaaaactttcgtaaacttgatactttctctgacgatgtgggttaggagccagctattttacgcagttcatttactattgtatttaggaagttcctgaacactcccaggaagcctgcccttgcaagatatcgcccttcattccttaactcagatgctccactgggattctgagaagcttcaattcactgatatacatcggtgggagctgctgagccatttaagctttgactatctctacttgaaaggcatgagataaagttttccactgctggagaggagagcatttaagtgacttaggctctcaaccaatcacactcccccagcaaccctgagagggtccttgaatgttaatttcatgattcaaaataaatggatcatcaacctttgggaaattcattcatcaaacatacactaagtccctactatgcaccaggcactagggaggataaatgaagctgcaggaaatgccagaggtttcctttgcttctttcacacatcacaaagcacatcatcagctcacagatgggagtgtgctaggcaaatccaatgtccctattctatttccccaataggcaaagcactctgtgcacctaggcagagttagtggccagagcagctcaggagctccaggaaccacccccttcctgggtctgcttcctccatttccctaaggtaaatcttctttggcacccaaagtctgtggttccaagaagccacaggtcaaaacaagcactagtgtgccaggtcacctctgttattcccagtgtcggagaaccatgctcccgcaaagatctttaatatggaaccctcagtggcttctgcagaacttggaagtagtaactatgagggctcaaatcagccactcagcccagaccagactttggctttggggatggtattgcaattaattatgcaatatggttctttgctgataatccccttgctgctgctgggaggcagaggcaaagctgcttcttactagagagctttctttttaatttaaaactggactcttaaaggagcaactaactcttcttgtatgtactgaacatttagaaactaacattgtaaaggacagcttttcaacacaaaggtcgagtagtttcatcttatagaatcttggaatagcctgtctggctaggtgtggatgtcgggagggggactagtggggaagaattgttgagaatcaaaggggaaatagagggagactgaggatgggacaaggaggaggcaaactcaggaaggattctaattgtcctgagggccagccttgtcgatggcaacttctctgaaggcacccagggatgctgaatggcctaataagaggaatctgctggcaccctaggttagagttaatgcttgtaagagctaatacttagggtgcactattcttagttctttgcctgttttcattaatttaatcctcatgacaacccagtgcgattaattttattattagtagtaccattttccagatgaggaaacagaggcagagagagggtaagtgattttctcaagtctcggagctggtgagtgctgaagctgggattcagagtcagggaatcagctcaaaagtctgtgctgataactatggtactaggaagaggtccaggaatgggtccacccagatccagctcgatgacctgggccagttacttggaccctggatttgttttcacctatacactgggagaggggtggagaagaatgagttgtggtgaagggtaaatgagatagtgtgagggaagagtgccttgtaggctggagggctctggacacgtgttcattgtggttatttagttttctactgggagaggagaggaggcagagagattagcttttccaaggagcacccagcttgtaccccagagactccaggatctttggagaaccattgaagctagagaggagatgaaggaggcgggatagaaggactccagggaggagaggggagcctggcattcgacccatttcaggggtctgtttggatgcagagatggggttgatgtgcccacttccatgcaaggtcccacccatggagctgtcttggggcctctggacattgcactgaaatcagccacaggagctcctatgctgagctgggctcaggcctgctatcctcacccctgaggtttccagatactgccctagggccctttctctatctctgtttgctcctctcaaccctccttcgcattcatttccaagaccaaaggaagctcagcctgcaacaggactcacagcactgtgtgttccgctgcgtccttccccttgtcaggcatatttgctgcatcgtcgctccccctctgtcctgagagcccacccagcacagggaacttgcttattcccagaatgaggccgggcctttccttgagcgagccctggacatgtgtttgttgaatggaattgaggagcagtctgggaggtggccagagccctccttccagctccactgtgtggctgtgggtaagtccagggatctctgtgagccacagtctcctcctgatacagagggatggattggacaactccgagggcccctttagctctgactttcccagggttccagggatggaagggcccgaggtgtctaagaggctgtacacgtcattgctgtggcctcagtgggccagactgtgagcccagcccttgtcgttaatgcctgttgattcccacaggtggctctgaggagtcatttaggaccccgagtgggcagaattaacaccaactttattcatctggcaacaagagtttggttggcaataaattgcttctccaatgagagcataatcacttctcatcagattagtcctcgccaggagctgttctgaaatcctttccgtgtctgatgcatacagctctgactccgaaggaaaaaaatgaaaaacaaatgagatgaaagaatgatgaatttgataaagggcaatgatatctgggggcttttcctcctgcagagaagctcggaagtggggggcgggtgacaggtcattcgaagaagtctgagggggtgcgatcagctgctcccccatagtctcactgctaggttgcatgaaagcgagtcccagagccagtttctccacacacagacatttatgccctggcaaagcaggcagtccagcagttcctacagcctgttctgtgagtccagggaagtcccagctgtctgcccttttacatccaacctcaccctgcatgtgaggatcacttgaggtagacatagcaaaattccagacatgagatttctgtgttcttgtcaacatcagacaagcagaaagcctcctaaaccagtggccagacccagaaccctgcatcagggtcacaggtacaggcttccctgagttcttaggtcctactcaagcaaatgtctctgaaatattttcagccagtccccaaatcctgagcgccttttatttcaccaatgaaagcttgctggggtctgaatgtttgtgtctccaccaaattcatgtgtcgaaatcctaacccccaaggtgatcatattatgggaagtggggcctttgggaggtgattaggtcatgagggaagagctttcatcgatggaattagcaccctcataaataagatatcagagagctcccttccccttctgtcatgtgaagacacggtgaggagaagaccatctcagaaccaggaagctggacctcaccaggcactgaacctgctggtgccttgatcttggacttcccagcctctagggtgtaagaaataaatttctgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtggtggcgggcgcctgtagtcccagctacttgggaggctgaggcaggagaatggcgtgaacccgggaggcggagcttgcagtgagccgagatcccgccactgcactccagcttgggcgacagagcgagactccgtctcaaaaaaaaaaaaaaaaaaaaaaaaaaaaaaaagaaataaatttctgttgtttgttagctactctggttatggtattttgttacggcagcccaaacaaagacatcagtgtccacctccctagtcaatggggccactattttcaccaataaagcccatttttgacatgccttacgctagcttgtggccttagctgttgattgaaagacaaataacagtgaagtacttacaactattgcttcttgtgtgggcttcctcctgagtgtgcacaaaagctggtggccctcggactgaggattcttgattagggcaactgtccctaaaattgagttcctctctgtgctgaaatatttgaaagtaaaaaagaacatcatgataagacaccataaatgggagaccttgtgaccctgcaagtcgatgcctttggagagagaaagtaacttactaaaccgtatctcatacatagcttagagattctgttaccagctggattcaaatcccaaccatggaccctgacctcatcactagctaaccctctgaccctggccacagacagagccaccaaactctccagagacagaaccccaggaaccaaccacttcagccgcagaggagcccggcacatatctaaaacagcgcgtgatcataactattcagccacaagacgagccttcaagccagcctgagctcccttcataaatttactttgatttgaattttatgtcagtcatgttcttgagagagaggtgaattttcacctccttaaaaggcataccactaattcaggcctctgggagttatctggttagagggtaggaggggggtgtttacttcctgtaaatatactgcctagatttttggcacatttgaggatgcagagacagtttagcattttaaaaaagctaagctaaagaatatgtaaagcatcctaataaaaatatagttagagcccaggcgggaggaataatcattatattaatgcattgggcttgaattcccacaggcactttttgcttatgtaaaaatccttccctcttgttactggtctcaggaaacggcaatgtatttcctttttttttttttttttccgagaacattgggatctctgagtctggtttttgaagttctatcacagcttttatttatgaagcaaggcatacttgcttcataaataaaacaaggaacaatactgagttttggaatcagacacccagagttcccatcacggctctgccaccaactaactatgtgaccttgggctctttaacctctctgaacctcagtttctaaatttgtaaagttgggctgctaaaatctaacttatagggggttatgggatgatgacaccgatcagtgtttataaagtacttgtcatttggcaaatgctcagttaaggggcgtcactaacagtgcaaggccaacccatcagagaggctgtatatggaaagagcattacgaatgcttccagctgggtatcattagcagttctattctgaagaataattattcgtgacccttggtggacctaaggcctggctgagtgtggctcagatctggggcacagtgcttataatacttggtcattttgacccctcattctgggtactgtcacataaatgcagagttgcggtcatgaagtgggagccaaaaggagaatgaaagtagcgccccttgagtgaagggattgttgcctttatttcccatggtgctttccaaacttaaatatgcatgtgaatcacctggggatcttaagcagctgattcagagtcaataggtctgggatggggcctcagattgtgcatttctaacaagctctcaggggatatcaatgttgttggcccaattgcaaagttctaaagcagaagttctcagcccaggctacccattataatcacctgaggagtgatttttgttaaaaagcactttaacaaaaatacttattctcagggtctatctcagagaaattaattagaacctagggaaggggaatggtaggcagggtttgggttggtcaaaacaactttgagtattttccgttttaattattgaccaaggactgctgatggtctgtgatattgtttggccatctccccacccgaatctcatctggcagttcccataaatccccacgtgtcatgggaggcacctggtgagaggtaattggatcgtgggggcggttacccccatgctgctgttctcgtgatagagggtgacttctcatgagatctgatggttttataaaaggcttttcccccttttgctctgcacttctccttgctgctgccctgtgaagaaagatgtgtttgcttctccttccaccatgattgtaagtttactgagacctccccagccatgctgaactgtaagtcaattgaacctctttcctttataagttacccagtgttaggtacgtctttattagcagcgtgagaacagactaatacagcctgattttgcccacatctctacattcagccataagcatctggtatggaggcttcctttggccctgaaatgccatgctgcagaggggacaggtaatagggtggccatggtcacagcagtagtcactccagctctaccctgcagctgctgcagcccctttcccttggtctgcaaccccctcccatgtgctgctgcagagcctgcagagccagatggccaacgatggagctgggcttggagaatgactttaccacctcactgtcgtggggtgactgctctctcaaatcaagagtgcctgggctttctgacccctaacccaatgtgtggagctcctgggacaaccaatgagtctcttctgtgctgactgtgctcactacagctggggctggtagcagctatgccttcaagggtcccagcccagggctcagtcaggatgggacaggccaggctaaggggttggaaggctacgatctgaaactagatgaactcacaagcaagccaagtgactagaaatggggtgggctgtagacgggtggggagtccagggttagcggtgcctgggaggaggcagcaggaccccagtcacagactctggcaaccatggcatgactgttggaggctgcaaaaggggaggctgaggaaaaataatgctggacggtagttccagctcctctggaacactggacagggaaggaaagcagcaactccagcgtgggggccgggaaagagactccatccttggaaccaactgcctaccctctgcacaggcacacggccagggtacaagagacaagggagaaactgggtaaagaagaggtggcagaaggtcaggaggatgaggtgcaagcctagcgatgctgagtcccacagccaccaccaccaccaccactactactactaatggccggtgtacctcccttctgtgggctgagccaaaggcagtggtggtagtgaggcagatggtgcggaggaaataaagaggcccgtgtctcatgcctccttccctcaaccagggatctttgaatgacaataatttcttgcctgggtctatcacaagccacagccaacttcaaagcaggactcttgatagtatgtggcttccttggcctacaggagaccttgtgaagaaagagtgggtcacaccttctgtatcaagatttctcagagaaacagaactaatttcttctctagtaagcctgtttttgctcataaggcctcccaactgattagatggggcccacccatattgtcaaaggcccctttactcaaagccaactgattttggatgctaaccatatccacaaaattccttcacagcaacatctaatttagtgtttgatgaaatgactgggtgatacagcctagccaagctgacacagaactaaccatcacatcccccactaggtccactcctgtggttgcagaatgccagtgccttcaaaggggtgtgtgtttccctctgtgtctctacacatagatgttcatttggtgtccagtgggaccaggaatagactctctctctcttgcctctacccttgttaaggtcctgatcaatcaatgactggaccattgccacagtctcctaactgtcccttccagccttttttttttttttttttttaaaccacagttgtttttctctgccacacctaccctttaataaaaaataagctatccaaaccttttatattatgtttaggggccattatcaccttatttacagcaatctctgctctaacacaaagtaaaacagtcatagcattctccacctcaagccagctgggccttgtaatagtcacaattggcattaatcaaccacacctggcattccttcacatctgcacccacgccttttttaaagctatactattaaagccagagagctttgtaaaaggcaaatctaatagattactctctgtctccctgtttaaagtactttggttgcctgttttagcacaacttctacctgtaggaactactcatgcttcctgaaagatccaggctgtatgatgtgtctgagccttactcatgcctcaaatgctttctgttcattcatgcccactatcctatctatcttctgtcctgtttgtcaactactgcccaccctacaaacatgcacatgtacacacacacacactcagtccacatacaagtgtgcctggcgttagatctagacttcctctatgaagtccttccttgcccctgtctttccttttttctctttcctcccctctccccactcacttcttcactctggagtctgtacatcctttcacacagtgcctggtacatttactaccttcctgatactttccctctaattcccctcagacaatctgaaacttaaattagaatagtggatcacccttagaatgggtgggttcccattagggttgatcagcatcaggggatgagaaaatcaaagcaactgcctgcactgattgagcacttactccatgacaagctttctgtgactatttcgctgaatctttgcaactctgagaggtcagtacttttattttacccattttgtaggtgagaaaactgaggctcagaaagggtaacacagtgacacagtaaggggtagagccagcacttgaactcaggcctcctgactcctaggcccactctaccaccacaaggtacacagtgtggttgaacggtttggctgaaagcactttgtttaaattaaatggcttcaaatcataatttgattaaaaaggaacatttccacttttatcatttatatgtaatgttgacacatgagcttttcctaatttgtttttaactgagatataatttacatatcataaattcatccttttaaaatgtacaactcagtgatttttagtatattcataaagctgtgcaactatcactgttatataattttagaacatttcatcacccccaaaagaagcctgtacacattagcagtcattctctcttctttccttccctactccctggcaatcaccaatctactttctgtctgtatggatttgcttattctggacatttcatataaatggaatcattcattgtgtggtcttttgtgtcacttctttcactctgcatgatgtttcaaggtttatccaagttgtagcatatatcagcatgtcattccttttcatggctgagtaatattccattgtacactataggctgactaacggccctcaaagatacccacatccttatccctggaacttgtgactgttaccttataaggcaaaaggaacctgtgactgttaccttataaggcaaaaggaacctaaccttgcatatgtgatcaagtaagaattttgagacgggtagatttgtctggagtactcaggtgggccctaatgtaatcacaagtataagaaaaaggcagaagataatttgactacagaagagaaggcaatgtgatgatagaaacaaaattggactgatgtgcttcagagatgaaggaagaggcaccagccaagaaatgcagacagttactagaagctgaaaacggcaaggaaacagaatctcccctctaagcctccagaaggaactaagccctgctgacaccttgactcgagccagtgaaaccaatgaaggacttccaccttcagaactgtaagagagtaaatgtgagttgtttaagccactatgtttctggtaatttgctacagtgttaacagggaaggagtaatatgaacatcccacattttgtttatccattcatccactgatggacatttgaattgcttccattgtttggctatagtgaagaatgctgctatgaacattcatgtacaagtttttgtgcagatgttttccattctcttgggtatagatctgtctatacaggagtggaattaccaggtaatacggtaactaacttgatgaagttttgttctgcagacttttgtggcatgaatttcaaagagggcgggctgatgcttgggcaggatgaagaggtttttgtgcaggagctctggggatggaaggcagcctcaaagttccaaagagcttttcgggaatttaagctgtcattttacacatatgcagcactttcagcgtgccaaagaaattggggctgcaattacgtttttttgtgtgtatttgtttgaaaatagaagcggatgtgctctttcctaaagctgatactgaaacagtgtagatatgagtaattaggtaaaaataaactgataggaatttcaaaggacagtcacaacagaaactggtaacggaagtgttcgtcaaacggattcagacataacaaatatggcctgagtaatttatgtgagctagagccaggcactggaatgggctctttcatgtaagtttttaaatttaattcttgccagaaccttattagggaaacatcgctttcctgcatgtgttaaaaccgaggatgtcatggtggctacagagtgtttgccgaagtcacagagctgttatgagatagtcacaattctaaccagatctgtctgaatgggaattacttttatttcactgaaaaagagaacattttcttcaggttatttgtttgggtttagtcatacatatactgagaggtctctggcaattaactttgtctagagcatctctggttcactttttagtgggaagtccttgtaaatgaaatgaggtagagacaaaagtcttatacctctccatagaaactaggaggacagaggcatgaagtgtcttgtggtggtttttgttttgtgggcttgtatttttgtttcttgagtacctgccagatgccaggcttctcacttggtcttcgtaacatcctgctgaggtagttattatgatctccactttacagattaggggaaaggtatttggaaaggctgtaaccctaaaatgacatgactggtaaatattagagccaggatctgagcctgggttttctgatttgaagtcccttgttattttcaccacacaattatgtccctttttggtttggaatctaaaacacagaaagaaataggattcttctctctggaaaacattaggtaatgtttgggtaatgtccatggtgagagattcaagtgaacatctcagcagcctgcgttgggaggcaggatctagacgtgccaggctgggatggatccgagaggctcatctggtccaatagtgaagctcaggtccagggaaggagcacagcccggggccactgtggggatgtggaaacagcatgaggctgggacgaaatcctgctccaccacttactgccaggagacttgggcaagcggtttaatcagaggctttttcccatttcaaatggggataagcagggccctgtggaaataagaaagaaaagaaagtcacccagcagtagggattctgcaggccctggctttcccaggccacatatctctagagggtgaagcagagtgtcacctcctggcctgggtaccctcgggctgttctgaagcttatgagggtgttcagatgctggcactctccttccagtcactgctgagggctgggtccccactggtcagggtcactcgccccttaggtcactgacagggccttcaggggagaggacattcggtcaaagagctttgcagaatctggaaatccagctcagcgtttcctcagcctgcaaccccaggagactcgagccacaacaatactgcagtcccactggcggctgcttccttgttgctaagcaaccaaatatttgctattaagttcctgttgatgaagctaattgcaaaggttaattgtcctctgagatgaaaaacgctccaggaatgtatttaggagttgttctctgaacttctgagaggacatgatttcttgaaaaagcctatttttaagatggtgatggcatcagcactgttctgcctgctttgttcatcccttagtgtggaagtttttcaaatttagttagcaaaggaaatttttgttcagagggattcctatatggaacctcactcagtgtatgggcagagatgatggatagctaacttggaggggtgggtggagcctggagccccgcccactcagccctgcacactcatagtcccgcccactgggagccccttcattcactggcttagggatagtgcttgttacttcctgttattagactgtgaggtccctgagaggtaaaactgcttggtctaccctgtgcatagtatccagcatacagctggatgcagggcaagtaaacagctaatgcatttcaaataagtgataccttatttgtcatgaacccagccaggtcaggtggatacagttaaaatactttgattcaaagatcaaaaaatcaagctccaacactgttccagtgactggttttgggtccctggtgaagcaggtcagggacgtgagaaaagaggaaataatgggtttccatctcacctccagaatttaacatgctgtgtgaccttgggcaagtgtctacacccccaagaggctcagttgcctcatctgtacatgggaatgataaagcctaccttgcttctcagagtgaagtacatggcacagtccctggcacagagcaggagctccattaatggtagctattttcttcattgttttccaacaagaggctaaagtggtcatgggacatcctgcctcaggcagaaaggcaaattctgattcaatgcattggagattccaaggaaagccatagcaacaaggctggggtcaggaaacggcaaaaaaggaggtgggaaaggccctctgaaccatctctagcaacttttccatttcacaagtgaggatttaagaggggttttcttataagatgatgatggtcctctcttttaggaggctgtgagaggtgctagggtgataatgtggagagttgatactagttctgtctcagagtcacctgtggggacccctacccaattggcagcatcatggagctgaggggcttctaagaatctggatggagctcaaaactctgacacttgggcccctgaggcagttgttccttgagaagtggcaaccattcaagtctgccacgttttcactcatttctttacttgggatttatttatttatttatttttgtgacagggtctcactcttgttgcccaggctggagtgcaatggcatgatctcggctcattgcaacctctgcctccagggttcaactgattctcctgcctcagcctcccaagtagctgggattacaggtgcttgccaccatgcctggctattttttttgtatttttagtctcaaagtctaatgcaggggttggcagactttttctctaaagggtcagagagtcagtatttttagctttgtgagccatatagtctgttgcaattactcggctctgccgctgtagctttaaatggccacggctgtgttccaatttttctttaaaaatcaagtttggtccaaaggctgtagtttgtcaactactagtctaatgggaaggagaaaataataaagttcattacagtacagttcagtaagcatcatcatggagatgttacacagtgtggcagggacccagatgagggaaaaaatatttctcacttgaaagagttcctggagaaatcagcttgggtgcctttggtagagtcattttctatatctgtttctttgtctatagaaagaacatactgttacagagatcacagcataaatgtgaagatgtatgcatttaacatactgtctggattatagttacatccataagccaacacaaatgttagtaataatgcgtgtttctaagggatttttatatgcaagcactctcatgcactgtatatatattatctcatttaaaactcataatgattccatgagagatctatactcattctttccattttgtatatgaggaaactaaggcacaaagaggttggatagtttgtctagtaagggcagagccaggattcaaaggcaagcaatgacttcagagccagaactccctaaccactatacgtattgtaagcactaatgttaaatatttggcctccatcaaatcaggaaagaaaattgcaggtcagcaagcctgtttctgcaggcagcag

SEQ ID NO: 433 - DNA, 20001 bp, Homo sapiens
ggaggatcaggagaggctgtatagaagaacagagattttgtttttggtcttgtgggccagataggatttggattggcagggagaggacattccagggaagataagttatgtatggttgggtggacatgctagggattggagtgttcagggagctgggagtgggggagatgcatttgatgtagtgggaaattgtgaatggtattttctttgactctgtacctttaaccatgccctacataattgtgccacccactccaaccagcctctccaatcctggctgtcccatttatccaacactcactcctgcttatgctgtacccaccctttgccatcctggctcatcttcatacctaatcttgactacatttcccatttatatccttgtgcagggccctgtgaacttgattcaaatttttgacctcagaggtttcttcctcaattcccactcaagcctacagaagtaaagctaacactaagccagatcttcgtgtgagatcttgaaatcttctatctccttaaagtaatcctgtgaagtgaaatttcttttacccccattttgcaggagaggaaactgaggcttgagatgttaattgtgagcactgtgtattattagtccactttgcattgctataaaggaatacctgagactgggtaatttataaagaaaagatatttatttggctcatggctctgcaggccatacgagcacagcactggcatctgctcggcttccggtgaggtctcaggaagcttttactcatgacggaaggcaagggggagcaggcatgtcacaagatgagagaaggggcaagagagatgccaggctcttttaaacaaccagctgtcctgtgaactaataaggtgagaactcactcattacctcagggaaggcactaagccatttatgagggatccacctgcatgacccaaacacctcccaccagacccaactccaacattgagggtcacatttcaacatgagatttggaggggacaaatatccaaaccatatcagggtgagatttgaaccccaacctgtctgaccccatagcctaactcccaccactaggcagatgacaaagcctcttattgccttggcccaccatattggtttttttcatcgttagtacccttggataggatattttactctaggcaacccttggaacttagaccctgcctcatattgccatcctgccgcaaatccttgggtagcaaggacatgtcataggtaggaattctcagtgcagcagttagtttggggtcctaaaagactttattttctttttgttgttgttgttttttgagtcagagtctcgatctgttgcccgggctggagtgcagtggtgcaatctcggcacactgcaacctccacctcccagattcaagcaattctcctgcctcagcctcctgagtagctgagattacaggagtgtgccaccatgcccagctaacttttttttttgtttgagatggagtttcgctcttgttgcccaggcctggagtgtaatggcgcaatctcagctcaccacaacctccaccttcttgggttcaagcaattctcctgcctcagcctcctgagtagctgggattacaggcatgtgccaccacgcctggctaattttgtattattagtagagacagggttttgccatgttggtcagactggtcttgaactttcaacctcaggtggtctgcctgcctcagcctcccaaagtgccaggattacaggccactgtgcttggccaatttttgtatttttagcagacggggtttcagcatgttggccacgctggtctcaaactcctgacctcaggtgacccacccacctcagtatcccaaagtgctgggattacaggtctgagccactgtgcccggcccgtaaaagactttcaacaccagcatttatatttgattctattgacagtgcaagccagtgaaggttttaagatggttataaacatgaggataacatgatcaaatgccatattttcagaagataagtcctggacacagtccaggactatcctgcctcttccctcctatacaatgaagaggtggcaggaagacacaatttgcaccctattttgtggtttaagttaaggttataagagtctgaattaggtagtggtggtagaaatggacagaatatgataataagtaattgactcattttactctgaaataaatgtatttcttctgaaaataaactttctcaccaatagcatcatctggaaagaataagctcatagcttcataactctcggggacccaggatgtatctcaggtgtatcattgttccttggttcatattcttgaaacttttggcaacagcatgatgtggagggaagcttagggggttgaagtcaggcccgctttctagtagtgactctgccactcaactaaccatgtgaccttgggaaagtccttaatctctctgagcctgtcttctcatctgtaaaatggggttaatgtctgtcacacagggtagttgtgaggcttaaatacaacagaagatagaaaagctatgatgagcacagaataaatgtcagtttttatactatcttttcttagccaaacatctcattaaaagccctgagtaatcacccttaaagtcatgtttgaaagaaaagtgattgggtttaaccaaccttttagaaagaaatttggctttccaaatgttttccactgtgtattaagacacataaaaatgttcatatcttttgacccagttgttccacttctcagaatctattgttaggaaattgtcctcaatacagaaagagtggaatgcacaaagaggttcaatgcacagatggctacaatagtgaaaaatcagaagcaatttgaatgtccagaagccaatgattgcagagtcccactgcagtctgctgatactttaaacatgctttaaatcagtataaaatacacagctcaaaacaatatgaaaacgggcaaagtaaatcaaggatcaaacattcttttcttcgattcatcacctcccacctctgatgtccaaccccactcttctgcagggcttccctgtgtggcccatataccaacaattctctttttctgccatctgggtactaccagggctcatttgcacagcattaagcttcccacccagctgcctaagccccctcggaggcaaatctcagctctttcccctgcagacacagaggttctctccaagcttggcagttttttggcacagctctctctctgtctcccaaggcttccttgctctggccccaccccatatccctattaccttcccacttccaacttctttcccgattgtctccaacgcagttcgctgtgcccttctaagttagagaaagtattttctcaggtgtccaaaatttgttcatctacataaacttaaggaagagggaaaaaagatagattttgatgtcaaagtttatttagaagccagtttacactcagtctccaagtctttcagtcttgactgcttcgtggaatccctcaagagaagactaaaatgttattaaactacatcatttcaaagctggaattcatgaagttagaaacacagacagttagctggtcaaaaataaaaataaaaatcacataaagtcatgtggtgctacctgtattttgtaagcgggcacttcctcttttggtaactccttgaatgaagagcatttggtttctcttgagtttgtataattatatgcattgtgcaatttcttagctttggcaggcgctgggtagcatttggcttcagcactttcaactctaaggacaatttcacaattgggcttttcctgtcagctccaacatctggacccaggggagactgggtccaccatgcgatgaaaccctatgtgaacttcctcagccaagcaagaacaagctgtacaagggcaggtccttccctcactccaggagcctgaaagcaggtctttcactgtggctgccaggttatggccattttttaaaagaaaataagctgatcattttttaaaatgctgctttactggttgaacaataatcactatttcaaatcaatatttattcagcacctactgcatgccatgagttccaccctgtgtgctggaatacagagacagctcctgctaatccatcctgcctcttctatcttccttcttctttcctccttcttccttccttccttccttctttacttccttccttctttagttccttccttccatccttcttccttcctccttccttccttctttacttccttccttctttggttcctttcttccatccttcttccttcctccttcctcccttgcttcttttcttttctttttctttttcttttttttttttttgagacagagtcttgctctgtcacccaggctagagtgcagtggcatgatctcggctcactgcaacctccacctcccagattcaagtgattctcctgcctcagtgccccgagtagctaggattaaaggggcccgccaccgtgcccagctgatttttgtatttttagtagaggtggggtttcaccaccttgaccaggctgttctggaactcctgacctcatgatctacccacctcggcctcccaaagtgctgggattacaggcatgagccaccacgcccagcttcctttcttaaatattgtttaaataatgctgaaaacaaaaaagaaaaaagcacttacaatcccatcacttggtatataaagaataaaaaagagcattgttctaaagcttatttagaagcccatttacacttagacctcaagtcttttagccttgaatactttgtgaagttcctcaaaagaagagtgaaatgttattttaaaccacatcatttaaaaaatacattgctcatcctaccctctctgagtccgctgctgcctctggtggcctggggcagggaatccaatgcctgccccaactggccacggcagtgatggaaggtggaccaatgagaactagtctctgcctaggaagcactcgtaggttatgttatatacaaaggatgatgccttcacagtttaaactctccccttaatttataaccttgtgctgagctttctgcctctcccacagatcttccagtcccacctcctctcaagtagaactccttaaatgtagagttgtttccttcttccttccccacacacttaaaacaggcaggcacattttgttcttcatgaacgttcaggacccgcacactgtgaaacaatgagtgaaaggagtagacagcacggactctgacttcctggctctagaaaattccttccagagtaagtttgcatgcagttcactgttgcacacagtcctgggccaaaggatcccaaatgaaagcaaaaacccatcaagagaattgtgatttaaaagttaagaaaacagcctgtgcatatttttagaacagcccagaaaagaatacatctgtgacttgaaacagctggaaatctactttctgccaaaattatgctgattatgaaagctgtaatggtcagacaagagacagtcagaatccaaggagtcctgtattttcatgtattcaactttcaaataatctttactttcatacattaaacattgacccctctacactgcctttcaaacaccaaatgccagccagccatgaagtttttacagccatgtttgtataattgaggattttattgtattttgcccttatcagtttagtagtaagaatgatcaaccaaaagaacaaaagtaatcagaagcgtgggttttataaactcataatatacttcagaaaataaagaaaattatgaggcatcctgaaaacagaataacattagccctggatagtcattgggttacaccagtcaaccatgtgttcaattctgaaggaaaacaaaattttaaaatatgtgtgaaatgttaaaaatattggtaacaacttatggctaaaagacaaggtatcattagggatatatatatatatatatatatattaggattactgaaaatgaagtcttctcctacttggcactctgctagggtatgtctgtcattcactgttatgtcctcagtgccttgcacataatagatgctccataaatatttgttgaataaatgaataagtcatttgtagctttgacattttaaagaatttattatgcataaaagtagagatatatttgcctgtctctaaatatagaaagagaagtagaaaaaggatttctgaagctgccccgtcaatgtgcgtagagatggatcaatctcttacaggggtacaaaaggtgaatttaagcagaaagggtgacagtgagctgtttgtcagactattgtccaaatgccctccctcacggtacaccctcctccaagccacacatacccctgactgaaatcaggcaaaaaaacagacctggtaaggccaggacaaagacaaggcttaggagtgaggtgccccaccccccgcccccatcacaggatgcaacgtctggaaagaggtgggacaggaagttgtgcccgggggagaacatcaaattctagtccaatatagtccaaactgaggaataaaatgaaaatgtacaaccaaggtaaagaaccaaaccagagatgctggtgagtgaagagcattcaaatggacatttctagaggaattctcggggtagagtgcaggcatccaaactggtgtttcccaccaacttgctgtgtgcatttgaagaaaccagagcagaatgcatgcagctcctatgcaaaagacggataaattacaacacagaaaagacagtctaaactcgtgcaccagcagagcaagtctctgatgtatttgctccaaaatgtaaatgatgaagccaaatattggacacagttgagatcaggcactggaaaattatttcaatggtgccaaggccacacgcatggaggaaaagcagtgtcagcagcaagtgtggtgagaaacagggtaaaagcaggatggtcctgagattctaagatcagaaccaggaagtgttggcaggaaggcctgggagatgatcagaacagttctccctccagagaggacccaagcctcactcgcactgccacgccaccccaatcttgaaggtaccccatgccgaacctcatcactgacagcttgtgaaggtgtataacgcccaggaggagttgtggtaaacgtatgcacacatatatataaatatcatcttgctccaaggtttttgaggatggtgagctctgcttgtcacaaaggtaacaggggtggtcattggtttcactttatgtgaccttaaagtgcattttaagtgaactcacattcaatgtcactttgtgggatgcttggggaagagggtctcctttagtgtccagtcttctgaggctctgccttttccctctctggccctcctcagacaagcagagctgagactctgccttcaaagctcgggtattgcctggaatccctgaggcagtgctagctggggaatccagtcagctaacacatgcctctcagacagtctatactctctcctctgacatccaggagggctcatggcagggccacacggtgagaccttgcccatcacacagccattacagaggattcccacagagccttttgacagtggtggccactcatggctttcagagtatgctgcttccctgaggagctcaccaagggctgtgatactctcagaagtgcctctgaaaggcagcagtttacagaaggacccctgctgagcccctggtgaagctgagctgctgcacagcttgcccaaggaacacgttttagaaatatcttcagatccactgggactgccagaggctcctcatcctgtgcccagcacaggccagtggttctagcccttttggttcaggataaaacttcacccttcctaggtttttgtctttccactcatccctcactggtgaggtaaaatatgcctattaaatcttcccattggtgtgcgagagtcaatatttagggtacttgacaaaagctctagattcctcttcctctgagtccttacacagcatacacctatgggcatggaattgaataatctgccagtcctccatttccttcagctccctaaacagcaaatacaaactgaacttcattagcaactccaacttgaatggcaaatgccagccactgggtcagctcaaagctcaaggataaatttcagtggtgaaacatccacagaaaaccctcaagtgggagaatgctaagaaacagtgggaaagaactaatgggaatctaggcctacttcacacacacacacacacacacacacacacacacacacacggactgcctgcgtggctggtacaataaaagtgtgtatttacactcgctcatctatttcattacaagggaccaatcacaaagacatttattttgtcttctttcctgctctggtaagctaattacaaagtaattgaattagctacagaataaattagttgttatcaaactgcaagtaaagggattcttctaaaaatgattttagggtaaaacactggcttgcacaattattccaggttaggaaatatttttaaaatttattttattaatatgtttattgtaggaggaaatcctaaatttaaaggtaaacctaaagtaaatatttattctacctttaatgaatgacaaagaaaggaaagcatgggtaaattcttgaaaatgctagagggggcagtctacgtgaaatgtttacatgataatctttgttggttgaagtcactgaaatattgaaacgtctttagtggtgagcaagtggggtggaatggtgcttactctacataatgttcgatttagcacccttaccacatgtaattactaagtagccagaaagaatgtctttttcaaaagtacatactctgccctcttaaaaatctcaaaaatagcatgttttcttttcaacttctaaattacacttctattaaatgctatgcagagttcagaaaatggctgcctctgatcaatctggtgtgcaaagcccttcatgaagtcatatccatttgatcataaataagctcaaagataccttgcaataaaagtgtcaggctttcagctctctggcaaagtagaagttatttatacattgaaagggtgtgggatattaatggcaaagacaaaaatgattggaaaaggcctggaatcaaaggacaaaagctggaattattaaacacaatacaacataatgccacaatcagaaacactgtaataccatggaattcttacagtgccggtcaaattatgcccatgagcataatacttgagacttgagggtgaaatgtcaggtcctatacttgggcctggaagcaacagcacaattacaagatcaaataacagtattgggaataaaaatagtttgcaggttttagtgggcagtgaactcagagttcatggcatgcagaggctgcagaaaggccaatttgaggatggacagtcctacaaggcatagtctggaagcagggttcttaactggggctctgttggtggggagtggatttgggagtcacagcctctattgtcagacatttatttcacagtttcatagcaacattgtcatgattagctatgtacatataactttgcaaccatccttaatgaatacctaaggatcatcctagaagtgaaatttctgggtctgagggtgtatacattcttagtgcttttaatacatactaccatgtgcctctagaaacattttctgtttctaataagagcagttgaaaattcctgtttccccagctatccaccatttgcctcatgattttctctaggactaaattttaaagtagagtctttaaagtagaagggagtccaaattccatccctttcattttataggagaaaaaaaattgaagcccatgaaggataggcgatgtgtcctctaataccagagcttctcagggggagagaagatgggggtggctatagctcccttctcctggccttaggcctgatatagaacaggtgcatggaaacgtccagcatagagaaatctacagaaacagaaagtagattagtggttgcctaggcttgtggatgggagggaagatggggagtgacaactaacgagtatggatgggtgttttggtggggccattgaaaatgttctaaatctattgcggtgatgtttacacaacactgtgacgatactaaaaattattgagttactttaaagaggtaaattgtatgttatataaaatatatcccaataaagctgctattttaaaaaaaaatgtgctcagtaaacatttgtagaaggacagaatagagggaggaaaacagatcaaacatccttgttccttcatttccaaccagtggtctttccactttctcactttcactgaagtagaacatgtctaaaattgtccccagctcagtgctgggtttcccctaggtgtttccctgtgtttcaggaatgtgtttttttagtaaacactaacctgcctcttccagaacttttgagtagagaattttttaaatctgagcttcaggccaggcatggcagctcatgcctgtaatcccagccctttgggaggctgaggtgagtggatcacttgagatcaggagtttgagaccagactggccaacatggcgaaactctgtctctactaaaaatacaaaaattagccagatgtagtggtgcatgcctttagtcccagctacttgggaggctgaggcaggagaatctcttgaacccgggaggctggggttgcagtgaacagagatggcaccactgcactctaatctgggtgacagagtgaggctctgtctcaaaaataactaaataaaatctgagcttcagccttttatattttcctgagaatctagctcagggctggtcacaaagtaggcacttgatagatgcttatttactgaaatactggtgaactgtatgtacattaaatattaagtaataaggcagtaatatagcattattttctaatattgatgcctaatttctccagctgtcagttcaagctctgtcaattcagttggcagttaacactctggcatttcagagattctgatctccccccttacatttcactgtgcatagtgagttgttacgggccccactttgccctcagtgcccgaaagcacaggactaaatttaaggctcagaagtattgactgcagcatctggggggcaaatctagaatccatgaagcttaaactttattcactttggaaggaggaaaggtcctctttaaaaataaataaataaataaataaataaataaataaacaagtgggggctgcgcatggtggctcacgcctgtaatcccagcactttggggcagtatcacctgaggtcaggagatcaagaccattctggctaatgcagtggaaccgcacctctactaaatatacaaaaaaaaaaaaaaaaaattagctgggcatggtggcacgcacctgtagtcccagctactcgggaggctgaggcaggagaatcgcttgaacctggaggcagaagttgcagagagctgagatcacaccactgcactccagcctgggtgacagagcgagacttccatctcaataaataaacaaataataaaaataaaaacacaaaattataaatgctaagtacagcaccttggaaggggcctgaccaaagaagcttcctcagcttcctgataagtctgcttgtggctttgttcgtttctctctccttttcattggatttaattttgtttttatgtttaaaagtccattgttagtagcaatttagcatcataagcctcctaattcttcttaaaaatacagtgcatttaagtaattgtgtaattaactacccacaccatctagacgataactagaatggtggggcatcccatctggagtggaggatgggctctcaaatcggtgcctaatgtgaaaatcacacatagtcctaattgtctttaaaatctcttaaattgcctgttaagtacagaatgtgtggttttatgtgtctgaccttgtcagtagttcttagacatactcaagtttgaaaatcactaagccagaccaaaggaaggaaaatccaaatgcaggtgcctggaggtaagaacctctttgccttatgaccgctctcaaatctctagcttgaacaaaggtaggtgctcacctgggatgttgactgcctcttgtttttgatactgagcccttataaacttaataaatgttaccagcttggtttgttgctatggaatttgaaaagatgatatatttgaaagctgatagactgggacttggcacaagaggtgctctgtgaatgtcagttggatttaaatctcatttgatcaggtctccatacacactgctctgctaaagatggtgtcttccaagctggtgtttctgtttgtggcctcactacatgacaatcccactcattcagggcgtgggccctggactcagcacctctttcggggtaaataaaggattccttttacctgagggagggttctcaagtctcccatttgaaaacatttcttcatgacaactacatgatgtaactttgtataaacaaaagttatttgaaatgaacttacttaataatttacttgctacatttgcttttttacttctttgtaaagcttaagcttagaaaaggtgcttctgttgtatttgcatttttttaaactgactcgagtaaggcaatgaatgaggtttccgaaagatgaccagagataaatctagctaaaatcagtctcaggacttgagttagttttgttcctacccttatacttatttcactgacataagtaatagtgtttcctactatctactactttgggggaagaaaagagagtccctttggtacagagttactaagcacctaaatatcagccctgtttgctgggcatgtgggattcggaaatgaataaatagtgcacagccttgacctgaaggtcacatatgtctgaagatatttagtcccctagatactttcttaaggagatgtaagggcactagctttcaatgtacttttgagggaagtaaccatattcctccaatgtcttcatagttacattgctttatacaaaaactctcttcgtaatagcaccaacgtctgcctaggtgttcaatccagacaccatgagtcacccagaccactccttcccttcacccccacaacagttgaccaccaagacatagtagctctaagtcccaaaatatccatctctccctcttactcctctatctctttcctggttcaggcctcatcacctcttgccttgactatcaccacttcctaaacttttctccctgtctcccattcccacttcctgccttttcccaatctccctgccttacccagcccatgttccatactataactagaaagggctttttaaacacaaagctaacaatggcaccctcctgcttaaattcctctgtgcttccccgttactctcagctgtggtcctgcacctttttctcctgctaatgtgcatgctcatatgtatgtgcattcagaggttcattcgctcatgcacggttctgagcatgccagctataatcttgccccatcactctggagggtgcaagccctcagtggggaacccctgccttagagcatgaagctcaagttccttggccttgcctaaaggttctttctgatctggcctattcacatctgcaacctcatttcctcccagccacgcatatgtgccctgttcatcagcctattccaaaccgcttacagtaccctcaaagagaccatgccccatgcgtttttacacattgctctcttttccttgaatactttccccccacccctcatccacccatttagcaactactaaccctccaagacacaacttaagaaccaccacctccaggaagccttccatgctccatttatgtccctattctctatgttatatgtccctcccctataagatcatttatggcttcatgcttatctgtaattaatagagtgttcaagtttatagcttgtcttgtgtgctagggaataagctccttgagaccaagaactttgggttatcaattgttaagatctcagttctttgcacagtgcttttcatcctaggaatccgctaacatttgatatttgtgggaggaaggaaagaagtaagagaaggtggaactttgaagctgtgatcattttctttccatcaaagccatagcaaaaagaacaatatttttaacatccatttaattaacttctataaagattttttgttgacttcatgaatcttaaaattctttattaaaagatcttttggctggtttcttcattctcacttttgaggatttgtcttaaagttatataaaggattcataggagagaggcagaggtggacagattacttggggccaggtttgagaccagcctggccaacatggggaaaccccgtctctgctaaaaatacaaaaaattagctgggcatggtggtgcatgcctgtaatcccagctactcaggtggctgaagcacaagaatagcttgaacccgggaggtggaggttgcagtgagccaagatcacgccactgcactccagcctgggtgacagagcaagaccctgtcttaaaaaaaaaaaaaaaaaaaaaaaaaaaaaaaaagatttatgggaacattcaatggtcccaggtttcaacaaaaactctgtagctctagaggatggtggccggaagttgggctttgaagtgaaacagacctgtgtttgaatccctcttggccacttagtatctgcatggctttggcaagttacctacctctctgagcctcagtttccatatctgtaaaatagggatactaaaactaccaactcctggccaggtgcggtggctcacacctgtaatcccagcactttgggaggccagggcgggtagatcacaaggtcaggaggtcgagaccatcctggctaatatggtgaaaccccatctctactaaaaatacaaaaaattagccaggcgtggtggcgggcacctgtagtcccagctacttgggaggctgaggcaggagaatggcgtgaacccaggaggcagagcttgcaatgagccaagatcacgccactgcactctagcctgggtgacagagcgagaccccatttaaccaaaacaaaaaaacaaaaaaacaaaaaaaactaccaacttcatagcattagtttgatttttttttttttctttttgagacaaagtcttgctctatcacccaggctggagtgcagtggcacagtctcagctcagtgcagcctcaacctcccgggctcaatcaatcctcccacctcagcctcccaggtaggtgagatcagaggcctctgccaccacacctggctattttcttatttttagaagagatgaggtctcactatgttgcctggtctggtctcaaactcctgggctcaagtgatcctccctcctcagcctcccaaagtgttgatgttataggtatgagccacctcacccagcctagtttgaaatttaaatgataaaatacatacaattgagtatatacacataagtatttaatgtatgatgatgattattattattacaaggacaaaatctagtgcatctgatcttaagctatggtttcatagtaggtgactgtgaagtggtggggggagtccttgaaaggagaaacaaaaaattcagtgggaacttagataaggagaagatggagaagtcattttttttcctaatctgtttagctcattctcttataattaaactgcaagattattccttcaactacaaaatggataaattattcattatattgacttgtttgaaaagatatcatagtttaaaattgaatgaatttctctttaatatgattttctggcaagattagattctaatgtggattaatatcctaaattgagagctctaattgaacactgtgggaaccaagcatgagtcaaagacatcgtccctttacaagtggcagtcaccgaggaaacgttcacttgtgtgtcagagggacacctaacatcagcaagagtaacagtagctgaggctgaatgaaggcttgctgtgttgggtacgcatgtcaagggagacgcaggacgctatttgcctcacatctccctcatcttgcagtcatcgccgtcctgtgccttggtggagtttttagtgtatgcagcttctgtgaacacaaggacctccccatcatgtccattgcactccctccatacctagcacaagtgcatggtccggagtagtgcccagtgaatatgtgtcaggacagtggggaagggaggaggacaataccctctaacggccccagagtctgtgccttctggcccagattcagtcagactccaccaaagtcagtctccaggactctgttttccaagtttgttcagcccttccccctcagctaacctgttcgtccctttgagccaaactcactgattagcattcagcttctttcactttcaatcatgccagacccggtgtttcatgcttaaccgttagggaaacatcctgtcttttaccatgatttttgcaggtggctaatatcatcaattattttactcactcaactctcagagggtaatcacttctttgattcaagtttcaaggccatctcactgtgggctcctatacatcaccgattacaccgggcagagtcaagcagaggtgctggccctgttctttacagattcatctggaaactatggtgctgttaatctgctctgtgttcatgctaatagtgtctgtctataatcaacctcaatctaccattcaccacgccaaaaagataaatgccagacttcagaaaatgaactaaaggcagccctcaaaccccagaaaatctcctgtccacccctgccagggcgcaagatgtcctgatttaggaggttgatccctcctctaattcctccttagaatgtatttcaaaatcaaaagccaatagttacatttctaagcaacggagcagaccaaaaatgttttgtttgacacagaagcaatagaagcaagaccatgtttctattttatgaaacctctgagggtaattcactgaaatcttgacatttaatatcacccaatcacctctctagcaagctattttctttggctccattaaccccacacacacagactgggctgctggcacttactgggtcttgtcgttaggtgggctgcttttaataccagggcaggatttggcaggaagaagtggcacctgctttattgaaagacatcttcatattttagcctctgaaagagaaatgtgcaacataaatgtccttaagagacgattatcgtacatcaagatgtccattccaaaaggcattgtaccagatgcccaatcacacacagtcacccagaacagacgtgacagatggagactttgagcttttaaagaaaacaaatgtgcaaattccaaagtgtctgtgtgctccaggccagcacatgcccaggtaatttgagttgtgcccattggctgaaagataagattcaggcctcagagagggtttggggagaggatgagtacaggtttcttgttgcccagagtctccaaatagatacacacaggatacaccacctcagcccagagatatttaagcactgagttaaaagaaaggattgagcatgcagcatcaattgatacattaatgctggttctctggcatcagggaagacattaacatacagaacttgtcttctccactgttcaaaaatgggaagaatcattccaacagggagagcagggaagtccaaaatccataatgctcaggtacaaagtaatgaaaccagaaatccagggtatttttgctattactaccaagggcctatcttcggtgtaatggcaatcttctaaatctctgcatagtttgacacctgcaaatctgattgagtctgattgaaccatttgctgtctaaaatccttgggagaccccgataacctagagctgtagctttcaaattgctccatgggctcgggccaaggcttccacagggactgagggaggaagggtacagctcttgggcacatccccttggctccagtcagaaaagttatttcctctgttttacaaattgagcttccaagtaagattttcttcttttctctttttatctgtctctgaggttgggtacagtggcatgatcgcagctgactgcagtcttgacctccctggctcaagtgatcctcctacctcagcctcccaagtagctatgaccacaggtgtgcatcacctgtggtctaatttttttattttttaattttttgtagggacaaggtctcactatgttgcccagactggtctcaaactcctgggctcaagtgatcctcccgcctcagcttctctaagtgctgggattacaggcgtgagtcaccatgcccagctccaagtaagattttcaacaaagagtcttgaggcttaaaaacaaagtatgtttgaaaagaaggggtctgcaggattaaattcagataagatcctccccattcttttttgtttgtttgtttttggttttttttttgtttgccaggctgcagtgcagtggcgcagtctcggcttactgcaagctccgcctcccgggttcacgccattctcctgcctcagcctcctcaatagctgggattacaggtgcccgccaccacccccggctaattttttttgtattttttagtagacacggggtttcaccgtgttagccaggatggtcttgatctcctgacctcgtgatccacctgcctcagcctcccaaagtgctgggattacaggcgtgagccaccgcgcctggccgatcctccctattctttatcctgtcttcctcttagacgttccccagcacacccagataatccagtcatgtccagtgacttccttctctctatatcaaagtttccttccgttccatttgcctggaatgttctcccttttctcttctctgcatggtaaatctgtattcttgttttaagattcagttcaaattttgccttcggagtactaccattcctgcttagcagcaattatccatattcccactgcatttgtgcatgtgttgacgcatatcgtattattacatgtgtctgaatcttggatcagtctgcacactcatagaatatagagtccctgtcttattctgtcctcctccatcttcctccagggcctggtatgctgtgggcactcaataaatatttgatggatggatgcttagctatttaattcaccactagatagcaatttggcatattcccaaacaattttattcagaaggaattcaaagaaataggcccacattctcataaccaactcaagcagctctatgttaacaaagaatataactacttctaactacttctgtttaggtcggagttttatttttttaataaaatttatgattgcaacaacattaaaagagatattgtatagaggtcacatgctgaaagcccatggacaacaacagtcttttaaattggcatggtttgaccctgccaatctgattgggtcatttcttcacttaaaattctcacgagacttcctgttgtctgtggagttcagaggtttctaggacacctccaatgctaaggcctccacatggaggcctgaatggaaaggaagtggctcagggtctcacaccttttgcttcagtcaaagaggttctacagaatcaaagtgttttttgtcttaatttctttttattggaatggctatggctgagcctgactctccaggtttccatagttcccaacacttgctactttccccatccatcttcacctgcttgattcctgatatttgagtttgcaactcaaaactcacccctaaccccagccctctaaaaccgttttcatttttatgaacctatttccaggcccagagcactatgcctatttttatatatacttgcaattgtattgcatatacaattttatattctgttttcttcacttaacactgtatcataaatatttttccagtatgtgagatgtgagacacagcctctgatggttactttttcttttttgagactgagtcttgctctgtcacccaggctggaatgcagtggcacgatcttggctcactgcaacctccgcctcccaggttcaagcgattcttctgcctcagcctcccaagaagctgg

SEQ ID NO: 434 - DNA, 20001 bp, Homo sapiens
acaacaacccactcttcaaataactagcccactcctacaataacaacattaatccattcacaacccaaattacctgttattggaccccacctcccaacaaggttgcattggaaattaagtttccaacacatgaattttgggggaacacattcaaaccataacatttactctgaacttcacaaagaccacaaaagaattagttgataaagaatgagctaaatagttgactaaatggtttagcaatcataaatataaagcagcataactattgtgttaaaagcattactatgaggcagatatagcaacagcatcagcctgatctaaccaaacaatgccatctcagtaggatactggtgaagccattccctaggagaaggtggcgtgcgtcataggtgtttgctggactttcttctgccttattcctggttcagagaaactcagtgatccatttttcatcccactccaaagcagatcagatggttgtcttgcttgtatcagagctaatgcttccgtggggagagctctctgtttctgcctgcaagtgctcacagttcggttgtttcagccagcaccaacatttgtttcttagatctaaaagtagccctattcctgtctgctttatatattggagttctgagtatacttttgtttaacaaaatgtgttctattacgtaaagaaaaaaaaagattgatagctattagcttaggaggcttctagaactcagtgcacagccagctcttgctctctcatatatttttacaaatatcttcaagaaacaaatggcctttccactggctcttgagggataattttaataatatatttgcagaaatatttgaaatggaataagggtattatgactgtagacttcacttatttattgttgaatcttgtagcttctgtattaaaaagaaagaaaaaacacttttattgaagacagtatgtcagaaaaaacatggattttttttttttactcaaaaagacttgtgtttaaatataatttgtgccacttattagctctgtgatcttaggcaaaatattgagatctctgagtctccattttttcatgtataaaataaaaataataacaattcctgtaatatactgctattataaggatagttagctaatttatgtgaagtgccaagcacagtgcctaatagtatttgtaactactatttattgaacccttactatgtggcagacactgtctaggtcaatggttctcccttggggacttgttagaactgcaaattctttatcaggccccagcctacacctactgaatcagaaaccctgggggtagggctcagccgtctgttttataagccctcctggtgattctgatacacactaaagtttgcaaaccactgttctgagtgtccaagaaattgaatgtatgattatcatattcatattacactacagctaataatttgtgctgaaacaaatatagatatgtcctcttctattttgtttgatgacagccctagatttttcccaccttagtcatatctgtgaccattccttacaaggagataggcgacctggaaaacccaaatatcatacctccttctccctcccgagtcctctcttcctcccctagcgggtctgcatcctgtctgtgtcaagcagtttatgaaatacctggtgagaactcagccactccagaaagaatgaatagctcctcctgaatgcagctccagcacctggagtcagtatctccctgacttgccattatgtgttcccattggtccccctgataaaatatgatctccctgagggcaggaacaacatcctaatgatttctgtgtccccagcacccagtacacttaatagacacctaataaatgagtggtgaatgaatgaagtgtcagccccaaatcagagggacatttgttcctggagcattcaggtgttaggcataccctagcagccagtatatttctagtcatggtgacaagtaggcaacgggattgcctagagacccatgaaatgttatctgagccatgtcttcattcatccataggatcagttctgtgccacaaggaaagctgtgtgacagtctcatggcagatcagacccacattaggaacagcctagaaaagcaaactgcaaatatccatttcttttctctgtcataatttgttttcccagttgctggcgaggttgaaattagctctgtctgttgacaatttggatacaataacctttctgtttcgtgaattctgaacagtgaaggactgaattctgctctgggctgcagaaaaataacaaagcactcagtaggatagatgggaatggagcacggacttagctgaggaagaatttggccctgctctggagctctctttgaatttattattcctgccttccatgtcttttcatgctaggtgggtgtagaaagccatcctgctcaccactttgtcccccacccactgccacctatgctgtcagccattcatctaacccacttagaagaaccagaatgaatatagatttcttctttcacacattaatttatggagccttcctatttcttctcattgcaatgttcctacctgctgcagtcacattcaattttattgaaaagcagcagggaattcatcctttgctggaaaactttgacaattaaattcaaactataaggaaaaagttatcctagtttcagtctctctttaaatcaaagtgtagacagtatgtagtgggttatggtgaaaggcccccataatgaggagagcaggtaccctctaagagttgaggggaaaaatcgatgcagatgatatgagttaaaccacatacagaagtgaccctgagatctggattttaagtggatgatggccaaattccaatcacaactggtatgaatcctctaaagttgaatgtttgtcataaaactgccacctatttgggtcatattgtagcctgcttgaagaaagatctaactaggagagggtggtctgcatgacctctagaaagacaggagtttgtcggggtcttctgtgcagtccaagaagatagcatgaccagatgacatgatgtgtttatctgcaagccagatctattcccataatgggaggtaaatgcatttgacttagatagctccatgatgtccataaaaaccattcagctaaatacctttgcttcaactctgtgcttcccaggcaatattccattaagattatggcttatcatgaagactttcctccaacccaggcaacatggtgaaaccccatctctacaaaaagtacaaaaattagctgggcgtgatggtgtgcatctgaagtcccagctactcaggaggctgaggtgggaggattgcttgagcccaagaggtggaggttgcggtgagccgagattgtaccactgcactccagcctgggcaacagagtgagcacttggatcaaaaaaaaaaaaaaaaaaaactttcctacatatggaggctgtgttgccccacgcccataagtttacataaagtccacttggcattcctgtttctcactgttgggcatgtcttctacatcttgaaagtttgggtagtgtgagccagttcctctggttgaacccttctgcacataccatcaaattcaagatctggaccaggaaataataggaccacactccggacatggttcagtaaacatcctaggtaacaaaactcttgaattcaactgtgagaaggtgatttttcttccctatctctgtcttcagaagaccagcgttaaagttgactgataatcacagccttttttaaaaaaattcttactaaggtgacattgttaggctgttttgggcaatcctttgaagtggtttttcctcccaaattttctaatttttgttcattatatatttgaaaagaaattcaaattgcctgataatagaaaatgaaaacatgacaagctataaactctgaccttaaaagcatctctaatatagcatcataaaatataattagaaatccatttcaacatcacattacagatctatgacttacaggtaatttctgtcatttaaatatgagggtgagctgatggctgaattggattcttaggagaaaaacaatttcttctgcattaggagttattagtttaattgaataatatctggatcatactggtggtaatgttaatgttattacccattatcttggtgatggtcacaccactgtttccaggaaaaatatagcccattaactgaacagaaggattaaaataggaacaaagtggcaagcttttcatggcttattatgccagggtcaggacaaaggaatggccctgaccttgaaatgggacagaggacccagcctgagctaaatgcctcaaagaattccaagggaagtcctttcaggcatgacagagtgcatttggtttcctcagcatgtcgttctgaacatttctactcattaatttattcatttattcacttactcgttcattcattcaaccagcccattcatttattcaaccaacatattttgtgcatcctcctgaaaccatgaatggtgatagatcatggagagacaaagatgacttagtcaaggagagagggtcaaggcttattgagaacctgctgtatctcagacattataatgggagatttcagacaatatctgttttattcttctcgagaattcagaaggtaggtagagttgttatacccattttatacatgaagaaactgaggttcagacaggtaaaatgacttgtccaaggcctagaaagggaaggagtcagaactcaaacctaggcctgtcttaattcaaggcctaggctatttctactacacctggaatttggacttagaacataaacacatttttaaaacattataatacagtgtgatgaatgggatacacagtcatataaagcaagacagctgccacggcgaaagccagatttccactctaagtgactcatccgacgtttttaggtaataggaaatgtctaggtggccctaatatgtcctccaaatctcttcttcatcctcagccccacacccagctctccctccatctccttcttatcaatggggggttctctgctccccccatcttcacaagcgaagggcatttgttcttccacaccccacatgatgcagggcaagaggaaaggtcaggctccacctcattctcatcacctcctcacctctcattagaaccgtgatcctgtgagcctcctaatgcccagccattaactagcatctgtcctcctggtctctgctacctaccagccttctggtcactcccagccctcagtgaagatgttggccctgggatcactgtcttatccaacccaagtagctcttcctgggactaggaccactttcagctgctgtgaatactggagtcatgttggcaccatgagatattttatcatcctatgaactcatttgggaactcaatgacaggtgatacaatggcctaagcccatttcaaagagtatttctgacaaagctttgtgtaagtacaaaaaaaattttcagaccatgctttttcccattataacatttcataatctcttccttgttttgtccctgcacctctacctccattaaccaggtctcatcaagttgtgacataagccaggtttcatcaagttgtgacaggtgacagaggcgtcacatgacaggggacctgattaggaaatccatatcctcataggatgcactttaacatcttcttgagctgtcttgatattttgagacatacggcaaagattccatatactgttccagtgaccagtgaccttgagaacatatttaaaactatagatttctgtgccccacccagagatcccaattcagtagcgctgaggtgggatctgaacatgagtagacttagaaagcctctagctgattctgaagcacagctagtttggggagcactgacatatagccactgcccatgaacctggatgttcctaaatcttgataccaattgagtgacttgaatcctccctcatctgtatgtataccatcatcaggtcggaaaaatacctccagcttccagcttaaggttgccctctcctttcccaccaccagtaacatgctagtaaacatttaacaataggctctcagaaagaaaaaaaattaagccctgatttataatgtttgccagtttccatggtgtaaatactctcaccagggccaatttccagctaccaatgtgatgccactgaacgtagaggtgggaaaagatgcatgtaattaacattccttagacagaagtcagctccagcacatcactgtcccacccatcctttactgattcccaaagatcaaacaaactacacccaagaaacagaggggtctctctcagatcctacagcacagccagagcctctcagaagtaaggttgtctccattttttaaaaagctctggcatattaaaaagtggaaaagtgggccgagcatggtggctcatgcctataatcccagcactttgggaggctgaggcgggtggatcacttgaggttaggagttcgagaccagcctgcccaacatggtgaaaccccttctctactaaaaatacaaaaattagccagtgtggtggcacatgcctgtgatcccagctacttaggaggctgaagtaggagaattgcttaaacccagaaggcggaggttgcagtgagccaagattacaccactgcactccagcctgggcgatagagtaagaccctgtctcataaataaataaatagtggaaaaagtgctactgcaagattggcaaaattggggtaacgctttaacaccaaaatacgatgcaataaaattgtattaatctcaagattatttataagaattataaaaatattcatttatacttcaccataaatggggtcaattggtagcaggacatgtggaaagccgtaagatgaatgtcattcggttctgtcggtgtatctctgtgactctggagaaaatgccagactctttatctgaggcttttgtgagtgtgaaaactggggcataccccctcaccactccgaatcctgtctccacccttctacctcccaccctcacgccctccccttcaatccatgagagaccctggacatagttttctccctcctaccttctgttctttgcctctcaagaatttccaaagctaggtgccctgccactgggtcttatctgggtcacaaaatagccaagtgacaagaattaaatgtaacaagaaaacactggggggtccaggtcccttctgcaccactgaggacctgcagttagttactgatgacgggctcttttatctggctccagtctggcaagagatctggtggagaattctttctggctttcattttccttatttctctgagccatttctggcaggaatgttataagcaaatcaaattttgatcagttgaagactatttgaagactctaggagctgctgctgattcattcatttattaaacaaacatttatttaatacctcccttgtgccaaatcctgtactagacagtggggaagagggatagagagaggagatgaagagcacacagttcctccccttgaagcacggagagtggaggaaatggatacatgatatgtaagggggtaacagcagtccctgaggcagatcccatgacagggtgcaacgtagggtaccttggaagcacagaggaagggtggctaagctaaaccaagcggtcaggaaagccttgaactgcattctcaaggacaagtaggcattacctaggtgagaaagggttaaaaggattaaaagggagatggtagtttatgcaaagaagcttaaaaaaaacaaaagctatgtggttcgggaaactgcaagtagaatatctttgatatggaggaccctgggttcagaggctggttcctttgcttattagctgcatgaatgggactgaatttagcttctctaagctgcagtttcctcagcaggaaaccccaccttaaaggactgttagtatgcagatgagataatgcatgtagcactctcatatctagcatagaggccatacccagtacttgacagcttggtgatgaggatgaagatgaggatggtggtggctggcataaaggatacacataagggtgaaagactgagggagatatgaggccggagaagtaggtggggccaaagggtgagcccttgggctccatgctgaacaaaattgggctttacccctaaagccaaaggaagaatttcaagagtggagtagcctgatcaagtgtctgttttagaaagttctgtctgatggactgggtgcagggagtaaaacgggaggcaggaactgattttggaggctcttgcactaatgtaaagacagtgaaggcaatagacatggcacggatggagtgacggaagcctctccagggtgtggctgagggcgccattcctttatgatttctcaggctatggatgtgaattttcctaagccaggtctgctcactcacagcagggcccagctgcatggaggaatatagaatccagggtattatcattagaattaagctgcttcgttgagtccataaatgtcacactcgggcataccagcatgtctttttttctggcttacaatgtaaaaagtaacaatggttatctgtgggtagtgggattatgaattgtttttatattattccttttgcctgtgtctattttctaagtgttctacaaagaacatattttgtatacggaaaaatttattataaaaatgtttttttaaaaaaacaaaactatacatagtttcgatccaaacagcatcctctctccttactgcctgagtaaggaaatgcttgattgaattagaaatgggaggggaggttgttgataggatccaacttcaaacttctaagctatttattttcttccttttgctttggagattgtgctgtgccaatgaagatagactgaagacgtgaatagtcttgagtttgaaaaataatcgtcgtttttattgttacagcttcaggcatggattatttccatcatttatatttcaggaaacctcaagtacagcaaaattgcccaatagttagagaagatcggattattgatactctctttttaaagaaaataaaatatcttatcagagagaagtccaagtgacaataatatcaccatacgtctacagggttgcaaaagtaaggagttgaaaggaagctctggtttaagtacgtgatgtttaagagaactgcagacaggggtctaacagctgagatttttcagcaccatgttctaaagcactttcttgctgggcctaaatcaaatgtttgtctatataatgtcttagacattgtatgcatcatcgggccatcttcctaaaaggtggcattttgattacaatcttcaatttggatttttaaaaatttgtaataccagtaatgataaatagtgcacatagttgtatggttcataaagtgttctaacatttaatctttacaactctaagtgtttgagttcactttagtccattttagagatgaagaaggtaaggctcatagaagcttactgactggcctgagatcacacagctaggaagtagagagagaggattcagatcaagctcttcggacttgaataggaatgccctttacactgctcccttctaatgacaggttttagttacagatgcctctttacccaccatggggttacttcccagtgaacccactggaagctgaaaatatcctaagtggaaaactgacattttttaaaacataatgggatgtgaaaacacaaaatacaatatccaaaaaatgctggcaacacagtacactgtacagtatcggttgtttacccttgtgatcgagtggttgactgggagctgtggttcactgttgctgtccagcaccacaagagtatcatatcacaaattgctagcctcagaaaaggtcaaaattcgacgtacaatttttactgaatgcatatagctttcacatcatcataaagtcaaaaaattgttaagccaaactatcttaagtcagggactgtctgccttttattttcattagactcactaatcaaaaaggcaagcagggcccataggaattatatccattcctgttgctgttgtaacaaattacccacaaatctggtgccttggggtaacacaaattggttctcttacagttctggaggttagaagtccaaaatgagtcttacagggctgaagtcaagatacaagcagcgctggttccttcgggaggctccattgcacagtcagtggctgccagtcttccttggcttgtggccacatcattccaatctctgcttccattatcacagtaccttcccctctcctttagtcaaatctccctgtgcctctgtcttgtaaagacacttatatttagggcctaccctgataatccaggacaatctccccatctcaagatcattaacaatatctgcaaggcctttgtggacatataatgaagcattcacaggatccagggatcaggatgtagatattttggggggccgttactcagcttaccatggcaatattcgtttcattcatttatttagttattatttagttatttttgtagagacgcagtgtcactatgttgcccaggctggtctcaatctcctggcctcaagtgatccatctactcagcctcccaaatagcagggacttcaggcacaagccactacacccagctttatttcatttattaagtggtccctaaatgtaagattccctgaatttaaatttaggccatagctcttcacagttttctattttaacctttcacttttgtgtgccttgaggccttagtatttgtttgcttgcttgctggctggcttttaagcaaatttaactctgactttctattgaaaataactcacccaaaacccctcctcctgctctctgtcagggatggatgcagaccactgactttttccaggccaggcttggaaagggcttacagagaggtgcattctttattgttcggcctctcctaactactgccatttattgagcacttaatatgtgtcagaaactttgaaatcattctacatttatttacagctcatttgtaccttggaacaggcctgtaaggtagattattatccccattttaccaatgagaaaatcaaggctcaaagagttaagtaacattcccagggttacacagttaagccacagaccctccaaaacccagcctcttaataccatgcttttgcaaaattaaataattcccaaacctgcgtaatgtatagatctcttttaaagggcaaatacaagctcacaaacacccaaggttgagttataaggattttcattatcatattatttaaatatgtgcaaagataaccagatatgaactccttatgcttatagctctcttaagatgataaaaacaaaatagtgatactaataataacacaaataaaactgcaaacactttaaatgctaattaagaacattgctttaatgtgatgggtgatgctgttttgctgaaattaaatgactgctcacaatctcgatgcaatgctgaccctcgtagcctgggtccttccgagtttggtatgcatacaccagggccctttgggctaactcagttctcccactgttcttccaaccactgacaacacattgttcaggcagcagcacacgtatcctttgggctttacctagtcaaaatgtctttgatttgttaactctgctttccttttagaacccactctctttagcagctgggttctctgggaaggagacctgcatcaagattagagtgcaggaagttaccaaagaatgttcttgggaaccacagctgtgggaggcaggggaaggaagcaggatgtgcagagggagaagttgagctgtgtcgcaggcccaacaaagacctctaccaaccaactcactgggctgggtggctcttcagagttgtcctgccttggggacaagagcactgacctttgtgcccctggaggatcactggatgagggtcaccctggaaggaagtttgacctcacattaggctgtgttatctagccaatgccaaagaactgacagctaagagcaaccttttaccatcatccctgcagctgggaagtaagtccttcactcctgaagagagatctggacagagcgtcacattgtcttccacactaacgcacaataaagttgtatagggcaaccgtgagatgtgaaaacaaatgcatcccagccactgaactgcctggtgatgcttgactagatctttgagatgatccttaatatgtacacaatctattattttattctcacaaaaatataaatataaatgtttaaattcccacagagaactaagaagactctaacaacatatttacaggcccctagaggtcttcagaacctactccaagaaagaggaaggttaggaagcttccaccccagttacctctgctgggaattgctgcatatacctgtgatatctccgtggtgtgacaatcacaaagttttacgaatacttctttgggtggcagtaatcatgatggacagatcctctcacaattcacatgtaatatttgggaataaaaacttgattgaacattcattcaacatatttgatcaggcacatactatgacgtgggtactttgctagacacctggtggggaagatacctttatacgagtgaacaaataatcatggacaaagaggatctgagagtcttgggtcatcagtaagccttttcagaagaggagtggcttgaggggacaagggcaggagcattccagacagaaggatccaatgcaaaagcatgagcctttggtgcgtgggcatgacaggtgatgtaggagatttggtcaaaaggtgggtcaggcagtagtgagaggtcgcactgacagaagcggagtggagagcctgccagtatgattaagtcatcagaggcacccccttcattactattcacctggccctgactgataccgtctcatttaacctccatgcactgtgattaacccagtagggaacaagctccacaagggcagtctgtctggtctactgccctgtgacgggagcccagcacagtgtccgacccagaaaggagctcattaacatgtgttttacagacaaagagtcaggttcagagaggacagcactttccccaaacttgcgcagcatataagtgaccaagccaagagctgaaccctcggtctgcctattccaccataccgctcttcaattcctgctccgtgagccacgaaaataactaaaagagcgttttcacagtcagagaaacttctgttaccatgggaaacctggaagagaggccagcctgtgtgtgtgtgtctgtctgtctgtctgtgtgtccgtgtgtgtgtgtgtgtgtgtgtgtgtgtgtgtgtgtgttctcaaattcctagaacggacaccctttagtgtctgccacaacacaaaatttctcctgtcatctcccaagtctctccccaaacctcaaatatgtggggtactcgagaatgaaaagggttaacctttcacagcttaggagagctgttactttgcatttaaatagccgcatttaagaaagcagcattcccaggatccttatttgatactaatgtgctgaacaccttaaagcacacttacttctcccccattcgggtcacttggagcttcattacttaataatttgaaagctttttatggaaatcagttgataaagggagatgatgaagtgaaatgttattacatttaaagacccagcaaactaggctgccagaataacacctgcgtcagacatttctaagtaaagaaagagaaggagaaggagatattggtgtgtggatgaattctcatttcttttgaaactgccgttactttaaagatactccttgcctaacaaagcctaacactctttaaaattgtcaagtgaagaactcatcagctatcttatgaattctacccctgccatggcgctctgtccccctgcccaccttcccagccgctgccttggcttcaagcccattgggtctagaggtccgccctactctcctccacaggcagggtcagcctcacacagtgcccacctcaaaagccttcatgactaaccagttgagaaaaccctgggaaacaggcttggatgcgaccttttctttttactttccatttttctttctctctctctttccttccttccttccttccttcattttttcgtggtggtggtgagacagggtctcactctgtcacccagactagggtgcagtggcacaatcacagctcactgcagccttgacttcctgagctcaagcgatcctcccacctcagcctcctgagtagctgagtagctgggactacaggcatgtgccaccacacccagctaatttattttttatgttttatttgtattatttgtagagatgaagtctcactctgttgcccaggctggtctcgaattcttggattcaagcagtcttcttgccttagccttccaaagtgctgggattacaggcatgagccactgtgcccagccgccactttttttcttttttttctttttttttttttatttgagatggagtctcactctgtcacccaggcttgagagcagtggcatgatcacagctcactgcaaccttcacctcccaggttcaagcaattctcctgcctcagcctccggagtagctgggactacaggcgcatgccaccacgcctggctaattttttgtatttttagtagagacagggttttaccgtgttagccaggatggtctcgatctcctgaccgcgtgatccacctgccttggcctcccaaagtgctgggattacaggtgtaagccaccacacctggccccagcctccatttttttaatggcaatatattcacatggtttgaaaatcaaaagatatataataaggttacacagtgacaatcctcagccttttgcttgctccctggttacctagttcccttctcctgaggcaactgatttttgtaatgttcttatatatccttccagagatactttatgcaactagaaatatatacacacacaattttctttatccttaccacccctctccacaaaggtaaatagattacacaaatagattactatacaaactgtactgtagtttgcttttaacatttaatatatcttacagatactcttacttgtgacatgacttttttaatggtgaatccaaagactatacagcaatgtctaaaaaaaaaagattcaaaagtatatacgtgtgtgtgtgtgtgagttttgtgcataagttatgatgtcaactatgacaaacaaatgaatattgcaattgatgaaagctgctgggtaaggatggtgggattatagggtcattctttttgtttctctctcctcctacgccgtgtgtgtgtgtgtgtgtttgtctctgtgtgtgtggccaaaacatggttatgtttttaaattctaaagaccttatttcagtatgtgaggtatattttcattttggtagagttctttcctggccctttcatatgcatcagcatctgtttcttaaaatacttgagtcactttattggtgaaggcttcctccaccactctaaaattgcagcataactctctcaccccatcctggccctccccctcacccttcccggctatattttccccggagagctaatcagcactggacacactgtgtagctgttatgtctgcctcctcctccggaatgtaagctccttgaggacaaggatgggtgtgtcttctgttcagggctcattctccagcacgtggaataggcctggcacagactaggggctccatctatcattgctggatgaatgagtcctcaccatcagccccagcaacccaacccacatgctctctggctcatgcctgtaaccactaaccagagcacctgcagataaccagtaaccagagcatctgcagctctgtcctctgcttcccttttccctccccactctggcaactctggaagaccactcctccctcccaggtctggatctcaccttagggatccattcctgcaagtgcaccctccctctctcctgcaatatgagcttatcttctatattggattatacacttggacatacaaacttgccctcatatcacacatctttcaaaaaataatcacatgtccttcctgctactgccatttttctcaactccacagccgacttctcaaaaagcgctgtctgggcttgctggttccgctaattcacctctgtctttcctgaacctgcttccattgtattttcagtagtggccagtggggcagcggcggcagcagtgagcacatggcagggggggcagtagggcagcagtaaacagaggccgcagaggtagtggggtaagcacagggtttctgaagaggccctgggcaggtcctggtgtcctcctatctctctggccattataccttagtctgctttgctctcccccatcctctcctctgcctccattcactccccaggtaatctatcctgtggttttaactaccagtctctatgctgatgacttggagtttacgtctccagcctggacttctccgttgagctccggcctcatatatctaccttcctacatgacacctccttttggagtcatccttgacccctctttgttttatacctcacatccaatccatcagcagataacgctgagccgacctgtaaaatatatctgcatcccatgccttgaaccccttccattgctcttccctggccctatgtcgccagacacagcaatggcctcctgcctggggtccttgctccccagcttgccccactccagttactttccctgagcagccagcaggatcctttaaaaatatgaatcaggtcataccactcttctgctcacaaacccctcagccatgttccagtcccatcacactctgaacaacagcccctaaaccctctgggagggcagccaaggccagagacttcctctagcttattattaactaattgtttaattaactaattcattatttatcccttaaatattccctgcatacctctcacaagccaggctggtgctgaggatatagaagggatgcaatgcggcccctgctctaatgctggcttctgggacgggacctgccctgggatggcagtggggatgggaatcatggttgaggagtgtccaacactgtttctttttctttttttttttttttttttttgagatggagttctgccctcgtcgcccagtctggagtgcaatggtacaatctcagctcactgcgacctctgcctcctgagttcaagcaattcccctgcctcagcctcccaagtagctgggattacaggtgcccgccaccatgcccagctaatttttgtacttttagagatggggtttcaccatgttggccaggctggtctcaaactcctgacctcaggtgatccatcaaccttggcctcccaaagtgctgggattacagtgtgagccaaagcacccgacccccagtgctgtttcttgaagactacaggatgtgttcccatggggtagggttaggggtgctgaaaggggcactacccttacaggttgaggcacctccagtcagatctggcctggatcatgggctgggcttcctcacagccctttctgtttgaaggcagacagcccttgcttgatgttctctcctgtttggatttggcatcacctacgtgatgttcgaataccttctgctgtggcccccttttcccttctttgctctggccttggcactaaggtttttctgactgctgaaggtcaggtagaagatggggaggcggaccacggaagagcaggtcctgggggctggtgggatgggaggcaggcatgccccatcagcctcttctgctcctttgctcactgattttactcaggggagcagcagacttgtgtgagcactaaaaagaacataataaaaatgcagaaaatgaggttaaatccaggatggtacttcagttaccaaaggacaagctaagtaaatgccgatggccagtgccagcacacagaaggtcatagggtgatgtgagtcctcagagctcccacccaccggaggcagcccttgggcggaggggcagtggggcaggcccggaacagctctgatggtcccttcctctctggcttcagaaatgccaagctgcttccacaaaaccatctcaggggaaaatcattatctacggacattatgcaattttcccatcgaaattacaagctgtgtttgaaaagaaataaaaagaaattgaatttgaaatgcttctgtgcaaacgcatcatcttctagtggatctgctaatgggcttcagatactttctcttgctctaaaatagttgatcagacagcagcttgtgatggtggctgcttcccggggaacggggcatagaatgagcacttatgaacggccagccagcccacctgagccaggttcagaacctgtgagctctgaccacggttcccaaagtggtcactgtatgctgtcccttcccctcctctacctggcagtgctggcacggctctatgctgggactctcactgctcctccagcgcctccagctgacacccaggtcgatgagtgtcacttcacactgcgctggctccatcctaggtccagggagtgcccacggactgggcctcggaggacaccagccccttcctcatcacagcctctcattcacccaacaagtattagttaagcgtgttcccaacacagatctaaacactgatagtacagcagtgagcaaaacagacaaacaccctcgccctcttggagcttccattctagcagggggagatagacaataaaaagtaaataaggcaggacatggtggctcacgcctgtaatcccaacactttgggaggctgaggcaagcagatggcttgagcccaggagtgtgaggccagcctgagcaacaaagcaagaccccatctctacaactaattttaaaactaactgggcatggtggtaggcacctgtagtcccagctatttggtatgctgagggtagaaggatggcttgagcccaggaggtcattctacagtgagccatgattatgcccctgtactccagcctaggcaacagagaaagaccctgcctcaaaaaaaaaaaaaaaaaaaaaaaaaaaaagtaagcaaaatgcacagtcaactggacaatggcaaatgttatgaagaaaagatagtgggataaaggaatagggatgctgagtcaaaaagggggcagggacctgccatggacatcaaagtcctcactgagaagttgacatttgagcaaagacctggaggaaacaaaggagagagtgctctggtatctgggagaacagcattccaggcacagggaacagcaagtgcaaggtgtgcctggcatgtttaaagatacataagaagtccaggatgccgaaacccaggttgtggaagagtagtaagagatgaggctcaggaggacaggcagaccatggagggtgtgggggaccagagcaaggtcctgtctgctgtgagatgcaaagccactggaggattttggccagaggaatggcatgatatgactgctgcacgaacaagagtctggaggaagggaggggaggtagagagacctgctaggaagcaactgcactcatctagctgagcgatgatggtggcttggatcaggatggaggcaggcaggagacggaaagtggttggatcatgaagatattttggaagtggagttgacagggtgtgccgatggatcagttgcagggtgggagagaaagaggcatccagggtggatggaactgaaagtacggcattgccatgtaatgggatgggaagaatgaaggaggctgggcttagggaggggaagatcaggagtttggtttcaggcacgttgttgagtttgagatgccacttagatacccagatgaaaatgttgagtggctgatatgcaagtctagagtcagaggctagtttgcaatagaagattacagcttaggaatcatcagcatatacacagttggctttttaaggcaggggactaaatgaaatcaccaagggagtgtggataaaagagaagaccaaaggcttgagccctggggcacttcaagctttagaggaaagtgaata

SEQ ID NO: 435 - DNA, 40001 bp, Homo sapiens
ccacggtacttgaacatgggagaccctagatggcacttcagttttccctcctgcaggtagcatcagcactaggcactgtagtgggggagaaatggtctgagatgcacagggcctgggtaccagttttggctgtcctactgaagagccacatccccttgggaaagtgtctaatcatttgtttctcacttccttaacttttattttaggtttgggggtacatgtgaagatttgttacaaagtaggactcgtgtcatgggggtttgttgtacagattatttcatcaccaaggtattaagcccttcacccaatagttatcttttctgctcctctccctcctcccaccctccaccctcaagggtatcccagtgtctgttgttcccttctttgtgtccatgagttctcatcctttagttcccacttataagcgagaacatatggtatttggttttctgttcctttgttagtttgctaaggataatagcctccagctacttccatgttcctgcaaaagacatgatctccttctttttttatggctgcatagtattctatggtgtatatgtatacattttctttatctaatttgtcattgatggacattcatgttgatcccatatctttactactgtgagtagtgcagcagtgaacatttgcatgaatgtgtctttatggtagaatgatttacattcccttgggtatatacccagtaatgggattgctgggtcaaatggtcattctgcttttagctctttgaggaattgccatactgctttccacaatggttgaattaatttacagtcctactaacagtgtataagcattccctttcctccacaaccccaccagcatctgttattttttgactttttagtaatagccatctgattgatgtgagatggtatctcattgtggtttggatttgcatttctccaatcatctcacttccttacttctatcagggttgcctgtccactgcatcttaccaggttgtggttagggtcacatgagaccttgtacaagcatgaaagccttggtaagctatagagagtcacatgcatgttttctggtacatgctgcttgttgagtgtcttcatagtaaccagctttatgaacagcagaggaagagaagacatttcccttgaggaacaagcagaatccaccatcctgtagaggcccagaatagcactgccgttttcactttttagtatggtgcatttgcttttcctcagttgtgctgcggtaacgaacagccctgcagctcagtggctcttgaaaaaaggtctattccttgtgttccatcacatttcagcggtgggtgagctgcagctctgctccatgtgtcttccctctgggatccaggttgaagaggctgttgatacacacgtcatgaagctttcctggcagagaaaggagcaaagatagaactacctgttggctcttacaacttctgtttgagtgtgacatatgttactgccactcacatgccattgaccaaaccaagtcacagaggcacgcttgatgtcacctgggtgggaagtacaatcttctcatgaagagggacagcaaatatgcaagaacaatagtagaatctcccatggcaaggaaggtcacttaacatcgtggtcctcagccaccagaaccaaatatcataccagtgagatgcttttaagcttcacctggtagatcatcaagctggttgctttcgccacagctctccctgaagtcattagagaattgaagacttgattgccacactgggtccttgctcagttaggataaggaaataaaccaaaaagactcagagccttggggttgggctctggaagaaatgattaaaagtcctagtggagaggaatgtgcactgactactctcagagcacaaagatgatttttagggaacagaaacaggtaagcaatcagatggggaaataaaggaaagaaaagtgagttagaaatgggattccttggaaaaaaggccactggtttaaagagacagtaggtcaaggaccaccctaattcacatgaggactaattacagaggaaaggaagttgcttggccaccagatttgggagtgatggttctggctggtgtggtcttgccagcatctttggtggtgtttaagagcaacacaggcatggttttgatgacatcagataaccttccatttgaatggatttctttcatttgggaacagcaacatgttcgtgtaaagatatgaatagagataaaggaagaggcacaggcagcaaatgaggtggggcgagttggcggtgagagagcattttacaatttatccagctgtaagcacccaccataatgcctccccaaacctccaaagtcttacttcctcctcgagagatccctctgtcctcaacaagatgaacagaacaatgtcctcatactcttttggttgaacaattctgtgacagagcaggggatttggggctgacgacatttagggagcagaccctggctgccccaacaatacagcccttgggtgtgtttttcttactgagttgtttgaatgttcaggtcaaggggccagagccttttggtacattccctgtgctgcaagttgaagctctggcatgagctcatcatggggttttttggaatcatgggccaagatggaatgtctcagagcaacgagggaccttacaggtcaggagcccagtggataaagctgctggctcaggtttacatgagaaatctgtgttggaactgtgacgggaccaatgtctcctggcttccaggccacagaatcctgtacatgccatgccagctcccattcacaaacttgaaaaattatttccccaaatacaattcagatacttttgataataacagacttgggatagtggctccccctgaaggccttttccagacaccatctcaaatgatggctctcttgacacaaactcttgggcttgactgagcttcctccttcattggtgagagcccagtgctacaggctgttcctctacaagaggattaggagggagctaagtacctgtccatggggccagaggtgtcaaggaggtagtcacctgaggcctgggtgcaaggccaatgtcaaagagctagggcagaatcttgggagaataacagctcaggagacaaggcaaggtcttaccttaatttcttttgctgtcttagagccacccttgtaatcaaagcaaatactccaaggctgggagacgccatagctctgtccttctcacccttctttccggaaatagttgcaatcaagagctggggctttctatttagactagctggcttccaattccagctccactgtttactatctctttacctttgtgcttcttatataaaccccctaagcctcagtactattgtctgtagaatggggtaacagtagtacctacctcataagactgttctgagaattaaataagagaaggcacctacagtatatagagcaatgtctggaaaagtgcccagtgatggtttcctattactattaatattgttattattattattattattattattttgagacagactcttgctctgttgcctaggctagagtgcaatggcgccatctcaggtcactggaacctctgcctcctggggtcaagcgattctcctgcctcagcctcctgagtagctgggattacaggcatgcaccaccaagccccactaatttttgtattttcagtagagatggggtttcgccatgttggccaggctgattttgaactcctgacctcaggtgatccacccgcctcggtctcccaaagtgctgggattacaggcatgagccaccatgcccagcctattatttttaaatgatgctatttttcacatactggatacttagttacaaaaaagtcatatgcatactctgcccttgtggagatctgatctagcaaatgagcattttgccttctcattggtcctccatgctttttggaaattcaggatgctaatgctgggagatcctttagggatcaaaggtcagccctctcattttatggctgaagtcattgaggcacaaggaggaaaagggattcaaccaaggtcttgaactcaagcgttagatgctgtatttctttcattcatctctattattgtcattaattaattttgatattctttctaatatgttttttaacttttagggaacttatatttgtcagctttgcaagtggggctcagtttcggggaaggggtgagagagaagaaaggaagaaactgatgaagagaatgaaagaggaaaagacctgcctgacacctggatcttagaaacaaacctttcctaacaacagacctccaagcataaagagagtattttcaaacaactcaaaaaatcagtctaaatcaacgatattcaaaaggacaaagaaaaaaataataggggattatgttcttttctcatctgtcttatgttctgaagttattcatttgacaccttctgctcttgtacgatggcaggcctgtattcccaaagatgcccattccagccatctattgctgtgtaacaaatgacgacaatgtatgatggtttaaaatcacaactattttatttcatctctcaatattgtgggtcagagttcaggcttggtgaagtgattcatctgctccatatggcttgaacagtggtctcagagtggtattctgctggtgagttggctggtttcaagggtctaagtgaagtttagaggcttcactcacatgtctgcaccttggcagggatggcttcaaagatggggtccactgggactggcgactggagcccacacctggcctctccactcagacttctgacagtaagcaaggcagaatcacatgactttttatgacctagcttcagaagtcacaaagcatcattttggtcataccccattggtcaaaacagtcacaagcctgcctagactgaagaggcaggggatggacgctagcttttaatggagggagtgtcaaagaagtcatacttccatggctccgaagttgggctccaatgtggaatgtgtttacctttttccttctgaatgggccccatgagcagccataactgtgaagacagatacaatggcagggaccatggcgccttcatttcctaaggtccatggtaattttctgcaaaccaatacttctcctcaataaacacattatagaataactccttctaatttgggtccagtcttgttataattgtaatatgcatgacattttgatatgaccattctgacattcacatctcttttatgactctgaaattgaaagtgtttggcttaaaaaaatttttttaccaacaaatgaacactgaactcttttcccatttcctcaatcttacaccatgggaatggaatagattcagacatgttcctatcactttattcaggcaatagtgtagttatttttgataattggctttgtgttaggcactgtgccaactgatttttatacactatcttgtttatgcctcttaataaccctgtgatatgactattatgcccatttcccggatgaagaaacagaggtttggagaatttaagtaactttctcaaagttcatctagttagtaaatgactcacccattcatgcaacaaatacttattaagtgcttactatgtgccaggcactgacctaggagctgagattacagctgcaaacaaagcagacaaaagcgcctgccctcatgaagcttacattcgaggagggagcaacggagacagataataagaaacaaacaacatgcatacgtaacacatcaggtgataaatgctatggagaaaaacaaatgaggaaagatgggtggaggcagtgggggtgcaggcagattgctactttaaatccagtggtcagttggcatagcagcaaaagcgacatctgagcaaacacctgaaggagatgagggagggggctagaaggaaatctgagaagaaggaacagtgttagagttcaggaaaatgatttgaccccccagtctgtgccatggtaaacccatgcttataatcactggactatagtacagtgccatagccactgggttgggtctgagctcagtgctgctcatgtttgaccacacataggatcgtgaaaaggtcttgttaacttgagattcctgggctcaccttcagagattctggtgctctaggtcccctatagggtctgaaagtgtgcatttctaacaagcgctccgaaaatgctgacactgctggttaaagatcattctttgagaagtgctgttaaagaaactcacttagtaaagtagggcacgaagagcaaagaaagtcctatgagtttccagggatgcttatggatactttggctaacagtaatttccatacccacacaactcccccctaaaaaggccaagtgttctctattcaacacacagacacgtaaatgcacacacacactggatcaaatcctcaacaaatcctcaattatcatttaacctaatgttaatttagaagttaggaccctgagtcagaaaatctggcccagcttataccagctgtgcatcctaggcaagtcacttaacctctctatgccaaatatagaggtctttgtttattatgaaatttgggagaaggaggcatttgtaatttgcagttattcaatgaaaagaagtgaactgccatgccctcccgaccccatccctctccagcaaagcattagcccatcctatgaagtggggaagaggccaaggggatgagggagaggaaagggaattgcaggaagtacacacaggatacaaaccatgcgtgtaattttgtgagcaacgatgcaacctgacagttttcagcctcttccctggggccagcaccccatcatgagatgcttttcctttgccacatttccttgtcttctgggtccagaggaaaacggtttttccattctcactatggtgattcactagctgtaccttcccaccacacctcccaagcctagatttatagctcaaagggaagatgtgaaggccggatttgttcataaatggcaggtggtgataggaagactgtgtggtctgagagagggagcattgaaccagaccaagcccattcctgtctgaggtcggcctgagggattgtggccttggcaaggctttcaacaagttcttcttctgtaaaatgggcagaattgccacggcttctacttcctcctggacacagaagtaccaagaacagctagaagctcaggatcctactaatgttgaatatgccaaatacacaaatatccaaatagtgcttatggatagctgggtactgttggcagttacagcctcactcaccttttctgatattaataataattaaggacggttgttcagcacctaccctttgccaggcactgtgcctggccctttgcttccagaatctctccagatccctgtgattgccctgtgggatgagtagagttatcattcctatttttcagataaggacactgaagctcagagacagtaaattactttctcccaaggtcatacagctactaatggccaggttggggtttgaactgggaactctctccatagtttgtgcccatatgctattgcctggtctccatgcactaacttgtttgtttcctacagcaacaaagttggtttcataaatctgtaaattgatgctgtagtcttagagatggctgtagaccggaaaactgacattgccacacaatttggcttagaaacccatccatttgattataacttcttttgctctttcccttatccttgctttttttttttttttggcggtgtcttgctttgttgcccaggctggagtgcagtggtgcaatcatagctcactgcagccttgatttcctgggctcaagtgatcctctcacctcagcctccaaggagctgggcctacaggcatatgccaccatgcccagcttattttttaaaaccttttgtagagctgggtctcactatgttgccctggctggtctcaaattcctgggctcaagcaatcctcctgccttggcccaccaaagtgctaggattacagatataagccatcgtgtctggcccttgcgttttgatttggttttactcttctctcaggaaagatacaatctggcttcccaaattcctgaaatactgactcaacacaaatgccttctgctgttttcccaaggagctatttggttgtgctttaacttgcaccacaaattgttcctctcagcatctccttccttgaaggaatgaggtatggctaatgctctggagtctcttgatattgaaaagaagaaacgaaaataaacgctgagcttttagacccataagccaattgctgaagtcacttctccccagcctcagcttcaaatagcggaggaaggctgcctgcctaccccttccgaaaggacaatccaattgtaaatattatctgcacttctaagaacatttgaatggtaacactcaagcaattactttactttcaagatcattaaacacaaatctgacttgtactttaatagggctgccaatgttgttaatggtggagagggtggcataaaggctaagttttttcctctaatgggtgaatgtttacattattaccctttctgaggagtgctgttgctgagagaggttgctcaatgcccagagacattttttttctttctcacaccccagaatccaacccctcttttgccaaatgcaatgtcagaacaggtaggaggtacagcaattgtggcatgggccatgacagtcccccaactcctttctcctctgggttgctcacagtcagtctccctcacccagctcctctccatggacatgtcagggtcccagcaaagaaaatggactttggaaggaatgaacaatatttttacttaggaggctccactctcatgccttgaatcttagctccctgctattttcctcctgttttagagaacgggggttctaagaacggtgccagaggcaactgtctagaggcctgcatcctctgctcatattcagggtggaaggggccagctttgcaggagggaggcctgtagactttgctctcctttttccccaggctacctggtctcttagaggcacctgcagtgccaccttggaggctatggaaagacaactgctgtcatcgtagaaattggacactggagtctgcaaaaagcctcctggaagggacactcactcgctggaggtgctgactcccaggggttggggtggtccattccttgtcccccagcccacaacacacacactcaggccattgctcgtccttcactggtagacctcatagcatgtctcatggcccctcccttggcttcctatgaaagtgacctgggtggctgcctatggagtgagatctcaggttcacctagaagccactctgtccccaaagaattctgtctggcagtcgggatctgatagtcctttgataggcagggtctggtgcctttcattgctcattgagaaactggactgaaaatagaagttttgaatgttgggtgagcagagcgtgctgtcagggcagtgtctatacagtgtgtttcccttttaacttgtggtttagtttcaggtatgattaagttatacatttccagaaagcaaagacgttaggggctcagactttgggattacattgccctaattttaattgtcttggtggtttctagctgtgtgacctcaggcagtttattaaactctgtgggccttatttcttcaaacataaaatggaggtggggggtagggggtgcaggggtgagagtggagggttggggggattggggaggtagtggggagactacagctaataatccttatttcacagggtcgttatgagggttagataaatgtaaagtccttgcataagctgcttcatgggaagtacttaatgatcatttctctgttgtgaaatttgcttcctttgcctgctacagacatttcaaacactacacatacagcaataaccaagtagaaaagtctctctgaggttgatgtgactgatatcggtcatttttttatttattttttccttagatttatttatatttatttatttatttatttatttatttatttatttgagacagagtctcaatctgtcaccttggctggagtgcagttgcccgattgtggctcaccacaacctctgcctcctaggctcaagcgatcctcccacctcagcctcctgtgtagctgggaccacaggtgtgcaacatccctgccagctaattttttgtattttttgtaaagacggggtctcaccatgttgcccaggctggcctcaaactcctggacttaagtgatcctcctgcctctgtctcccaaattgctgggattacaggtgtgagccaccacacccagctagtcattcttaatatcagcttttgatggaagaggagagatgaagaaaggttcagaaaggagcctccaaacctcagcgacaggctctgctgcattcacacttctgtcgagaacccgcagcttctccattttgtcccaggtaggtgcaagagtgtgagggagcaaatcctccctagtgcctattcttctccgggacaaatattcatttcacttttttttttctgtccaggtaattccacaagaattgccatattcatatctattcgatattctactctagcaatgggacccataacatgccttatattcattggtcagaaacaaaatggcagccaaaatgattttccaatgggctgagaaggataggaaagttggcgtttggacggagacctatggttgctctggaccctgagtgagagtcatgattctggagccatcttttgtgcccagatcaactaataacagacatagccaagcccactgatttaatcaatgtgtcccccagcttctccttctctggccagctctgttgatttttctgaattaattcttttgagtaaggaaaagatcaaactctgggatcccttcagtgcctaagtctactggtttattcaagaagagtgagagctctgggatttggaatctcacttctgtcctagaagacccgtttgtgcccctgaagaatagaagtacctgaaaagcatcattttgaggagtgtgcatttaaggtttttccttgagttttcctcactaatgaggttaataaggaaatgatgcttccaacaatagctgttactgctaagcccctgtggagataaaagatcagtggtaagatctttcaatgccttctcattttaaactcgtagaattggtgtctggtacgtgcacataattcagttgtttgagggatttgcatctgcactactcactggtcttccacatgcattcactaggttttatgtctgaaggaggcaggcgtgacatttccaagtcaaagccggctgacttctgtcagggagctggtagagttattttaaaagtttagtaacatgcttttctctataaaataatatctgctaataatagaaaatttagactccataaataagcagaaagaatagtagaaaatcacccatcatcctaccacctaaagatagcccatgttagcatttggagatactgttttctatttatttatctattcattaatttttaaaaacataatatgatcacacaatacaaacaattttttcctgctttttttcagttaacattatggtgtaaacagattattgaaaatttttaataaatataattttagtaactatatgacatttgtaaaattcatccaaccatttctatattattggacactttctgattttttgttattacaagtaatgctagttatggcatctatgagtagatgttttatttactataataaacatctgtgagtagctgtttactataataaacatctgtgagtagatgtttattatagtagtagctttagtagtttattatagtagtagctttagtagtttattatagtagtagctttttcattatgtgagattatttccttaggtcagagttccagaattggaattactgggtcagaagggataaatatttgatagctcttaatctataatgcaaagtagaaattattatgttggcaaaagggatggatttgatggctatgaaggccccttctggtgctactagtctgtgtttctaagactctttcttcctcctatgttgatatatctatcaagccactataacatagaggcttgccagacattgatttttcaacattgaacatttgagacagtgtataaaataatcatcaaaaaggatttgagtagtatgtgtaagtaatattagaaccctcaatcaaacacacttgagcaaaagagactcatttattggctcatctaattaatactccagaggtaatacgcattcaggcatagttgaacccaggaccttggttttcttctccccatcctttggtcttgttttcttctctactggcttctcaggcaagctctcccattttgctcacatgatgatgccagaaactccatctttatctttcaagcaactctagtgaggaaaacttgcctctttcccattattccagcaaaattccaagattaatacttaccagctctgactggcctagtttgaatcatgcggctatggtaacaggcatattatactcccattttgcctggactgggttacatgcatttctctagagctggagaagaagtcatcttcacctaaaccaatattgactaagagtggaagagagtccgccaagagagaatgaggaaggtttaacttaaagaaaagaagatgaatgtcagctgagtgagaacagtctctccattaaaaagcacttctcttttagagtgctctctagaacccttcctctaggatacaaatctctaacaaggtattgccttgaataaagaaagaccctgagccctcatgaccttctataggaagcaagtgactgttaatatcaggtaagcaggtcaccacggaagacattcctagaaaaccaaacccatttcttcatttattcatttggcaaatattattgcagcacctaccatgtatcaatttagcatttatttagctgccaatgttctaggtgctgggggcacaacaaagattcctgtccaatctcgccatctggtttagccttttgaaggtgctaatgaattctctgaaatgtctctgatgcaccccgactgtctataggccatgcatgtgtttatttacaattggaatggctcattgccgctctggctggctgggctataatttgctcaggcacttaagcttcactataaaaaaaatccaaaaaaatcactgcttcttcgctagtttcaatttggctgttatgtttatactgaagattacctggatgaagcactcagcttaaatgcagcagaaatgtaaaatagggcatgtgaaagaaaataggtatggatggctaataaatcccctcaaatgaagagagcttctcatgcagccttagaagatatttgcataacctaatttcccatagcaggatctttgccgctattcattcacatgtttaaatctctctaaaatagagactggtcatttatacttttacctgaataatagtcatttgtaattttacttgaatatcctaacaaaattttagtgagaagcatctccctacagtatgataccatggaacactgtgaccaaaagatgtgttgaaattagtgaacaagtgtccactcattcaataaatattggccgagccatgtgccaggcactgttctaagagtgctcttgagccaagaaaagatcctgaggtagacaaattattcaaggtaggactaatatggtttggctctgtgtccccacccaaatctcatcttgaattgtaatccaaattgtaatccctaggtgtcaagggagggacctggtgggaggggattggataatggggacagtttcccccatgctgttcttgtgatagtgagtgaattcccatgagatgtggttgtttgataagtgtggagctcttcccccttgatgctctctgtctctcacctgccgcaatgtgcctgcttccccttccaccatgattgtaagtttcctgaggcttccccagctatgtggaactgagtcaattaaacctctttcctttataaattacccagtctcagggaagttcttgatagcagtgtgaaaatgaactaatacaaagaatttagacttgcgtttgaaacctttcactgacaaatgctgactgtgtgattctgggcaggtacatttgtctttcaggcttcattttgttgatgttgtaatctgagaagcaaaggcaggaaaggcaaagaagaggccacagtgtgaagaggttaggagctcaggtgataatctctctgaggcccgggttcaattccctactcccacttagtagctgtgtgacttgggtgagtttcttctctttaatcttagggttttcaattgtaaaatggagtttataagagacgtgctttataggattgctgtgagaaacacttgcgatactgcattgaaagcacttagcctagtgcctggcacataaggatgcctcaatcaacgcgagctgtcacttttcccattactgctatggttactgttattgttgttattgctatcttagctgacaactttaataattacagttggcactgaattcattcattcattttatatatacgtatatatttagtgagttctgctatgcaccagggacactctagtgatggggaccaagctatgaccagtcagaaagacttttactggctaggagcttgaattctagtgaagagagaggcagatgataaattagtaaacaagcaaacaaatacagaaataatagtttcagagagtgatatttgctattaaggaaataaaatggaaaaactaatacacaatgactggaagtagggggagtctttaaatcttcagagagggagacatttttcctaagaggtgaatgctgagaagataacagttacgtaacagacctgaagaagggctttcaaagcaggagagatagcatgaagatcctaggaaagccagggtagctagagagtagctgacaaaacaggaaaatgacattaagagaaaaattggagagatgagtgccatgatcgattagtgatgtctgtgcatggcaaagaagatgaagaatcagcgagaacatcacacatttgcaagccctgctgtccctaaagtcccttttaattgctagtataaaaaacttccaggaatctcctacctttaccctataatctgaccaaattagaagcatacagccgtttaataatcatatttctgattttaagaattttaagaaccaaagtttcttgaggttatctacttctgggttgaataagaaataaggctatttcctggttaagaacaactatctcggccgggtgcggtggctcacgcctgtaatcccagcactttgggaggctgaggtgggtggatcacctgaggtcaggagttcgagaccagcctggccaacatggtgaaaccccgtctctactaaatatacaaaaaattagctgggtgtggtggttgagcatctgtaatcccagctatttgggaggctgaggcaggagaatcgcttgaacccgggaggcggaggttgcagtgagccgagattgtgccattgcactcccgcctgggcaacaagagtgaaactccatctcagaaaaaaaagaaaaactatcctggtacaaatctggtgcgatggtcactttctctctcctctgtcacatagcagctgagaagggagagcagtttcactagagctcagcttcatggttggttttattctaagctaacaattatggtaagctatatcaaataagtcaatggaaaaaaattggccaaaaataggagggttgagatgaacatttggttgaaccaatgatttgggtgaaagtaatttccacagacactggatttgctacataaaaaacccatacacacacagtgttggtgcacaatgggaaggttttgtcatctttgatgtggctgtatatatttatgccattttttcatttttctatttttaaatttattttcatttatgcacttcatctttgtactgtttgtaatatacaacctgaatgtaatcaaactggagattggttaatactgtatgtgataaatgttagggatgagctgactaaaacatacatgtgttttatatgtatacatatagaaatgtatctgcatggatgaacatgatggaattaacaacggaggatgtctctgagtgaagctgatggtttaactataatttaaatactatattctgattttcatatactggttttgatattatactggtttggatattataaaaaattaagtaataaagcatgaaaggaataataaaaaagtatctagaaatttcagaaggttgttcgaagtttttgttcatttcaaatttattttcagttcattgtaatgtctgctctgctcatttggatgtattttcatctatgttataactttttgcacatttgtcaaaaatttgtgttttctattgcttactttttaaactccatacaatgcatgctactttgtaacccattataatatattgttgaattcactacagctgattctttaacttacttccttcttttcaatattatatgcagtcagaacaggagtagctggcagaaatcaatgcaaattttaaaatcgactgtgcacggtggctcacgcctgtaatcccagcactttgggaggccaaggagggtggatcacctgaggtcaggagttcgagaccagcctgaccaacatcatctgaaactccatctctactaaaaatacaaaaaaaattagctgggcgtggtggcgcatgcctataatcccagttacttgggaggctgaggcaggagaatcacttgaacccgggatacggaggttgcagtgagccgagattatgccattgcactccagtctgggcaacaagagtgaaactctgtctcaaaaaaaaaaaaaaatcaacaacatagtaacaaatcttgaaaatttctgaaattcagataaaattgtttgaagatccattgtaagttgcaaaaccattcccatgtcatatccaaattatccatatgagaaacatagtgagtaggaatgattgtttccagtgattatctcaaccaatggtgtgcttccacagaaagcctctctggccttcccacagtcactagcaaggctctggtggatgcctgaatttcacttactctagcttcattttcgagaaataatatgcaaatgtcctttttgagaattggagttcaagaagaagggctcagtcaaactccaaagtaacctgtaaatgcatttggagaggtatatgatgttaaaatttttctctgtctcaacacacacacacacacacacacacacacacacacacactcatactttctctttttagttttagtgatatttaatttttatttccaattcacattccactcaattcttaaaagtgtggcagtctaccagctctctagtctcttggttatgtaatgattggaaaaacaggactgtttcaaggaaacttacctttttgtttgtttgtttgttttaaatcttagattcaggaggtacatgtgcaggtttgttacatgggcatattgcataatgctgaggtttggtttctcttgatccggttacccaaatagtgagcatactatctaatagatagtttttcaatccttgtccccttccttccctctctccttttggagtccccagcatctgctgttcccatctgctgttcccgtctgtgtgtacccaatgtttagctcccacttctaagtctctctctgtgtctttctctctctctgtctttctcttgctctctcttctgagatcattttagggctcatttttagaattaccctaggtattagatattgagtagcccaggctaacctgagcagagtctgcagctttactttgctgtggaatctagtgcaaagtattctccggcccctttgctacacagtcttcttaggcttaaagcacacaacccttattggtgccccctatttctgaatcctgccacatcctggacactgggatttcttaccctggcatcccagcctccctgccagcttcatctctcttcattttcccatgatgtcctaatcccaaatgacctgcttccactctcagctttaggcctttcaactttcggttccctctgcctggagctcccccactcccatctgagggcccatctttttctgctggctaatttcttccacttccttcaagactcagagcaggtggcagttcctctctgaagctttcctatttttgttttccctattctgtatccccttcaagttgggctcagaacctcttctgtctcctcacattatcttcctgggtggtagctatgaatttatatgctctactcccgggtagtcactgagctcctggagggcagggtctgtgtgctatttatatctgtgtccatgcactctcacctggcattgtccaacagaacttcccatgatgaaggaaaggttctgtgtctgcaccgtcctgtacagtagccactagccacaagtggctattgattatttgaaatgtggctaatgcaactgtggtaatgaattttttattttgtttaattctggccaattgaaattgaaatagccacatgtagctagtggctaccatattattggacagtgcagattagcactttatggagcccgtattaggtattgaccttgaaggagcatgatagttgtattatattttttacatgatggcaaaagatgttagtcccttttatttttagtgactttgaaccctcaaatccattaatattctcctctccttcactggcccagaagagcaagtttatgaattcattcattgtcctattacagctaagcatagaggctccgggttcaaacacagccagatttggatctagattcaccacttaccagcatcactagccacatatccacaccaagttattgaacctctttaggaaccaatttccttatctgcaaaatgggatggttgataatacccaggtaaaggctatttgcaatcattaaataagagaatgcatgtagaatatttagcgcattgcttggcacacagtaagcatccaaaaacattaagcaattgtcatttattcttttattcatataaaccacatttattgagcacctaccctgtttcagatgctatgctaagggacagagataaaaatttttcaagccaacgagaacaaaaaaaagggaatataagaaaaatgatagattggaaagtcacgtatattatcacaagatgaacatcagcgcctcatttttaagcttaaaatcatattaaagtattttatttgcccaggagtaaatttgaccccattttttaaacatggaggcccagaatttgcattcacactatctaagcccttacaatatgcttgttaattagtgttcaggctagaaaagcattatttttcatcatcaagtaatgaatttgtgtgtggtattaagcttttatattgtaaaattcagctcaaaaagaaagattttttctgctccacagaggactgaatttttcaactgtgatatatcatttatgcatctcatccattattgatgtgtgacagcttttacatgaggcaccgaccttttaaaataaaaataaaactacatcgtcctgatctgtttcttgtcgatattgtttttagagtacaagagattcttgtgttctatggaattcactttgaagcttcctttctttgaaaagaaatggcaggaaggcccccaaacaaactgggctttcctatttggtgcaagagctctgtgcatgtgtctaatcttgaattctgaagtgcaaatgtcatgtaatgaaagtatcagcagttacttaaatgtggttaaatatggaaactcggcataaagtcgatgtttatttgcagccagtgacagtgataagggcaggagccctccgataagtggcttttagccaccgttaatcggctgatggatggattggtgcaaggctggtcacgaaggaagccgtctcaccctctgtaatggaacgtgctcatctgtctagcagagggtgagaaggagaccatgtgtgctgttgattccattatgctgctcagggtaacctctgccgctggtgagaggaggcaaaaatcaagagaccttgacctgaatcatagtggaaacttagagacttgcagaatgtcacaactggaagggatcttagcgatcatctaatccaacccctgtatttttagatgaggaaaattccatgcgtaaaaagacaccagtatttattaatcaatgtacatatatttactccctgcataaaatcacagctggctgcccactgcccttaaggtgactccttattaagacatcaaggcccttcattgtctggattctgcttccttcccaccccagccctcatatttctttcttgctctctctgtctgtctctctctcctcatgctgtacctcgactggggagctccagtgtgagtaactcctgttctagctttaggtgtctgcttggatgacagcaacacaaaggttttccctgactctccagaactgagctgggggtgctttctgttacccttggttcttattcccctcctcatgattaccttactgtcatatttgtctttaactcatttgtctcctacttgatcaggagctctttaaggatgtctcatccatcattgtataccaagggtcttgcaaggtgcctggcacatagtaggtgctcattaaatatctgacactaaatgaaatggttaattatatgccaagcattacagcagataccagtaatacaaaactgactaagacacattcctgccctggaagaaatcaggttagtccattccatttattcatagtttttcctaaatagggcatttttttatcccgtttatgaaatttgaagaagttgcatacctagaagctttgagaaaagtgcagggacacttgaaattcccaaattttcaaacaatggttaaaaataccccaccaggttgggcgtggtggttcatgcctgtaaccccagcactttgagaggctgaggcagaggatcacttgaggccgggagttcaagaccagcctgggcaacatagaccccatctctattttaaataaaataaaaattaagaaaagaatatcacaccattagcatcagacaaaaggaaccacaaaataatttaatctcaattaagctgtcccctcacaagtagtaagaaacaagctcatatttgtggtgtaaaagaaccactgccagggtgatctcagtgtccacagctattctttcctgtacatgcccaggtgacaggcagggatgagaaataggagccctgtggaatgttaggacttgggcaggctttggaatgaccaagctctgtcccctcctcttacagaggagaaaatggcaggccaaagagaatcattggctcaaagtcaagtaccaagtgagtggccaccctaggcctctgggctgtgtcccttctccaatgaggtattgtgaccccacacgtcaccaccccaaattagtcatcttcagacacatttccaattgtggtagtggacattggcttttttggttggcccagcttcccgtacaattggtaacagtaccctaatttttattaggaaaactacgactcccacacatgggggagctcgttccaccccagcttcaggcatgcatcctgagtgactaaagtcaatgcaccttccgcccagcactctggtttacaatctaagttgacttaacaaggaaggtccttttcaaccgagctcttgtctagctcttatcatagctagagttcagggttaaaagcccccccatgatcttggctcatccagggatatctgatattggggagggggcaggatttaggaactgctcctcgacatgggaatgatttacaagtgccaacaaggctccttagtgactgctggaagataacttccatcaaagacagcaatagtaaaatcagataaagacagtctttgttttagacatcagcaccccaaccctcactcccttgaactcatagttcagggaagtccatttactgccatgttccagccggcttgttggatttctgtttgtcagtaatcttcagttcccagccaccaaaaaattaattatttaatcaaacaattaattagtccatgcagttagctagttcatggtgccacgtaccctgcaaaggtgtaaaaagctgctgctgattctcaaatggctgtttggatccacctgcagacactggccaccttttttttttagacagagtctcactgtgtcacccagggtggagtgcaatggcgcgatctcagctcactgcaacctctgcctcctgggttcaaatgattcttctgcctcagcctcccaagtagctggggttaaaggcgctccccacttcgcccagctaatttttgtatttttaatagaggtgaggtttcaccatgttggccaggctggtttcaaactcctgacctctagcgaatcgcccacctcagccacccaaagtgctgggattacaggcgtgaaccactgtgctgaacctcaaattttttcttaggcaattaatttcagttcagaaaacttttattgagcacctactatatgccaggcctgcatgaagcgatacataaatgggtaagatacactcttggttttgaggggcttgcatggcataactggggagtcaggaaggtaaaaagtgctgctggcctctcattctgaccttcctgaagccaatattctggggtcaaattcaaccaaggaacttacctgtccagggcggctctggcctcagctcagactgcatatgtttaattttcaagtgtacaaggaattttaaaattttgttttgagaaagaaaagtatcccagaatgttaagtacagaggatcattactgcaatttcttcataatgagagataactccaagctcacagtgtgtattttttaaaaataaggctaaataataggttggggctgctttcagctagctgcagcaatgtttatgaacgagcaaacctctggtgcatctgggaagcaggagatgcagggcctggtaggagtcatgacaccgcaaataagaatgatcctacaccaaaacaaaaatactgtgacctacatgcgctctcttggagactgctgcttggttgttattaatgtaattagggaaagaacatgtaagagtgtgtttagaagttcctggtgactttgttagagtaccactttttagaaagctaccacctatcaaaagcctgctgtgtgttaggtattttatatggcaatgacttcatttaatgctcattaactgccctgtgaagtaggtgtggttgtctacttcacagcttggaaaagttaagaaacttgctcaaaggcatgcagcaaggaagtccacagtggctataacaggactcgcctactgatgactgtgccacccatagaaaatgaggtcaactcccaaccctaagagcaggtgtcataggtattttatatgttcatagacttttattaggaaacatacacataaaaatgtataatatgtatatgtatatgcagtttaaagaataatgagagaacaaattcttatgtattcaaattcttatgtattcaccaccaagcttatgaaacagaatattgttatcattttgtttgaggtttcttgttcttttttctttatcatctatatatgtatatgctttagtatttcctgtttttataggatggaataatgcattatctattctcccgtgacttgattctttaacattatattttagtgatttatccaagttgattcatgtagatgtagtttattcaattttactgctacctggcttaccaatttgtgaatatgccacaatttatttattcattctgttgctgatgggaatttggattgtttctggctttactaacagcactgctgtgaattttcttgtatgtacctgttggtgcacacgtgtgtgttttagggtaaataccagtggaattgatagagtgtaagcatgggttcctcttgatgataatgccagagtgtttaccaaaggactgtaccaattttaattcccataagcagtggatgagagcttacattgttctccaatctctccatcctgatattgaccagtttgtaaattttcaccattctggtggtattttcttggaatgctaatttgcatttactgatcattcataggtttaggcaccttttcataaatttaagaaccatttgtgctgcttctgctatgaaatatgtgttcaactcctttgcccctttttcttttgggtttcctttttcatattgatttggagttctttatattttctgaatgctagttgcattagttcgttttcacactgctacaaagaactgcctgagactgagtaatttataaacaaacgaggtttaattgacccacagctccacatagcaggggacacctcaggagacttacagtaatggcagaaggggaagaagaagcaagtatcttcctcacaaggcagcaggagagaggaaagagagcggaggaaactgtcatttataaaaccatcagatcttgtgagcactcactcactatcacgagaccagcatggaggaaaccacccccatgattcagtcacctcccaccagatccttccctcaacacatggggagtatggggattacaatttgagacgagatttggatggagatacagaggcaaaccatatcactaatttttatcagttatatgtattgtaaatgtattttcaatttgaggcttgtctttttattctcttcagggcatttttatttatttattttttttgaaatggagtcttgctctgtctcccaggctggagtgcaggggcgtgatctcggctcactgcaacctctgcctcccagattctcccatctcagcctcccaagtagctgggactataggcatgcaccactatgcctggctaattcagagcattttttaaaatgagcaagaagttcttacattttaaaacttttgggctgggtgcagtggctcatgcctgtaatcgcagcactttgaggggctgagctgggtggaccatctgaggtcaggagttcaagaccagcctgactaaagtggcgaaaccctgtctctactaaaaatacaaaaattagctgggcgtggtggcaggcaactgtaatcccagctactcgggaggctgaggcaagagaatcgcttgaacccagcaggcggaggttgcagtgagctgagatggtgccactgcactccagcctgggcgaaaagagcaaaactccatctcagaaaaaaaaaaaaaaggctttttatatttcagactgaaggaaaagttataaaagtagtacaaagattttttcatccagattttctaaatgttaacattttattgcatttgctttaacactttatctcttttatatttttcttgctgttgtaaatggtgtctttaaaaattgcatattctaacttggtggtgtttagagatgcaattgactttttatattgtttttctatagaattttgataaactctccaattctaacatttttatacatcatttggcatgttttccaggtaagtaattaagtcatctgcaaataatgacagtttttgttttgtttccagtctttttgaggttatacttctctgattgatgccttcagtaccaagttgaataggtacgttaatagtgagcattcttgtccccttccttgtcttgaaggcaacattttcaacatttcaccataaagaatgatgtttgtggtagttttttgtttttcctttctttcatttttgaggttgcccatgattgggtgtggaagttccctctcattcctagtttaagaagacttttgttttaaaaaaaacatgagttaatgttacattttattgaatacttttctctgtgtttactgaaatgatcatgttttttttctcctttaatctgtaaatggagtggatttcattaatcaattttctagtattacattcttgggataaacccaacttggttttatgcattatctttgtttatacatggctggattcagcttgccaatattttgtctaggactttggtatctatgttcatgaatgagattagcccgtcactttcgttttgattctttgtctagtctggataacaaggttaatgttttggtcatcttctgctacataaaaatttgttctaggtatttgttgtacgtaaaaaactaccccaaactgagtggtgtaaaacaacaacaattatttattgttattatctatcatggctctgggggttgacagggctcaactaagtggctcttgattgggatcttttgtgtgtttgcagccagagggtggctgggaatcacttgaaaggctttcttgctcatttgcctgctgcctgatttgggaagactcaaacaggtggagctggaaagctgagactcacaggtatctctttctatctctatttgttttggtttcttcagcatggcagtttccaagtcattgagctcccagagacttccagagcaaatatcccaacagaaactggtagaagctgcatagccttttcaaatcttggaagttatatggcacctcttctgctgcatcttgtttgctgaggaagtcacatcaggtttcaggggagggcacagagacttcaccctttttttctcactatattgcccaggctgaccttgaactgcccaggctgaccttgaactcttgggctcaagtgaacttctcagactacaggcacataccaccatccccagctgacttcaccttttcaaggaagaagtttcaaagagcgtgtgacacgatttaaaatcattatacttaaactagccccataaaataatttcagcagtgtttcctctattttttcatcctccagactatttgtgtgagattagcattaatctgttctggaaattttggtagtgctgatctgtaacaccaagtggaccttgcattttctttgtggagccacttttgactacacattaaattttgaaaatggatatagggctctttatcttttctgtttcttgttgaatcttatttttaggccatgtagatttattactcatagataggcagcaaggataaacggaagcctaggatccatggtgagccggtccagcagggctcaggaaagctgcccagggtagatggagtctcatctccctgtgccccatgttgcaccacaactgaggggcctcaaaatcactctgctctggcctgggtttatgtgctctgggcgtcacttggctcactgagcaccagtgttgcagaatatccagttctagaaggaataaggacatagccctggttgttttggacatttcctccttatctcaggatgttgcattcttagtccatcctgcctgagaaatgcaagcaagagagggaagagctgggtcagccaaggtcatctggagacgtgtgctacaattgtggtgcctgcaaactctattgcaattagtcatgtacaacatactttcccagactatgagctctttgaggccaggaactatttataatttatctccatattcatgtgcctggcaccatgcctggctcatcataaccctcttgccgaatgcagacagtagagtaaaagcataaagaagtgtgtagtcaggaagtctgccaatttaggcagtcaggtggaaggtttaacaggggaagcaacatttgagctgtgcttgaaagatgatttggtgttagccaggcaggagagcggaaggaaagacactggaaacagcaccagtaaagcacagagatataacacagtacaggataactgcaggctgtattagtccattttcatactgctatgaagaaatacctgagactgggtcatttataaaggaaaagaggtttaatggactcacagttccacatggctggggaggcctcacaatcatagtggaaggcgaaggaggagcaaacgcacatcttacatggtagcaggcaagagagcatgtacaggggaaatgccctttataaaaccatcagatcttatgagactttttcactatcacgagaacagtacgggaaaaacctggccccatgattcaactacctccagctgggtccctcccatgacacctaaggattatcagaatcacaattcaagatgagatttgggtgggaaaacagccaaaccatatcagagggctataggtcagtgtcttcagagcctatcagagtgcttggctcacagtgggtgctcagtaaatgcttgtagatgaatgaatgaatgaatatattgatatccttaactttcttactataggaacatttctgtctataagaccaaatctattgtttgtgttttaaaatgtagattttattattattcagatatgatgaagccaacagatcacgagatgatggctattgcaaagatagtttgttactcaagtttcccaagaagaggggacaggccacattatggggttggggacacataaggaagcactagggttggtcaagaggcagagggagcaaggggaaaacatgggcaagggcatttatggtggtttctgcaggaagaaatgggcaaggcaggataagcaagtttaggcttggttagtttgaataatttcagtgtgctctgaggaataggggctgtctctagatacctggtacctagccctggagtgattagggcaggtaggtattagccctgagtgtgagaactcaacaaaggaggtggttgggctatgggctcttaatggatgtgtttgcatacaaaaagtgcacttgtagatgagtttagtttagttttgttttttttttgagatggagtctcgctctgtcacccagactggagtgcagtggtacgatcttggcttactgcaacctccgcctcccgggttcaagcaattctcctgcctcagcctcctgagtagctgggattacaggcacccgccaccacacctggctaatttttatatttttagtagagacggggtttcaccatgttggtcaggctggtctcgaactcctgacctcgtgatctccccaactaggcatcccaaagtgctgggattacaggcgtgagccaccgtgcccagcctgagttttttttactatccctaagaattgtctaaccctgggaagggcagttccccaagattcatcaaggtcccaagatgtcaatgcagcaaatattgaaactagaaaacacaatgattgattatactttgacaattagggaattctgtctcttagatcatttggtgatagagctgtgatcactgggaactttcatgacctgttttgtcttgataccacccattttcatgccaatttttgccatattttattatttcatttattcattcatttaataaatacttactgagcatccactgtaaaccaggccctgtgtcagactctggccctcgcaacttggtcaagagagacagcctaggaagcaagtggaattcctgcctgcatggttagtgctctaatgaagccctaaatactgttatcttcagaggctccttgccctcccctggattcctcaggtaggaaggtaccttgatgtcaagtttagtgccatctatggaggcagtttcatttctcataatggaggatttgcttttaatcaaagagaaggccttttgtcagtctgagagctttgtcttttttgtgacttgcagatagacattttaataataggactagatacgtggctcttggagaccaggctgtgactttaaatagtgtgaagaccccaatggctggattcacaggggcaatctgaatactgatcatgaatttttaaatggccttagaaagtgcagcatgattttaggagagatttccaattaacttgggctgttcaaagcagctctatgcctgggaaagagaatgcatgagaattttccaaagagctttttctcttgaaacagaaaatataaatggtagtggggggaaaaaaatcaaagttactgaatatggaaatcaccactttggggtttatgagaaccacatcctgctaactccctgctatgcgatggggctttcagaggtaatgaggcaagtaccagagtgtcaaatgtctgccttgctttacacttatgtgtgctcttgtcctggtcctcctgctggtaggctacatgctcagcccaggcagagatggtgtctgactcctccttctagtctcctagggaaaatcttgcactcagcaggcacttaatgcactctggtgggattgaactgaaaagacaagactccccaggaaggcatagggagtcctcctgttgcctattactctgctgtgaattggaggcacagcagcctctctgaggctacaggcaaaggcttttgccttctggatggaggaaggaaactagctcttactgagcccttaccatatgcctggtaggcaccttgcagcattttttcatcaaacctcttgataaccctttgtaattggtattgttacccccattttacagatgaggaaatagaggcactgaagaataagctctcctgaacgattttcactggaaagatttttcaacattccatctgtccactccaccagcctgagacaaccatctttactgaggttttgaatagttaagcaggaggtaatgcactcttaacagtgtttaaaaggattaagcaattcaaagcatacctccaaggaacccctgccagagatgctgaatcttgagtttgctttcttcctctgaagggcatctgaactttcacctgactccttatgcttagctcaaacgggggcaggttcaagcaggaaatcggatggcctgagaggtgctgccactgtaattaagaacagagcagaccattgccaagactcaagaaagttgtatgcctcttaatctggtttgtttcattaggccttttactaatgcccaagttatggcccttctgaaggtggctagaagcaggtgttggggtggaagtgggcctaaaacccagagcccagtggctgctccgcaaaagagagatgggcaataacattaaaattatatttatacctcaacttagtccacaaaactgaggttcaagcactgaaccacctgcctgatcattgtcaccacagggcatgatcatttacagtctggatttgacaatacatcagagagcatggacttatgtttggacatttaaaaaccgcctccacgggaggcagagtttgcagtgagcacgggtggcagagtttgcagtgagctgacatcacaccactgcactccagcctgggtgacagagggagactctgtctcaaaaaaacaaaacaaaacaaaacaaaacaaaacaccttctgaatatcgcattcaaaataaatttttaaaagttatcaaaaacttcctaaatgatgcagattcttaggatgatacaggtatttgactttgaagaggacaaaggctgattgcaattcttcttctgacacgagactctccgacagtgtgtgtggctccctttactttccacatcttccttctttcttctttcctagcttcattccttctgtatctcctgcatctcagacatcatagcagaaactgctaatcatttttcaatgtgcattctcctcttcttccttcaggagaaccctcaagtttttgctgaggagatagctgctcagttaaaaaccagatttctcagcctcccatgcaactatgtgacaatgtgactcttttcttgccagtggtgtgtgagcaaaaataatacgtgcaacctttgaaagtgcaattaaaaaaaagaagaagcatgccctgttcttcctccactttctcctttcctctgcttggcacatagctatgatggcaggagttggagcagccattttgggccatgagatgaaagccttatattgagccatgttttgagcagaagaacagaaaagaaagaacctgggcccctgacattactgagccaccataaagacctaggctctctacttgaacttcaggtaagagagaaataaacttcaatattgtttaagccattgtatttgggcgtttctctattatagcagcctaccatgtatgctaacagaagtcatagatgtatcttttttttttttttttttgagatggagtctcgctctgtcacccatgctggagtgcaatggtgcgatctctgctcactgcaagctccacttcccgggttcacaccattctcctgcctcagcctaccgaggagctgggactacaggcacccaccaccacgcctggctaatttttgtatttttagtacagacggggtttcaccatgttagccaggatggtctcgatctcctgacctggtgatccacccacctcggcctcccaaagtgctggaattacaggcgtgagccactgcacccagccaatagatgtatctttaaagccagctataggtaatattcaggatagagaattaatgggtaacagactggaagtcaacagaacaattcacccatccatgacttgctggtcaaaactctttagcagctgaaagactgtagaagagcatgtctcgtggtagcatccacccaagaaaaggtggaatggagaggtttcaatggaatggaagtcagacagacatgagtgcacttattagctctgtagctttgggtaattcttaataccctttctcagtttctccttctattaaatggatacaataactcttgcctgactattttgtgaatcaacaagaccatatgtttaaagagaagcatagtgtgaatgaaagagccagaaggtctggatttgagtcccatctgccattaacttgctgggttgccttaggcaagtcactgcacttctctgggcctggtcccatatccttcaaatgcggaagtttagactagattatctctgaggtcttttcctgctcagacattgtatggttcaacaaattaggctataatattatgatgagagtcagaatttacagcaacattttgctgaaggtggcctggctggcactggttcctgagagtggattgtgtgtatcagttcttaaattggtagtcagttcttaaattgggtcaggatggcagcttgaaataggccatagtaggagtatttacaccacagaaattggcaaacactatgaagtggggctcccccctaccctccacagagagctggttgttaagcacttacccgcatgccacttactacaaggaaagaaaaagtttttgtatgctttggtgctcacagcagcaaataactagtaaagcttaagatgagaacgtgcaatatttgtctataatgtacggaggactgagggggaagaattagaagttactccactcctagatcccaggtgccctggtccagtgctaagttatagtaaatgggccccttgtggcatgaaggagttagtatctcttcctcagtcactaatttacctgggcttattgtcctgttgtgcttctggtgcaccattttgtaatttaattaaaactggaggcttgagataatgggctggtcgtgcctgcaaccccaccctgggtaaaagttgggcccctgggagcaggaaaaaaggtcttccaaggcaccaagtgatcaggagcagtcgttacattattccagttaatccaaatgaagtagttacctaaggccctgactgatctagccaagtgggacctgtggcttggaaaatgtttagagattctggaccaagggattacccacttactcattctcaccatttagagtgtcttctccaaagcgtattttgagatacagcacttccttggtatgctggtagcaatccttcccaccccaaaatacctcatggttaaataagtttgggaaacactgaatttaacaaagataaacaggttatttatggcactactcctcagacattttcataaattaaagtagtgcttctccaactgtctgtggtgatggatcagattttaaaatttctattcaatgcatgatttggaaatcaatacatcctattgcccattactaataacagctcttgtcttgtgcacttattgtgcaagtgtggacattcaacctggtctaaatctttcaatgagatgagttcatggctatgcacttggatgacccagcaatgtccaattgctataaaagtctctagttgggagtgagaccggcccttcggtttgcacgggagccgggtgaggcctgtgactactggctttcctccacttccctgataacctgcatgactcagcagaggaagccataatcctcctaggtacacaactctggtgacccgagagtctcacccccattctccacagcagctgcagcaagacccgcccaagacaacctgagctcagacacacctagccctgcccccacctgatgctccttccctacccaccctggtagccgaaggcaaagggcatataatcctgggagtcctcacccactgctggtccctctccatactactacagctgatgctttctggaaagtgccacctcctggcaggaggccaaccagcacaaaaatagagcattaaaccaccaaagctaagaaccctcaaggagaccattgcaccctgtccccaccaccacctctactggaacaggcactggtatccatggctgagggtcccatagaaggttcacatcgcaggactctgtgcagacaacccccagtaccaggttagacttcctaggtggctagacccagaagagagacaacaaccactgcagtttggcccacaggaagccacatccataggaaaagagggagagtactacatcaagggaacaccccataggacaaaataatctaagcaacagctttcagccccagaccttccgtctgacagagtctacctaaatgagaaggaaccagaaaaccaaccctggtaatatgacaaaacaaggctcttaacacctcctaaaaatcacactagttcaccagaactgaatccaaaccaagaagaaatccctgatttacccgaaaatgaattcaggaagttagttattaagctaatcagggaggcaccagagaaaggcaaagcccaatgcaaggaaatccaaaaaatgatacaagaaatgaagggagaaatattcaaggaaaaagatagcttaaagaaaaaacagtcaaaaattcaggaaactttagacacacttttagaaatgtgaagtgctctagaaagtctcagcaacagaactgcacaattagaagaaagaaattcagagctcaaagacaggacttcaaattaactcgatcaaacagagacaaagaaaaaagaataaaaaaatgtgaacaaagcctccaagaagtctgggattatgttaaatgaccaaacctaagaataattggtgtttctgaggaagaagagaattctaagagtttggaaaacatatttggaggaataatcaaggaaaacttccccagccttgctagagacctaaacatccaaatacaagaagcacaaagaacacctgggaaattcatcacaaaaagatctttgcccaggcacattgtcttcaggttatccaaagttaagaggaaggaaagaattttaagagctgtgagacagaagcaccaggtagctaataaagaaaaacctatcaggctaagaggagatttctcagcagaaaccctacaacctagaagggattggggccctatcttcagcctcctcaaacaaaacaattatcagccaagatacagcctttttcagacaaacaaatgctgagagaattcaccattaccaagccaccactacaagaactgctgaaaagagctctaaatcttgaaacaaatcctagaaatacatcaaaacagaacctctttaaagcataaatcacacaggacctatgaaacaaaaatacaaattaaaaagcaaaaacaaaagacaaaaaaaccaaagtacacaggcaataaagagcacaatgaatacaaccgtatctaacatttcaacactaacattgaatgtaaatggcctaaatgctccacttaaaagatacagaacctcagaatggataagaactcaccagccaactacctgctgccttcaggagactcacctaacacataaggactcacataaacttatagtaaatgggtggaaaaaggcatttcatgcaaatggaggccaaaagagagcaggggtagctattcttatatcagacaaaacaaactttaaagcaacagcagttaaaagagacaaagagagacattatgtaatggtaaaaggccttgtccaacaggaaaatatcacaatcctaaatatatatgcacctaacactggagcttccaaatttatgaaacaattactaatagacttaagaaatgagatagacagcaacacaataatagtgggggacttcaatactccactgacagtactagacaggtcatcaagagagaaagtcaacaaagaaacaatggatttaaactataccttggaacaaatggacttaacagatatatacagagcatttcacccaacaaccacagaatacacattctattcaacagtgcatggaactttctccaagatagaccatatgataggccataaaaggagcctcaatacatctaagaaaattgaaattacatcaagcactctctcagaccacagtggaatgaaactggaaatcaacaccaaaaggaaccttcaaaaccatgcaaatacatggaaattaaataacctgctcctgaatgagcattgggttaaaaataaaatcaagatggaaattaaaaagttctttgaactgaatgacaataatgacacaaactacccaaacctctggattacagcaaagacagtgctaagaggaaagttcatagccctaaatgcctacatcaaaaagactgaaagagcacaaactgacattctaaggtcatacctcatgaactagagaaacaagaaaacaccaaacccaaacccagcagaaaaaaggaaataaccaagatcagagcagaactaaatgaaactgaaacaaacaaacaaacaaaaacccacaaaagataagtgaaacaaaaagctggttctttgaagagaaaataaaattaatagaccattagcaagattaacaacaaaaaagagaaaatccaaataatctcactaagaatgaaactggatatattacaactgacatcactaaaatacaaaagatcattcaaggctactatgaacacctttatgcacataaactagaaaacttagaaaaaaatgggtaaattcctggaaaatcaaaccctcctagctgaaatcaggaagaattgggtaccttgaacagaccaataacaagcagcaagattgaaatggtaattaaaaaataaccaacagcagaattctaccaatcattcaaagaagaattggtattgataccaatccttttgacactattccacaagatagagaaagaaggaacacttcctaattcattctataaagccagtatcaccctaataccataaccaggaaaggatataaccaaaaaagaaaactacagactgatatccttgatgaacgtacatgctaaaatccttaacaaaatactagctaactgaatccaacaacatatcaaaaagataatctgccatgatcaagtgggtttcataccacggatgcagggatggtttaacatacacaagtcaataaatgtgatacacgatataaacagaattaaaaacaaaagtcacatgatcatctcaatagatgcagaagaagcattcaacaaaatccagcatcactttatgattaaaattcccagcaaaataggcatacaagggacattccttaatgtaataaaagccatctatgactaacccacagccaacgtaacactgaatggggaaaagttgaaagcattccctctgagaagttgaaagcattcccgttgagaactggaacaagacaagcatgcccactctcaccactcctcttcaacatagtactggaagtcctagccagagcaatcagacaagagaaagaaataaagggcatccaaatcagtaaagaggaagtcaaactgccactgtttgctgatgatatgaccatttaccttaaaaaccctaaagacttctccagaaggctcctaggactgataaaataattcagcaaaatttccagatacaagattaatgtacacagataagtagctcttctatacaccaacagcgaccaagtggagaatcaaatcaagaactcaacccattttacaatagctgcaaaaaataataataaaatacttaggaatatacctaaccaaggaattgaaagacctctacaaggaaaactacaaaacaccactgaaagaaataatagacaacacaaacaaatggaaacatgttccatgctcatggatggatagaatcaatattgtgaaaatgaccatactgtcaaaagcaattacaaattcaatgcaatccctatcaaaataccatgaccattcttcacagaattggaaaaaacaattctaaaattcatatggaaccaaaaaaggggctgcatagccaaagcaagactaagcaaaaagaacaaatctggaggcatcacactacctgatttcaaactgtactataaggccatggtcaccaaaacagtgtggtactggtataaaaataggcacatagaccaatgaaacagaataaagaacccagaaataaacacaaatacttacagccaactgatcttcgacaaagcaaacaaaaacataaagtggggaaaggtcacccttttcaacaaatgatgctgggacaattggctagccacatgtaggagaatgaaactggattctcacttctcaccttctaaaaaatcaactcaggatggattaaggacttaaacctaagacccaaaactataaaaattctagaagataacattagaaaaacccttctagatattggcttaggcaaagatttcacgaccaagaacccaaaagcaaatacaataaaaacaaagataaacaactgggacccaactaaactaaagagcttttgcatggcaaaaggaacagtcagcagagtaaacagacaacccacagagtaggagaaaatcttcacaatctatacatctgacaaaggactaatatccagaatctacaacaaactcaaacaaatcagtaagaaaaaaaaaaaaacacaacaatctcatcaaaaagtgggccaaggacattactagacaattctcaaaagaagacatacaaatggccaacaaacatatgaaaaaatgctcaacatcactaatgatcagggaaatgcaaatcaaaaccacaaagcaataccaccttactcctgaaatggccataataaaaaaatacaaaagacagtggaggttggcatggatgtggtgatcagagaacacttctacactcctggtgggaacacaaactagtacagccgctgcaaaaaacagtgtggagctttcttagagaactaaaagtagaactaccatttgatccagcaatcccactactgggtatctacccagaggaaaagaattcattattcgaaaaagatacttgcacatgcatgtctatagcagcacaattcataattgcaaaattgtggaaccaacccaaatgcccatcaatcaacaagtagataaagaaactgtggtgtgtatatatatatatatatacacacacacatatatatatatatacacacacatatatatatatacacacatatatatatacgtatatatgtatatatatacatatatatgtgtgtgtgtgtgtgtatatatatatatatacacacacacacacacatacaatggaatactgcttagccataaaaaggaatgaattaacagcatttgcagtgacctggatgagattggagactattattttaagtgaagtaactcaggaatggaaaaccaaatatcgtatgttctcactgatatgtgggagctaagatatgaggacgcaaaagaataagaatgatacaatggactttgaggacttgtggggaagagtgagagaggggcaagggataaaagactacaaatatggttcagtgtatgtatactgcttgggtgatgggtgcaccaaaatctcacaaatcaccactgaagaacttactcaagtaaccaaataccacctgtaccccaataacttgtggaca

SEQ ID NO: 436 - DNA, 20001 bp, Homo sapiens
gtctcagccacaagatcagcctaattaaatttcaatggtcaaattaatatttctccacaaaaattattttgaagaaatgaaagatgcaactgattcttgaccttcttagggaatcttctaagataccatttacagatcattcatgtttttatgcctgtattataaagtatgtgacattctaaccaaagtttatatgacacagaatatattttccacaattcacaaagtatatttcaatctttactgacgaaatggcattcactaaggcacttctatatatgttttaaaatggcaggaccttaccaaaaatggtcatatctatttatatgttactccaaccttaatcttgtctatatatttcttctttcttagtctatgccaatgtgaacttagagtaacagcttccctccaacagagtccatatctgtttttctgcaaatctaaactaaaatcatagatgatccatttaaatgtgcatttattgaatgcttgctgtgcgtggcatatgcaatctgatctcatcctcacggcagacagttccatgcagttgttattacctctattttacagataagcaaacaggctcagagaggttaaatgatgcatgtaacacacgtggcccagtgggaagctgagtatttgaattcacttaagatgctagagtccaagtttcacctaatttcttattcatctttaggaagcatgcaaaaaagtaaaatttatcaaatggtaagaactttcatagagaatttccatcttttcttaaggtcagtgaaaatggtgaactttcaaatgcttttgcaatattcacacagatttcaaattgttttcattgaaaagaaacataagaatccaatggttatctcccaagcctaactgtactattatcatccacagatgagacattaagaataacaattactacagtagaactccttttctcttaaggggaaaacaggtccctagaagaatattaaggaaatggacagaaaacagggctgctgctgtagagaatgaaattatgagcaatgaccatgactgcctgcctcagaaaaccactggtgtgggaagatttgcacgtgtaaacaatgacgtgtgtgtctgcattaaatcttcctcattctatatattctaatgagtctttagcctataacaaagtaaagattttgtttaatgaacacagcattcattttgactagaattgtgaatccaaattgtggttttggagggcttaatattagtaatggaattttataccatataatttaaattatgtaactgcatagacatttgcctttattttgtacatccaggtccagactatgtaatatgtggctaaaatgacacacttaaaataccagaaatctcttattcaacttttagaccaaaaacacacacagcacattaattgcattatttccctgtaaaatttcatttaaatattatttttgctgagatttatttttctatactcttagaagaaagtcataatgcacagtttctagtatgaggcagcactttatatctaaaataatatattgagccaatctgtcctgataagacctcaaatgaggatcctggcaaccactgtaaggtcagttgcacactccctattttacatgtattggtgctcgaactgttaaagtgcttagccagattgttattcattctcaggaaattaatacacgttaatccaagtataaccataacaaacagccatccttagagggcctattatgcttgcagctttgcataacactccttttaagtcataaaacaattcaaaaattacatattataattcccacctcatagactagacaattgagagccagggaaattaaaagtattgttcaaagggcacagctactacatttgaggaagaagatatttgaaaacgtaactttaaaacttgtaaaacccagtagctttctgggcatagggtcctcggcagattctggtggacaactgcttactcacaaatgtctttcagtgggcaccaacctgggccctgacacccactgatgaagtaagtttccagctctgtcatggccctaattctttgaaaagtacatgaacaaatgcagtgcttcttaaccaatcagtttaaaacaaatcagtacttaaccaaaatgcagggccaactctgactactaaaccaaaggtgttaacccccaggtgggccataggttcctaacagtagagttgctgaaatgatttgccagtatgaaagatgatgacaccttagatgccccattaactccagatttgcaaatgtttaagtggaggggatgggaggacacatttcagaccaaaattttaaacagattctctctcttcacttctttccctttctctctcttaggaaagttgcatgtatacattaagtgtggagggcacagggaggaggtgacactatcaaggagaggaatgtgctttcagacctaattagagcagcactgaagaaattttgatgtcaacaaaagatatatatatatatgtagaaaataaaatctcctccaattggcagacccaacctagtttcaaggctggggttcccatgtgaagccaggaactcaactataaagtgaaaaagcatcaagtacatgtttttcctcttactttctttgtcattgtgctaaattccagctgagcaggaacttaatataacttgagtcattccatgtctacaaatgctgacttaactgtggtaacgtaaaacaaagcaaataagcaaacgaatgcaaaaaaagtgcagagaactatgaaaatatatgcacaagcctatggggatttcagggaataaaaccatcttgcacaattattttcataggttggtaaatttattgcctgatctgtgttccaacaggaaacatgtgcccagaaaaataaattagagaagtgctcagctgtaggctagtttagttaaggagtaatgaaaaggataagaatagatgatgtgagtgtaagaacaggctcagatgctttcagctgtgtgtttctggtttatattatcacctctctaatataaatctaactctacagttctttaatgactctctggggaccaccactcacaggattaaacactaagaagggacccaggagagtgctgcctttcatctcctttgggatatgtcagagttgtcgatcttatttttttttaaatggtattcaagccaaggttacctaaactatgctatagaaaggaaaagaggaaaggaagagggagagagggaggaagggaagagagaaaatgaatgttggagtttgtaaccctggaggtctaaactggcagaagttttatttcaagctctcaggaccaatgtgccttcctttgacccttactcataaaacggcatccaaaatacaggagtagccaggctatgtatacctgtccagtttggatcccaaactgacttttgcctggcgttctgaggcttgtgtgagtcacctgtctcatgctgtttggccattaatgaaagagttatagcttctctaggcctcagtttcctttttttattgacttgagatctctggagagtcttctggctcgaaagttatatgagtctatgattctgatagaaggccccagagaggaatagcgaagggggaaggggaaaagttctgtaaaaaaggccagctccatgactttggcagctataggggaggagggaaggtgatcctacaggcgctcagactttctaagcattttccaccttctgctttattttttatattggcctctttttccaagacaaagctggcacatgagaagtattagtgctcaacacaacctcttcttcagctgctttttctaagttaccacaggacactagatttctttctttttctgaggagctgtgaactggtgatgttggaaaggtttctggcaaaacccaagccactgctctacagtctatacacagcctctctgtaatccaaagaagtcctcagttagaagggggtggagttggagagaagtaggtcctccttgtttcatttttagcactggtgtgaacccgggtaatctgaagaccacatctgggcatatgtatgcaagagtgattgtggaaagtacagccacttctctccaccagcttccttgcccaaaaacccaccctttctccctccacccacgcaccagccagaagccacccttcatcgccttggtttattgtcatatttttgtgttaatacattctgttgatctgcaatgtcaggttggataatgaaatttaaattgagtcccttcgatttccaatagcgaaacatttgtgcatctaactccggggctgacaaacaacttaaatgcattctggagtgtcagtcacacagcactggcacccgacactgcagcggctttcttggggagctttttttttttttcctggtgaacatttgcaaaggcgtctgcccaggatgcagtcaacctgcatccttatagcaaactggcttatcagagagcagagactgatgaagcaaatgcgtgggccacccattcccttattttctggcccccaatagccagttctttaaaaaaaaacaccaaagggggagagaggataaagagaccaagaacaccaaattaactgacattttcttcaccaataaataagaaaataagggtcactcactgtatttcagactgatcacagcaacatccagatggaaatccaggtggttaagaacaagagaaaacgcatgatcttgataccaaaaggaataaaaattaaaaaaaaaggaggttgatgaagaaaaatccaactgcaattatccgtcaattttagtcaacataggcacaaatccaactgtgctctgctggtttctctcccccaatcaatgcctcaatctgccgcggtcaacttttcttctctgaaatttctttgcagatgtattattaatttcctctcctcttgtgggaaattcaaaaagaaaagaaaacaccaccacaccagttctttactttactaaaaaagccccaaacttttcattccaaaaatatctccttggctcactttctcctttatagagaaaaatgaacatacttttttctttgtgaatcctcggttcttcatttccaatcatccttttttttggggggggggaggggaacagctgctttaagattatttatttatgtcagaacacaccaacccccgcgggtctaactctggtttatttcattcttgaatgctccctgtgtgcacatatacacatttgtgttaagatccagggctcacaagaaaaagcttcgttcttccttctctcttgcacaatcagtttatccattgcgttcggttccaggagaaagctgcgtcctgcatccttcatttttgcaaggcacccaacagccaccaccaccaaaaaaaaaagtctccttttacatggtcaattcctctccccagcctccccttcgaagaatttggggagcaacttcccccccactctccatccttccggccggccccttcgccaaagatctgattagatttctcatcacaacccagtgcgcaattgaatttttgatttcagccacccggccagccaccttcccctctcccctccaaactccggttatatcctgtctccttccctccaccgcctctgcaatttcataatctcacgttaaatggagtgcggggggcgggggcgggggcgggggcggaggtagtggaggaaaatttcaaggctccgtcagctgtcaagaagaaacccattcctccccccgctactttttttttttctttttaaggctcggggtgcctttccttcctctgtccccgcccccacccccagcacccggtccagatcctccaggtgttgcagaactccgcggtcggggccgggatcacgggggagacgcaggatgcggtccctcgccggtggcccctgccagcccccgggtccccttctcctccatcagccggtagtggctccgggagcgccgaggtgatggaagttgagactggggcttttatttcaaatggggagggcgaagtgaggggacagacagggtggtaggcaaattaaaaaaaacacacacgaaaaaagaaagaaaaaaagaaaaagaagaaaaaaagaaaaaggaagaaaacgggtaaaaaaaaaattccctaatcgctggctcttctcatccttctcaaatgcaactgcagctttgatctcatttccagctgcgttgggtacattttggagccacaagttggttcccgttggcgcagaccttcccgatgtctgctagtcctctgcgaggagacgcgttctcgggagcgcagctgctccgcgccgcccttagcgccatcgccctggctcacggctccctgcgcggcagaaaccccagtccccttccatccacttcggtttgaactctcttcctccccctccctctgctctctcccctctttttctcccaaataaatgctctcccagcaccggcggcagctcttgccagcccaggctttctctcgaccaatgccacgtcctgacgcttagggtcctagcttccaaaagctcctttcggactgcagtcgccttccctcctctgcccctctttctttccccttttcctttccctttctctgcttgtgatcagtaaaatacaattacccaattacctcccatcatcttagcactgattggtcaattgcattaacacttgaagtcagggaagaggggattggagcttcagagatgtggctctgctgccacctggagggcagagccagaacagctgagtctaaaagcaacccccacgctgggaggttcaggctgtgtgggagaagtcagttttttcaaaaagcttgcctgttttcatccagaaatccaggagttttgagctacaaagaggaagacattaaaatcaaatcaccactaagattcaaaattatcaccaaacacacaaagctgttgctttcaggttgcaggttaagagcctctcccagtcaagcacactggtcccaagctgaggattaacacagtactattgcttagccgggcgcggtgtctcacgcctgtaatcccagccctttgggaggccaaggtgggcggatcatgaggtcaggagatcgagaccaacctgcccaacattgtgaaaccccgtccctactaaaaatacaaaaattagccgggagcgatggcgcgcgtctgtaatcccagctactcgggagactgaggcaggataattgcttgaacccgggagacggaggttgcagtgagccgagattgggccattgcactccagcctgggagacaagagcaagactccgtctcaaataaataataaaaataaataaataaaaaaaaagaataggctcatcagaaagaatccagagtagcttaaaagctactcgggagggaggctgcggtcgagcaggataatcttaccaggaggaagcaactgtaaaggcgagatagtagccttcagcctatgcagtgttgcagtaaattggcctgttcagtttgtacaagacatccaggacagcttgacaactcaattccaacatcccctgctccaggatgtggacttttccattaactcgtgttagagaaatagttggcacatttcaaattcactgggtctccttagagggactgggccaacaaaataatgctattaatattatgtttacattggtttctttctccaatgtataattttcataaggccctttcagttaatctatgggcattcactttatgtcatttatgtatgtaaccttgagataggaatcaataaaattaggaatgataatttaaacagtactatatatatatatatggaatagattaaataaatgttcctctgttttgtatgccctaagtgatgatctttgcactgattttctttatttttgagagaacagaatatgtacttggtttaaaaacagttttaaagaaagtgagtaaatcataacggaaggtagcatcaaacagaaaggagaaaagatttattaagagaacatcagagacatatctaagtttatacaaaatgctatttttttcctcttctgttcccattatactccacggtatttccttgtttgagttaaaaaaatttcatctgtaatgttctttgcatactgagagcatgctgtaacgtgcatctcagatgtcagtacatgcaagaggaaagacttttccttacacatggattgtgatttattgtaatttccccatctttttggagagctttgatgttatgaattacatgaaaatgtgaatttctcgagggttaatggcattgcttctatttttaagtgaatgctgtattgattgattcaaaacactagtgggcagttgactttaatttgtgttttgaagctcttacccttatatgctaattatagtttatccactaataaacgattaaaaagtacattcactagctgcactagatagcttcaaaggagtctatcctctgattctgaagtaagctagaagccatttgaaatgaaaattttctttttagggattttgacagcaaaggaaggccaatgatttgtttttttcagagctgattattagctctctaccagacatctttaatactatcagaatgaattaatctattaggcaaagcagcagggacaggtaagtgctatttggccaaaatggaaaaaggaacagcttctctttcctgttaaccttccccttcagcagctacagtatctttacccacatcattgactcattcacactatatgaccttgaattcgtcacatggctttcatttttagatttagattgaaccagtcattattgagcatccatatggcatggttttttgttacacttttctcatatatatcaccttatttagtactcaaaacaacaccctgagagattttgaagatggaaaaaatgaagcttaaaatcacaaacttggtaaatgacacagccaaaatttgaacccagatctactcaatgccagttcttccagttttgcgataacattaaggttttggtaacatggggaacagctgtatatcaattatcagcatgcaggctgtcattttctgccctgaatgccaggcatgaatttgtaaccctttcagaggatggcaataccacatttgtcactgaatgacctcacccaaaaagaattggaataagtagtaaacaagctaactgtcatgaaagtacacatgcaaaccaaattgttgctgaaaaaaaacataattatagatatttatgcagtagaggttgccaggtactattaacaatgacagagtatgtgttcaagtaaaaatttctataaaagctctttcagaagaaataatattacaccaccacccttcccattagcccatctagttaccaaaagcatggagaggacaaaatgcttattgaaatgacatgacttgggagaagaggaggcacagtgctagcatgctagatttgttctacggacatgcagatttctacttttgttcttctctgatttgtagatgtgagacattaaacaaaactgttatcttatttcactgtatgttcgtgactatagctggtgtaatcattagcaaacagcaggggacagcatcttgtaatcagaaatacaaaatagcaaatagaacaaattcagtaactttgcttaaaaataaaaaagtgaatgtgtctattgtgtttattaattggatttaacaagctgtaggcaactctattgaagcacaatacatacttaaagtttgtgtctttatgctgtgttataaatcctggaaataaatattctcttttcacttccaatagtattacatagggaccagaatatcctccgggataatcgtatcaagcttgcctgtatagtcacacgtaatgacatgtgaattaatttcattaaaacaacttattttttcaaaactactttgaatttaaaattcaatactcagcaggagtttactaaacatgttacattagataatattctatagatattgtattttggaactagatgatatcctaataatcctctattctttatttcttgaaatatagataaaaggtcctaaagtcctaaatactgatgtgcaaatttctgcttttttttcaaggtcccccgccgacccatgatggctactcctccactcagccctcatcccatatagtcttattttttgttctctcatactttttaacatttgttttaataactagcatttaatgaaagcttgcgagtgccaagcctgtctctatgtatgttacagatttcaactcatgtaatccttccaacaatcttatgaagtaggtgccattgatgaaattggacttgaggttaaataagggaacctagctaggaagtgatagaggcaagattgtaactcaggttatttcatctcagaggttgtggttataatacatatttcctactattacttattgtgatggatagaaatgatttgctcatgtctatgtcccccccaacctccaaaccataattgatttcacaagagcattgtctgtatttctaatgctttgtacaccgttgagtgaataaacgtctaagataatgctcttaggaaatggaaagacctacattttttggtctcttaccgactattcttttcactgtggtgcacaaaattgtaaaaagatgagatacttgtcataattattaaaatagaaaagctaagagaagatgccaccaaataagatgatttcagcaatgaagtataacttttgaatcagttagcaatgagtgcataataaaccatttgaaatcttaatagctgaaaacaacaatcatttattatttctcatgactctaaaggctggtcagaaattggttaagtggctctttttgatctttttgatctagtggctgagttaactgcttgctgatctagaatggtctcagctatagtcactggtgcaactgggctccaccccacatgcatctctctctctcttcttcagcttggaccaagcatatttcttggcaatggcagaaatccaatagagcaagcagaagatcatgagtaccttttcaggcttctgtgtgaatagtatcagctaacttcccactggccaaagaaaatcacttagttgagcccattgtcagggaatagggcaggtcattccaccttcaaggggaagtgtattagtctgttttcacattgctataaagatatacccaagacaggctaatttataaagaaaataggtttaattgactcacagttccacatggctggggaggcctcaggaaacttacaattatggcagaaggggaagaagcatgtcttacatggtggcaggtggcagaaagctagcaagagcagggaaaactgtcttacaaaatcagcagatctcctgagaactcattcactattttgaaaagagcatggggggaaatgctcccatgatgcaatcacctcccatgaggtccctcccccaacacatggcaattacaatttggattacaattcaagatgagatttgggtggggatgcagagccagaccatatcaggaggttactgcaaagttgtataaaacgaaagcaagtggagaatcagagtgatcattgcaatcaactacaacttctctcccttatgaataacaaaggtccttagtgattactggggtttgctggaaagaaaatgtccacattagtgaccatctaatcagtcacttatttaaacatatgcataatgatcctcaattacgtgccaagcattatggaagtcatcactaactcctctgtcacctttactttcctgatagcacctgttgatgctgtctcaggaatggctcacagatgtgtgccaaagagagtgtacctatttctctttattactttagagagaccactatcagattcctgcgtggactctgccactcacctttcttgttacccattctagctcctctctagtaccagctagcttgtgaaaaaggaaagtagatgagagaaaagtttaaatgaacaaacattaaaaggaaaatctgttccatatgtacaatgacaagataccacaacattgaacaaaactatttgtaatgcataggaaaagattcatagtttaaatacaaaaatagttcttgaaatagctagcatgaatgggaaaaatatttgaagagccaattaaatgaagaactagttattttaacatgtattgggacctatgttgcttaacacagtgcctggtcctttgacctcttaataaattttgattgactagatgaatgaactgtccacttggttgggggaagaatgtggatagatagtagctatgctaattacaatcaatggtgagataatatggtcagaattttacagaagtgtaaagagctggggatggaagacagaggagacagtagctacctcaatgtggggccagaccaagaggatttcacaaatagaaactgtattaggctgtccttgcattgctataccaaatacttgacactgggtaattgataagaaaacaggttgaattggctcatggttctgctctacaggaagcatggtagcatatgcttctggggaggcctcagggagcttctactcatggtggaaggcaatgtgcgagcatggtgggagcaggagtaagagagagagaaaggggaggtgctactgacttttaaatgacaagatttcacaagaactcactaacgtgaggagagtaccaaaggggaggtgctaaaccattcatgagaaatctgcctacatgatccagtcatgtccctcctggccccacctccaacattagggattacaatttgacatgagactccacagggacacagatccaaaccatatcagaaacgctaatgtgttcaaggcttcatgaacgtggatgtagttgatgattgcagaattgcccatttggcagccagaggacaaagaacaaaacgcattctaagaaaaaataatttgttacccaaagattaacagagttaaagcttaactaacttacaaactcagctatggttgaagtgatcaactattagatgccatgtacagatccaaagagtccagcttttgaaatacagtcattcctctgtatctgtgggcaattgattccaggatcccagcagactgcaaaatctgaggatgctcgatcccttatataaaatagtacagtatttgcatgtaatctgtggatagcctcacatacattttaaatcgtatctagattacttacctaatacaatcctaatacaatgcctacacatcacttcattcttcaggattcaatgtaatacccagcacttggcaaattcaaggtttgctttttgaaattctgtgaagtttttatttcttaagaggcagagtctagctctgttgctcaggctagaatgcagtggtacaatcctggctcactacagcctggaactcccgggctcaagcgattctctcacgtcagtctccagaagagctaggacaggtgtgagcactgtaccaggctctctggaaggtttctgatctgtgattggttgaatccacagatgggaaacccacagatatggagggttacccattgataatcttcctaggaggatatcaatcactaaagaagcttgggaaggaagggcattggcgaaggggagcatgttgacagacaattctccctttttcagaccacatgaggcaacatgacaaatttgaggagtgacttaaagtaataagaagaaagctgaaagaaacaacggtatgacaatttggcaaccacttctgaatggccttcaactcagttatcttttacatatcctttctaaatagtgacccaatcactttaaaaacacaatctcctttattaaatgtttctaagggagaaggtatgtgtgcatagatactatgtggtagtatttttgtactgtctaaattaggaatctttgcactgggaagaaaattgcccataaaggtatctttaaaacttcaccaggaattaggagatggtgtgaatccagttgtgtagtttgggaagacagctgcattttatacagctaaatcagcacttgatactaaacaattcctaaagaatgtcactttattttagcatcagccatgcagtgcagattcaagaaatgatagccttgttttccccaccgcattactattgtgctttcagaagatgaaggcatagacagtgcagattcaagaaatgatagccttgttttccccaccacattactattgtgctttcagaagatgaaggcatagatttcaaaactgagttctcttcacattgaagattcatttagcacatctgtggttccaggcctccagctgatttagtcactcgtgattgaaataatgttaaacaatttgcatttttaaatgtccaggtctctaatatacacacttttaagagacaaaaatgactctctaagggttgctgtagacttatgaaaaaatcatttatgatattgacaccgaaatggagacacctttatcacctgaataaaataatgccttgaaaaatgaaaataagtatgtataaagaaataaagactttcaaaatggaaggggcttaggaatcctttgattcactatacatatctacctaatccatcaaaaactgtgttagttttataggggcaataagagataaaataaatatgcttgtggctaataaagactgtgaggtatgtcccagatttgtggtctccttgcatggagtgaacacagggtgactgttacgtgagtgagtgtttgacattttatcacaaccttcaattgacaatcttgaaaaggatttctagtgaaattttaagaatatttatggaagttcgcattttcactaggataacaattatgtcacattgaatttcaattttttactttaattcttatgaacgtttccacaattttttgttattgttcttatttattttaggggttccattaaaaaggccacagggatttttcactgctcatactgtcaattgtgtttctttgacctctatgggtaaagaatggtaaaattacgattatcagaacaaagtttctttgaagaggcccatccttcttttctgtctttttttttattcctttataatagcccaaggcctgaaccttaagcagttcccttctccagaaagaatgatactaaatacaataatttgtacataggtgctaacactttagtactatccaattcaatccatttatgtattgaacgagcaaatatttattgaatatcaatttcagtgggttctgtatatactatgacttagcaatgctttagtaacttttcatcatttcccagacacacttatatttttgtaaaagattactgtatatttagaaagggtgtatgcttgatccaagaaaacagcatggagtcgagccaagaacagcaagtctggaatttcatagacctcagtctgaatctgacattcattgtttgtgctttaggagaactgcaaatactttaaggctggaacttaagggaaatgtgtggcagggaagaagataaaatgccaagaaatgaacctccatataacagccacatcaagaattattatttttttctttttggggagttttttcgaacggtaaaggaacatcactgagggctaataagaagtgacatgataagtttggggtctacaaaagttatcccagaggcagtatgcagatgaatcagagaagaacaacggaaaaccagagagaaattgggaaacttggaggttacgaggatctaaacaaaggcagaagatctggagttggagagagaagggtgggtataagaaatgtcaagggttagaatctacaaagttttattaatttgcgtatttgtttgtgtatgtgtgtgagtgtgtgcatgtgagatattctatttggaggccatgcataactctcaatcaatataatgaagtactccctcaaaataatgctctatgaacatgggatgggcttccttataagggtgattttcctgccactggagtagctcaatcataggctgcacgttgtggttaggcctttaaggcaagcttatattagattagcagttcctaaacattgtccctgcttaaatttccactggagctatatgagaagagtaagggcattatagtgggattgtcctattaattacttgaatttaaagcaagagtcttcaatttgtgattaattcttataattttacaattaaaacattttttttcttttatttagttttgttttaaaatgcaaatatctgacaaaagaaaacttgaaagcaccatactgggccacttttatgttcactttaaggacataaaaagtgttaaactctgggcctcagcagacttatagcctttgagagacctttgggcttttagattttacgcttttattagaatatttctgcctgatgaagtgctttcaggtagatcaacagagcaatgtgattgaatattattcaacctttcataaaccaattgtcttaaaccataattgcaggaaatgctcccaaaagtttccaagtgcagccttttcaaaagccaaattctaaagtgaaattgatgacatcttacaaacacttgctcaaaggttccttttgcagtaaaatacaacattgaaaaaatgttaggagccaaattgccaacatcattcaccaaagtcaactatttcagaagctccctccatagaggcctacagacctgtatcaagtcattttccacttgtaatttggggatattgaggggcctggaagacctagctctttttccttaaggtgctgctgacaagtaatgcaattaaattaagcttcaagtcataggagggtgcctctaagtgcctgtacagttaaatgccaccggatttcaaatgaaaatgatgtgaattaatttcctgggaagaacaaaaagaaaaggaaagtcaagaagaaacacagcttctggtaacataatacgtagattaatggcacccactgattgactgaagtgtcaaaaaacacatctttcagatataaatgaagctactgaaagagtttggggttttgctcactctcttttattcaaacgaaatattaactaataaagtcaaggtaaaattagtttttcttagtatctttaacttcttctctacctcagaagctacccttttagacaagaaagtctagtgaaagagggtaagattcattcaaaggcatcttattataccagaaataaaattaaaataccttgtattgacttataaaatcctcttttacctggcttcaaattctcaacttcttttagactttcaaccttttttttttttttgagacagagtcttgctctgtcgcccaggctggagtgcagtggcgcaatctcggctcactgcaacctctgcctcttgggttcaagcaattctcctgctttcactccagttcagatcctgagcactcctgcctcagcctcccaagtagctaggattacaggtgcgtgccaccatgtccagctaattttttgtatttttagtagagacagggtttcaccgtgtttagccaggatggtctcaatctcttgacctcgtgatctaccctccttggcctcccaaagtgctgggattacaggcatcaaccttatcccacatttcctgccctagcactagcctctccaggcatatgggcattcttttagtgctcgaatagggccttggccctagctgttttctctgcctagaacattcccctctgctctttgcaggcactgatctttttgatcttgtaagagaggtcatccctctcaagcaactcaattggctaccccatgtctattgcaacattttaattttctgcagaacccttatctgatgtctgtttttatgaatggagttgtctacctctgctgaaatgtgttgtccatgagagtacagaccttactttcctgttcatggcatatactccactcatagaatggtaccaagcacaaagcaagtgcaggattcaaatttttgaatgaatagctaagatggtaaaagttagatctggaaatcaactgcataatattgataagaagtcgaggtagagatttgagaaggcaacaagctgtttctgtagcaaatattctcaggtcacccctaagtaagtcttaactgaatgatgactatgtatccagttgtatttacatttgtcaaatacaaaaaaaaaaaaaaggaagaatgtatgttcttaacttctagccatacatagacaacattggataaaagcctgggctcttaagcccaacaccagaagtttcagtattggctcccttatgtcttagctgtgtgactttggtaagttatttaacctctctaagcctcaaagacctcatcaataaccggttacacctgttctacagaattacaaagattaatatgaagtaatgcagaagaatagttagcacagttgctggcatccaataagcactcaattattagtcatatttgctgttattaataaatgtatgataccaagttgtgcgttactatgggttctgtcttctacatgtggttacttgaccaacgaggttgttttttggctctcccttaataatgtagcaaatgtgaccaacgaaacagaacttcggcccattctctttgagcagctcttccttggtgtctccacctatgtcattcagccagactgcctgactagagtttaaagtcactttcatcaacataaatgtatagcaacattaatgttaaaactattttttggaagtatattaaggaaaatgtcattttgtccttatctttcctataaagatttagttattgtatctttaaaaaggttagcctttttctcttccaaagtgtcaaaagaaatctcaaaatatggtgtgaccttgaactaattgctttccctttccgtgtctcagtttgtctgttttaaataagtctaataattcctaacacagcagctgctcacttcatggtagtgaggtgaaaattagtttctcatgttcaaaaccagagtcaccttcaaaactgtccccgatacacacccacacattcatttatgttccaggttctttcattctcacatggacaaagtgtatggcatgtgtcccttcctttacactctacctgctttcactccagttcagatcctgaccactcttcccatcatatgctcctgccccaatccaacccacccatggctaatacacagtcaaaagcaccagctgtgatgcaaagcagcatggtccacttattgagtgcttactctgtgtcaggcactgtgctcagcacttcatgtgcactgtcatttcactgtagctccaatgattgccacgcccacgttcagagactctcattagctgcatgcctatatccccattcattaccctttataacatggccctgagcttgtactgccattcactatttaatgatcttgggtaagatgtgctatgtaatctcaaaagatctcgattactcatctataaaataagtgaaaataatagtacaacctcacaaggttatctggttttttttttttctctctgtggcacaattggtatttcaagttagatatctatgtatctatgtatctatctatctaatatctatctatctatatacaatttttttttgtttttgtttttttgcttggggaggtgccctaggtcctgtaggatgtttagcagcattcctagctggtacccactagatggcagtagcatcctctcttccccactccacctcctcaccccccattatgacaatcaaaatgtctacagacatgaataattctctcctccccaccgctccactgaaaaccactagggtgttgggatgagtaaattagatagttttaaatactggacataaactgtccctttctttctttctttgaatgattgggagaaatttgcatgttccctattccccagcataatcaatagaattgtggctcccaagattagtcctgaattgtcctgctcccttgcctgtgtagctctgtctactgcaacactctcccacccagcttctgccttgcaaatgcctatccatcctctaaaattctttttcctaggggaagtttcccaattctttccaactgcatgatatttctccctctaaatactttcaaatgtcattt

SEQ ID NO: 437 - DNA, 20001 bp, Homo sapiens
aaaaaagaattaataccaatcctactcaaactattctgaagaatagaggagtaaggaatattttcaaacttattctgaggccactatgaccctgatactgaaaccagacaaggatatatcaacaacaacaacaacaaacaaaactacaggccaatatctctgatgaatattgaagcaaaaaccctcaacaaaatactagcaaactgaattcaacaattcatcattcatcatgaccaagtgggatttatccctgggatttcaacatatgtaaatcaatcagtgtgatacatcatatcagcagagtgaagggtaaaaaccatatgatcatttcaactgatgctgaaaaagtatttgataaaattcaacatcccttcatgataaagccctgaaaaagctgggggtagaaggaaaatacctcaacataataaaagctatatatgggagatccacagctagtctcatagtgaatggtgaaacgtggaaaacctttcttctcagatctggaacacgaagatgcccactgtccacactgttattcagcacagtactggaagtcctagctagagcaattagacaaaagaaagatataaagggaatgcaaattggaaaggaagaagtcaaattatcttcgtttgctgatgatatgatcttatatttggaataaccacaacaaaactattagaaataataaattccatagtttcaggacaccaagtcaacatataaaagtcagtagaatgtctatattccaacagtgagcaatgtgaaaaagaacaaataatcccatttaaaaaaacaacacattaaattaaatacctaggaattaatttatccaaagaagtggaagatctctataatgaaaactgtaaacactgattaaggaaactgaagaagacacacacaaaaaagggaaaatatttgatgttcatggattggaagaaacaattttgttaaaatgtccatactacccaaagcaacctacagattgaatacaatccctatcaaaataccagtgacgttcttcacaaaaatagaaaaaaactatcccaaaatttacatggaatcactaaagatgcagactagccaaagctatcctgagcaaaagaaccaaattggaggaatcacgtcacctgacttcatattatgctacagagatatagtaaacaaaatgggacagtactggcctgaaaacagacacatagaccaatggaacagaatggagaacccagaaacaaatccacacacctacggtgaactcattttcaacaaaggtgccaagaacatatgctggggaaaagacagtttcttcaacaaataatgctgggaaaactggatgtccacatgtagaagaatgaagctagatctctatttttctccaaatacaagaaatctaattaaaatggattaaatagttaaatttaagacctgaaaatatgaaactactacaagataacattggggaaactctcttggacattggtctgtgcaaagatttcttgagcaatatttccctagcacagaaaggcacaagtaaaaatggacaaatgggatcacatcaagttaaaaagcttccacacagcaaaggatacaaccaacaaagtgaagagacaactcatagaatgggtgaagatatttgcaaactgcccatctgacaaagaattaataatgacaatgtagaaggagctcaaacaactctataggaaaacatctggctgggcatggtggctcacacctgtaatcctggcactttgggaggccaaggtgggaggatcacctgaggccaggagttcaagaccagcttggccaatatagtgaaaacccatctctactaaaaatataaaaattatccaggggtggtggagcatgtctgtaatccctgctacttgggaggctgagacaggagaatcacttgaacccaggaggcggaggttgtggtggattgagatcatgccattgcacttcagcctaggcaacaggagtgaaactccatctcaaaaaaaaatctaataagccaatgaaaaaatgagcaaaatattagggaatcctaatacactgttgatgggaatgtacattagtacacctactatagaaaacagtttgaagatttttcagaaaactaaaaattgagcaactatatgatccagtaatccctttgctcaatgtatacctaaaagaaaggaaattagtatatcaaagagatattggccttcgcatgtttttttcagcactattcgcaatagccaaaatttggaagcaacttatgtgtccattgacagataaatagataaagaaaatgtggtacttatatataatggagtactattcagccattaaaaagaatgagattcactcatttgcaacaacatggataagaccagaggtcattagattatgtgaagcaatccaggcaaagaaagacaaacatcatgatatctaacttatttgtgggatctaaaattcaaaacaattgaacttatggatgtggagaatagaaggatggttaccagaagctaggaagggtagcggggaggtgagagggtgggagataaggatagttaatgggtacaaaaataatcagaaagagtgtataagacttactacttgatagcacaaaagggtgactatggtcgaaaatatgttaattgtacatttaaaaataactaaaagagtataagtggattgtttgtaatgcaaagggtaaatgcttgaggggatggataccccatttttcatgatgtgattattatgcattgcatgcctgtatccaaacatgtaatgtaccacataaatatacagaactactatgcacccacaaaaattaaaaattaaaattttaaaaaagtatgtatattctgcagcttttgggcacattgttctcttatgtaaattggtcaaatttgttaatggtgttgattaaacctcccctgccctcccctccccactcccttccccatcccttccccctccctttcccctcccttccccctcccttccctcttccacttcccccttccttcccccttccctctcccccttcccccttcccttccacacacctacagtgaactcattttcaacaaatgtgccaagaacatatgctggggaaaagacatatgctggggaaaagtttcttcaacaaatagtgctgggaaaactggatgtccctatgtaggagaatgaaactagatctctatttttctccaaatagaaaagtctaattaaaatggattaaagacttaaattcccccttcccttcccccttcccttcccccttcccttcccccttcccttccccttcccttcccccttcccttcccccttcccttctcccttcccttctcctttaccttcccttctcttctctcttgctatattgcccatgctaaactcaaactcttaggctgaagtgatactcccacctcagccttccaagtagctaggacagagaaacatgtcaccatatccttctttgttgcttgttagttttttaaatgctttgaagtacattttttgcctcttttcagatgagactttggacttggagtttgggctaatgccagaatgaattaagacatcgagggaccattaggaaggcataagtgtctctttaaaatatgaaagagacatgagatttgggaggggcccagggtagaatgatgtgattagactttgtgtccccacccaaatctcatcttgaattgtaatccccataatccccacatgtctagggagagaaaatgtggaggtaattgaatcatgggggtagtttcccccatgctgttctcgtgatagtgagttttcatgagatctgatggttttataaaggggctcttttccctttgttcagcacttatccttcctgccaccctgtgaggatggtgccttgctttccctttgccttcggctataatagtaagtttcctgaggcctcccaagacatgctgaattgtgagtcaattaaacctctttcctttataaattacccagtctcaggcagttctttatagcagtgtaaaaatggactgatactgtagaggattgaattaatggactaatgatcattatggttgcatatgacacagattcaggttttgattgaaaacctcttctccaacctaaaactgtacaactatgattacctctttttctaagtgttagaatctcaacttcagttctgaggctctctgcctgtaagtctcaggcttcttaggcacagactttctattaacaaagttaggtcctccttgctgagggagtgattaggtaagagaatctggggctggtttcctcgttattctggcttaaatattactggctttacctcagtatttcataatgtaaaacataatttattgttcaatttactttagcatttcttttttcacattacaagattttcacattacttggcattcagttactctttcttgacaaaagccaagtctttttccttggcaagaaccaagtatttttcccctagggattgttctctagaagaaaagtgttcatttgaatttgttccaaatattataattaatctataaatgccttacggtctttttaattaaaaatattgatgatgtaaaagttatagactatgtctacacatataaatggaagatttcttttcctgatagaataacctatgagatagataggttaaacattaaaatttctgcccaagctacagtatgtcttcaactggtatctagtcctctagatgggttgttttatttcatccacctttgtttgtaaaaatttgtagaagatctcaatttcctggaatgagattggggagatatagagacatgcctttaatcagaaaagaagtggtcttaggaatatactatttgaatgactgaaagactgaagagttctgcttctgcccataagaaagtttgtcattgactttttcacagttaaatcccagcatttccttgttagctatagagctaaatagctgggcacatgaatgttataaatccttgatcacagtaaaatattcatggttgcttcaccattattgacagagaagttacaaattcaagaaacaaattttggtgttgacaaattttttgttggcttacttgggtgaccagataatgggaatgtccaggttaatttccactaattaggtcaatatttatatagtcatgcaaagaaattatctctgtttttctatgaagaaattttccaggggatgtaaaattttaactacctttgtacagtagattctgacattatatttaagtatctttatattttggacttctgctctgtatacctttatacttttctgaaagattgagataatagaaagcctttgtggaaatatggaaattgtcccactaggagatatttctagatccatggaccagccatacatttttcacgtgttttaagaacacaaatagatgcatgagatatcttcagtaaccctcagtgaaagaagctttgcttttctggaccaaggacaagacccaagatgtgagtttttgaagcaactgacaagggatactcactgaaacttcctgtaatgttttgaaatatagctaaagtcttaaatctcacatgttttcattggaggaatcttaattgggaaaattaaggaagcaaaacacagacattaatcagagtatacaagtatatttggttttcatatatagccttataagtgtttattttctaatttgccaagtaacaggagaaacatgttccatgttacacataaaataagtaaaccaatagatttataatctattatgtagaatattttattatgtgatacattaacataggtatagaattatttttagatatatttgattggaaaatttaaaattacagactatatcaaatgtgttagagtgtaaagaaatcaatgcctaatatgttctggaagcatgatatggtcttttatgtgtgaatctaaaaattatctcagcatatacaagttcaggaaagtattgagtactattctttagagagatttacaaaaccatattgttttataaattttatctataagggattgtttttattactatgggattttatcatttgaaaaagtcacgttcttcggaagctgtgttaagttttttttgtctagaaaagtgttaacttagttatttttgttgagtgccaagtaatattatctttcagtttttaaagtattaaatctttgatgacttaagctaaagaggatagtttacatatcctggtttttacaagtaaacatctaaactgcccaagagaagatttatcctggtgaaatttatcagtgatgattaaagagagaaaaggaactaaatcttgcagcaagtaagttgtgaaaaaaagagaatgggctataggttttattatacccttgtgttcttcaacagatgtgcgtttgttagtctgtaacttcagcagtgacagaactctagaataagctggaagtggtaatgtgaatgagacatgtggaacgtttatcacaaatggcttctaaggaaactcaaactctctctgcacacatcctccttcactgtcagatctatgtaaatggaatcatcttgtctacgtttgagatttagtaattctgtagttttcctcagcagtgaatatcacaaagtttgggtttgtatctctacttgtcccatttttttttctttaagtttgtccttaactgtcagatctagaaacgctaagagatcaatgttgtttttatttttctttttgaattgtcttttcttttctttttttttttttaactgggatctggtcaatgtctatttgttatggctattaccaaagcctcctgagtcacgcagggacccacaggaggttgtgcttccagtatttcctcactaaaataaatttttctgaagaaaatttttagcagaaaactagcctcactttttttttttttttgagatagtctcactcggtcacccaagctgcagtacagtagcatgatcctggctcactgcaacctctgcctcctgggttcaagtgattctcatgtctcagcatcttgagtagctgggatagcaggtgtgtaccaccatgcctagctaatttgtctcacttaattatgaaattaatcatcttatttcctgtgaatattaatgtatttactataatttctctttttttctgatttgacccctttttctttcattttctaccatttagctctcctgccgatgatcagttcaactttttttttaactacaattctgcttgcttctcattaaggtacatttcattacaggtaagatcactactcctacataattaaatacgtaattcctaagacatacaattttattgtgtgccccaaaaggttttcctgaattataagtgtttaattctttttaacctagactatgtctataaatcttttcaagttgacaaagattcacatgatttgttctatcttcaaagtgaagcattcaagaacattgataataactgtaatttattgagtccttactaggtgccagccagtgttctaggcactttactttcttttataaatcaacagttcacttgagttcaaaattaattgctgaaaattaagcaattaagaattaatgactattgggatccccattctacaaatgatgaaagtaagggtcagagagctttagtaaatggcccaaagtctcataaaaaatggtgaacatgaggttgtagctgaagaaatgtggctccagtgtccacattattcacaacatgctacactttccctttgaggatgtcttggatcttaaataggtgcatactcagtgagaagcttagagtcactactcactgtaataataaaacccattgtcccgcagactaccatttttcatgtaacagtcatgagcttggaaaatttttatttaattatatatttataaaaaaagaaaattgtcagcagaataccataaacgagagatgcactaatagttctgtagatagttcactagaaaggattctgaatttctcaaatttaatcccattgttttccagtgagtaaactgagacagacttgtaattgcattcaaaaagtgactcaaatccttgtcttcttacatggaatttggaatttctcttagagtatgcttcttcttggaatctggtagctaagattctatttttgagttcttttggtatctaaatagtgttatgaataaaaccatgtcctactgttctgtacctctttctatagtgtctattttctcctctctcactacctagctcatctcaagaattcattaaaaaataaacatggcatatttggtgatagtcatgagttagttcacttgagttcaaattaattaaaattaagatattgtatgtaagtgttgaaaaaattggggtataggcaaggataaaatggagagaatcacagctccttataagttggacaaggagtcagaccaagtaatcactacagggaacaatgtgataaataatatagctatttatacatttcagagtcatgtcttctgacatttaatgaaagacaaataaagactgaacatactttgaggcatgaaggaatgaaggtctaatagtagaaggccagagtactgagtgacatatttcagaagatgttattcttggtgctgcacagatcatattataaagataccacacatacaaacacaaaggactatatctatgtcaattatttatttagaatttgttaccaccatcagagagtaagtcatttgagaccaagaacctgtcgcctattcatcatagctgaattctgtgccaagaaaaatgttttaaataagaagttataaaatgtatgaatggcttttgggactttaacacttcttctgtatagaatattcactaaaacttagaggtagaagcctttacctgtcgcagaaatgaaaatctttgtggagaaatagaattgtcaagggaagatggactctggatgagaaacacaatagagacttactgcatgtttattgtgtgtaaatcactattgaggatacaacaatgaaaatatgctctgtgacacaatggatgtaatcatgttcccgttcactatttcattacaggtcttgttctcctgagctctcacctctgatacaagcctgaaagaagagtaaatgagacagaataacaatattacagaaattgtcctcctgggcttctccaggatcctgatgtgcaaaatgcattatttgtcatgtttttactcatatacattgtgactatggtggggaacctgctcattgtggtgactattattgccagtccctctttgggctccccaatgtacttcttccttgcctgcccgtcatttatagatgctgtgtattccaccaccattcctcccttattgattgtatacttactctgtgataaaaagactatttccttcccagcttgcatgggtcagctatttatagaccacttgttaggtggtactgacgtcttccttctggtggtgatggcctatgattgccacatggccatctgtaagccactgcactatttgaccatcatgaattgacaggtttacatccttctgttggtggtggctgtgactggaggttttctgtattctgtgtttcaaattttagttgtgtacagtctccctttctgtggccccaatgtcattgaccactttttctgtgacttataccctttattggaactggggtgcattgacacctactttataggccttgctgttgttttcaatggtggagcaatctgtatggtcatcttcacccttctactaatctcctatggggtcatcctaaactcccttaaaacttatagtcaggaagggaggcataaagctctgtctacctgcagctcccacattgccatggttatcttgttttttgttccctgtattttcatatatgttagacccgtttcaaactttcctattgataaattcctgactgtgttttattcagttatcacacccatgttgaatccttttatatacacgttgagaaattcagagatgagaaatgctatagaaaaactcttgtgataccaaagtaggaagacaggatttagatgctccaagctcaattaagaagtcatcccatcatggcatctgtttgaagttcaagatctcaacgtctatatccagaactgagagcagatggggctgcttgggtgcaggtcctattgtgtacgttttaaattatgtattttctctattacacatctactgagacaggacatttctcctgtattcccagcacagagtggagaagggaaggaataggtaattaaaatagatgctcctgttcaaaagggaaggctatggtgcttccttctgtgtaatttatttaaagactttgtggaatatacaagcaccatattcacaaatatctttgaaactgccccttctcagacttgagctgaaactctatgtgcagtcagataatactcttaagaaccttggaattatgtttgcctagtttaaggtacttacgtgacccaccattaaatttgtctgaagtctattcatagtgtctttacatccacaagttcggaatgacttttatttggatgacccctcttacttttagagtacttagctctttgcagagactggaaagggaaaccattttcatctttgacacccacaagttctgactcttttatgtttcttgtaaattctgtctgaaaatgtaacagttaatcttttaagtaatattattttaaaaatctgacttattataacatacaatgctataataaacagctgtaactttcaatattctattaggaaattttagttgtatccacctattcatttaaatacattttttattttctaccttcttataggtgacagaattactaaacagttatgtgtattttcagcctttacttacaatatcatggaggcccttggttttatatactacagccagtgccaaacactttaaattgctgttatggaaacaccacactttttaaaaaaaatttatttatttattattattatactttaagttttagggtacatgggcacaatgtgcaggttagttacatatgtatacatgtgccatgctggtgcactgcacccactaactcatcatctagcattaggtatatctcccaatgctatccctccccccttcccccaccccacaacagtccccagagtgtgatattcccctccctgtgtccatgtgatctcattgttcaattcccaactatgagtgagaatatgcggtgtttggttttttgttcttgtgatagtttactgagaatgatgatttccaatttcatccatgtccctacaaaggacatgaactcatcattttttctggctgcatagtattccatggtgtatatgtgccacatttccttaatccagtctatcattattggacatttgggttcgttccaagtctttgctattgtgaataatgctgcaataaacatatgtgtgcatgtgtctttatagcagcatgatttatagtcctttgggtatataatcagtaatgggatggctgggtcaaatggtatttctagttctagatccctgaggaatcgccacactgacttccacaatggttgaactagtttacagtcccaccaacagtgtaaaagtgttcctatttctccacatcctctctagcacctgttgtttcctgactttttaatgatcgccattctaactggtgtgagatggtatctcattgtggttttgattagcatttctctgatggccagtgatggtgagcattttttcatgtgttttttggctgcataaatgtcttcttttgagaagtgtctattcatgtccttcgcccactttttgatggggttgttttttttcttgtaaatttgtttgagttcattgtagattctggatattagccctttgtccgatgagtaggttgtgaaaattttctcccattttgtaggttgcctgttcattctgagggtagttttttttgctgtgcagaagctctttagtttaattagattccatttgtcaattttggcttttgttgccattgcttttggtgttttagacatgaagtccttgcccatgcctatgtcctgaatggtaatgcctaggttttcttctagggttttgatggttttaggtctaatgtttaagtctttaatccatcttgaattgatttttgtataaggtgtaaggaagggatccagtttcagctttctgcatatagctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtggcatagtttgaagactggtagtgtgatgcctccagctttgttcttttggcttaggattgacttggcgatgagggctcttttttggttccatatgaactttaaagtagttttttccaattctgtgaagaaagtcattggtagcttgatggggatggcattgaatctgtaaattaccttggtcagtatggccattttcatgatattgattcttcctacccatgagcatggaatgttattccatttgtttgtatactcttttatttcattgagcagtggtttgtagttctccttgaagaggtccttcacatcccttgtgagttggattcctaggtattttattctctttgaagcaattatgaatgggagttctctcatgatttggctctctgtttgtctgttgttggtgtacaagaatgcttgtgatttttgtacattgattttgtatcctgagactttgctgaagttgcttatcagcttaaggagattttgggctgaggcaatggggttttctagatatacaatcatgtcatctgcaaacagggacaatttgacttcctgttttcctaattgaataccctttatttccttctcctgcctaattgccctggccagaacttccaacactatgttgaataggagtggtgagagagggcatccctgtcttgtgccagttttcaaagggaatgcttccagtttttgcccattcattatgatattggctgtggttttgtcatagatagtccttattattttgaaatacgttccatcaatacctaatttatggagagtttttagcatgaaggttgttgaattttgtcaaaggccttttctgcatctattgagataatcatgtggtttttgtctttggttctgtttatatgctggattacatttattgatttgcatatattgaagaagccttgcatcccagggatgaagcccacttgatcatggtggataagctttttgatgtgctgctggattcggtttgccagtattttattgaggatttttgcatcaatgttcatcaaagatattggtctaaaattctcttttttggttgtgtctctgcccggctttggtatcaggatgatgctggcctcataaaatgagttagggaggattccctctttttctattgattggaatagtttccgaaggaatggtacaagttcctccttgtacctctggtagaattcggctgtgtatccatctggtcctggactctttttggttggtacgctattgatcattgccacaatttcagatcgtgttattggtctattcagagattcaacttcttcctggtttagtcttgggagagtgtatgtgtccagaaatttatccatttcttctagattttctagtttatttgcgtagaggtgtttgtagtattctctgatggtagtttgtatttctgtaggatcagtggtgatatcccctttatcattttttattgcgtctatttgattcttctctctttttttctttattagtcttgctagcagtctatcaattttgttgatcctttcaaaaaaccagctcctggattcattaattttttgaaggtttttttgtgtctctatttacttcagttctgctctgattttagttatttcttgccttctgctagcttttgaatgtgtttgctcttgcttttctagttcctttaattgtgatgttagggtgtctttgttctcgttggtttcaaagaacatctttatttctgccttcatttagttatgtacccagtagtcattcagaagcaggttgttcagtttacatgtagttgagcggttttgagtgagattcttaatgctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcaaagctgagttcaattcctgggtatcctttttgactttctgtctcgttgatctgtctaatgttgacagcgggtgttaaagtctcccattattaatgtgtgggagtctaagtctctttgtaggtcactcaggacttgctttataaatctgggtgctcctgtattgggtgcatatatatttaggatagttagctcttcttgttgaattgatccctttaccattatttaatggccttctttgtctcttatgatatttgttggtttaaaatctgttttatcagagactgggattgcaacccctgcctttttttgtttttcatttgcttggtagatcttcctccatcctttcattttgagcctatgtgtgtctctgcacgtgagatgggggaaacaccacactttaaggtgccactttttttttttttttttttttttttttgagacggagtctcgctctgtcgcccaggctggagtgcagtggcgggatctcggctcactgcaagctccgcctctggggttcaggccattctcctgcctcagcctcccaagtagctgggactacaggcgcccgccactacgcccggctaattttttgtatttttagtagaaacggggtttcaccgttttagtcgggatggtctcgatctcctgacctcgtgatccgcccgcctcggcctcccaaagtgctgggattacaggcgtgagccaccgcgcccggccaaggtgccactttttattattctcctgtcttcttgtatggtgcagagctccacagtttttatgatttcaaacaaccttcattttattttatctcaaaattttgtgagtcaggaattcaggcagttgttggctgggtgtttcttctgttttgtgtggcaaggactgaagtcactgtcttattcagctgataattgagttttatgtaaacgccggataacttaatgcacatttaaagcatattgtaagggatgacattaagagatgcattgggtcctcttcctatccctttagatgaaggaacacaagatcactccagagaatagtctaggtttttacatcgtgctcagagatcccagtggtagaaagtggatgggtccagccagctaagggctgtgtccggaactgacacaatgtcacttgcatcatattctatttgtcgtagtgatcacatgaccacccagatttgaggttttacagaaatagtagataacctttgatgcggaagtttcaaagtcaccttgcagatcagcatgcaggaaaatcgtccacatctcaaaaagagcatattgtagttttattcattttaagttagatccataaatcatcttgaactaacaatatctgagcaacattgggttttctaattcctgaatacagtatatctgttaggtatttaaaatgtttatttttgaagagttttgcagttgttattcatgtagggatcttccttatctattcataagtatttatgttttcagatttcatcacagatttttaattaaaaaatccatttgtcattgttgctagtatgtatgtaaaggaaattgaagtttttatttgacattttagtcctataaacttgtaaatttacttcttattcctacaaagttattctttagggttttctctaacactatcatgttatctgcaagtaagtatagctcattacttggaaagagatggggtgtttcagtttctttttgtgtcatgtttggaagattgttctttccctacattttacctaattcatctaagctgtcaaactaattgaaataatgtatttcagaacaatccttttctaaccttttaagtctaaagaatctatggggtgattatttgttttatgattcctggtattggtaatttgaatttgtctttcctttgataactcttcctggcaatttatcaatttcattatgaaagtaccaacttgtggctattttcattttctctattttatgttttccattttattgcttttgatcttatatttatgtcctttcatttacttaccttggcttttatttactgttcttgttctagcttcttaaggtgaaggctcagatgcctgcttgtaaatatttattttaaatgtaagcttttatagctatacatgttactttaagtactgttttgatcacacctcaaacattttgatgtttttgttattgctgagttctaaatatttgcttatttacattatacttttttctttgattcataggttcactaaatatttattggcatgcttcctaatatttgaagcatactctagatatatttatgagttatttatttatacaaaggaaattatttcaaaatttagtgattcaaacaatatgtactcattctcaatttctgtaggtcaggatactaaggatggcttaggttcccatgcttcaaggtctctcacaaaaactgtaatcaagatgatggttggggctaccatctcatatgaaagcttagctgaggaaggatccacttccactctggtattgggatataggtcctatttttatgttagttcttcatcttggaattataatttagaccacagtatgcttgatcatatctgatagttcttcagaattaaaaatatttgtgtgcatgttttagcacttaccagtaagacagcacagcacatatagacgtgctctttgaattttagcagtaatacatattacatttggggtgatgtgtttaatccatttactagctaagttgaaaatgactaacttttagtgtagcctgttatgtgataaagactttagctatctcagataggtatttatgggactctttaagactcttatgacacaaagatcaaacatttagctcaacgtatgatgagatgaaggtgttcaatagatccaatggtaagccaagtcatggaaataacagtggaagcccttaaatacttcttccttgttggaaataaaaatttctttattgtagaaacagttattggattgatattagaatataattaaaatattgagttaatggatgtattagtccgttttcacactgctgataatgacatgcccaagactgggaagaaatagaggtttaattagacttacagttccacagggcttgaaaggcctcagagtcatgttgggaggtgcaagtcacttcttacatggcagtggcaagagaaaaatgaggaagatacaattcaagttgagatttgggtggggacacagccacaccgtatcaatggactactgatcattatggttatatctgacttagatacaggtcttgatcaaaagcctcaaaagcctgtactctaactaaaactgcagcactatgattacctatttttccatgaatcagaatgtcaacttccgttcttaggctctctgcctctgagcctcagggcttcttgggcacagactttctaacaggaagggtaaggccctacttactgggagcatttttagcaaagagaacctggagctggttctcctttaattctggctgaaatattacttgccttacctaaatatttcataacatgcatctcataacttattattcaattcactttaaaattattcttttcatattgtaggcatttcacattacttgtcatttacctactcttccttagcaagaaccaaatctttttcctctagggattttgtaagaaaaaattatacagagaggttctttcatttgaagttgttccaaatattctaattaactaatctatagtgaagttactctctctttctaaaatattgttgatgtaaaggttatagactgtgtctacagacacaaatggaagaattatttttctgatagagcagcccaggagatatcaaaaaagttaaatttctgcccaaggtagcgtatgtcttcagttggtatctcgtcctctaggtgtaatattttcttgaaatgtctaccattgcttataaaaatgagtgaaagttctcaatttcctgggatgagattggggagatataaggacatgcttttacttaggaaagaattggtcttagggatatgctagttgaaagactgaaagactgaagagtttggcttctgcctgtgggaaagctctgtcactggattctccatgaagttaaatctcagcattgtccttgttaggtaccaagcttaatagctgggcacatgaatgttataaatcctcaatcacagtaaagtacttatggttgcttcaccataattgagaaaatattcaagtaacaaatttaagtgttgctacttgtgtcatataataagggtgttttccaggttaatttccactaattagttccacttttacatagtcaagcagagacggtctctgtttttcttcgaaggcattttccagcaggtgagaatattcaattacctttcacagtaaatattgtcgttatcttaaagcattattatagtttggtcatctgctttggatagtgctatacttctctaaagactaagataatgagaagcctgtgtggaactgtggaaactgtagccactaggaactagttctatatccatggatcagccatgtatattcctgtgttttatgaggacacatagaggcatgaggtatctatggcaatcctcagtgaaagaagcattgcttttctggaccaagatgtgagtatttgaaaccattgacaagagataattcattaaaaattcctgtgatatgttgaaatgtagctaatatcttaaaaaccaatggttttatttgataaattctaattggaaaaattaagctagcacacatggaaatttatcagcatatacaatgtatatttggttttaatatacagcctaattgtctttttccatttgtcaaataagaagaaaaacatgttccatattacacttaataataaatgaatcaatagatgtgtaatcttagtgtttgggatattatattttatatgatatattaataaatgtgtacaattactttcagatataattgattagagaatttaaaattctggatcatgtcaagtttgttgaagtgtaaatgaacaaatgcctgttatgttctggaaacatgatacaggattttacttatgaatctaaaaattatttcagcaaacatactaatagatacgtacggtcaggaaggtacctagtcagctgtcatttaaatagatttataaaacagtgactgtgaaacatactattatagatgtttttgtgttattatagaattttatcttttgaaaatgacatgaacttaggaaactatattaaatcatttttttctagaaaattgttaacagcagtttacattgaaagcctagtaatgctatgtttcagcttttaaagtattatgtttttaattatttaaactataaaggataattttataccctagttttacaagtaaacatttaaattcccaaatagaattttcttgttgaatgtagttttgatgatgaaagggggaaaacacactaaactttgcagcaagcaagatgtaaaaaaaataacggaattggctataggctacattattctcttgtgttctccagcacgtgcatctctataagtctatagcttcaacagtgccagaactctttatcagctgtaagtggtaacatgaatgagacatgtggaaagtgcatcacagctggctt

SEQ ID NO: 438 - DNA, 40001 bp, Homo sapiens
tcatttaaaagctctgagtgaaagcttgggcttctgattgatccgataatattgtctcattcccattttaaactacctgttccttaaattgcatataaaaatacagtccatgcaatattaatacactaatgaataatacactaacaatttgaagcatgccaacccacccaaggatttttcatctcctgcatgtttcatcagagacacttggtatatactgaataatcgttaggatgatgaaaatgataataataatgaaataaatatggagcagttttactatggtggggaaaaacatgaaaggtaattttcaattataagtgagaaatggacacctgtgatccacggatcggcctctgcttttgatgtatcacaggtaagggcagctgcagctgcgtgtgagggtatgtataacacagtctcatctgtctagtgctgtcagagaaggtgtgattgtacaaaagtgggatttctagatatcagaagtgaagtggtttgagagaaaaggcatggactttggagacagctggctctggattcaaatgctggttcccccacttccctgccctgtgagttctttctgctttttattttctatctggaaaagaggataataactgccccacgggattatagtgaagattaaatcagatcatgtatatgagaatgtctgggccagggcctgaaacctgaggggtatccaccaaatgatttcctttcccaaagcacagtggacactacctgtagtggcttcataaatgttagtcccttccacctataccttaataaactttgaggcagctcgctcaaaaattcacaggctttttcttcttatctgtggatttgggaatacactcaggctactggagttttggggtcccagatctgcaaatcagagaggtgttatggcacgtctatatccaattatggatgtgtaagcatggatggtatgccaaatgctcatcaggaagaaacagtctataggtgtatataagctttcttttaaacatgaaggtttatgggggaaataatatctattatttttggaaaagcattttatgcatgtatttttgttttagagacagggtctcaccctgtcacccaggctggattacagtggtacaatcatagctcactgcagcctcaagctcctgggctcaagtgatcctcccatctctgcctccctagtatctgggactacaggcgtgagccgctgcgcctagctaattttggccttttttttttttttttttgtagagatggggtctcactatgttgcccaggctggtctcaaactcctgggctcaagcaatcctcctgctttggcctttcaaagtgctgggattacaggggtgagccactgcacccacagggaaaagcattttaaatgggatttattttgtaaagttttctgagttttttcttaaaattgaaaataggtgcttttattcgttcattcattcattcactcatcagtcctttactgactgttgacagtgagctagtcactatgctgtaaacactgaagatgcaaagacatgatccaaggggatgacaggcccatgaacagcgactagttaagtggaatgaaaaatgctaaaatgggatacaaaacactgtggacatagcgtacagccagaaccaagaaaagtggtaagtgtttcagggtagtggatatacaggttgactatcccttatcccaaatgcttaggacctaaaatgttttggattttggatttttctggatttggaatatttatgtatacataattagatatcttggggatgggactcaaatctaaacatgaaattcatttatgtttcatatatgccttaaatacatagcctgaagataattgtatacagtatttttaataattttgtgcaggaaacaatgtttgactgcacgttgactgctgctgtcacgtgaggtcaggtgtggaattttccacttatggtgttgtgtcagcactcaaaaagtcttagattttggagcattttgaatttcggatttcaaatttaaggatgctcaacctgtatagagtatgtgacgtgttgtgtgcatgtatgtgtaccagagtgctcgaggggtacgatgccaaccctcaagctggccgctattagtcattgattgctgaatgtgttctaacccactttgcaaagcacttactcatgttttctcatttggtcttaacaactctgcaggctatgcatggttgtccccatttcacccttgaagaaactgaaattcagagaagaataaccagacagtatatactcggagttttattttgtctttctagctcaaaggctatgtttgagctctgctaaactccaagcctttgccttaacggagatgcagaagagagtaagaaaagaccttgcgcctaaaaagccagttgtgagactaagacttaaatgggaactaaagttttaagattttaggcaaaatatgatcagtcccaacctggagggaagtgagctgccaagttcgtggctggggtgaagtttaatagaggaggagctttttgagttaagtcttgaagtaggaataggactttgagaagctgaaaagagggaagggcactgcagtcaaggggaactagagattctggaaagcacacacctaatgctggggttagaacaaaataaagagaaggaggatgtgccaggggtagaagaagttaaaaaagagttttcaacttgtcttcaggataccaagatttttgtgccatttccttttctgactaaatgtgacaacttaggcaaggcttttaactttttaaattttaatattttttctccatatgtcaaaagtcatccaaggaactatcataagaaaaaaggtaatactatgaaaaagccatcagaagtccttgatagaaaagtgctctgtaaatacgggaaattagattgtaatggacaacaatgacctggcccagaacagtagaccaccacggtaggaggagaggagctgactctcacctgcctatcagagtcacttcctccctcaggcagatgatgtcttctgcctcaccctaaaagtcagctcaaactccttaaactgccactgtttaagcttttaaccatctggggagaattgtagacatgtgatagtaacagactactttttgaccaaagcaaccagaggatatgccactacttgtgctatacaacacaggtaataccgtttcaccaccctggacctcagttccccatccgtaaaatgaggaagtaggaggagatgttccccaaggttgtctccagatgtaatgttccatagcaatgaaagatgacaattcatccagagtgcttgggatgctaatatgtatcaactaaaattcaaaataaaacaaaaaccaaccaacaaaagcagacgagaaaaacaataaggagggagggattctatggtcaaattttgttcaaaaaattaaacacagctcattactgaaagccttcagtaagttgaaatgcattgataatctaaaggaggataagatatagaactcctccaaaacttacttgtccacatagttgttttttcccagatatattgtccattggaatatacttttaaaaaaattacactaggtttggcctaatcagttcaaacccaaggcagttctctcctaggctcaggagagaaggttagtacgtagagaaagccctggattagggctgtccagaccaggaatactcatgttttaaggccacttctgtactctttcttacagtgtgaccctggacaagtcattgcttttcttttacctcataattaaaacagtttggataaagtggtctccaaagtatcttctggttctaataatattttgtgaatacataattttctgtagcttgttcattcattcagcaaatatgcacagaggagaagttgtgtgccagcaactctaaggagactgaaagaaaaatcgaatatgtgccatgtgggaagtctcaggccactaagaaagatagacacatgcacagtgacaaatgagtgtgatcagtgcttgtgtccaagcgtggctcgaagagggcatctcaccattctggggaaggggatggttaggaatggcttgttggaggcaatactggtggaaggatgaataggaattaacatggtggtaaaaagagctctgggtgaagaaacgtcatggatagagagaacactgaatgcaatgtatctgggaaccataacatcaacagcaaaaacaatagtaatgatggcatcagcggctatgatagctccagcaaatattaggtgttagatcagagctaagggctttacattcattaatctctaatttctacaaccctataaagtagttattatactgattttatagttgaggcagtaacagccaattcattatgttttggggggatgtttccttgaatacaattaactttcagctaaccctaaataatctatctacttaatctattactcatatcattttcagtctgagattttttttcccctttaattcaagttccttctggctgcttctgatcaactccagtgagggcatgaaatggaaactcttttcagtattggcttaggcaaaatattaggatgtgcaaacatcatgatggattttaaacaaaaaatgagtgatttttagaaatttccatgaacatttctcccctccattgggtgaattattgtgattaggacttaattaattcagttgtccttcctgactttggaaagtcttgaactttttttatattaatgcattcattcatcaatcatttattgaaaaccaatcccatgccagacactgaataaaacactttggggattaccttgaataccacatgactcaatggaggtggtacctcttccaggaagtctttctggctttacaccttcacgtgtgcaacaagctgggtcaaatgactttgtctgctcccaaactgctctgcatcttgattaatcataatactttgttcattgtagcacaattgtcaatttgcttatttgtaatttttgatttggtatcttgattatgtctatgagggcggagatggtgtgtgctgttaactgctgtatttccaatgcctaatataccacttggctgcataataggtccagcacatggttgtgtattgaatggatggactttcagttttttgaatacagagatctatctaacattttaaaaatccaaagtgcttatcaaaatgcctcaacatagtaggggtgccttagaaatttgttgaatgaaatgaataaataaaagatgacaggcatagtctctgtctcaagaagcctacaatctagcaagggagataggttacttgtggaccagcttctaccctttctactgaggaagagaactccatctttctctattcatgggccgtgtggcttgcatggggctccacccgcagctaggacagagaagatcgctccagaaattgattcagaggtggccacctgatccaaccaattcttgccagagagaacatatgaatcccaggtcttggaattgaagagatcttggtttccactgatgttggaagtaaggatataaagcttggagcttttgcaaacaactggctactatgagggaagcaatctgagagtggagccagcccaatggaaggaaagctgagagactgcctattggtcaatatatttccttttatcactgtatgagttggagttatcagatatttgtaatagatcattttaactgatataggcatgggcccataacattgtaaaggaagagagttcccaataatttagagaactcaaaagagagatttgtcatttcaatgaagaactcaggagagaggtggaaatgtttaatccaggccattaatgcaggtgattacttgaattctcaggtaaaagttaagtggaagtacttgaattaggccttgagagatgaaaaggatctatctattaatgtaggtgaagcacttccaaaagaggaagcaatgggagcaatgtgatgaggcccaaacatagggaacacttaggaataaatgcctggctggagcctgagttccatcttaggcaatgacaggagagaagcaaggacaggtgggtaggatggaagaccttgaacaccaggcactgcagtatgggatctgtagcaaacgtgcatctcccttcctgggaggtagggtgtggagtggaactgtccatcgaatgcccaccagatggcatcccctgggcctaccgtagacttttgggatcagaagctgagcccgcctttctgctttatgaaagatgccttaggatctcccctcattcgtgattatttccttacaccatctgcagatttttaactggctatttgtagggaaagggagagaagaagagaatagagaggcaccagtgataggccctttggaagcttcaggtctcaatatgaaaactgcatccccaagacacatctcctcacaatgggagtgaaaggagaggtgaaggaaagtatcagaaaaatagtaacatgaaattcctcttcatttgccagggccatagcaagaaagaatggggccttggtaagagacatttccaaactgacaatcagggtttcatatgggattttacactcctctaaggcggagggcaggtgttcaccttccatcctctctgctgccaagaccaaagtgggtgtttcaggctaattctgctctactcaaatcagctgaaaacttaggcaaaataagctttctatgtaggcctggcttcatgagcatgcgatctatttagctgcatgaagcgtccatgcttagaggggcccaaagctagatttaatgctcttctgccatcattaaaatttttaatattttttgaacaaaagtctccataatttcattttgcactggaacttgcaaattatgtagctggtcctgcttctatgtctcagggagtggagggaaaaagtcaaaggtcacttaaattactaagatttggctgctttcctttggccatctcgtggtggtaacttgccttacctggtaggttgttgcatacgtcccacagcttctgaacctctctcccctgtctcctactttaccactttagaaagtgcagcctctacttccatcagtgtgtgtcccatctgcctctcaggagcaggcagaaatgattcccatcccttcattatattttccctgattcttcctgttaaaaggtatttccttttttctgtcatcttacattgaacttttatcacttttgtattgtattatggttactttcgccaggtaagatggagccagcataagcttttagagagaagaacctagattgaatgcacagctttggaaatacaaactttctgaacctcaaggtcattatgggttaaaatgggaggaaaaactacttatcatttagggtcactgaaaacattaattgagatacagctagtgagtcaaatcttttggtttgcccaggacaatcctggcctatgcctattagccaaacattattattaatattgcccccttttaacttcaaagcatcctggtttgaataaaaagttatatggctctcaagtttcatattttaaaatgcccaggaaggcatctgacacatagtaggtgcttgagacatgtttgctgaatcagaagctctttttttttttcttacaagaaattttcttagctgtgcatgggtgttacacctatatttctagctattcaggaagctgaggatggagaatcacttgagtccgggaggtcaaggatgcagtcagccataattgtaccactgcactccagcctgggtgacagagggagagagggagggagggaggaagggagggaaggaaggaaggaaggaaggaaggaaggaaggaaggaaggaaggaaggaagggcaggagggagggctggagggaagaaaggaaggaaggtagggaagagggagggaggaaggcagaaagagaggaaagaaagaaataacgggaggggggaaggaaggaaggaaggaagggtgggaaggagggagggagggaagaaaggaaggaagggagggaagagggagggaggaaaggagggaggcaggaagggagaaagagaggaaagaaacaaaggaaaggagggagggagggaaggaaggaaggaagaaagagaaaggaatttttccttcccttttgaggggcatgtgcatacatttttatatctctaccaaactttacagatttataattaatgacaaagtacgcagaagttaaaaaaaaccactgtgtgatggaaaaaaatgacaaaaccaccactttcatcatgcctctgattcttcaagggctgccatgatggctcttttgccctttgtgtggcttcatgggagggaacagggcatgctgctcttttgttttattgctattccagtggtgtgcaggtacgcagaggtgcagggacagtggagtgcttttagttttacatttacactgaataaagcacattcatggcatccccatctcctttgaggaggagctcgagtctggggagggggggagctctgacctattagtattgagggagtatctactatgtgatgagtgccaaggccaaccctttatatcaactgcagtggggtcggtgtctgctcatgagcatccctggagtaattggcttcatggaatcttgctttggctggcacagtttcctctcacagtctggggaacctctgaactgtggagttgattgtcatgacttgcccagctccccggccagacacctcactcaatatcgcaatagcacagatgcattggaaaacacggcatcttgatcttgttgtttgggtcataacactttgccctcactgttttgatcacacttggatcttttctccatcagcagtgggggcaattaatctgtggtatgcagagcggttggaattatggattagaaatacaatgtggccaacctggacataagtatgatcctgaaatgtctgccaggtaggtagacagtaatgagtaatattgttaattcattagttatgaattaacaacaaaaaagcttagtttcgttatctagttcacaatgaatattactggtaaaaagacaaacttgaaataaaactgatggccatcaaaactgaactccccacagactaggcgctccttttttgcactcccttaaaacttgttgcctgtctctgcctcgccaggggtcacactgttctctaatgtgtaggtgtattagtctattctcacactgctatacagaactgcctgagactgggtaatttatgaagaaaataggtttaatgaactcacagttctacaggcttaacaggaagcatgattgggaggcctcaggatacttacaatcatggcggaaggcgaacgggaagcaagcatgtcttatcgtggtgaagcaggagagagagagcaaagaaagccacacacttttaaatcattagatcttgtgagaactcacccactatcacaggaacagcgagggggaaacccatccctatgatccaatcacctcctaccaggcccctcccctgacacacgggcattacaatttgacatgagagttgggtggggacacagagtcaaaccatattagtgggcttatgtgtttttcttgctgacaagactgggaacttgttgagagcaaaaatgatcttcttcatgcctgtgtcaagcagcagtccagttcagaccagtatttgtccagaaatctagcacttgcctcacataggaaaaatgaagcagcttggccatcagtaccttcaccctcattttaaagtgtgctttgtttgtggaggagacactgaaagtcattgtaaggtcattggctgaattttagttggatttagttgggaccccttagagagtcttgggcagaggaatgacataatctgacttaggctttaaaaagatcgctctggctgctgggtcaagaacagattgtgagggatggaggttcaggagactggctggggggctacatcagccacctaggtgaaatacgaagtagggcttgaaccagggcagaagcaggggaatggtgccatattttgaacatgaggctgatgggtttggctcatgaagcagatgtacggagtgagggaaagaaagaggaggcaaggacgactccagtgcttttggtctgagtaatggaagactggagttattattcattgagttgaggaagggtggggctgggagcagatttggaatactatccactgtaggaagggagactgtcactgggcttgtccccagcctctcccaactccccattcctgcctttgggaaaccccagtcctgcccaggccccggtcttgctcccatagcaccagcttctaacctctgcctccttcagcatccttttatgtgctgctcgtaccctaggatgtcctcatgtctgtcagatgcatcgggaaggaaaatcaggttctacccaattagctcatcttaagtggatttcactgtgcatttaattaaacctgttataatcttgaagggtattttgatacatggcacttgatacagagtaattagactactgtgggcatgcacataaataactctgggctgaggtttaagctgggctctgctgctatgggtttgtaccagctatcttgccaataatttcaaagccaataatgtttacacactctagtttgcagccttcttagtccttctggctggtggatcgattgcaaggtcatctggttatactttgctctggcatagaagaagcattcctgatcttgtcactcccactcaaatgaatttattttaaaaaaattgacacataataattgtacatatctatgagttacatagtgatgtttccatacataaaacgtatgtatcagatcagggcaattagcatatgcatcatctcaaatatttatcatttctttgtgttgggaacattcaatatcattcttctagttatttgaaactatatattattacctacaaagctatagaagactagagcttactcctcctatctagctgtatcctttgacaaatatctccccatcctcctttcccctactgtaaaaactccttgagtgtgcattcttggccatgcaaaattttggtggcccattacttttccagtatatactcagtcctcaaaactttattctaccggacaactatatctcaatctgcctccaaaactttgcttcagccacttcctctgcattgagtttcctttgtctttcttttattctgtatttgtcagaacaggatagattatgccacagtaacaaatgaccccgacatctcagtggcttactgtaccaaagggttttatttttctttctctctctcagtccttctgtacaaccactgcaggtcaagtgcagctcagctctatgctgattattagggtagaggtaaaagagaacatgggtaatcatatactgggtcttcaagcttctactgagaaatggcatattcatttccaataacatttccttggttaaataaatcacatgactgagcctgccattaatggggtggggaagtaaaatcctcccctggacagaccgtgaatgttgtgaacaataatatggtctgaagttgcactatgaatctttccaagataactcctcatttttatttccaaagcaggggtcattctgtactttccattagagtttcaaaagtttgtgtttttctcctttaacagatatggagctggcagacggggcagtgctttttgtatctttctcaccgaaggtgtctagtagacacacattaaatgttatatgaataaaggtggcctttccaattgtgtactatccaggaggcaacattaagaagcagaaaagcctgagaaagctagaactgctccccttagaagcgcatatggttttgttcagtaatagctttatttcattctatccttatgacaaccttaggggacataggtagtatttttacccccattatatatatgagaacacagaggcccagagagacacaaagatgctcactttcagggtgaattaaattattgtcggtttagcacttacttttgaacttaaagtgatgtttaaaaatgaggattactgtttcatggccaaaaggataggctcaagccttctgtctaacaggagcatgcctttgccaacacatatgccctccagagagtagggatgggttgcgtcggagaaaatcattgggttacccaacaagattcagatagactcacttaattgctggagtttatgctttcctgaattattacattaggctattgtgttagggagagccagagatttaaaatcgattccttggaatgagtggaatggattagtgtttacccaatacttgtaccccattgtattaggaagtaatcagcttacttttgattttacaggatcataggcagaaggcacttgccttgtctcaggtaagactttggactgtggacttctgggttaaagctgaaatgagttaagactatgggggactgttgggaaggtatggttagtttcaaaatgtgagtacatgtatttggaggggccagggacagaatgatatggtttggctgtgtccccacccaaatctcatcttgaattgtactcccataattctcacgtgttataggagggacccagtgggagatcatatgaatcatgggggcggtttcccccatactgttctcatggtagttaataagtctgatgacatctgattgttttatcacaggttgctgtttttgcatcctccttatttttctgttaccacggtcatgtaagaagtgccttttgcctcccaccatgattctgaggcctcccagccatgtggaactgtaagtccaattaaacctctttttcttcccaatcttgggtatatcattatcagcagcatgaaaatggactaatacaccatctctacaaaaaatttaaaaaattggctgagtaccatgggacatgcctatggtcccagctactcaggaggctgaggtgggtcaaagatcgcctgagcccaggaggttaaggctgcagtgagccaagatcgtaccactggactccagcctgggaaacagagtgagtgaggtcctgtctccaaagcaaacaaaaacccaaaatatataaaaatatacacaatggaaggaacaaactcatttgtggagacaataaaaatgtatgcttaaaaagttgtcattatgtcagttcattatacagagctattcattgccaatacctatgctaagtattggagaaagagagatggaaaagaactagttcctagacaggcgtggtggctcttgtctgtaatcccaggacactgggatgccgagatgggtggattggttgagtccaggaattagagaccagactgggcaacagggcaaaaccccatctttagtaaaagtgcaaaaaattagccgggtgtgtggcatacgcctgtagttccagctattcgagaggctgaggtcagagaatcacctgaggctatagtgagccgagatcacgcccctgcactccaacctgggcaaccagaatgagaacctgtctcaaaaaacaaacaaaaacaaaaacaaaaaagaaaacaaacaaacaaacaaacaaacaaacaaaactagctcctgcccttgaagaaacctcatacctaggagaggaagcatctttcattgcaaggcagactaataaccgtcaggtaggaggcacaaaccaaatatttgggagcacagagaaagagaaggggaaggcaataccggagggaaagctgctgatcccagcagtattactctagtccaggtggcttattaaccagattgtcaataatgtcatggtaaatgtttctaatgtttttttaaaagcctccaagcattttattgcatttgacccttcatctaataaaactatctgcctacaccaagtggtgtcagcatgtcacttaacatgagcggccaagtccattccaaggtccacaagggagaggggctccttatgaaagcagttcttcctccccgcatgcctgatccaactcacaccctccactataaattccacccaggccatgtctgatctgtgttcttgagtatgttgtgtatgtatcctagttctgctccagactctggcaagtatttctaccatggaggctaaatagcatcagctaggagtcagggctctcaaagcagccagtatgtctggattcacatcctggctccatcactgagccgtaagcccatagagaggatcagttttctcatctttaaatcaggaattatgaacatctgctttgctgacatcctgtggatattgtgaatgctttaacaattccctattattagccctgccaccaccaccaatacctaacatatactaaaaatgtcatttgtgccaagccctaggctcagcattttgtgtgcaacatcctatttaacccttacagttctccgaggttaaccatgtatttatctccattgtagagatgaggtgactatggctcagttacctcaagcaacctgcccaatattatgtagctctggagtgcctgggacaagacttgaacccaggttaatcatgctaccaaggtaaaccctttccgaccacattctactcacaaaggaagtggaaacatggtgcccaagtcagggtataagaattacttagaaaagacacacctggccagatgcggtggctcacacctctaatcccagcactttgggaggctgaggtgggtggatcacaaggtcaagagatcaagaccatcctggccaacatggtgaaatctcgtctctgctaaaaatacaaaaattagctgggcatggtgtcgcgcacctgtagccccagctactcaggaggctgaggcaggagaatctcctgaacccgggaggcagaggttgcagtgagctgaaattgtgccactgcactccagcctggtgacagagtgacacagttggccaggcacagtggcttatacctataatcccagtgctctgagtggctgaggcagaaggatcatttgaacctaggagtttgagaccagcttgggcaacatagcaagactccatctcttaaaaaattaaaaaattatttgggtgtggtggtaggtgcctgcagtctcagctactcaggaggctaatgctggaggattgcttggccccaggaagtccaggctgcactgagctatgctcccaccactatactccagcctggaagacagaagaagaccctgcctctatttaaaataaaaaaaaaaaaagatacactgcaacataccacagcacaaacacacaccacaacacacacacacacaacacacacacacacacacacacacacacacacacacacacacacacaatccctggttccgcttcagcagattctggttcagtgcatctggggctagggaaattatgtatttttttaaaaagcaaatggcctaggtaattttgatatagctggctcttagaaagacttttgggacctcactttgaattaaaggatgtctcattctgctcttctctggtacttgaatctggtctacatcctcagacttttcaaactagttagaaagccatccatccatccactgactccacatacctgtgtgctggccatcagtgacagagaccaatgtaaggcacaattcccaatttggaggagctcatggcttcagttctcatcttcactggaactctgcctcctttctgcttctgtgaattagttctagccatacattctggaggccttgtggagaaagctctccttcgcccctagcccttctttggtcctttcttcttcttcttcctccttcttccttcttcctcattctccttctcctcctcctccttccttcttcttcttcctccatcttccttcttctccttcctcctttttccttcttctccttctcctactcctcctccttctttcttcttcttcttcctcctgctcctcctcctcctcctcgttctttctcttcctcttcttcctttttcttcttcttcttcttcttcttcttcttttttttttttggtgacagagtcttgctctgttgctcaggctgaagtgcagtggtgtgtgatctcggctcacagcagcctccgcctcctgcattcaagggcttctcctgcctcagcctcctgagtagctgggactacaggtgcatgccaccacgcccagccaatttttgtatttttagtagaatcagcgtttcaccttgttgaccaggatggtctcgatctcctgacctcgtgatccacacatcttggcctcccaaagtgctgggattacaggcgtgagccaccacacccagcttctttgtcttattgtgtgtatttaaggtgtacaacatgatgttttgatatacatatatgtagtgaaatgattattatagtcaagaaaattaatgtatccattatcacatatggttactttactatactcctcttgcagtctgttagatctctacatcttacatgactgcaactctgtactgtctcacttacatgcccctatttcctgttatctcttcttttgtcacaatacctctgaaggagaggatggagaaaagagtgctttgtaaaggtgtgttaggtctcacaggacttgctagctcacactctctctctctctctctccctccctctctctctctttctctttcttggtccccctccctaatagccagtttggcgcatacctgtggttgctctgtctaccttcctgttgtatcccagtagatccccaaaataagcatcagcagccacattgggaccctaccctccacaatgaggaagagattgagaggtttggagacaggacagggaggcaggcagggtcaaaccaaaggttcccttggagaatcatgagtgggttttagaggggtcaatgaacccttgaaattgtacacgtatcccttatatgtattgcgtgtgtgtgcagtggtggtggtaggagagctcatgactgtccctgagtttgcaaagtgtttgtgactcataaaaggttgagagtgacagctatccattacttcaaagggggtaaatagttatcttcagagaagaactttcatgagggcccacacattcccttaatttcttacccaagagtcttatttgattttcgacataaccatgtagagtagttattagtttcacttaatgatttgagaaactgagatcctgctaggtaaaataacttggcccaagccccatagttaccaagtggcagaggcacagcccacacccagatcattccactagaagaaacaaaaagttctcattcgctctcaggaaaaattagggaattaaccagttttaattggtaatgagaattcaatactcactttttgagtatctactatatgctagtcaaacacatatacacacacgtgtgcacgcacacgcacacacacacacacacacacacacatatatatatatatttcacaagagccctgaaaatccaggcaaactttttgttctacaaatgaggaagattaatcccagagaggctagattaaattgttcaaacttccaccactggcaagtgaggatttaaaccctggtctactgaagtcgtcagttttgtctcttttgatatctttctcacctccctgggtaatttgcagaacctttgtgggaactgcctggctgctggctgaggcagagttgagggaagggaaaggaaatgatacactgctaaatatctctgaacctcagttttttcatctatggaatgggagaaagtcatattttaaaaggaaactgtgaagatcaaatgagataatgtatttaagtgcctgacatgtggcaaggccttgctacatttagctgttattatctgactgaaaagagaaggacacgctgccgcggtgggactgtctccctcctcagggctctgctgttcagcaatgccttagtggccttctgtgaggtggaaccagctttattaaagagtttctctttttcatcctgccaggagatttgaggagttcaaaaccatttttcaaaatatgttttgacatttaattatatacatcttcctcttcggttataacttcccttgccatgtctgcaacaaacagggatttttgatgtactagtatagttcctatccctccataatcagtttcctgcctttaacaattagtaatctcaacatcgaagttcaaacacccaggtaacttaattatttctctttctacttcccttaaccaggaagaaccagcaaatgacacattggtttatccagcattttttaaaatgtgactttagactgcacactggaaccagtgacccttctctcagaccacattcaattaatatgcaaatgaattagaccttctgggtcagcactgaagtttagaatcaaaggaaatccaggggcagaggagggaggaattaactacttagaggagtagttcagagagtacaggatttggaattagatcaaacagggtttgaatcctagctctaccatttaccttcttttaactatggtcatgagcaactcattagccctcaatagctacctctaagcaagctctggggacgtgagtgtccatctcaggtctataagcaagatttcctaaacaaagaacaagcactgtgttccctgagatgagatcccagattgcagcatgggggagaggactgcagacctccagagagcaaccttaggacccggaacccacttctagccctaccacggggtaattgtgtggaaaggtcactggagaggcttgtgtcttggcactttcatttgcatgatagaaataataacaaacacctcccgctatcctccctccttccctctcagatatagtagaagatctaacaataactcaacagcattttctgagtgcctgccctaggttaggccatgcggaagaagctgaagatactcagatgaatgagaccatccttgttttcaaggcattcagagcctgatggggaaacacacactaatgaccatttgtcttagaataaggtgattgaaccacaagataaatggactaggacagtgggaaggaggaggaaggggcctctaagccctcttgggataaagagttcgggacatgtgacataaagaaaaataatttttattggtggggtgacagaactagtaaatgtcttttctcaaacgtctgtgatgttgtagaaaggtactagaatttcatttggtgtgtttactgcttattcatttatttattcattcaacacatttcctgagtgcctaccacatatctgtttctgtgctaggaacttaagtttcactctctcactttatatgatgatagatcaatctgtctgtcatttccagtcaatgagatggtatttgtatttttcagcccctagttggggccattgaatatttgttgaaagtgagcaaacaaaggaacacatgtttgatgcagtctaaaaaccttagaattgacttctaaatgtctttgaaaggataaatcttttgtgattctattaaggaacttgagtcagcttctgtcaaatgcactgtgtttgggaagcacttgggtgttcagaactcttcagttcctgggactttgaaaagaatactttgactatgtggtcagtttaccatctacttaatcaattttgcctggaaaagacttaggatacacagagcaacttagaaaagtggtacccagtactagcaaccttttcttccctgctctgttttcctaatcttgcttcattgggggaaggaatatcatgttcattttggccgagggaatcagtattgtgttttaataggcaataaggtatgtctccctgcattctggagccaggtggagctcccagcaaagtggaagagaaaaggcacagggcaagggaactatggggtggggactgatgaactagcagtgattcaacctgagactgtgggcacctagaactttgtgcagatgttcaagacatgttaggtataacaggatggctttcttcttcttgaccacaaagcaaaaacttcatccatccgtctacccacccactcactcctccctttccccactgacccatccacttgtccagtcaaccagtctctacaggcaggctcatttctagccacgaagtatacagagatgaatgaggaaatacagacacatgaacaagccaattaggatacactatatctacagcaatagagacatgagggagctgctgagaaaatccagcagctataactaactcgctcagcaggaatcatggaaggctccccagagaaagtgccaacagagcctggaagaataaatctgagattgccagaacaggtaatgtggagagttgtaccaggaggtgttaagagcaatctcaaggtcatggaggcaagaaagaaatattctggggagtgggagaagttgaaagtgtggctagaatgcaagtttgtggcatttgcaacatattttgcaggatggttggtttctaatttgctgagttttcaagagctcaccttagatggcatcagccttgaagacatatgaatgcattttaatatcaaacaagattaggttaaatatactggctctatgctctcatatgcgtatctactgtatgtccccagttgaaatgcccattatacatcattcattcttctgttcattcattttaaaaaacaaatgtttattgagaaactactctgggccaacaaaggcacagagaggtgagtttttccacatttacccagctaagttcatcatagcaactgatagaggagaactcaactcccaaagcccacactacctctgcttacaccaggcattatacaacatgaatttctctttggagaataaagaaaggagctagctgttcatggaaactgaattatttgaactctgagttttgcttggctttggtaataaacattactaaggaagtgtctcttcctgggtcacttctgcctgtttatatcagaaggcttcatcaatgagcaaaacagatgaagactcctgtccttgggaagcttactgtacagtgtgattacttggaattacctgttcaaaatggctttgccttccagacagtaagcacaatgaagtctagagttatgtctgtcttgtttgatgatggacttattacagtgcctggcacagagtagaaccatatatatgtattttattacctttccaatctgcatccatcatcccagaagtaaatgacaactggcaagctattccttgcaagctaatctcatgtcctttgagagggctcttaatggattccacactcatatagcagccacagtcataaatgcgcttaaaaataaacagaactttgttctgccaggctttatgaatgccatgattacatgggcagaagtgacccatgaggagagacttccttggtagcatttaccaccagggcaaagtgaggctcagagctgtaggaactcacgttccatgcatagctagtactttacattctttccttcatctatctaaggagaaattcacactgtatgatgccgagccataagtggaagaaacatgggtttgggggttggtgctctcttctttcatttgctatgatgaatgtggccagatacacgtggaaaaattaatctctttgtgcctttgctctctcatctgtaaaatgcctgacttgaagctcaggtgagagcattgaatgaaataatatattgaaagcatctggcccagtacacctagcccagcatcagcctgtaaaatgatcattattattactgtggttcagacttttggggagatgtgttaggctgtttgggttttgtagaaagaatctaggacctagagacagggaacttaagttctcatcccggctctgtcacctgtgagctgtgtgatatcagcttagttactcagcctctctgggccttgactccttatctcttaaaaaaagaagttggtccaataatttctacttataattttttcttagcaaagtgccctcctctcaatccctacttgctaatggcatcattcagcctctcttggataacaactgccaagcctctatagctaccaaattagaacatggtgatccatctgggcaaattggaaggagctgcgtttcccctgggtagacccagccccatgctggagctgcctggggagctatttgggggctggattttggtcccattttctcccagccagggactatagtgcagtgtacaacctgacccaccatacgccgtggccctggcctcctcactggcctccagacatacctgtcctatttcagtccttgttccacactactcctaggaatcacttccactctgaaccctaagcaggattcactctccttcctgcacaaacccttcactggcccctcttggcttcggcataaaaccaagccactttgctaggcctcatacaagcttttcctctctcagtggggcaccataagtgcacacatgcaccgtaagtctgcagttccctggacatacaatgcttttcctcactgcagaacctatgcacacaaggccccctcagctcagaatgccttcttcaagttcctcctctgtactcttcacccatgctaatgcccagacacccgtcaagactcagctttgtgtcaactcttccagcaatctttctgtaaccccaacccttaagacagactgggagcccctgtactgagccttcattcttagcacaaagctacctcttctagtgaagggcctcatgttataattgaggaaactgaggcctagacaagaatcacaagaccagcaactggcacttattgacagctgtgtgccaagtgctgacagccactctaggatgtgggtattggcatttctagtttacagctgggaaagctgaggttctgagtagcatctagtctctgttgcagtggttctcaaagtacagtctcagtcctgcaacagaagcatcagcatcagcggggaacttgggagaaatgcagactctccagctgactccagacatattcaatcagaaattcttggggtgggcccaaccatatgtgtttaaagagccctccaggtaattctgatgaatgccaaaatttgattaaagtttgcaaactaccggcctaatattatccagctggtcatgggtggatctgggatttagaaccatatgacagatagctaaaaaaattaataagcttatgcttttaacttttatgctgtgtctacctatgggtttttctcagtgaggcctcccctggtcgcccgatttaaaatcacttctcccctcctaccatccactgctaagcatttcctatctcctgccctttcttttactcaataatacttcccagttggcatactacacattctaaatcttagtttacaatttactatttgtcttagtaagattgcactgccataacaaaatagtacagactgggtggcttaaacaacagagatttagtttttcacagtcccagagcctggaactctgaggtcaaggttccagcatggccaggttctggcgtgagccctttatctggtttgcagacaggtggctaccttctccctgagtgtttatatggctgagtgagagggcaaacaaactctctgatgtctttacctaaaagggcacaaatcccatgatgagggccttgtcctcatgacctcatctcatactaattacctcctaaagtctccatctccatatgctgtcacattggggtttagggcttcaacgcatgcaggaggtacacaaacattcagtccacaatgatctccttctatctgaatgtaagccccagctgggcaggcatttgtctgtgtagttcacttgctaactgctaaatccttagtgcctagaacactgccttacacatagtacgtactcaacgtatacttagaaataagtggttacatagctggttggtgacacagaagggaaactcactgaggtctacttattcacacttcaatacattccctatgcctcctcaaatctttgcctcctttttagtgatctcctgatagcagctctctccttcctagagaggtcattttccagtatcattcttttaccaatcatcacttgcaggaagagggtttttttccagcaagccctgcagtgcggttaccctaggcatgatttagctaatttactcagcgctttgtcttaatggttcaccaagtggacatttttttcagtaatgacagtaaatgcatttgaaatgtagatatcgacccaggcgatgctgtatattcggctcatcaaattttcatgttaaaattaaaattctttttttttttttttttttttggtgggaagggaaaagctgaagtgttgattcactgtggcatacatttttccaaatgaaaagagaaggctttaatcttacatacttccatggctactgccacataatgggcgatgatagcaagagagagggaaagaaaccagactccttttggagctataatgttccactcatggccctcagctatacacaaaaatgtgcatgggatactttgccccaccaccctcagccaaaagaaatgtcatcatcattccattatttctctcaaaatctttccagagttcccagctgcctcagtcatcatcagagattctccaacttctgctacaagattaaaacaatccccactgtttttcacttgatttatcacctcctcagtggtgcttccctgaccaccctatccaagtaggcatcccatgttcttctctattatcatcctggttctacttcctagtacttattatagtccataactcttcattcatttttttttactagtttattttttactggtttgttgtccacccttagataagccaagacttgtagagccatagctagtctttccttcctggagcagagatgggggaagaaatatcaatttatttcatattaaatttacctgctacacacactgacccaatttactgttcgcaacaactccatggggtggggaatggcaccactactttgtcaataaggccactgaggtcagaacagttaaaggatttggcttgcaaaacatcagataagtgaacggtctttagttaacaatcagttctgcccatctccaaagtagagctaagcagcaaagcctatagtacttggaagccagctgacttctgttcaaattctggctctgacccctaccagctctgcggccttggatgagttatttaacttgttttagtttctccacttgtgaaatgggaataataataggacctacttaatggggaggtaaaatttgaagaattgaaaatataaaggatgttgaacaatgtctggcacatgacagttatacaatacattttagctagggtttcaacttcgccatgttggcaattcataattgctcacatttgagtaggttttacaacacactctactttaagacaatattggcaacaacccccacccccactcttaatacacacacacacgatttcccccattttccagatgaggaaactaaggaccagagattttctgccacttgctcaaggtcagagagctaagaaactggcagagtgaggacgaggtccaggacccctggctccttctccagtggtctgcctcctcaggccagaatttatatgggctctatgcttcgaggttgcatttgtggccttaggctgccaagccttttccagttccttgaaggaactgacctaacaaacaaacaaaaactattaaatgcagtaagtcatttatctgccaaaacaatgtggtgaaagagagatccaataaaaagaggggctgatgagcagatcagagtatagagatctgagcaccctgtacactctcccaagtgggcaactgaggttcttttgggccctgctggcatctccccattggctttctgttatccttcattgcaggacctttgtgtatgggcagcaagactgatggcttcctgaacagtgtgattggaaaaattctgcctttatctttaacacagttatgtccaaaataatttcctcaatcagactctcaattccaccattcaagacacagtcaggataaacactgcccctcaattatcctgcccatggggcaagaaaaagttttcagactcacttttgaaaggtggcctgcctattggtggctttccttcactgcatgtgccaagtaatcctacaaagtgaaagggaaagagactcatgttttactttgggcaattcctatgttccagggacaggtagagcattttgtgtatattgctgtatatcatttaatcctatgtcgacactgagatattagtagtattgtttctttttgatgcataaagaaacaaactcagaaagcttaaagaatttgccaggggttacatagctcatattaatgggtctaaaattcaaacccaggcatgcccagctctggagtctgtgctgcttccatgacaacaaaaatgacagatcatgagcttagcagtttggctttctgtgtgactatgcaggtatacatgcagccttttcttccttattgggccactcaagatggtacagttggaaacctctgtttagaccttgagtctgtttacttggaggctgggcattatacttagtttctaaacatctgctctcctgacacctagaatgcagaagcgctcaagctggaagtcctgacttgttttgactccatgtgacagtttgtttctactaaaactcatgtcatgtgtgtatcactgttaatgattttgaactattcagccctaaggtggggccccaggagcaattttctgggtcctcccttttgagtgtaaaatgatctacagaaaaatgtgtctgtggtcctcctagcatcccagaggctactgggggctctgctatggctggaccatgtgccagttctgggttctatatcagggattcctgtccatgagcaggcggcatcctcagcagctcattcctacatcactatcacctctgagtctttcttttatccacaacccaaatgccttacctcatacttctactgacactgtgtagacaccagctttttaacaccctgagtccctccatctttttccttagcattttcttcttcctccttttttaaaaataatatttctttccactgtcatattatagtcatgcttctcagcccaccaaagccttgaaatggtatttgactcccaggtgtgcactcttgacttttgtgccctatctctactctcaacagcaagccgtagacatctgcagccatacgtaaagttctgagcagtcttctcgtctccctcatgctatccaacgtaaagcctcacaatgtaaatcctgtaaatctgatctctctggaagtcaaatgaagtgtcctgaacatcagtcatatgtcaggcacctgctttcccttaggctatcttaattgtgcctcagtacaacccagagaggtaggaatttttgtacccattacatagattagaaaactgagactcagagaggttgaataatatggcctcactcaaactcctgagggtcagagttagggctgtgatgtttctttgtctaatttgaaggtcaggtctttctatgacaaagtactggctagcattgaagaccttcatactatcctgtcttgttctgctttctggaagagccaagtattacaatatgctattctttgccgtgttgtgaccaggttaaaaattaaagcaaggtatgtcaactttatgcctcagcagtcactctataaagcagcatgaaaccacacatggccacaaatacacatttaaaatgaaccataactttataagagacatttagaacttacaatcaaaaagccatttattaacagttctatccacattcaccaattagatggccctgtcatttatctgtttgaacatcaggcagttcttcaactattattttaattaattaattcagcccttttatccctagggtgggccctgggagacacctggcttattttcacagcagtccctgatgctcagctgtcaagccacatcatgactggcactccgagcttcatgcaaggccaagcacttaatctctttaacagagacctgtcatcacttgctttcactccagcacagccccagtctgtgttgagacacaatgtctcatgcacctgtccctgccttcccattgtaacagccaccatatgggttcagacccttctcaattcctctctgcatcattgttcctgcaattcactgagagcctgctttgtgccaggcaccatgctatgcgtttcatattcctcttctctcatccacaaaaccactaggcaaaataggactatcatccccatatcccccaagaggaaatggagtcttagaaatgtaaagtgacttgtgcaagatccctcaactaggaagctgttaagccaggattggaagcgagctctatattgacttcgatgattgcgtttcttccactcttctgcattgttagaatcttgcctttaatatctaagatctaggaatgaaagacagaagctagctaggctatatactatataaaggggtaaaatggaaaagagggtcttcagaaaaagcatggcagagggcctgctaaggggaaataagacgtatcaaaaaaacaaaacacctgttgagcagtcttctgtggatgtactgtgtacattctctttactctctcctttgtggacttttcagtaaattctgttttgttcctgatatttatgtacagtgtatttatttggtagtggttgtagagcaggtgttcagggctagcaggagaaggaagagacagtggacagttggattatatgttgatttaaaacagcatatgattattggccatatgtatgtcttcttacatgtgggcaacaataatgaaaaacatatcaatatcactgatgattagagaaatgcaaatcaaaactatgatgagataccatctcacaccagtcagaatggctattatttgaaagtcaaaaggtaacagatgttggtgaggttgtggagaaataggaacacttacacactgttggtgggagtataaattagttcagccattgcggaagacagtgtggcaattcctcaaagacctaaagacagaaataccattcaacccagcaatcccattactgcgtatatacccaaagaagtataaatcattccattataaagacaaatgcatgcatgttcactgcagcactattcacaatagcaaagacatggaatcaacctaaatgctcatcaatgacagactggataaagaaaatatggtacctatacaccatggaatactatgtagccataacaaggaacaagatcatgtccttttcaaggaaatggaaggagctgaaggccattatccttagcaaactaatgcaggaagagtaaaccaaatactgcattttctcacttataggtgggagctaaatgatgagaacatatgaacacagagagggggagaaacatacactgggacctattggagggtggaggatgtagggtgggagaagggacaggatcagggaaaataactaatgggtactaagcttaatagctgggtgatgaaatatctatacaataatccccatgatgcaagtttacctatgtaagaaacctgcacttgtacccctaaacttaaaatgaaagttaaaaaaatagcaggtgaaagagagtgatggttgcagggggcaggaggggggagttgccacacctggatgaggaaggagggcatttcaagtgaggatacagtttgtgcaaaagcccagagctgtgatgagtaccacacttcccagccacatatgttcctgggaatatgacggttttggttttcagaaggatcctttttgcacggaagatactgaacttatctgcttgcattcaaaaggctatataggcctttcatagtaacttctgaccagctttcattcccaagtggtagctttataagttctgccttttacctttcccccatgctgtttaagctgtaaaaaaaaaatgtagaaaaaaaaaaaaggaaatccagccattttgagtccattgcctcttagcctcttagcctcttagctgccctagggggtgccacctctaagctgaaaccttctgtaattgtttggggctcactgggcctcccaatgacaccttcatttaatgccattacagtgtggctccaggttcttaaaacttggtacctgtgctctttacttctgctgccagaaggaattgcttttaaaagctatcctttatgctactaaattagttctcactattgctttgtgtatccaggtaagatggaacagtcaaatccttcattctctgggttgtggaggcagtttgaagcatgtctcagagtgtttcccaaagcatgtcctgtagaacactgagcccatgataccagcttccaaatgtaagtttagtagtcaaatattcttgggagatgtggtgcaatgcatcccagtctgagagattcctaatgcatattggcagattaaaggcatggagaaaaggcccacaagaaagaaatctttttaacccagtgtttcctaaacttaccaccaaatagggaatcctatttttgcattatttctacatcctttggtaagtgctgctctagggaataacaaccccttccaggtgcatggtttctaatattttacattctgttagagcaatactatgaggaaagcagtatgactcctattttgtgagtgatgacattgaagggcaaagatgttagtgacttgtgctagggaatacatctggtaggaggcagttgaaaattagggtctctgttttgtagggtagggggtctttgtcatcaagcaacagggcctttttgtggagcccatttgcacccttcaaggttggtctagaccatatacacacatatacacacatgcatgtgtacacatacacccacccaaaatgtgctttataaatagtcaagttattattgctttaaaaaatcccactatggggtaggtggggagagctaaataaagaaattcttatttaatgcagaggaagctgggtgcttcatatacattacctcataaatttttgaactaatcgtgagaggtaaatatctgtatccctgttttatagagaaacacaccaaggctcagagaaattaggtaactttctcggtgtcacagaataccaaaatgctcagccaagctttacgtttatatttgattccaaaacccattctctgtcctcatcctactacattttgctagtgaatgtcactattcctcttagcctagaacctaacagaggaagctagatttacccagttgcctctgcagagtgacatgatgtgtgttccaacaggtggtttagataaggctggcttttcctggtgctttgagaaaaataagagtattgagaattagtaactctgccctaaaaggagatcaaagggaactgatgcttaaatggtttgacagtgttatgccccaccctggaaggtggatttgggactttatcccttaaacaaaaagaatagttggagccttattagggaactgagcaaaactaaccaatataagggcttggacactgctcaggccaacaagttgccaagttggatggaaaagcagctcatagctaggagaggccaaggccaagttgtatggaaaaagccaagtcaagaggtagaaaggctgaggtttctagcctgggctgtgcatccatagagtgtgggatcctggtaaatctcttaactcctcttggccttagtttctcatatttaaaataaaggggtgtgaaaagatgcccagagatggtaattactatggggaaggggaatcaggtttctgcctggaggccagaggaacccattgtctgctctggattgtctcctctggcctcattctggaaagaggcctcactttaggtcccccagaggggagaaggtttggtgacctcagcctcctgaaatgaacacagaggggactcccatacctcacgtttagcacagagggcactgggaacaacagaccagggaccataaggaggctcagctcatgggaggttgggggctttcccccattggttacttggttacctaagtttatgtcctaggtggaaaatctgcagagtttgcttgctgtttgtctatttggggtatggtttgtgtggaagtgcaggatacgttgctttggatcctgcatcctactctccagctaagtgggttgtggtcacgctaaagagggagggaagcaggatgaggccctgggactgtgaagggaagggaaggcagggttgccagcatgggcctgggaaaggactctaagcttgagcaacagaaactttcagaggcccccacaatgagtgattggattaaatgatttctcagctgcatcccagctcacacataaagtgttgatttcatttccctaccttcctcgagcaatgcagcaaacatcggcaccacagatgtgctcagacttgagcctgactcacggaagagagtctggggctgccaggtctcagacaccagattataatcagcttcttcccaggtgctgcacacatgaggcccatgccatgggcaaacagtgcccaggggtggttcaggccctgcagagaccatggacagttcacctgacaggaaagaagatcgggaggaactcacttcacagatccctcaacagagctaacagtgttctttgggcccctgttactatttaggtgagagttgcaaaggcagcctctcctagattacaaagtgtgggtggaagtcatcaatacttcaatagtaccagctgtcaggacctaccctcaggcctctcctacaccctccctgccaggctcctagccttcccacaagggagagttggccagtgcttttgccttggggctggaggttggaaatactgtcagcagtgctgtcaaggtgaagctaaaatacggcatctccaggggacacccaggctgtgggccatggctgaggctgcagcgtggaggtcagcgtgcaggctctgagggggcagggatgggcccagtggagtccccaccacccagtagttccttaataaattgttgaatgtttgattagcgtggagaggtggtgaaggaggggtcactgagtgggtcactgagtgcgatgggagagattggggaagcagagatctttggaatttggttttagagaattaaggatgaattaaggaaggaataatttctgagtgcctactctgggggacccacgtgattgacacctcacatgagttactctccttaaatcctaaacaagaattattattatccttcgttatgagctgaggtttgagaggctaagtgaattacccagagacaaatcatttctaagtgaaaaaggcaggattcaaatctagatcttctgatttttctgccttcatatagttaggtcattattttctccattttgtagagaagactgaggcccagaaaaacaactcagagctaggagagggcaaaatggagactaaaatccaggaatctggcttgccagctttgctccattcatggactgcttgatgttctcccgggacatccaggtctccctcacccaggtcagcattgagtgtactcagcagcttgtcctgttcccgtgggggctgggacttaccccaccctgcagtcctcatcttctccctcatttgttcaggcagcccctttggggagggcggacatctggctcacagctggcctgagtgaggctcatgcaactctataccgaagaatgtgggcttcatgtgtgtttttcttttctctgttgtaacaaaattggataatgagcctggtgaatgaggccccagctctgccatgctgtgccattgggttaccctctctgggtcctggtatccccatttttaacaatgtggggttatgcaaaatgacacccaagatcttctcctggtactgactttctagaactctgtgtaaaacggttaccacacatacaccaggagagtcaagcattcttccttgcccatgtagtgaaatctaaaactaaacatgcataaaatattttgatgtttaaatcaaaccttggcattttctattcactttattttttacccttgtataaatttttaaaaaatagtcttcactttatgagaaaaagatattttcccttaaaagtgcatagaatttcaaactctttttgttgttcttatgcattctttcttaaaaccttaactaaaaacaaagaaaaaaggagatgaagtgcctaaatataaaaaactttctggggttcctgtttatttacatcttaaaatagttaatatttgtgtcaacctggctaggctatgatgtccaggtgtttggccaaacactagtctagatgctgctgtgaatgtatttgtgggtatgattaacacttaccatcagttgcctttaagtaaagcagattacacactatgacgtgggtggaactcatccaatcaactgaaggctttaagaacaaaagcaggtttcccagaaaaggaggaattctgcctcaagattcaatgtgtaaatcctgcgtgagtttgagtttccagcatgccctgtgggtttccatacgttccctgtgaactttggacttgctagctctgacaattctgttagccagtttcttaaaacaaatctctatttctggcctggttgtggtagctcacacctgtaatgccagtgctttgggaggctaaggtgggtggacaccttcaggctaggagtttcagaccagtctgggcaacatagtgagaccccatctctacaaaaaactttaaagttagctaggtatggtggcacatgcctgtagtgctagctactggggaggctgaagcaggaggatcgctagtgcccaggagtttgaggttacagtgagctatgactgcgtcactgcacttcagcctaggtggcagagtgagaccctgtctcaaaaaaaaaaaaaaaaaaagaaagtatttatctcatctatctctctatcatgtatgtatgtatctatctatccttttttttttttttttttttttttttgagacggagtctcgctctgtcgcccaggctggagtgcagtggtgggatcttggctcactgctagctccacctcctgggttcgcgccattctcctgcctcagcctcccaagtagctgggactacaggcacccgccaccacgcccggctaatttttgtatttttagtagagacggggtttctttcatcttgttagccaggatggtcttgatctcctgacctcatgatctgccccacttggcctcccaaagtgctgggattacaggcgtgagccactgcgcccggccgtatgtatctatctatctatatcctattggttctgtttctctgggaagccctgacatacacatctgctagactggaagactgtttccactggaaatgtcataggatccatggttcttagaaactttccaggagtgctgtcttcactttctggctgcatcatatcatggctggtgagtttgggactcaagtgacctgggtgtgaagccaacttcactgcttactagctatgaggcctggtgtaggcagcacgccccctgggcctcagttccctcatatctggagcagggggtggggaatggggtgtgtgatgataacgccttgctcgggtttgttgggagggtcaggagggacaatgcattaaatcacctgacgcagaacgtaacctccacgaagagtaaatactacccatattattcctataactcctcctcctcctctgattcctcctccttctccttctatcataattattaactggactcagacaacatttagagagcactgcctggttgccaagccctatactggggagccagtgatggcagatgaaagtaaacgtctttacccttcaggagctgagtcaattgagaggagaaagctccgcatgctctgtgagtcacaagacaagatgatataaatcaaagctctcctaagccttcaaggcccaacccaaatcctgtctccttcacaaaacctttccagatccccctattgaaaagtaatctcctgactcccacgtccccagggcctttggcttgtacctttcctatggtccttaccactatttaccttgtattagagtgatttatgcacatgtcagcctctcccactagaatgtgaattcctgaggacagaaatatttatgaagggcttttctatgactttgactactctatgaaggaccaacataacaacatcaataacccacttcacattttaagatgattttatgacaaaataattaaaattaaatgtaattaaaacattttcacatattcattctcatagccaatagtgttttttgtgtcccttttatagatgctgcacaggaggcagagagatggccgtgacctgtacaaggtcagagaactagttaacagcagggctaagcccagaatttggcccatctgtgctcagcagtctaagtctggcacttaactgatgtggctgcgttgcatattcctagttccattaaatcacccttagcgagcaattctgtattctgccatgcataagcagtttggcttccttgtcatgagtgtggtttagtaagttctctccctgtttagacataaaaccaagccagttgagacaaattgcatcttttaagtgcctttccagactggttgtgactcttaccctgacattttttgggtctgcagaggctcctctgtagcagttttccccacaaaaaccatgtggcttcagagtgattagagttgggtgtgcttgaacactgatctctccactcttcctcccttaaacttctcaaggctttgtgacaacattgataggctcagttatctgcctttgacaaatgaggcaattgaggctctgagaggtggagtgacttatgtgcccgaggctgccactgtcaggattcaaacccacatctgttcagatgctaaagactttccattatgcccacattgaattcttttccctaatggggagggactgggaaagaagggactgactctcttatctctagcaaccaacttcatttgtaagatgtcaattacaggactgatttttctgggagacttagaatcattagataatgaccatgagccaaagattcacttttgagtttggtacgcactgcttgaaggctgggtatgactatatgattgtttttttttttttttctctcccagtttgaacacattaattggcagaagtttcccctgtgatcttccagtacaacattcttcctgcagccacacctgaccagtgggaggactgactaaattcttcatcctctccatcccatgcctttacgtctgctgtgtctcccacgtggtgagtcttttctttacacctctaactaggctcccatctgtcaagatcccactggactgggcacatgaactggctgaattgagttgatttgtactttggcaagaccggtcttcatgcaataaacattaggggacaagtcaaaagtagaaggtaactaataacggaaggaaaggaaggagaattggtgagggccagatttggctcagaaacttgaacttcttttattgggcagtggggagccatggaggcttttgagcagagaagcgggccacatgatgcaaattatattttaggaaggtagatctggtaggagaaagtaaaagtatgaaggctgcttagtagattcttagaatagtctaattatgatgtgatgagggcctgaggcaggtaagtatccgtggactggagagcagtaatagttgggaggtattttgaatggggtagactggagtcatttgctaatggggtctcacaaaaaatgtggcacaacacagaagaaagcatccaggctttggaatgaatcatcctgggttatgaatctcagctcagtcacctgcaggtgtgtgaccttgggcaagtcatgtaaacttgctgagtttcagttttcatctgtcaaatagtaatatttgacaactcagacctgttgtgaaaatcaatagaagtgacaaacatgcaaagctagtcacattgcagaggatcagtcagtgatcaccatcataaagggaggtgggaatgtatcctagctaagggcaggcctagaagtgttgcgcttctgctcctttgcagctgtttgaacttgggaaaatgactgaacctgggtgaatcttggtaacatgggaataataatagctctcccacagatcttttgtaatgaatatcatattaaattagataaatgtatgggaagtgattagcttatgatgggcacataggaagccctcaggtaaggaatagttgctaatattatcattattagagcctgatggacactgctgattggctgaaccagcttccatttctaccccattttctcttttctgcttatactatagaatttctaaatactgtctttcctagcctcctttgcagctgggagtggccacgtgacacagttcaggccaataagacatgagcacatgtctgctgggggatgcgggaaatgcttttaaactcaagattaaaggaagagccccagtcagtgtggtccaatttcattctgccccttattcctgccttaagttcgtggatcgtgcctgaggctgggacagacaactcacaaccatgaagaaaaggcaaagagaatcacaaagatgccagcccaacgctgggaagctactagcctacaccaatgctaacaaccatccatttatgacttcttgtcatgtgaggagaatgaaccttctgtgtgtaagttactgtatttgtgttttctgcatacttgtagctgaatgcagtcctaactgataaaagaggtaaaggaaggagaacagagaaaggtcactaggtgcttcagagcatcaacattccagctaaaggaaactgctccatgttttccatacaggatcactgttttccttcttacagggatctccctgactggaaccctcactctcccctcagcccctccagtccccatctctgtgcacataaatcctttaaggctcagtctagagtcacctcacctatgaactatcttaatctctccatgtagaatcaatctttcctcttttaatttctgttataaatacttacaataatcatattcgcaaatggctatgtagtgtgttattggtattcatagcttacttctactagcagaaactaagttcctttagatatattatttctgaataagacacacacagtcttacaaaaaatattaattattattattttgttaagtatttggtctactcattcagtgaatgtgtactatgaatctactatgtgtaccattagggttaataacttaaactctaatgacaaacagtttgggctctctctatggaacaatttactgtttctttgtctttcagatagggataatggtaaaaatagagattttatgaagaataactgagttaatatctgtaaaatatagagaacagtatctagaatacagaaaatactcaggaaatatctattgttaatattattattattattgttgttgtttaccaagctattagtttctaggcatctacttgttttctgccatacagcaaatgttgaatgaataacttgtgaataacttgtgtatgtgtacctctgaaatgtttaaaaactccaaatgaaactaatttaaattcatatatacttaagtatattaatgttcatgaataattcacatgaacaaatatgtgtttttcaattgattttctttggagattgcattgagaatttcacaacagctcttgaagtaactggagaagcagtggcaactaccacaaaaccagaaacaggaatggcttaagtcaattagaaaattcatttgcttttaaattcaacagttgtctactctctgcctgctctggtttagcacctagagagcctcctaccacgtgagtctccagagtgaaaggtgaccctttcctctgacccacaggaacccccccatagtctgagcccaacatacagcagcagcttcatttccaacccttgctaagagcctgggtactgcaatcagaaggtctttgtttagattcttgttctgacccttgctaggtgtgtaatccttctgggccttagtttaccatgtacaaaatagaacaataaggatattcctcatactgagttattgtgaagcttggttgtgtaatgatccaggtgaagtgcttagcacagagctgaacacatggtac

SEQ ID NO: 439 - DNA, 20001 bp, Homo sapiens
gaaggctgtcttcagtttcctgggcccatagctgttacctggtttgccagggttcggcactgacaatccactaattggaattttttcttggatccataggtttttggtgataaaccaggagctgagagaatcaaaaagaatggtaaagcccaggcccaggacatcaagcaatgtacatatttggaatgacctcatgctgtgggccctgattgtaaataaaaatgcttttgcggaaacagcaaaatttggggaagcctgtcttccacctccttgactgaaaagtctggtcagaggtgccacctggctacttcctcctcatccttctaggaccttcctctggacccctcagttctgagccctccatgaaaccctcagccatcaaggggactcgaatcgggtccagatttctgcctgggttgacatctggggtgaaccaacacctggactcacacatcagccacactggatcaagcccaaagacaacgcagacacacacactatttgtgccgtcctctatcatctttttaccatccactcatttcttcccagtcccctttgtccacttctgaaatgctgtacttgtttgtgaaacttcttctagggtcactttttgctccatatgagtggctttcccctagggatatatatcaagataagattttagagaataaacactacagaatcacagcctatgagggccggggttgcgaaccccatgtactttgaaaatgctcctcaggtgcttctcatctgtagacctggttgaggaccctgctctgtgaatgcttctcggatgctcaccttcatccccatggtgacaacggctgtctctacctgtggatctccaactgcctgccacacatctccacctagcatggactaagtgctcactatatgccaggcactgttctaaggactttatgtggattaattatcatatttaagccccaaaacaatcctgagagggaggtactattattttcttcaatttatagatgaggaaattgaggcacagggaagttatgtactttgctgaaggtcacatagctagtaagttgttaaaccaggttctgaaaccagataatttgactatagagcctgtatccttagccactggctatattacctccttcaaactcacatattcacaaacgggatttctgggtcctatggtagttccatttttagtattttgaggaccttccatactgttttccataatggctgcagtgtttacatgcccaccaatagagcgcaagtgttccaatttctccacatcctagccaacgcttgttataggatttgtttttgtaatggccattgtaacaggtattcggtgatatctcattgtggttttgatttgcatttccctggtgattattgacgttgaatgtcttttcatatacctgttgtctatatgtatgtcttctttggagaaatgtttatttacatctcctatagattgaatgtttttgtctccctaaaattcatatgttgaaacctgtattagtcagggttctctagagcgacagagctaaggaaaatatatatagttataggtctagaagcaaacagaggtgctgggggtggctcctgaggagaatcaacattatcttgcctggcaactgcctcaggagaggccatcactgttgccttaggcagcacagggtttatttcctcagacaaaggtggaagggctgatagcagcatgggttggggaggggatgttgccactactggggatgtggaaggggaagctgtttcttctggcaaaaaaggttcatcagagtttacaaactccgtgtcccgagcttcatcagggtcatcccacacatccccattccaagttgcagggtcctattcttttctaagcaataccctcactttaacagtagacacctggcgaggctgtgcatgcacctttgattgcatgtcagccacttgcatgataagaactcgtgtctatttttccacaatttcaactcttcctctacaggagataagactgtcactctgggcaatcttagcagatttgagattcagtatctgcttctgaagctgggagatagaattgctgagttcatcattttctttcatcactttgtccatggaacttagcagcaaccaaccagcttcattatgttccttggttctccacatatggtcaaaggtattatgtatagagtcactaaacttcttgcctctcatgagtaatgaatcaggcgtgtcaaatgcatttattttgcataactctctaaacaattcacaccaaggactatcagtgttctccatactattagaagtagagtccttagcattttgaagtcctaatcatagtaaacagccaactgcaaaaaccctaaaaccaattaaagaactccatccttaatattctgttcctctagaacgactcttggtaccaaaatctgtattagtcagggttctctagagggacagaactaatggaatatgtatatatatatgtgtgtgtgtgtgtgtgtgtatgtgtgtgtgtgtgtgtgtttattaagtattaactcacatgaattgacaaggtcccacatgatgtcacatgatgacaaggtcccacaataggccatctgcaggctaaggagcaaggagagccagtccaagttccaaaactgaagaacttggagtctgatgttcaagggcaggaagcattcagcataggagaaagatgtagcctgggaggctaggccagtctctctttttacatttttctgcctgcttatattctggccaggtgggcagcttattagattatgcccacccagattaagggagggtctgcctttcctggcccactgactcaaatgttaatctcctttggcaacacacctgcacagacacactcaggatcaatactttgtatccttcaattcaatcaagttgacattctatattaaccatcataaaccttaatccccaatgtgatggtgtttagaaatgggaactttgggaggagattggatcataaggatacagtcctcatgaatgggattagtgctttaataaaaggggccctgcagagctcactgtccctttcaccatgtgagattacaatgagaagattgccatttatgaaccaggaagtgtgcccttaccagacatctaatctgctggcgccttgatcttgaacttcccaggcttgaggatatgaaaaataaaattttgttgtttaaaagccactcagtctaaggtattttgttatatcagccaaaatgaactaagacaaagtcctctgtctattttttaaaattgagttatttgtgttttttttgctgttaagttgtaaaagttatttatacattatagcaattaacctcttatcagatatgtggtttaaaaatattaatattttctcccatcccgtaggttgccttttccctctgatgagttttttcctttgctgtgcatttccttcgctgggtgtatttaaatttgatgtaatccttcttctctatttttgcttttgttttctgtgctttctgatgtcatatccaagaaatgattgctaagatcaatgtcatgaagctttctccccaagttttcttctaagagttttacagtgtcaagtcttatgtttaagtccttaacccattttgagttggttttctatatggtgtaaaatgggctccaattttatcttttttgcatatgcctacttggttttcccaaaaccactgaagacattgtcctttccccattatgtattcttggcactcttatcaaattagaaataaactaatagaaggaaattgcttcaacttaataaagcccatatatgaaaagctcacatctaacagcatcacactcaatggtgaaaaactgaaagctttttctctaagattaggaccaagacaatggtgaccactctggccacttctacccaagataatactggaagtcctagacagagcaatctgtaagataaagaaataaaaggcatccaaattagaaaggaaggagtaaaattgtctgttcacagatgacatgatcttacttatgtcttagaaaattctaaagattctttaacaaaacttgttagaattaataagtaaatccagtaagtttcaggatacaaaaaaaatcaatatacaaaagtcaattgcattttcatacactaacaacaaataatatgaaaatgaaattaagaaaataattatatttataatagcatcaaaaagaataggagtaaacataactaaggagatgaaagacttgtacactgaaaactacaaaacattgctgaaataaacataaaaagtcacaattaaatagatagacattccatgttcatgtattggaagacttaatattgttaaaatgtccatactacccaaaggaatatacagattcaatctaatccctgtgtaaatcccaatgacattttttatagaaatagaaaaaacaatcctaaagtgtgtatagaacccacaggaccctgaatactcaaagcaatcttgagaaagaacaaagctcgaggcctcacacttcctttcaaaacatattacaaaatgacagtaatcaaaacagtatgatactgacataaagggacatatagaccaatagaaaagattagaacacccagaaataaacctacacatatacagtcaatggatctttgacaagggtatcaagaatacacaatggaaatggaacttttagtgaccgcgtattacatgagaaattagaatctaaacaaacctcagccatagggtgagttagtgcttacctgccagtcccttcctgtgggcacttactaatgcatgagtgtagtacaccaaaggctgagactaagataagacagctgagagaggacccctgaggcatagccttcccataaccagatgatgactgagggaagagtaatagaacactaggataagtcctaccatggcactccttcatggaaagttctgcagctacactccaagaaatgggacagggcagcagaaaagagagagattactgaagcatggaaagcaacagtggcactgcgaaaaaaagagaacttgacagctacccagaacctggcagctgagctatgaagcagatacagatttctcatggttgagaaagctggtggctaggatataaagtataaagcaatctccagtctcatcaatgttctctcatcaagagaaagttatgttcccaccttcaatatgtttgaagctaacatttttaattttaattttattttttatattttttatagagatagggtctcgctatgctgcccaagctgttctccaattcctggtctcaagctatcctcttgcctccacctgccatagtgctgggattataggggtgagccactgcatcagtggctagcattaaatagaccctaactaaagctgcaacaaagcctagaccctggtaactacagattatattaactcagatccccacacttgaggcctaacaggagactgagtgtgccctaggtccagtctgctttatattactttactttcctcctccttattcataaataaatgtaaaagagaaaatacaaacgtttacctagacaaagcaaaacatgtcctcatctcttaaaaaaagacagtagggctggtgcagtgggcatggtggctcacatctgtaatcctagcactttgggaggccaaagcaggtggatcatttgaggtaaggagttcaagatcagcctggccaacatggtgaaaccccatctctactaaaagtacaaaaattagccaggcgtggtggcaggcacctataatcccagctgctcaggaggctgaggcaggagaatcccttgaaccccggaggcagatgttgcagtgagctgagattgcaacactgcactccagcctgggcacagagcaagactctatctcaaaaaaaaaaaaaaaaaaacaaagacagtgggaaaggtgaacaatgagtgtgatagagaattttagcatataaatgaaaactatatttaaaaatggaatgttaaagtgaaaaaaatattatatgagaggtgaaaagtttatttgaaagacaacagaaaattgggcacagcaaaggaaatggcacaaaacaaaatcaggaaggggaaaaggagcatggagcaaaacctggagaaaacagtcataagtttccaagagtcctttcctagtggagtcatagagtcatacaggaaataattacttcagcaatgaattgtgacaacacttgtgtgaaatgttgtctaccagggaagctggcctgggcctagatgtccagggtttttattgggagatcactcacataggcatcctctacctaccacggacccaaattccagaacccagaaagaaagcagatacttatcacaaagcacttatttgtataaagtatagatatagtgagccactcttatcagttacagaatggtggaaccctcctgaaaactaagttcccagataacagccaagggccaatcttgtaagcagacctttctagagatagcagtctcaagcctgccatgttaactatttctgcacaacccctaattgcaaattaagtatacacttcttcatatgtcaaagaaaaatgataaggaaaataaaatattttgaactggatcataatgtaaaaatagtgtattaaaatttgtgggaggcagctaaagcaacacttagagggaaattcatgactttcaatgcctatattataaaataaaaaagatgtaaaattaataatctaagtttccactccaagaaagactaagaacgaatgaaagagagacagaacccagaaagaaagcaggtacttatcacaaagcacttatctgtttagagatatagtgagccactcttatcagttacagaatggtggaaccctcctgaaaactaagttcccagataacagtcaagggccagtcttgtaagcagacctttccagagacagcagtctcaagcctgccatgttaactatttctgcacaacccctaattgcaaattaagtatacacttcttcatatgtcaaagaaaaatgataaggaaaataaaatattttgaactggatcataatgtaaaaatagtgtattaaaatttgtgggatgcagctaaagcaacacttagagtgaaattcatgactttcaatgcctatattataaaataaaaaagatgtaaaattaataatctaagtttccactccaagaaagactaagaatgagtgaaagagagacagaacccagaaagaaagcaggtacttatcacaaagcacttatctgtatagagatatagtgagccactcttatcagttacagaatggtggaaccctcctgaaaactaagttcccagataacagccaagggccaatcttgtaagcagacctttctagagatagcagtctcaagcctgccatgttacaagatacaaatatcaggaataaagagagtatcactggaaaccctaaagacattacaacataagagaatatcatgaacaactttatgccaatgaatttaataacttagacaaaaaggaaaaaattcatgaaagccatggattaacaaaactgacaaaaagtaaaatagaaaaaaatatgaattttcccatatttattttaaaagttgaattttattttaacctttattttaagttcaggggtacatgtgcagtgttgttacgtgggtaaagttgtgtcatgggggtttgttgtacagattatttcctcacccaggtattaagcctagtacccattagttatttttcctgcttctctccctcctctcatccttcaccctcccggggctccattgtgtgttgttcccctctatgtgtccacatgttctcatcgtttagctctcccttataagtgagaacatggagtatttgattttctgttcctgtgttagtttgctaaggataatggcctccagctccacccgtgtccctgcaaaggacacgatctcattaaaaagttgaatttctaataaaaaaatctttccacaaaaaaattatcagtccacattgtttcacttgtgaattctatcaagcatttaagaaagaataatactaaccttatgcatacagtcagaaaatagagaaagcacttcccaatacattttgtgtaattagcgtaacacggtattataataacaggacaataaaaattacaagccaatatttctcatgaacaaagatgcaaaaacccataatagtatattaataaattggtcccagcaatatataaaaaggacaatatatcatgaccaaaaaagagatttttccaggaatgtgaggtttgttttgtatttgaaaattaattaatgtaatttatcatattagcagaaaaaaagagaaatcttatctcattagattcaaaataagttattttacacaactcaacattgattcatgacaaaacttttggaaaactataatagaaggaatttcctcaatttgataaaagatatcttcaaaagatctataattaataccatacttaatggtgaaaccacaaatgttttctccttaagacagggaacaagcatgtccactctcactttaattcaatatgaaagtatttcaataaggcaagaaaaagaaataaaaggcatgcatattataaaggaaatgcagaacagttttttattctcagattacctgattgtgtgtgtagaaaactccatggaatctttttttttccttcaacttttattttaagttcaggggtacatgtgcagttttgttacataggtaaatgtgtgccatggtgatttgctgcacagatcatcccatcacctaggtattaagcccagcatccattagctattcttcatgatgctctccctctccccacagccccctaataggccccagtgtgtgttgtttccctccatgtgtccatgtgttctcatctttcagctcccacttacaagcaagaacatgtggtgtttggttttctgttcctgcattagtttgctgaagataatggcttccaactccatccatgtccctgcaaagaacatgaccacgttcgtttttatagctgcatagtattctgtgttgtatatctatcacattttctcttatccagtctatcactgatgggcatttaggttgattccatgtctttgctattgtgaatggaatatcaaaaaacaactgctagacctagtaagtgaatttagtgaggtcacagagtacagggtaaatttacaaaaatctatagtgtttctatatactcacgatgattaattgaaaataaaatttaccaacaataccatctgcagtacaataaaacaagcaaatacagaattaatcgaatgagagatgtataaaatctctacccttaacactataaaacactgctgagagaaattaaggaagacctgaataaaagaaaaaatacaccatattcatggattagaacaatattgttaaaatatctattctcctaaatttgctgacagattcaatgaaatcccaatcaatatcctaacaagattttaagaagaaattgacaatttgattctataatttatatagaaatgcagaggatgtggaataattgaaacaattttgaaaaagaagaataaagttggaggactaacataataaactgatttcaagatgtattgtaaacttacaggaataaaggtagtgtagttttggcatagggataagcacataggtcaaccgaacagaatagagtcatgaaataaacccatggtcaactaattttgaaccaaatcactaagtcaactcaataggaaagtaaatcctttttaataaatggtgctggaaaaactggaatctgtgtggaaaaaagcaaatccaaaataaaaaccaaaacttcaattccctccttacctcatacataaaaataatataagatagggcatggccctaaatgtaatagacagaatcataaaaattcaagactacttaggagaatatcttcatgccttttggatagaaaaagatttcttagctgggacacaaaagaactaattgtaagcttcatcatgatacattagacttcatcaaaattaaaaatgtatgttcattgagtagatggatggttaccagaggctgggaagggtagtggggggtgagaggggaggtaaggataattaatgggtacaaaaaaatagaaagaatgaataagacctattatttaatagtacaatagtcagactacagtcaataataacttaattgtgcattttaaaataatttaaagagtgtaattggattatttgtaactcaaaggataaatgctgaggggatgaataccccattccccatgatgtgcttatttcacattgcatgcctgtgcaaaaaaaatctcatgtaccccataaatatatacacctactatgtatccataaaatttttttaaattaaaaaaaatctgctcattaaaagagactattaagaagataaaggcaactaatggcattggaaattttttaaaaaaagaaagtacacaaaccacttgtatccagaacatataaagaacacctacagtttaacaataaaaagacaaacaacccaataaaaaaagggcaaaaaataatgatttttgacctaaatatcactccttatataaaagttaagtcaaaatgggtcacaaacctaaatgtaaaatgtaaaagtacaaaacttttagaaaaatatagaagaaaatatttaagatacaaggctgtgcaaagagttcttaggcttcacaccaaaagtgcaatccccaaaaagaaaaactgataaactagatctcatcaaaattaaaaagttttgctctatgaaagacctttttaagaggaagaaaagacatgctatgaactgaaagaaaatatctgaagacccacatacccaacaaaagacaaataactagaacatactaaagagttttcatacaacgtggatgacccttgaggaaccttgaggacattatgttaagtgaaataagtcagtcacaaaaaaggaaatactgtatgagtccactaatgtgaaatatctagaatagttagattcatagaaacagcaagtagaatgttggttgtcagggactgggggaaggagcaaatgaagaattgtttaatgtatatagaatttcagttttgcaagaagaaaaaattctggagattggttacataacaatgtgaatatacttaacactactgaactttacacttagaaatggttaacatgttaaattttatattatgtgtttttaccacaataaaaattatttatttactatttatttatttatttattttttgagacagactctcactctgtcgcccaggctggagtgcagtggcaccatcttggctcattgcaacctccgcctcctgggttcaagcaattctcatgccttggtctcccaagtgagccagttaactttgtatttttagtagggatgggatttcaccatgttagccaggctggtctcaaactcctggtctctcaagcaatccatccccgcttggcctcccaaagtgctgggactacaggcatgagccatggctcctggccattttttattttttattttaattttttactggtttattttcatgatgttttctgacagagggttgatatgatcttgttttaaaaatgtattatttatgttaagttccagggtacatgtgcaggatgtgcaggtttgttacataggtaaatgtgtgtcttggtggtttgttgcacctatcaacccatcatgtaggtattaagcctagcatgcattagctcttttccctaatgctctcctacctccccatactcccccaacaggccccagtgagtgttgttcccctccctgtgtttatgcattctcattgttcagctcccacttataagtgataatatgcggtatttggttttctgttcctgcattagtttgctgaggataatggcttccaacttcatccatgttcctgcaaaggacatgatttcattagtttttatggctgcataccattccatggtgtatatgtatcacattttctttatccagtctatcattgatgggcatttgagttgattccacttctttgctattgtgaatagtgctgcaatgaacatatgagtgcatgtatctttataatagtatgatttatattcctttgggtatatactcagtaatggaattgctgggtcaaatggtatttccagttctaaatctttgaggaatctccatactgtcttccccatggttgatctagtttgctttcccaccaacagtgtaaaatcgttcctatttctctgcaacctcgccagaatagagaactcagaaataaaaccgtgcatccacaacaatctgttctttgacaaacctgaaaaaaccaagcaatggggaaaggattccctatttaataaatggtgctgggaaaactggctagccatatgcacaaaattgaaactggaccccttccttacaccatatacaaaaattaactcaagatggattaaagactaaaatgtaaaactcaaaattgtaaaaacctcagaagaaaatctaggcaataccaattaggaaataggcacaggcaaagattttatgatgaagatgccaaaatcaattgcaacaaaagcaaaaattgacaaatgggatctaattaaactaaagagcttctgcacagcaaaagaaactatcatcagagtaaacagacaacctatagaaagggagaaaatttttgcaatctatccttctgacaaaggtctaatatccagaatctacaaggaacttaagcaaatttacaagaaaaaaaaacccattaagaagtagacaaagaatatgaacagacatttctcaaaaaaagacatacatgtggccaagaaacatgaaacaaagctcaacatcactgatcattagagaaatgcaaatcaaaaccacaatgagataccatatctcaccagtcagaatggcgattattaaagagtcattttttattttttttgaagacagggtctcactctgtcacccaggctggagggaggtggtgcaatcatagttcactgtgctctcattctcctggcctcaagtaatcctcccagctcagcctcccaaagcactggtattataggactgagccattgccttcagctgaaaacaattttaaaaataaaataataaagaacttccaaatcttacagcaaaaagccaattaatacctccaattagaacaggagcaaattcgacccctaattagaatatgggcaaaagaaacagagattttaccaaagagatgtacaaaaggcaaataaaaacattaaaagacagtcaacattattacccatttgggaaatggaaattaaaactccaatgagatatcaatgcatatctatcagaataactaaaacggtaacaccaaatgttggtgagtatgcagagaaactggatcactcatatattgctggtagaaatgtaaaatggtacacctactctggaaaacagtttggcagtttcttatgactcagcaattgcactcttgggcattttatcccaaagaaatgagaaaccaatgttcacacaaaacccaaatgatcatagtacttttattcataatagtgaaaaactggaaacaatccagatgttcttcagtggatgaatggttaaacaaactaaggtacatccacaccacggaatgctgctcagcaataagaaggaacaaactactgatacacgcaactatttgaatgaatctccagggaattatgctgaggaaaaatagccaatcccaaaaggtgacatagtttatgattccatttatgtaactatttaaaaattgtggtttaaaaatgtgtaacataaaatttaacatcttaattatttctaaatgtacaattccatactgttacatatactaatttttttattttttatttttattttatttatttatttatttatttatttatttattgagacaaattcttgctctgtcacccaggctggagtgcagtggtgcaatctcagctcactgcaacctccgcctcctgagttcaagtgattctcctacttcagcctcccaagttgctgggaccacaggcacatgccactatgcctgactaattttgggggtttttttgtttgtttgttttgagacagagtttcgctcttgttgcccaggctggagtgcaatggcactatctgggctcaccacaacctccgcctcccaggttcaagcgattctcctgcctcagcctcccgagtagctgggattacaggcatgtgccaccacacccagctgatgtatttttagtagagacagggtttctccatgttggtcaggctggtctcgaactcccaacctcaggtgatccaccctcctcggcctcccaaagtgctaggattacaggcatgagccactgagcctggcctaatttttgtattttttgtagagacagggtttcaccatgttgcccagactggtctcaaactcctggcctcaactgatccacccacctcagcctcccacagtgctgggattacaggcataagccaccatgccctgcccctatattcacatttttatacgaccaatctccagaactttttcttgcaaaatcgacattccacatccattaaacaactcatcatttttccccagcctctggcaaccaccatcctattttctgttctatgaattttctattctagatacttcacataaatgaaatcatacagtgtttatatttttgtgactggcttatttcgctcagcatagtagcctcaagttgcatccatgttgtcacaaatgacagcatgttcttcccttttaaggctgaaaaatatgtcattgtatgtatatgccacatttttgtatccactcatctactttaatagccttttttaaatgacaaaattttagaaatggagaatagatttgtggttgaagagtttatgagaagggtcagaaggtagtagatatggtaataaaagagcaacatgaggggtcctcgtggtgatggaactgtcctgtattttgactgtggtgatggatacggaaacctgcatgtgttataaaattgtataaaactaaacacgagtttacataaacgaagaaaatctaaatgagttgtggactgtatcatggtcaacatcctggttgtgatattgtactacatagttttgcaagatgttattgtcaaggtaaactaagtgttcatagatgtctttttaaaaaattttcttacaattacattagaatctacaattatctgaaattttttttttttttttttttgagaaggagtcttgctctgtcgcccaggctggagtgcagtggcgcgatcttggctcactgcaagctctgcctcccggattcacgccattctcctgcctcagcctcccgagtagctgggactacaggcgcccaccaccatgcctggctaattttttgtttttttttagtagagacagggtttcaccatgttagccaggatggtctcgatctcctgaccttgtgatctgcccgcctcggcctccaaaagtgctgggattacaggcatgagccaccgcacccagcctatctgaaacattttttaaagtttataggcaataggcttggacaggcacttcaccaaagaagatatctaaattggctataaaaatgagaaaagatgccaaatatttaattttataaatgggctataaaacaagaaaacatgcccaatatttcattttacccactcttttagactggctaaaattaaatgtcctgatatcactgataaagaggacactgttagagcataaaattacagataatagtcccttcttttttctctttattttcgttttaatttttttctaaaccatttcacatttctgaagtagttctcctcttattcacagtttcagttacccatggtcaaccttggtctaaaaatattaaatggaaaatttcagatataaacaatttgtaagttttaaattgtacaccattctgagtaatgtggtgaaatctcctgccaccctgcccaggatgtgactcattcctttgtccagcatgtccatgctgtagatgcttcttgcctgttaatcacttagtagccctcagggttatcagactgttgcagtatctcagtgcttgtgttcaagtcatccttacattagtaaataatggccccagagtgcaagagtagagatgctggcaatttgggtatgacacagagaagccataaaattcttcctttaagtgaaaagatgaaagttcttaagttaataaggaaagaaataaggttgctaagatctatgatgaaaacgaatgttctgcctgtaaattgtgaagaaggaaaaagaaattcatgcgtagtatatatagggcctggtactatccttggtttcagctatctcctggggctcttaaaacatgtgtccccccttggatactgtactgtaatcattttagagaactatttgacagtctgttataaatacacattcttaaaaaaaattctttttaagagatagtgtctcactctgtcacccaggctggagtgcaatgactcaatcacatctctctgcagtgtccaactcctgtcctcaagcaatcctcccatcttggcctcccaaagtgctggcattacaggcataaaacaccacactcagcctgaaacatacattcttataaacagctgagtcatggctcagctctttccctcctagatattcatgcaagagaaataaaaaaaaatattttcatgaaagacttgcacacaaatgtacatagcagcttttttcataattaccaaaaacttaacaacccagatgttcattaataagagaataaatgaacaactttgtatttttaaaaaggctttgtacttttctaaatggtttccctgggaaggtacatacttattctaacaataagatctcctggttcagaaaaattttggagctgattttggaacctgtagcatattttcttgatgtacattttcaaaggtattaaatttccgccttttgataataggtttaaattttggaaacaggccaaaattattcaaagaggaccaggctcagtggctcacacttgtaatcccagtaatttaggaggccaaggcaggaggatcacctgagatcaggagtttgagactagcttgagcaacatagcaagaccttgtctctacaaaaaatttttaaaagttagtcagatgtggtggagtgcacctgtagtcccagctactcaagatgctgaaatgggaggatatcttgagcccaggagttggagactgcagtgagctatgattgcacaactatactccagccttggtgaagagcaagactttgtctcaaaaaaaaaaaaatattcaatgagaaattgggtgtatctattggttaaagaaagaggtgtggttctcaatctttgccacacattagtatgacctgaaaaacctgaaaaattagaatgcccaggtattgtgacttaactggtttagggtgggccagttgttggtattttgttaaagctccccaaatgattccaataaaaccaagtcctaatctttttagttgctcacttcttgttaattttttttaacccacacagctgaaagcgatactacactaccatgtactgtaacttagccttcactagcttccttatagctaacacctctgatgtatatattaccgtggtaataaatgcctaagttgtttttcaggatcttggggtcagcccttgtccagtttgagtgcagttgagatcactgacccttaaactgagcctgtgcagatgccgaagaggtgaccttttggcatcagaggaccataaactcctctctcagatcatgctaatgccattatttcctgaatacatatcctatgaaaagccatgaaccctgactatgcttgtgcaaatcatcaattacgtcatttttccccactgccaatcacctttccccatgccttagatcaccccacttctttaccccataaatatcactgagccctaactttctggcagtagattggagaactgttctcccatctcctcactgggctgccctgtgaaaaaatctttctctactgcaaaactcatcacctcagtgattggcttcggcaccacaggcagaacaagcctggttcagtattgctaatatgcagccaaggttgaaaaccatggctgggagctgacgttaattttcttctatggtttataaactgacttctaaaggcaggtcctaaaaaggggtctcctcacattctctgagactacggcattgtaggaacaaatgtacagtctcccaagacagctgttttgaagaacaattcccatttggatgtataaattctagtgtgttttcaaacaaacgtttgcctctttatcttacagatgtgctaaagggacaataaatgtaaaagatctagttgactctcctacttcccttcaaatacattcagatgattaaatatataattttcaaaaatacatttatatctttctaaggcaaacttactaaaattattctttattatttcagtttgtggtgatgaataaggtacaaagatatatatattaaatagttataaaggatatacatattaaaggtatagtttgctaatgaaaaaatataaaagacagatatagatatacagattaaaaggtatagttatgaagaacatatatataagatgtagttataaagaaaaaatatgtatatatgtgtaaaagataaagttgtaaagaataactattaataataacacaatttagtcatgaagtctttgcccatgcctatgtcctgaatggtattgcctaggttttcttctagggtttttatggttttaggtcttacatttaagtctttaatccatcttgagttaatttttgtgtatggtgtaaggaagtggtgcagttttagttttctgcatatggctagccagttttcccaataccacttattaaatagggaattctttccccattgcttgtttttgtcaggtttgtcaaagaccaaatggttgtagatgtgtggtgttatttctgatgcatctgttctgttctcttggtctatatatctgttttggtaccaggaccatgttgttttggttactgtagccttgtagtatagtttgaagtcaggtagcatgatgcctccagctttgttctttttgcttaggattgtcttggtaatgcgggctctttttttgttccatatgaaatttaaagtcgttttttctaattctgagaagaaagtcaatagtagcttcatggggatagcactgaatctataaattactatgggcagaatggccattttcacgatattgattcttcctatccatgagcatggaatgtttttccatttgtttgtgtcctctcttatttccctgaacagtggtaaaagtcaaaattgacaaatgggttctaattaaactgcagcgcttctgcacagcaaaagaaactatcattagagtgaacaggcaacctacagaatgggagaaaatttttgcaatctatccatctgacaaagggctaatatccacaatctacaaagagcttaaacaaatttacaagaaaaaaacaaccccatcaaaaagtgggcaaaggatataaacagacacttctcaaaagaagacatttatgcagccaacaaagatatgaaagaaagctcatcatcactggtcattagggaaatgcaaatcaaaaccgcaatgagataccatctcatgccagttagaatggtgatcattaaaaagtcaggaaacaacagatgctggagaggatgtggagaaatgggaacactttcacactgttggtgggggtataaactagttcaaccattgtggaagacagtgtggcaactcctcaaggatctagaaccacaaataccatttgagccagcaatcccaatactgggtatatacccaaaggattataaatcattctactataaagacacatgcacaaatatgtttattgtggtactgttcacaatagcaaagacttggaaccaacccaaatgcccatcgatgatagactgattaaagaaaatgtggtacatatacacc

SEQ ID NO: 440 - DNA, 51749 bp, Homo sapiens
gtcacatacctctttgcctcaacccacttaaattctgagaaaaaaatcaatacagttaaatgaatgtaagtatgggtttatcattgtctctttaagtagaattatgtccacgttttacaagttccatttctttaggtgtcaaaaactagttttatttagctgaggttgagaatattgggcagagtcaaggtgagcatctagtgaaaagctttggaaacactccaggtataaagctgaagacattaatcaccagaataacaaatgaaattgaactgttctagaattgggctccttcacctcattttccacttcttcttccagtgtggtcatcaggattcaatcctggtcctatgctgtccataagataataccaaagggagcagacactcaacatttacttctttttatctcgactctaatcaagaaaatatgacaatatttctgatatctcttctcaaaaaactttttttttactctaagttctgggatacatgtgcagaatgtgcaggtttgttacataggtatacatgtgccatggtggtttgctgcacctgtcaacgcatcatctaggttttaagccccgtatgcattaggtatttgttctaatgctctccgttcccttgcccactactgcctgacagccccagtgtgtgatgttcccctctcagtgtccatgtgttctcgtttttcaactctcacttatgagtgagaagatgcagtgtttggttttctgttcctgcgctagtttgctgagaatacctgaaagctttgaaaaatcagattatcattaagaaataattcttaaactcaaaaattttgcccaaagaacttccttctctggagacctgaaagaacaaattaaatactcatcataaatatccaagtgcaaaactaccagttttgcatttataaaactaccagtttgcacatgaggaaactaagattcaggaagtgtaaatgatttaccccggcatgaagctagttaatagaagagcaggttgctccttactcttactatcttacttttttgttaatcatttatacacaaatcctgagtacctaccatatccatggcactaagggctgtgaagggaacaaatccaaaacattcatggttcctcctcccaatattattattagatactttaaacattacaataatgataaccactatacatcaaatactcattacgggggagaaactgggtcaatatcatggtcgcagacattattctcttgatatgagtgttagtttcttcagtttacagatgaagaaaaggaaactggtatgcaaaatgtcatataattgtctcaaatcacacagttcatcagaagcagaggtcaaatttgaacttacatttgcctgattccaagacctttgctcttaactgtatcataagctgatgtagttctacaactgaaacttaacatttacctccagagacaatggaagatactttagctaaaagtaaaagaaattttcaaaaataaggtttattaacgctagaataatttaacatagggagcctgtagaacttcatcactgtaggtgagttgaaaatgagaggatactaaattagaggttttatttaagagtgggtctacctaattgcctagtaggaagtgaaaacaaatgatatttcaagctttcttttaccctatgactttaaggaaaaacaataacaaccataaaacaccaccacctacgacaacagtcttctgtgttttcccatgcattcaaatgagctaaaaagtgataaatgcattgcaagtaaaatagctatgcagcactcttgggaaatgtggttccacggagatgccacagagactttcattgtaaagcctggtactgaagtttggacaaaggtgtgtttgtgtgcagtgactaagcttgtgtgggagggaggcaaccactgcagatggctgaaaaatatgctaatgttgaaagacccatgtgatggctggcatcctgaaagagacacagatgtttcctcccaagaagaattttagaacaagtggcttgctgacctattcaggcttgattccttaactgcatctcagggtcatacacacgtcagaaccactgagacaattgtcctcctcactttgtaccccaggaaagagatagagcagctaattaatcacaaggcctttgctgataatacctttcatttgaaatttttgttgtttttgtttttaagatgttttcatgttctctgagacttgctttcagaatgctgcctctgttcacatgctgggtctcctacagtgctcacattgctccactctctgtacgttttgttttttttccccataaaaaccatccctcttatattcactttttaagtctttcttttccccactaaactatatgctcatttcatggcagggagcatgactaacttgttaaccacaaaatcccaagagcccaacataatgcaagatacatagaagtctctcaaaaacatcttttctcagcactcctgagaatacctacaagacattctcagatatactagagaggcagagcgtagattgtcttgtattagtctacttaaacaagattgttcattccttcatttattcaacaaaacttcgggggtttatatcatgtgtcaggcactgctctaaatgaccaggatgctgcaataaaaagaacaacaaaaaaaattcccatccttatgggtttagggtgttaacatcaatatatttttaaaagaaattgaaaaaaacccaggtacttcgactacaaaaatcattttgtttgcagattacctaacactgctaactcaagttcctgggtctatagaagaaaaataaaattaaaaattaaaaaacagccgggcgcagtggctcacgactataatcctagcactttggaaggccaacacgggcagattacctgaggtcaggagttcgagaccagcctggtcaacatggtgaaaccctgtctctactaaaaaaaaatacaaaaaaaaaaaattagcaaggagtggtggcacatgcttgtaatcccagctacttgggaggctgaggcaggaaaatcgcttgaacccaagagacagaggttgcagtgagccgagatcatgccactgcactctagcctgggcaacagagcgagactctgtctcaaaaaaataaaaataaataaataaattagttaattaattaaaattcaaagacattgctaaggatctcactagttttcttctatcttaatcaggtagggattgtccccataaacaagaagagttctaacctgcaaagcacaacttaaagaaatataaatctgctgtaatggatatgaaagctaactgtgtaccactccatccccacctttctgcttctggcattataagctctccaatagctttagcataaattcacatgtcctattgtttcttgccacctctcagggttctgaaggaataggcaccaggttctgataagaacagaaacatctggagtgtgggagtgttcatctaaagaaaaaaagtgaaaatagcatgcattgaactgtttggtgtgctaagtaatgattagggttttcacatacattgtctcatttaatctttgcaataaacaaacaacaaagtacatcatatgccccccttttattttctaccaaagaaggaaatagggtaagaggtagagacgtacctttatggatctatagagagatttatggcttttgtaatggtcagagcacctaaatcactaattaacttcctagcaaatttataggctgacataacaagtgaataaatggtttcactagatactgaggaattttattgttcataactttgtgccaaaaaaaagaaatgggaaaccattagatcagagagagtggccatctaccttctattcacccagggaagattttgtagaaaaaatgggaactggctacagttgatactatataaagaaatactgacttttaaatttcttcactctctttcttaacagattctctttttttttttctgtccttaaggtctcaaagttttctccagctgaaaatacagctgcctcatagaaacactgcataagaaaattaataacaataaaccccagaggaatcagggaagtggtgataaggctgctttatgctttccttttacccaactgagaacttcctttaggcctcacttgctgaatgctaagaggccagggaggagcactagggaacataggagagagacaggatggcgggaagcagcgaacagatatgggagcaaagggaattttaaaaagaggaaaggtctctggccagggctggcccaaggaaaaaattgaaggtcagcagacgggttttaacacaaccctctccatctccctgtctattacctacagtgttttcatcaccctcagcgcctagcctcagctgctctaatttcccagttgctctaattcccatcctcccatccacctgaaacaacaaatgttccagaccaagagttagttttgtgtttacagtagagcctcattttgcacaaatgtaagtcatgttctgattttagaacctagtcttgccactagttttctttatcctcaaccacaaacaaatctattagcatgtattaaggctatggaaaaaaacagactggactataaccagcaggcaagcttgagaatggacactgctccccattctcttccagacaattaatagttactacaaaggcagaatgctgtaaagggccagacaccagcatatacacattcttttttctttggtctagatcaatggtaatcaagtttcaatatgcttaataattactgaatagtaaatatcacaaaatcatttacactataaatcataggtgatttaagggctttttttttttttttttttctgagacagggtcttactctgtcacccaggctggagtgcagtgggcaatctcgcctcactgcaacctccacctcctggactctagtaattctcgtgcctcagcctcccaagtagctgggattacaggcatgcacaaccaagccctgctagtgatttaagggtttttaagtaaaattttgtctctgcaaaattttcatctagttttgacttttaaacatgcccagctgaaaaaggtcatctctactataatacatttttctggagagaaaattatagcatttgaaatactctctaaggagcctataaccaccaaagataagaacaactcctcttcccataacaaatctcatctgtctcatgtcttactctctcaggaatatcctattcctctgctaaactactgcagctcaaccagtgaattaatcggagttaaatttttcatgtttcctatacttaaacagcacctatactttacataagaccttagtgcctaaaccaagggataaggaactgcgggaaattccaagcactttggcagaatccggaagggaaatacttgagttaggaagtcaaacgcgttttttaaaacctctttaaccatgccttgtaggtaagggcttcctcatcctccaggagttttgttcttggcacacgctgccgaccttactgacagctctcatgccacagctggtaagtgacagtaacagtggaatatttgcctgactctgagggatctttaggggaatgaagtagaaaggggagctgaagagaagatacccgagaacactgaagaagagatacatctttggagaagacactcttgggactgctaccaccccagttccccatttgttgaaaggcaatagaacaaaatcagaaaatattgtagctaaacttctgagatctatctcatgtacacagacaagtacacagaaataacagatgccaacgtgatccagcaggtctagcatactttgccattagaaagtattgcccagtgccggccaggcgcggtggctcactcctgtaatcccagcactttgggaggccgaggcgggcggatcacgagatcaggagatcgagaccatcctggctaacacggtgaaaccccgtctctacttaaaaaaaatacaaaaagattagccaggcgtggtgactggcgcctgtagtcccagctactagggaggctgaggcaggagaatggcgtgaacccgggaggcggagcttgcagtgagccgagatcgcgccactgcactccagcctgggcgacagagcaagactccgtcaaaaaaaaaaaaaaaaaaaaagaaactattgaccagtgctctcttcagcagtacatatactaaaattgaaagtgttgcccttaagaggggctggggcccagagccacctttggattggccaaagttcctgcccagaattgtctgggcaggaaaaaaaatgataatgggagtacccatttcaactgccacaacaggaaaccacaaatgtctactctatcagtctagagaatccaccaattctgtgcctttgcggaacatttgtaggtcatacctagagctttgattgtagctgaaaatttatatgaaaaagatggctagagataataaacatctttgcactcaaaacgttgcatctgaactttaggaactagcaagaagaaatacagagcattctatataattagatgaaaacccatgaagaaagtaatctatctgcacagtgagtctgggacataaataatgtgaggtacagcagagtagacaagtcaagccctgcataaagaatcaaaatagaaatatttcccttggtcacctctggcagaggattttaccagttccttgggatggaggaatcaaaatagatacaagaatataggattttaagtttgttacatattattgttatcttactcatgctaactgtatagtaaagttcatacaattttcatttcataatatagatttgctaaccattcattaattcttttattttcttactgaaaatcaaagttaaagaattcctccaggtatataaaaagatttctggactgagatgaaacttcactaaatgttgcagtcaagattctggtatctagacaaaaaggatagctaagcagcagatgttcttatcctagctctgtgttttacaaacagcaaatgtaataaataaaaagatatattttctcttccagtgatccatagatttgctgtaatcattgtaggcatttaaagatgtaatcttgtaatctcatggtcaggaagtagggttgcttttagtacaaagctaccagagctggacatagaatgacttccaccccagccttataaacatggccctgtatcacctgagctcatgagtcccacagtgcctggacccccaatgatctgctcatccccacagtacctgcctttggttctgaagcctcataacctttttaaaaacacctcttgtcaatgtaagtttttcaaactctacccaataaagtttgctctattattgtaaaataacaatggtaagaaaaaggaacaattgtcacactgatggactccgtgtgatttcttgttctaccaaactctattggaactttgtgaaattactgctcttctctggtcctcagtttactgacttgtaaaacaagagtttagagtccaaaagatgatctttaagttgtgcatttccaagggaatacgagtgaatcatacccttgtctgtgaaaaattcatccatttaacaacagggacatgtacaactaccacctgttagaatggctaaaatctaaaaactctgttgatactaactgctatcaagtattcagagcagcagaaattctcattcattgctggtgggaatgaaaaatggtatagccacttttaaagacagttcggcagtttcttatgtaactaatacagtcttaaaagctatcatgctcctaagtatttgcccaactgatttgaaaacatatgtccacacaaaaacctgcacacgaatgtttatatcaattcaattaatattaacagttgccaaagactggaagtaatcaagatgcccttcaataaatgaatggataacaaaccttgctatatccgtgcaatggaatactattcagtgataaagggaatgagttatcaagccacaaaaacattcatgactcctaagtgcatattgctaagtaaaaacagcaagtctaaaaatggtatgcaatgtataatcccaggtatataacattctggaaaaggtaaaactatggagatggtaaatagttcagtggatgccgtatattccagaagataggtgagtagggctgaacaggtgaagtgtgttggatttttggggggatgaaactatctgtatgatactgtaatgatgtgtacatgacaccatgcattcctcaaaccttacagaatattacagcttaaagtgtcactgtaagttatgcaaatgttttaaaaatcatttaggaagtcagaggatcccagaattgaatacaggtttaacaaaggtctctaatattttaaatacactaaataacctcactaaatggggttggggattaggtgtcgactcaaataactttggaaatgagtatagtctgtaagtccaaagacgaaaggaactctgtatactctagttgacaaagttttttccctcaagagtgtgggtcaataattctgacaccaatatacatggatgttggaattgagcaattaagtaaatggatggtgtatggtaggtgccaagtttcttactgttggagtaagagggtacagataagcaatgggaggagcctagaatgatccatgtgtgataggttagagtttgaaatatcagtataaactcatgtttagatcaatatagatacagatagttacatatagaaatgtttatagatatgtgcatgtatgtcattaagtacacacacatctgtctccttgctttgtcatctgagatggcctagaaaccattataccccagttgcaacaagcacagctggttcccagatcttggtttctaataccattctccagtaaaaggaactagggccccttggcaaaatggctggttctagaacttgagcagaaaatatgcaagatgagcctggaacaccttgcaattacagaaagtaaaaaaagtgctcaaaacaaaacaaaaccccacactgctgggggtatgtcaaaacaaaacaagaggcaactgaaatatctcccacaggccaaagctggaataatatgagcaacaaaataaataaagtaccattagattctaagttaaagtataaaataaatatttatgactacgcactcatataaatgactgaataaataaatgaaactgaagaaacaaatgtcctatgcagaagaattccaaataatttatagattttccaccctaaaggagggggagcacaatatacaactacttaagtgtgggctgcacacagtgactttctttcaaggatacaatacagaaaaggacaaaaccaaataacttcccagtggagaagcctgacaaatactaccaagccagatcaaggttaacatcaacagtgataaatcatattgatactgtgtaccattgatatgttgtaatgagaatggcattttacctctgtggtcatcctttccaaaacacatcacccagtctaaccacggggaaaaaaaccagacaaacctcaattgtgggatattcagcaaaatatctgacttattcgtttttgttgctgcaacagaatgcctgagactgggtaatttataatgaacagaaatttattggctcacagttctggaggctaggaagtccaagatcgaggggctggcatctggccagggccttcttgctgcatcttcccctggtggaatagtgaaggtcaagagagggcaagagggggccaagctcacccttttataatggcaccaatcctacccctgatgggggagccctcatggcctaatcacctcttaaatgtcccacctcttaatactgctacaatggcaattaaatttcaacatgagttttggaagggacatttaaatggtagcaatatctaactactgctcctaaaaactatgagggtcctccaaacagggaaaatctgagaaactgtcatagctaacagaagacatgactactaaatataatgtgatacgctagattggatcctggaacaacaacaaaaaaagaacataaggtaaaaaaacaaaaacaaaaacaaaaactggccaggtgcggtggctcacgcctgtaatcccagcactttgggaggccgaggtgggcggatcacgaggtcaggagatcgagaccctcttggctaacacggtgaaaccccatctctactaaaaaaatacaaaaaaaattagccaggtgtggtggcgggcacctgtagtcccagctactcaggaggctgaggcaggagaatggcgtgaacctgggaggtggggcttgtggtcagctgagatcatgccatggcactgcagcctgggcgacagagcgagactctgtctcaaaagataaaaaaaaaaaaaaaaaggaaaaaaaaaaactaaggactgaatacagtatacagtctagttagtaataatgtatcaccattggttcattaattgtgaaaaatgtgacatatgaatgtaagatagttataataggggaaattgagtgtggggtatatggaaagatggaactattttcacaataattctgtagatctaaaactgttctaaaataaaagtttattttaaaagttattcttcatgcattgaacaaatgctgttatgcttttgcattgtgctgggctgcacttcatataaagcaatgagtaaaacaaacctggcccatgccttcagggagcttatagtctaatttgaagcagtgacattcagcaactaaataaaatagaaggaatgaacccatgttgaggagttcataaggattaatggatgcagatgctgaagtggtgtcctcagactgatcccaaatcctttactctaggcctcagagccacaggctgcctttgaacccagccagaaaacaagttttgttgatgacaaaagagactctgtgaaaggtggtgctgggtaggactgaatcaacgcattagaatcagaagatgcaagatcaaattccatgttctgtctcatatttgtcataccagttctttgagctacaatttcttcaccagtaaaatttagctaacaatacccaccctgcagaattggtatgaagattaaatgtgattgtataaactaccaagcacatgtaatgtccactttcagtggcttagctggaacctcacacaaatctgttcatttattccagaacatgttctattccaacatgctctgttctcttttctcagaaagatcacaaactataagttttttgaatatagctacccctctccctctaaatatgcctctctctccttaagagctcttgtctcccaccacctcacttccttatcagtaaaagccttgtgtacaatgatgctataactcaacagatcttcccaagacagaaaaattgtgtttctagttgctttgctttcacacaaggaaactcaatttatcttgtggagggtgaaaggaagtttcatccaatttatttctggaagctgggaatatgctgtggagaaagagaaaaaactagagagaacgtttaaatttaaaatctacaagattctatctcaatttgtacaccagtaattcagaatttttgacaattcagagagaattccctatggttctattgaataaaaataaaagctagcaacttcaacgcaatatatttagtggtatattctaattatattaattaacttgatagaaacaagcccatgttaaattatatttaatatataaaagcatgctttttaagtttttttatgtattggctaatttagacacagtctttctggatacatgatgctatattgtattagtattaccaagcctgctgtaactgaacccaagcagacaaacaaataactatgtgtaaaataatgctgaagacaatgtcgttagaataggaatgaaaggagaaagcaatgcttagaactcccagtaagaggatgtccttgggtgaacaataatcagcaagtcataaaaatatatttaagtccaaaatccgaacactgtttagtgtttatttagtcaggaagctaacattgcctgtctaatcttaattttagtctaattcaggtgatgatgtctagcacctactgaagaaatggatgttttaataacttcaccagcccttggcaaaggaagaattaaacattacctctatctcccctttctccatcctgaaatctggctgagttaatgactatttatctaggtttgacaccgataaatttggatatttatccataatatgattctagaaataagctttctataatggtagtatattcagaaaaaaaaatcatctgtatcaaacactaaaaagactaccgagaagactctggtggaaatacacattttatcacatttataaatttataaatatatattttattctaccataaatttttattcattcaattacatcatcattttttctgtatcaagtttagcttaaatgctatttgaagttctttcttagaatacttccaaaattactaagaagagaatttaaatcaaaaaatattgcaaacctatctcccatagaaaaactgagacaaaactcacaatgtcctttcgtttacttttttactattaatacactacattttatagacttcacatttttcaatgccttttcataacactacatcactgatctgttttataggtgataaaataatttcagagacaataagggtctgaattgaagtcatacagcacaaagtgatgaccccaggaccaaactgcaggtctggctatgaagtccgtgctatctgcaacataacagcacagctgcaaagagagtgatttatctaaataactttttaaatttacatatttataaaatataaaacaaatcatgagattgagaattaaactttgaaatatcagagggaaataaaattaccaatctgttcactcaatcaatgtggacaacaaatcacatcagagaaatgagttgagctctaaacattaattaatctgaaagagcttcattgtgtagaatagaattagtaatgaagtgtttggggacaatcttgggtattctgaagaaatgaaatgattcagaacattaaaaagtgactatgttcagagacaaatagcccaccccttcctgctgcacttgtatcagttgagatttcttttccttggaagtaatagacactatcttaagcctgcttaagcaaaacatggaaatgtattaaaaggatcgtatgtctggggctcatgatactaaagactatttttaagcattcttctcaggaatctaagaaaaagggaagatgttggaggaaagaagagacagctcaaaggaggactcagtgggtagaaacagctaacagatctgtttctgaatgcacagagatgctctctaaggattcccacttaagtgaggaatctcgggcaaatatggggattggtaaatcactgcagctttataaatgagaggaaaggagtgagccaaacttgggcattatgctaacgtgactccatttctaccaacagactggtgaggcctgaggacatgggttacacagataccaggggtataatacaaaagagagggagagtcctccacacaccagtggaaagaacacaacatgagatttctgcagaaagctgcccgcatcagtggttttggcacgatgagattgcttcaatcctggggaaagcagggggcaggaggcaggagggagcaaaggcaagagccctgggcagcagcatctgcttctttggcactgggatatttggcagtagaccctaccctaggcagaaaagctggggctggaaagaagtaaaatgatagtgtctgggggcggggatgttctggtgaaatacgctgagaataactcagaagtaatccgtaaagattttaaaggagtctggtgtgaacgaggcaaagccaaaggaataccatatttggactgccattctgatgctgttggcttgggagacatgctgtatatatcactagatatatgtgaatatctttctatctctctatctatggagttctctgagtattgcctctttaccatactgtgtcatggtacttaatggtagggaagttattttatgcatttgtctgccctttcctgaacaccttctgacacaatgtaggaattcaaatcaaatctatctatgagagtcctgatgcctcacaaacatgtgatccctgccatgtcatttctactttcactaaaggattttacccatgacactagtcaagatgtcaggaagttatacatatggaagatagcaacaaagatcttctgaagcccagaacacattgattggcattcattttaaaagacatgtctcatgttatgtaatgcttacattcctaaaaagttgatatgttgcagtgaaatgtatataaaggcagatggtatttaaatactgattttaaaaaaaactctgtagcagattaatttgaaatgaaataatcacttctcattaattttctttgtagatttgtattatctccatagcagatctgcagaaaagggtagaatacagcagagtgaaaagaacatgggtttcaagccaaatagactaagaatagatctttatctacaattaactagctgtgtgagcttaaacacatttcttagacttttgagctcagttttctcatctgtaaagtagggctattactgatctcacaatttactgtgaggaaccatgtaaacaacttgtacatagtagatagacagctagatatggatatagctggtatgttttaaattttttctctctatatatatatatgtttctctctctacgtagatatggagagaaatactgggacaaaactctcaatgctcttttgtttactatttttattattaatactttacatttatagactatattttaatgccttttcataaaattatgtcactgtctgctttataggtgatgaaataatttcagagatactgaagaattaaagttacgcaacaaaaagtgatagacccaagatcaaactgcaggtgtcttggctataaagtccctgctatctgcaacataggagacatatatgtatatatgtgtgcatgtgtatacacatgcccctacatctatatctagccatatatatatatatataacaccatatgtttttgtttctgaagagaatgacatttctagaatttttaaagtatatatacagaaataaaagttaaaaaaaactatgcaacccagtcaagtcaaccatcaaaaattctaatattctggataataactattaaatttatacttttaaccatttttaaattatactgaaactagtatcttaacctactattttattactgcttaaggttgacagcctcaccacagttctaaacgaataaacgaatgagacgcaaattttttatgttcagtcctttcatctctatgaaaaccctatatggtctggctctgtaccctcacccaaatctcatcttgaatagtaattcgaattgtaatccccaggtgtcgagggagggtcctggcgggaggtgattggatcatgtgggcagtttccctcatgctgttcttgagatagtgagtaaattctcactatctggttgtttgatagtatgaggctcttcccatttcatgctttctttacctctcgcctgctgccctgtaagacatgacttgcttccctttcacctcccgccatgcttgtaagtttcttgaggccctcccagccagatggagctgtgagtcaattaaacctctttcctttataaattagccagtcttggggaagttctttatagcagtgtgaaaacggactaatacaccaatcaactgacagttagtaaccaccaagggtacagaactgtactgagcatatcagataagattttattgagagcttttccccaagtggaattatataactagcttccttcaaaatcacatttttttatcctcatattaatgttttaaattttggaaaagagtttgctcaaaatagcaatgaattcccagagtcaactgctgatggcctttcctcttttataaaatatgtagttacatagatgatatgaccattagtttctgcttaaggtttaattttgatatatttgcaattgaaaaataggccccaaatctactcaaaaccaatgcatgtcaattgctaagtttttcccaagagaaaattagaataaattttgtatggcaaaatcactgatttgcattccgtgaccttagctaatttctacattaatgtggaagaactatagggaatcatgtctggaacatgtctgtcattaagtttactaaaagattgctatttgagggcttaaagaggccaaaacatgagttggaatgacatgttcctcaatgttgggaactctttgtgtcaaacaaatctgtcagagtgtttatcaccacataggacatcagttcttatttttagattctcattaaacgcagtaaagcaggtgtctgcacaagctgaaatttcatcgatatgcttgttctgaatatagattgaaattatattgctccttattattggtaatgctttccttaaaaacagaatcttaaaaatattttaacaacttgatttaaaaagctctttagtttcactgcaacttaggtggtccaatcctgttcttccaaatgtagtttcacagaaaaaaaaatcaaactttaccaaaattttgacgtagcagcagccaacatggcaccactgatctcaagtgcttcaaaccaaatgacagaatttgagatttataaatgatcatgtagcctatcatattgcccaacctacttattttaatgtgagcaatttaaagccaaaatctatcgctctcatagatctcatagcaccaaataccgacatgcccagttttgtgagctatctcaactcacagggagataaacagtaaaagctttgagtttttttccaataacaagtacccctgtactctgttgaacacatccccccaccaatagcattcttcagtctttactgttttccaggcttggaagcaggatctcttaaggtatcatttggctccataactttgtagtcactttcagttgttaaaatagtcacattttggatctttaaaactgagtgctgttcatttagctccaatctcacatttgatccaaagcctctctcttttcatcctagcacaggctaaactcatgactctcaaaacttgagaggagagcgaagagagaaaacagggttgtgtcttctctcctctttacctctctccatcctgctttctatcctcctgtaaacttgaggcagaaaggaaggaaaggcagaagagcctacatctcctctcctgtacctgcccatgctgaggtttccatctctttcctattggtgtcctctcctttcctgcttaacatgggcaggcctgcaatcccttcagtgtggctaatatccaaatatctttggaactcttcttgttttctatttacactcaattccttgttgatctcacccaatctggtggcctttaataacatctgtatactaaatctcccaatacccaactgcctaatcaccaccttacttgcatgcccagtaggcttctcaaacttactatgtccacaaagccttctccacctgccatcttcccctctcagctaatggcaattccatctttctcgttgatcagaccaaaatttaaagtcacttttttttcctctcttcctctcttatccccatgttcaatctttctacaaatttcatcaattctattcagacttgtatcctcttcctgccatctctactgctgccaccctcatgtcaaacatcactagctctagcccagattatcccaatggtcttccaatggatctgctcacagtctttctcaacacagcaaccggagtgatcttattaaaacacatgtcagaccaatttatgccttatgatagcccatatgccttacatgatgtacttcattccctattatatcttttgctgcatcatatgctacatccctccttgctcactccacatcaagtacaatcaagtaccctgatttcctcagcaaacactacagtcatatgtttgtttgtttgtttgtttttaattcagctataattcacataaaatgggcaaatcttaagtgctaagtttgtagttttgacagttctataggcccatgtaaccaccatccatttcaagatagagaacaatattctgtcacctcaggttcttttccagtcaattccaattcatccttatacataactacaattttaatttctgttaccctagattctctttgcctgtttttagacttaatacaaatgtaatcaaatagtatatattattttatgtctagctttttcttacttaacataatctttttgagattcgttcatgtcatagtatgtattcatagtttttcttttctttcaattaatgactagtattccatggtatgaatatattacagttcatttacccatggggctaatatgaacaaagatgctatgaacatagtgtacaagttttcgtgtagacatacgtttttatttctcttgggtaaataccaaggattgagattattgggcacgggctaaatgcatgtttaactttataaagaaactgtgccttctgctctttgcatttgctgttccccttacctggaatgttcttcctctaggtatctcatggataactccttggctttcttgtctttgccaaaagtcaccttctcaatgagctctaccctatgtaatccaactccatcctccacctcaaccctagcactctcactatttccagattttctcatagcacttttcaccctttggcatgctatataataatgaattattatttattgatttttttctcccaccagaatgaaggaaaaagctttttttaaaaaatctctgctgtgcattaataagtcaacattgcctagaacagtgcctgacacttaagtagaaagtcataaataattgctaaatggaaggaaagaaggaaaaaaggaagaaaggaaggaaggaagggagggagggagggaaggagggaaggagggaaggagggagggagggaggggccaagaggcaatgaatgtctggggtgtctctcagaatgccaggtcatagctgctctgtggaacttctcaggtctccaaagctccagagttagtgtccaattgttcctagtgaatttcagcactcactcttgtcccaagtgtgctatctgtgggctttccaacctgtgcctctttagcacatgcaaggtgttctcttatgtaaaaagcctctgtattttgacatggagttactaaaatatctcttccatcagaagttaatctgcttggcttctgctttagtgtgtctagatatgcctatctggtctccccttgctcctcctcgaaacacacaccacccaattatgaagggagtttcaagcttctttccgtgtcccataagcagcactcaaacccaaaccccacccctcctccatttcctcagaccctgaaggtgttcatatgctctgtttccagaattcctccagctgaatagattcatggcttgtggttttgtttttttttttttcaaagcatttactacatagaagtagctattatttactacataatctggcagaaaattctagaaagctacatttctttggccctctaatacaagccctcactaatagaacggcaaaactgggattgctatttacttattaagtcttcttcctttgagaaaatcagaaagaagtaatgggcatgtgtgggggcaggagctatttgagaactcactattctttccactcagttttgctgtgaccttgaaactactctaaaaaaaagataagtttattaataaaaaaaaaaaaaaggagtcacgatagctctgccttaaagataacagtgaattcatgttaaaatcactgcccatacattttcctactggtccactaaagtaaatgtgaactcattcagagtttaagccaattctctcatcaagtaagtcaatgtttattacagtttaacagtgctgcttgtctcagcagtcttaaagtgattatatcagtgcctgttttggtcagggtatagccaggaaaatgcaatttactttaagtatttacaacggaggatacataatacaggaagttggttccacagatgataaaggagccgagaagccaaatgaaacggtgagaggaaacccttagcaacaccagggaaccactcctctccctgggctgcctagataaagggagacagcaaagttactagagtccaggtgtcagggttactcagcagaagccagtttcaaggcaggcctgtcagacaggagctagtgccatggaaaatatacaacctagccagagataacaccaaaaatatataattaaagagaaattccctggtaccttcatttctgtcaccgctcagtctgctgcaggtcttcccactggccacacacagtctgaagcccactgacacataagcctgggaaacagcctacaggtatcagcccttcaagcaggggaacagcaaggaatagatctgaggcagcaatcagcactgtggcaaactagaataaacacacagagcagaatttgaaaaacgttcaaaaatttctatcagagtagatgattctctgtatggtgctatttcagaacatttcaaaatacatgtattagcataaggaaaggttaatggcttatgctctattaggttcagagagagaaagaaagagagagagagagagaaaggaaggaaggaaagaaggagggaaggaaggaaggtagaaaggaaggaaggaaggaaggaaaagagagaaagagaaagaaagaaagagggaggaagggaagaagggaggaagggagggaagaaggcaggaagggaggaaggaaggtaggagagaaaggaaagaaagaaagaaagaaagaaagaaagaaagaaagaaagaaagaaagaaagaagaaagaaaaaagaaagaagattaatttacttaatggtaaacattattaaaataaatattcaagcaaagcttgaaaaagggagtcttgtttaattccatcccaccacaatcctattctctcaccctcctatggcacagagattagtggtagtgaagtggagaaaggacgttagaagtttccatgatatttctggctatttcagttgcagcatagaaaaaaaaaaaaaacactaacagtaatagttcagatcttatcttgatactaatcttgatgatttgtgtatttttaaagacatgaaacctgtaaatataattgggaggtaaagtttctttttcttctatttgacatcataaagttattttaacaaaaagaaaatttagtctaaaaaaagattgtgctcctaaattcaagtgttcgtctacttcttaagtctataatttactaggcacaatgttgtgacaagactaacaattagatcattgttgcataagcgctatgataacttcatgggcagtagagagtgcccagggttttggttctaagacatgagtcttagtaccaccgggagtacttttctggctgtgtatctttggacaaacaacttgacgactctgagcctccagtcattttaaataaaacagctacagtcatggtaccactccacgaagccattgggatgatttaacgaagtacaatttggtgaccactatggcacaaacgcttggcttctgttgttttcctttttattttggggacccaagaataagccttccttttagccaatgaagaaacaccaaacacaaacattatgtagtcagaagcaaccctaaaatagctactatataattaacccagtcttgagaagtgaaaacaattacaggattagagaaggaaaaacacacacaattttctatgccatctcaaatgcagcagctgaaagaagacccatcaaactcacttatggcacccagctgcgttactgcatctttacaaccctaaggattccagatgcgtggggttcacctggatctagggagcccttaaacgagctaaccaatgatttcctacaaaacagtggactaaatgatcagaagaagaaatgaaaatcacctggacagtttcgccttaaaataattgccagaaggggtggggaaagataagttttataagtagtttcttgccgcagttttcttattcaaatgcctcctggcaggcagtttttccacccagttctggttttagttgagttgctatgttttcctctctaattcagaccctgagaatgatctattgcaaatccacctactcttcctcccagagaatccttttattcataaaactactttttcttttttccatgaaactacctccatgttagccctttggaggaatttagtgaggaacttatcttccaacaaatacttgttgaaggcctacagcgtgccatgcaggcacccttctaagcactctgggcacaccaaggaacggaggaagtctctgtcctcatggagcttatattctagtgagggagacagacaatgaacaagaaacataaacaagaagtagatggtacagtgtgctagaaagtgataagtattatggctgaaaacaacgaaccatggagcagttccaggagtgctgagtcggcggcattggtgagagaagtaaaaacttctcggcagcattggtgagagaagtaaaaatttcctcgtgtcctcccagctgtcagcattccaaagagttagatttctgtgaaggcacacagcccttttcctgaaacaaggtttcatactggcaagtaatgactttgtttctttcccattcaaacaagtaatgaaattttacatagcaatttttactcttttaatttccagatctgattgtgtggaactacatattaggataccctggtttctatatccattatatttcattaaggctaatttagcttctctatctccaagtcctcaatctttccatcttcccttcacaaataggataattaccagctcatgtcctttgacgtcagaacagtgcaaccactctctgtgttttagcaattcagttgtaagactttcatttgattccctggacctcatttgaacttccgtgggtacaatcctatcttaataaaacacatactgactctgggaaaaattgtaaagcaagtaaaaatggggagggagctgctccacaattcatttctgaggctcttagctcatttattacagaaacttatttctctttccttcctgttgatagtgcttaagtagtcccctgacctgcactgcatatcccccctactcaaagcttataccataggtgacattaccttgaggaatttctgtataaccaaaaaaccagtgtttcatcataattaattcacacacagttaattaatacaaaagaattttttttatttttagcagggaagtgagtttctggcttcatcttagccagctttttctctccagggcttaatacatgttagtgcacatatacatttgatggatgaatgaatgaaagagaaatattaatatatgaaaatgtaatcctgacagagggaaggaaacaatatctgttttgtatttaattggttgaaaatagtattgggaccatatttctcccaggaccttctgcttcatccccctcttcatgcatccttttctttcacagtgctctgtttgtctttttgtctgcctgtctctgccactggactctgggatccttgagatgttagatacgtttagcggttttatctcctgtcactaatatttgggttgggggaacacttatttccccactacttgtttccagccagataggagcaggaatttctattctcctcctcaaaagagaaaagcatgagtggagcttgtgatgtctctctaggtgctgcctcactcctctccaagtggcttacttcattggaaaatgtgggagaagaaaccatcatactcagctcatcacatctgcctctccttttggacctggcctgcctgcagggcacccatattctctgcaactatcatggggtaaatgtatggagggggctggagcgtgaaggggttgtactgctcttctagggcctagaagaggtgggtgggtagatgagtctgcctaatccagtagtaaagtcttaggtggcccattgaggatgccatttttggaatgatggcactgaggcctggagtgcttatataactttgccaaagtcacaatgagcaagtgactttgcttagatttgaacctaagcactttggttataaacccaaactcttgaacacaatgtcctatttctgttttgttttttgtttgtcttgttttaattatttccacattctctaatcaaccttaccaaataagctgttttacatctctgtcagattcctgcatctactcttgaatgcaacagctagcacagggccggcctggctcataatatgcattcaaaaatgggtgactttaatgaagtgatattatcagagtccttgtgatgcttgaatgaaaaagtgaagaatgagctagatcacggcaaggtcactccgatgcttgaaaaaatgtagagtcagctctcatcccaaaactccaggagtcattaatttctttgatactttagagaatagaatcaggcgagggtgagttgaaaatgtctaacattgactctttgtttcctgtctccactataccattcatgtgtgtaacctgagctggggtacatcccagcaatacttgatatctttatcctaggaatttcttctgaaagtgtaaactatgggtctccacttgagcaagatcatcttcggaaaaaataaaaatagaaaaagaagaaatagggcattgtgttcaggagtacgggttctataaccaaagtgcttaggttcaaatctcagcaaagtcacttgctcattgtggccttggcaaagctatataagcactccaggcctcagtgccatcattccaaaaaagtaaagacatgtcttagaacagttatgcagatgatataaagcaatctatataaagtatttaatgtaataaataatatataggtgcttgataagtgctggtgcccttatataagattgataattttattaccttcttttagagagtaccaacacatgtaaggctgcccaggatgctgaaaaatcctgcactacagaaatgcattcaaccttgttcagtgcagaacctctcagatgaatttcaccaaaagctcttttttaaggggttttaaaattattcttaacatcaagacgaacactttgggccacactaccacaggtctgtgaatttagctgagggcaactcacacccctagtggccatcaagccctaaaggaagatgcaattcagaaatatacccccatttggctggtgggtcacttctgaagtctgagtccagcttcccttcaccatctgtcttttaatgtccagtactaagcacaggccttagttaattgaacatgcaaagtggaacccacaggcaatgatctcagtatatattttgactcatcatccaaagaaatcagagatgaaagcaacatctaatggctgagaatacataaatagccatttccactcactttcaattaccctgcagaggaatctggtcacagatgagctcagtaaattcacaatatgttatcctcaatagctaagctgagcaaaatcacccaatttgttagaacattaatcctctaaaagcctgccaaccctaatcattttatggcttcacattgcttaatggtaaagataagaggatccccagggatgcccaggtgtgaccttcagtgagtcaagtgcagacagtctcctgagaatgtagatggatattgtatggcctaaatatccagcctatagctagtgtggtcagtgttctaactctcctctgcactatgtgcctttcacagtcatcctggaggaatttccagtcctttgaaactggggattacaatgtatttatttctgaatccccaatgattggcataatatcagatacctggaagtcacacatttaacaaatatttgttaaatgaaaaatcaaataagtgatagtaggcagttaccttcagcaaatacactcaccatacatatgtacatacataaaggatggggttcttttttatatttctcaatctgaactgggaggtgaagtctctctttgcttgattctacctgtgaggggaatcgttctgaagtgctgataccttaagagcacaactggcagaattgtggaaagcaccataatctacaggtttaaatcttaggtctgtctcttagtagctgtgtgactttgggcaagctagttattctttctgtgtctcaatgaccaaactgtcagataggagtgataatcaaggttgtcatgagataggaataaattatatgcagctatgcatcacataacaatgcttctgccaacaacagactgcatatgcaattatggtcccacaagattataatggagctgccctatacagatataccattattttatctcttgcgctgtatttttactgtattttttctatgtttaggtatgtctagatacacaaatacttaccattatgttacaattgcctacagcattcagtttagcagcatgctgtacaggtttgtagccaagcagcaacaataggctggaccaccatatagcctagatgtgcagtaggctattactatctaggtttgtgtaagtacactctatgatattcacataatgataaatgtgcctaataatccatttctcaaaggacattttcatcattaaatgatgcataactatatatataaaatatatatgtgtgtgcacacacacaaatatctgtatgcagcatgtgtctttatatatgacatatactatatatatatatatatatatatatatatatatatgaaagaaatgtgtagtacacaatgaacacaatataagcctgggctattactgttgaaaggttgggagtagaacactaaggagtttatgcacccttgctcccatgaaaattgttctttctttctttctttcttttttttttttttttttttttgagacagagcttcgcctttgttgcccacgctggagtgcaatggcatgatctcggctcactgcaacctctgcctcccaggttcaagcgattctcctgcctcagcctcccaagtagctgggactacaggcatgcaccaccacacccggctaacttttgtgtttttagtagagatggggtttcaccatgttgctcaggctggtctcgaactcgcgacctcaggtgacctgcctgcctcggcctcccaaagtactgggattacaggcatgagccactgcacccagcctaaattgttctttcttaatgctttgttcccttttggtatctcttaaaactcacttctcacaatgtaaatgcagcatgaggagctaaaatcctgacaagggatagcatatatttgtctggcctttccctctactcagatttctctgggacctatagaagtgttgtctggtcaagaatattagttaccatatgacagacttttgcacttttgccttcccttttcttcatcctggggatatctcatcacatcacccactgctcaaagggcatgataaattctagccaggcaaagcccccatcgctgtaccaaaggagctatattctcctcctaacctaaatagtgaatcagtgtaacataaacttatatgactagtaaaatggttgctgctagctgaccagcggtcctgtcagggagtcatgcattgtcgtggtctttcaaatcaacttaaggtatgaattatacacaataaagtgcacctatttcttatatttatatgtgaatgagatttgacaaatgtataacctctataactaccacagtcatcaatacatttccatcatcccaaaaagttcccttgtccccttggtagcaaattatcgccaccctagtccccaagcaaccacttatctgtcactttagttgagtttttgtctttgctaaaatttcgtacgtttgcttttgtgtattttctttcattcagtttatttttgagtcatttatgtgttacatgtttaagtactttgctcttttttattgctaagtagtaatccagtgtgtgaatatactataatttgtttatttatcaacctagtcatagacatttgagttgtttgcttttttttttttttttttggctgttatgaataaagctgctatgaacattcatgtaaaattttttatgtggacatatgctctctttctcctgtgtagattcctaaacagcattgctggtcctatgataattgtattttaactttataagaatatgccagactgttttccaaagtgttctatcattttatattctcataactaatttatgagttacagtagctccacattttgtaaatacttcgtattgtcaatctctttaattttagtaattctagtgaatccgtgattgtatctcattgtggttttttttttttttttttttttgagacggagtcttgctctgtcgcccaggctggagtgcagtggcgcgatcttggctcactgcaagctccgcctcctgaattcacgccgttctcccacctcagcctcccgagtagctgggactacaggcgcccgctaccatgcccagctaatttttttgtatttttagtagagacggggtttcaccgtgttagccagtatgttctcgatctcctgacctcgtgatccgcccgcctcggcctcccaaagtgctgggattacaggcgtgagccaccgcgccaggccctcattgtgttttaatttgcactccctgatgattagtgatgttcagcatcttttcatgtgcttattggccatttgcatatcttctttcatggtgaatctgttgaaatcttttgcccattttctacttgggatttttttatcttctcattgaatcctaaggttcttttatgtttatatacaaatcctttgtcagatatactttgaaaatattttctcccagtttgtatttgcctttccattctcttaatggtcttatgagcagaatattttaattatgataacgttctatttttccattttttcttcatattccatgctttctctgtgcctaaaacatccatgccaacgcaaagtcacaaatattttctgatatttttcttcaaaaaatgtcataagtttagcattatgtttaggcctataagccatgtcaaattactatgtaaaaagagtatgaagtaaggtgtgtgtggtgttcattttttttaatggataacccagttgttctagcatcatttgtggaaaatactgcgtgaaaggcaattctacacaaaagcacacacacaccatcttctgttcattgatttatttgtctatccttacatgaatattacattgtgtttattattttagcttttataaattttaaaagaaggtagtataaatcctccaatattgttcttgtttttcaaaattgttttcgtcattctacgttctttgcatttccatataaatttttgaatcaattgacaattctaaaaaaaaaaaatcatgctgcaactgaggtaaaactctacatcaagttagcgggaattgacatcttagcaatatggagtgatccaatcagtgaacatggtatatcttaccatttatttggcattctttcatttctctaagcaaggttttgtagttttaaggttttacagtgtacattcttaataccttttgttaaatttatctctaattattttatcttttatgctaggctaaatgcaatcacttttattgcattttcagtgattcattgctagtacatacaaatacattttttttgtctattgctttgtatcctgtgaccttgataaatccctttgttaattctagtagctgtcttttaaattccttagttttgtggatacatgatcatgtcatatgtgaatacagacagcttcacttcttcctttctaatttgtataccttttattctttgcgttggtttttgcatgaattagaaccgtggtctaggacccttgtaatgttaaatagaagtggtaaaaacagacatacttgttatactctcagccttaaaattgaatcttttatcattaagcaggatgttagctgtgtttttttgtttgtttgttttttgtagatgccctttatcaggttgaaaagattccttctatccctaatgtgctgagatattttaccatgaatatgtgttgtattttgtctaatgccttttctgcatctaatgatgttcatatagtttttcttctttattttattgatatggtgaatggtaatgatattaattagatatttaaggtaaatcaactttgcaatcctgggataaatcttctccattctatgtcatttctttaatgtactgctggatttcatttgcttataattcagagtaattttgtgtcaatgttcaggagggacatgggtctatagttcttttgtaatgtgtgcaaagtcatttgtggaaaagactgggttcaaaggaaactcaacaccacactcacacacagaggtctggttttgttatcagataagtctgatgctatggtttaactttttgttcctttcaaaattcgtgttgaaatttaatacccaatgcaacattagtggaaggcatggcctttgggaggtgattgattaggtgcccttataaaagagcttgacaaacctagccttgttcaccaaaaactcattcctttttgcccttctaccttctgccatgtgagaacacagcattcttcctattcagaggatgaaatgttcaagtcatcatctttgaaggagaaaccagaccctcaccagatgatgaaccttccagcaccttgatcttggatttcccaaactccagaattgtaagaaataaatttctgttctttataaattacacactcaagtattctgttacagaagcataaaacagactaagacagttggcttcataaagcaagttaagtgtttcttctgctgctgttttccaaataagtttgtataagactcatattattcatcaaatattttatgaaattcaccagtgaagcaacctaaaaaattggtagttttgtgggaaatcttttaattttttaatacaatttttaaaataaatatatataggactattcaaatattctatttttacctgtgttaattctggtaatttatactgttcaagaaatgtttatttcaccgaaattatctttttttggcataaagttgtttataatatttctattttcctttttatgcttcagggtctctagtgatgggttctcttttattcctgatactggtcatttcatttgtatcttttttttcctaattactctggctggaggattatccattgtattaatcttttcaaataatcatcttgtggttttattaattttctctgttttccactttctatttaattattttcggttcttttctgtattattgttttccatctgtttacttcgagttttatttgctctatagtgtacaatatgcattgtcttaaaacagaagcttaaatcataatgtatttattctgataatattttttgttctgagtctacttaaatgttaatgcaatcactcttttaattaggcattttcagggttttttttttcattctttacttttaacctaagtttcttgcagtatcagaaaattgaatattgctttttaaaaaatccaatctgacaatctttgacttttatttagggactttaggccatttacattttatgaattattaatatagttggatttaaatctgtgaccatgctgtttatgtttgtctggataactattttccctctccatttttgagggataattttgcttaatataaaattctcggttaacctatcttttttagtcttctttcagtactttaaatctgttgttttattatgtattggcttgtcccatttctgacaaaaaagtctgatatcattcttatctttgttcccttttacataatatagagttctcttttcctctggccatttctaggatctttatcattggttttcagacatttgattaatatatgccttggtggattttttgtctgatgtttgtatgattgtatattaattttatgatttttatccaattcagaaattctttttctttatattgattttatgatttttatccaattcggaaattctctttatttaatctaatacttctaaaatcccccttttttcttcatggattttaattacataaatgtagagcacttgaaattattccaaagacttctgaggctctgtttatttattttgctacttttttttcctttttctgcttccatgtggatagtttctattgctacattttcaatttcactgaccttttattctacagtatttaatctattatgtccctcctgcaatattttcactttctatattgatttttcatctctgggagttccatgtgcttcaatttttaaatatttatttctttcctcactaacttcattttaaaaaaaattcttgagcatatttgttgcagcaattttaacaaatatttaaatccagtgtatgttaattccacttctgtcatttctaaatttgattctactgacttgtctttttcctggttatgagccatacacttcttcatgtgtccagaaatttttactggatgctgggaattgtgattgttacactgctgagtgtccaaattttgttgtcttccattagagtgtatttaagtttcttttggaaggcaattaaattacttgtggatcaacctagtctttttgaagcctgtttttaaactgttaaaaatgtctagagtagcttttcccttagggttagtctagcctactactaaggtataagtcttccagggtctgtatttaatgtttaatgaggcctcatcactttggccggttggaactcaaggaactttcagtcaagtatgttctctggaaattgcttattttgcagcaccctagtggttccttgcttggcataaagttttcatccttagcatgcatagcttagttttcagcaacagactcaagtggacctatatgcaaatttctggtgccctttctctgcatggctccctactctccagtttcctactctacaaactacagctacctcagcctcttcaacctgtagtttctatgtcttcaacacaacaagaccactgagttctgtttgggttctcctgctatgtgctgtccctaaagtacagaaagctgagatcattttagggcccacattactgatttaccttctctcaaggatcacagccctgtactacctttcatccaaagtctgaagacagttgtttaatacatttttgtacaattttctagtgtttctggtaggaggccaagtccaatttcagttactttatggaagtcaaacactggtttgattgctattatactctaggcaaaatggtttctgatttaagtaaaagtcacattaatctacaaaagacaaccttctccttcaaagaccataataatctctttttatcattaaacagactttgaggaagagcaaagaacaaatggtcaaagacggttgttttggcaaggttttcataataaagtttctccacccttttcatttagcagcaatctcctgcctaaccacttttcctcacctccatccttggttctggactcccatgtagcacactttgctcctacttttttcaaaatatctctctacagaatttcttgcctaattatccatctgttcagcctccaactccccattcagggactatgtagatgggctccagcagtggtggggagactagctcagggtttattgctttttatcaaggtaacacctgttcttttcagcaaatgccttccggagacaatagttctgcctttcatgtttaacccaaaagaaaacagctaatcaataatcactcctcttggccagtcattgagactaaacattttaatcagatgaggctttaaaataagtctccaggaagacagttaatagaactggagaacctttaatatatatctctctccttctagtatctggaagagcaacagaaggaagcattcaaaacaattcctacctaattgacctctgaggttgatgcagttgtacgtggcaaggatgtacaggttgttttgttttgttttgttttacgattttaagtatttcattgaatggaatgtttggattcatttatttattaatgcaagaaatgtttatttcactcttactttgtttcacctgccttgtgctagccattccctaatgatgaattgatatggtttctgtcaccaaggagctcacaacctcttgaaggagcaaaacataacaggatcattataacatagtgtgagctcatttgatagagacatgcttagagagctatatgagcacagaagagagattaattctccatgcttcccatgaccgggcaccatttcagtaatagcttatggacaatatacctgagtttctcagtattgagatgatagttttaaactagtaatgttgtaagagatatgaggaacagtgaatgaaactttacaaaatgaaatgggtgtctgtagggcctgtgaggaactgctgatttaaggctaagggaggatgtcttcatgctcaatgctcagatcattatcagagacaaagaaataaggcaagagagcagatttgatgtagttaattggatgagggagcaagccagaactctgttggaaggctgagttatgatagccaacaaaggagaaatagaattgactaagaagcatgttctttatacagcagtaatgcctaacctgagatccatgagtaggcttcagatgtattggaggaaaggaacctccccatccctgaaattgtcttcacatttttggatgtgcgcacatttgcatttttctgggaaaatgttccatagctttgatcaggtcatcaaagtgtcacacagcccctaaatattaagaactactgctgcatagtaacttatcgtgtaatggcaatgagttataaaaccaaaagcctcaaatttgagacctgcatcctccatgttctagttgtgtgaccttgaacatgtccttttattcctctatgcttacacttatcatctgcctaccttgtggaattattgtgaaggtcaaagggtttcatgaaataaaaagtgctacacagttgttatctaccaagacaacaattgacttaaataaatgcaaatacaatttattggaagttccttattactcttttaaatatggtaaatccattctagaggttaatacctatccgtgtgtgtgtgtgtgtgtgtgtgtgtgtgtgtgtgtaaacttccaaaaaatttcagtgtgaaagttttcaagcttacacaaaaggagataaaattgtataaagaactcccatgtacttctcattggtttcataatatcaacatatatccaatctggttcacctataatccgatctcctcctctttccctcactgggctatgttgaagcaaatccaagacatcatattattttatctacacattgtttaggatatttcttaataaataaggatattccttaataattccttaataaataaaaattccttaataaataatttcttttgtttcaaaatgaaattaaggaatttattaaggaatatcctatttattatttattaaggatatttatattcctcaaggaatattaaggaataactattaaggaatatttcattttgaaacaaaatgaaattaacatttttgacataacaacaataccatcattacacagaaatattaagtaaatcctcaacatcatcagtgttcaaatttccctggttattttcttgaggcaggatccaaataagattcacactgagcttttagttgctagggctccagatgttaactcaatcccaacttttccagattctcccatctagggccctaaatactcttcctttgcagctcctaagccagcatgtaacatgctggagattatagcagcagcctcagccatcagcagttggatccaggaatgatttttgttgtcaaaacccttatcaacagagatcggcctgattttcctttcagcttctgctttgatttctctgaagagctcctgactatttgactattgttttcatgactatatatggtgattttaaaaccttcctacaaattctttgacgttcctcccattaagaaatggtggctgtaccctacttgaatctagattagttttgactgctttacccaataaagtacactagaaatgagacaatgatttacaaggctgggccatgagtgatcagggagcatctatcttttttgctggaacagtccaccagaagcccagaccacatgaagaggccatacacaggcattccaattgagagtcccaattaagcttagtcttcatggcatatcaccagtcaccacaactgtggttaaaaaagtttccagatgattccagtccctggcatatgagttattccagatgtttgagtcttcccaatagagaccctagttgttataaagcagagaaaaaccatccttaagttttattagagaggacactctctgaaatcctgatcaataataaccttcagcataataaaatgatttatatttttatgccactaaattttgtggtggtttgctatacaacattagtaatgacactaagccaggcatggtggctcacacctgtaatcccagcgctttgggaggctgacgcaggcagattacttgagaccaagagttcaagaccagcctggccaacatagtgaaaccccgtctccactaaaaatataaaaattagccaggcatggtgtcatatgcctgtaatgcaagctgcttagaaggctgaggcacaagaattgctcgaacccaggaggcagaggttgcagtgagctgagatcacgccactgaactcgagcctgggcaacacagcaagactgttgaaatacatacatacatacatacatacatacatacatacatacataccctagttcttgccatgccagtttccttggagggctaaatcccccaaacccctgcttcagttcaccatgctaagtgtccgtgatttcagcatccagctaaagaaatggactgaaagaccttaccattcatcgtgaataatttaaaataatactcatttctaacaaagtaactcactctgggcctaggctgtgtctgtcatcactaagtccagagggtcttgattccatttccttggtgaataaacctccagatgcttagctttgtggaggaaagcagaggagttcaaacagtctgtgtttcaatcagtcttccttcatgcagtccatcctcacccctgcctccagttcctgggttgggcaaagccaaatgattaccttgttgttggcaccctcctctgcgaacacgtatatctcagctttattcgctctgctaagttggaaccacccacccattaactttttctcttctaaaatattcatgggcatctcatatctgctgcaacctcttactcccttttctctgtccttgtatatttgtacctggttttatttactctcaaggcttctggcattctggaagcaggacagggcaagtggctggaggctgatcctgttttccgtatgtgaaatttcactcagtccctgctttctggcctgcctctccttctagccatacacaatgcctgctattgctgagttcaagctttgttttgcttattgcctatgttcaaacaatcttcttgttttcagccctatccctcattcccaccctccacagtacctgacacctccaagtcctgagccttacaaagtttccatggggatggactagcttgttgctggtcagtttcctcttttgcagactcctcatgtcatgatctcttctaccctgctaagtcatttatcactctcctgcatccactggtattctcattttcttcctgggtctacaccttttaattttctttagttttagtgaagtcttgaaatggttataaacttatgtggtcagtacaccatgtttaagaaaaattgccaatatttatttatacagtcaccaatgagcaaagaaggttttgcttggataaaaatcagggttgacagaaatcatacatagcatttgctgtattatatcaccctcagtctgtagtttacttctttatttttatagggttgcagagtattaagaaatttctaattcatacagaaaatttgttgcaaacaataatgtttttaacagattgcctggcagtcttgtaatactctacaatataattgatccaaatcttgaaagaaggatgtaagaaataccttttattcaaatttggcttactaacaattatctaacattgttcacattttgtcattggtaagtattcagtttggagtgagtcgatgggacaatttttaaagcagtacataattggaatcattatgagatccctaacaatgtatatttaaatctcagaatgacttctattcaagacagtaaatggagcacacactcccttcccatctttctgaagacccactgaaatgataatcagcaaaaaatgggagaaattcctataggagctgagaatggatgggggacatcagcatatgaaagtcattagtaaatttctataagatagagactagatgatgggatactagtggatgaggaagaatggaggcagtgccagctctaagcatgaactgaagagactgagacagagggatgattaaacttaatagtgatgcccaacaaagtcatgagttgataatgaatcataactgagttttattgagcacttatgaaatgctaaacaatgctctgaacaccttactagattttgtcccatttaatgctcaaagcaatcttataaaactatcttgaattcatggctgaacaaactgaggcacagataagttgggtagtatatctaaggtttcacagctagtaaggcaagaagctacgtgtggaattcaagcaatttaaatctagaatctcataattgctttgccatactgaggctgttttcaaatggttctatttattttgttttgcatgtagattttaaactttaaggttcacttttatccttgacatttatctgcatttataaactggaaaatactaaaggattgaattgtaaaattgagcttgttcagcttattaaaagtcagacggcatcacaaattcacaaatgctaaaactatctgtaatataattggatcacaacatgttacccattcacatatttcttaacattggctatttctccacaaacatgccatgcacccagtggaagcatctgaatgttacctaacatttaattgaacccagcatttgtgagttgttataatgtacttgctaatacaactttatgagataacacatgcaccaatctgaattcaaaaaaaaaaaaaaaacactggggtagagctacaaacctcctatataacacatttgctttttttaaaagtacaaatacaaaatctgtaagaaaaaaaaaattccaaaatttactcaaaagcaaattaaacaaggtatcacaagttagcccataacctgtggtccttacagtagacatctcagggattccccagtgctcgttcccacgcatctcttctcccatgaacatagataggatcctggaattcatgttttactgcatatcagtgcccgtggccaagttaattgattgtgcaggtgatacttggctcgttagccaatttgatttcctctcttgagcatttggtatagggactcaaaattgagtcagtctctgcagatatatggactctgcagatatatggactcaaggtgtgtggtatggtgacatttttggccacaaggcctgaggagcatagaaagcaagtcttcagatgaaagaatgaagaaatacacaaaagtgagcaatagattcctattgtcctttgatacctggtttcaatcgcttcctgagatctggctgcattttagcccttggtctgtgataaagtccggagtccttcagataaaaatctccatttttgttttagctctttatggttgatttctattacttgaaatcataatcctaatgtatagaacctactatatattaatgcttgttacatataacatttgttatacatctgttatatgtttgttatatatgtgttgtgagtctgtttcttacttctttttaatttttttaaatttaattttttttttttgagatggagtcttgctctttcaccgaggctcgcgtgcagtgacatgatctcagctcactgcaacttccgcctcccaggttcaagcgattctcctgcctcagcctcccgagtagctgggattacaggtgagcgccaccacgcctggctaatttttgtatttttagtagagacagggttttcaccatattggccaggctagtctcaaactcctgacctcaagtgatttgcctgccttggcctcccaaagtgctgtgattacaggtgtgattacggtgcccagcgtgtttcttacttctcattcaaaaatgtttaaatgaatttttattatacttgcagacccttacagctcctgtggagcacagtatgaaaacctctagtctgaagcttctgaagaatctataacaggaatgaagagtttgaccagcttgaatttcaaacatctccccattggcaagacatgaaaaccaagctttcacttgatcagacgagcaagacatctagtctttctggagatgttctcttatatcttgttgctttgggctgagtggaatacatacaggagccttgagacccaaagactctccctgctgctctggaggttgtaacctctgaacttactgttgccactgctcaggcctctcccatgagagagtggttatttgttttccttggtttctccttacccattgtctttgttactggtacagatctactccttggtcttctccaggcctacccactcttcagagcccattcctacttactcagagctctagagaggagacaaagcccttccctctcctcgaccttggtccaccacatatgtgcaggtggttaacagtgggaatcttcctttccttctagtaaatcctttcccctctacagggtatcatagggtcccaaggcctcaaaaaaataatcacaaaacaatttgagcatagtagatttctccagatctggatttttcaatcatattcatgatcatcttgtcacctttatcaggttgggtctactggctggttggttggggcattaaaaatacaaaaaaccactttcattggtctctcatagccaggaaattcaagctgcttattagcatagcaaaaattcttttaaagcacttgtaaggaagcaaaaataacaaaacaaaacaagaagtactaggaagaaagaacaagaaaaggaagaaaaatgaaagagcaaaaaggaacattcagagagtagcaaatgctggagacccaaaagcagagtgggtggtagagatccgaggtggagctggctttgacacagattctggggtggaaacagcaggaggatagaagtgaccgggcaaagaagagaatctgctatgtgaagagcaccaacaggattctatgacatgaaggaagcccgttagatatctctgttccttacagagaacctgtgatctagagggacggtcactgaaaggtcgtgcaacttgttaacttctgcagctccaacgagcacacggcagaattcaaaccggggccatgattaaggtaccctaggggctccggtcagttcagctgccaaggaagtatttgctgcatggtctgtaataataacaatatttgagggcaatttgtcataatgttactggatcctcacagttctgagggttgatatttacagcagagttagtatgacccattaaaagaggaaacaaaatgaaaaggtattttcaaggtcttctgactccacatctcatatttatttttctccaacacaacagactttgattcagtgattaatttagtggaagctcagctctgaaatcatgcaactgcataggtatcctttctctttatttgaaagaggcaaataatttaaaagtaagtggatatcaaggaacttttgatatctggagcaagttccagtgtcctttcctatttagtcctacatttgtttgtttgtttgttttcccccagcattcagagctgtttatttccatcttcatactacaccaaagaatttcaaacagtgttaggtagactagctggaagttggagcttagaacatcctacatccctgaaaagttcagtgatgcagtcccaggtacacagctgcccatctgccacccaagaattgttgtgaagaaaccagagtctctgcagatgatgggacagaagcctgtggtgcagcagtggtcacctagcaggtccttggctgggacaccttctattataaagtatatcagtttaagcttgacagaatgaaacatgatatattttacaagtaatgaatataggccaatagaaaactcatagatacaaatataactaattctacaacttccataatggcccgtcctaattctttaatttgtcatctattataattcatagactttgtcacataattttagagtgggtcttaagataaaatcatgtttgttaaatatgtgaggttgatgataagctcaccaaggagttctttactcagtatgggaattcagagagcacaaagttacagagggagaagcaggattatgagggacagaagtcataggggtgattcccatttttattgactgacacacatattcttactttaggaaaaactgcatctaattttagactgcagttcatggcagatgctgcgaaccagcagcaagttcatgtccagaattgctcactgcagaggattttgtctgctggctggtaccatagtttctctttcataggctattccaaaacttctataatgctggtagatttcagtgaagtgtcaccccagcccacccaccccttgcacttagccagcagtggcacccaccttgagcatggtgaggtatgttatgccagcagggtccacattgctgctgttcacctccaagtgctaagctgctgtacaccttgcagtgggactccacttcactgcccagcaccactgtctgattgggcagcagccatgcatgcggaattagtcagtgaggagagcactctgtgggggcagatggggactggaaggctgcccgtctgcctgcccctctctgtagccctcatccagcatgtccagtgtgtatatctgcaggatgctgccaaacttattctccaccatactctccatgaccaggctccattgctggtgctgcaactggatacactgatatgaggctctccatggaactccttgtgggtcctcagccaggaaatggagagagtagaattgctggtggtgggacatcagaagcaaacaggttgggtggccagcatggccagcagcttcttgtccatccactgagcccaagtccaatagagggcctctggcacgtgaaggccatatagaggtgaggaacagaagcctatctgatctgactctccttccaaggctccccctgtccacttcccacctcagtttatcctcctgtgtagggagagtgttgcctttcaagtacatctgcctggggtggaaaaggctccaaggaacctcaacaccatgttcccgacacccttggcattctcaaacatgggccatgtgttcccttccctctgagcttcctccaagtggcttctcctgctaagaggtccagggtgccccactgtggggggccttcaggacataccagcatctcccaggggagcccccatacatttgcttttatagaaagtaataatggcccatttactgaacacttgccatgtgctaagccatgagatcagcattttgcatgccttatttaaacttgacatccgtcatgtgatatacctccattttagcaatgaggaaactgaagctcagagggcttgagtaacttacccagtgttatacagccagacagtggccaagtctgagtttgaaccaggatctaacttgaagtatcagttcttagctatcacactttgtggcctctgtatgcaacactatcctaagtctcatgttaggtatttgtccttgagttaaggaaaagttaaattcttttctgcaaccaccacttaaaaatgccagaaagtgttttctgagtttggttttttgtttgtttgtttgttttggcggttgtggggcgagtttttctttttttcgtcaaaaactggtttaatttttttttttgacaggtcttgctctgccacccaggttggagtgcaattgtgccatcttggctcattggagcctcaaccacttgggctcaagcaatcctcccacctcaccctcccaagttgctgggaccacaggcgtgcaccaccacagctggctaatttttttttttttttgtattttttgtagagacgcagtttcaccatattgcacaggctggtctcaaactcctgggctcaagcgatcctcttgcctcagcctcccaaagtgctgggattataggtgtgagccaccacacccggcaggtctatgtttttttacttttaactaaactttagtgatcagaagaaatgatcttcctgaaattactcttttctctgcaattcaggatgcatcagttgttattatacttttattttgtatatccatgctaaagtttattattattgtatacttatttttatttacataaggtgaaggtttttttctaaaactaaaaagctcttgagcagtacttttgaaaaatgcacacccatctaacttttacatgtgtatatgattatattcttgctaaattcttttttttttttttttttttttttgagagacagagtcttgctctgttgcccaggctggagtgcagtggctccatctctgctcactgcaacctctgcctcccgggttcaagctattctcctgcctcagcttcccaagtagctggggttacaggtgcccgacaccacgcccagctaatttttgtatttttttagtagagacagggtttcactatattttagccaggctgtctcgagcccttgacctcaggtgatccacccacctcggcctcccaaagtgctgggattacagacgtgagcctccgcacccggcctcttgctagattcttacagcaccatcttcagtctttgtttttgtcttccgtttctctccagacactctacattacttgccgcttctcccttcctgtcgttatttttcaatcatgtttcctcttcctgatttttgctggtttgatcaaacagtttccagtctagttttccactgatattttgaatattctagcccctttttattccattaatgattgcctgtcctttcctgccctcatgatcacattcatgttttcttatttcgtttgaagaaatcataccatctatttctcccacctcaggggttctagtcttctattttcccctcatcccagtcagtttaaacctttaaaatatggttttgtgggggactgctttccccccaccacaaaacttcatggacggaataatctagtccactctcttacctctaacagatttggctgagatcgttaaaaactattgatatgtccctcctttttgaagactccatatttaacacttcctgatcttaaacaatcctaggctgatactcactgtttagatttaaagataaatatatcttacaagctttgttgttcaccacttttcctgtccactacatctctacaatgaagttttcttttctagttcccttgcttggtgtcctttctagattactttcttcatatagacaacttgggtgatatattctctgattatacccatatcaaaaattcacgttcttttatcttgtcaggagaatgatacttcgctggtatagaattctgaggtggcaggtctttttctctaagtagtttgtgggatgttagttcactgccacttctggtgttacagatgagaagtctgattccttttcctttacaggaaaccgattttttctgcctggaagcttatcagatttttatcataagctttagagttaaaaaaaaaatcgattctattagaaacattgagtccatctaatatgcagacaagcctttcatcagctttgggatgttttctactataattaatgcctccaatccttctactcctttttaatgttttcttttagaactccttttaagattattattactttgcatgtctggactcctggatctatctgacaaatatatatgtatgtatattttctcatcacatctactttgcatttgtgttatatttcttgttattatttttccaggccactattccaatttcagcaatgactattctctccatttactgaaatgttcggtggagaagtcctcctttttaggtatagaaagtctctttttccccatatgtgtgtagttctttgagtagtttttattttttccctttcaaatgctcatttctgttcatcagcatttttagatgattgtgcttgtgttacttgtttgaggccaagagtttgagaccagcttgagcaacaaagcaagaccccgtctctacaggatttttttttttaattagccaagcatggtggtgtgcacctatagttctagctactcaggagctgaggcaggaggatcattttagcctaggagtttgtggctgcagtgagccgtgattataccactgcactccagcctgggtgacagacaggcatccctgtcaaaaaaaaaaaaagattcttatccccgagatgtggggtgtggaaggagaaatggaaggagaaattagagatgaaaagatatttaaatgacatgaaaaatgtctggtggatcttatatagatcttaatttaacaaactaaaacatggtctcttaagaaagtttgaacactgataattgatattaagaaattatatgagataatgaaattaagattatatttttagaaataatatttttgtttagaaacatatattaaatacttatgaataaaatgatatgatgattaggatttccttggagataattgtgggaagttgggtgtggatacagatgaaatcaaattgaccttcaacttgggtaggacagctggtcttctttccctctccatgtagcctcagaattttccactccatgtggtctttccatgtggtctttttagcagcacagctgtgctttatatatgaagttctcccaagagcacaaaactggaaactgccagaccctttcaaggcttaggcacagaacggacacagtgtcacttcctttgcattatactggttaaagggagacacagggccatcctagatcaatgcagcagggaactacacatggtgtgaatactggaaggcatgactcgtggggcaaatttgtggggactggtaattcataccatatctgagttttaaagctaagatgtcttcttttccataactgaggactgctgtatgccagccatttgcagtaggtggggagagaggccctggtcattctcttcccctacttggcatttgtcctcttcctccagcttgtatttctggcccagctagtgccaaagcagggggaagctggagcagtaaagaagtgggaatttttactgaaatggtgttattataatatagcttcactctctgaatttggcaaatgtttggagctgattccttctcttgtgatgggatgggtagctggattggtgcttttatgtgttcttttgagatctccctccaagtcactgagaactttttattgtactttccatagcatggacattttcctatggctcaccgctcccctaaaagctcaggttttatctcaactattcaattaaagactttctgctggaactccctcacttctcacttcccacccacccaaagccatcatcttgagcaaaatttagaataactccaagccagatacatcatattcccaattggacacaatattcatatatccttgactcaataatctctgaggatggacgacgatctcaatgcgatggcattttctttgttggtaccatcagaaaagctggccagctatgccagattttagatttttcaggggcagttggacaccagaccatgttgtccccgaccagagacatggaatttaacaagttcttcaggtgaattcattgaaaatctttacttctggtggggaaaacaccccaaacctacctccttggatagacaggaagggcttacatctcatctctctccaaatcttttcctgggtaccactctcaacctctttagcccctcagttctggtgagggaataagaattgtgtcctgagttttcagctacctccgttttgcaagtttctgagtgtggctcacctcaccttggtatctattggtaccttgctgtctcaatcatgaattttaatctcatatcctatgataagtgatctgtatgcccaagctgaattcacagccctatttccaaataaaatgtttgtttttcactccttttcaaatgctcctaaagcttttcttactctagtactttgagataagtatatggaaagcctagctattgaggtaacagaaaacgtgcattttgttttaaaaataagtcatattacaaaatcctcctacttctttactcaaaggaaaaattaaatacggacaaatgcccttttatccctccactctataaaactactcacatacttatagtctaggaaacaggccacttcattgacatagatgatcagaaattgtgggcccatcttggtaaccataggagcaggcagctgatgacatcagaggcctgcattgcggcttctgattgctcagagttgctatgctgaaggaaatcagaaggtgatgtaaggaaaacaccatattaaatacatttcattccatttgagaggcacttggaaatgatttctaaaattctctaaattcctgcagccatttttaaaccttccatttgaataaaatgtatattgcaaaaagaacttaagacaatttgaaaataagaatgcagacttcatttagcatatatatacacacaaacacatattatatatatatttactggttatgagttttgactgttagtttgactataaaagcacctagctacagaatggttatgccatgaccccagactaagtcacacttgtattaaaagtcattttaatataaacaaaagttggatgcagtaattatgctggcttggtgtttggttttatttcttttatttttattttttgagacggagtttcactcttgttgcccaggctggaatgcaatggtgcggtctcggctcactgaaacctccgcctccagggttcaagcgattctcctgcctcagcctcccgagtagctgggattaccagcatgtgccaccatgtccagctaattttgtatttttagtagagatggagtttctccatgttggtcacgctggtctcaaactcctgacttcaggtgatccacccgcctcagcctgccaaagtgctaggattacaggcgtgagccaccacacccggctggtgtttggtttttgtatgaactccacttttcccagtgccccaccttcctttcagctactttccaggtttctcaggttaccttctcactgctgttccacctcatcgttttcagtttcagtcatcacttttcaggtattttctaaactgtacagtttttctagctgcattgataaaagagggggtcacaacagaaggtgaatggtccagcccttatgaacccttgatgtcccagtagacattgttccatgaataataggggaggcctaataatcctcttgaagaaaaattcatgtcacatagaatgtgcaaaaatgagcaacatctacaaagaacgatcatttaggaggcatttaatacatgcgatggcttgattcaaagcctatttctagcccagggggtaatccaagcctcagccttggtttcatggctgcacaggttgtgtactgtagaattccaggcttccaggggtgcattgacaatgaaaagctcaataatgcagtgcccatgtcatgtctctctaggagacaatggcttagttggagatagtaggcttctgatttagaattgatgatttcttaacctattatgttacccctgggtatactgggtgcaggaacttcctcacagatagatgaaggagggaccaaataaatgttgcacctagtgcatcagtaggactggatttagagggaaagaaatgtgcacaaaaaaatccagtatggaaatctttaaagcaactccttaaaatagtatttgcaaattcaaaaacaatccattcaaagacaaaattatattttaaaactcacttttatcgaatggaaaaaaaaatgtacactggaattgtgaaaaataaattgcatctgaaaatgggttaccgtacataatgaaacattgttacaaagagtatgaggatgcttgctctgattacagtgactcctgtaacaacgtggcaagtgaaaatactgtattatttagtagtgaagccctccccctagtggaaataggtaggaattttaagaaaaagggttaacacttttaaatacattttatttcctcttaatatttacagaattaaagaaaagaggtggagaatagctgtagtgtggtataaagacttttcttacagggcttttaggccattataagagctgagatgtaaaactattttagagttttgagtagagcagctggtatggtctgaatgtttgcattccctcccaaatttatatgttttattttaatcaccaaggtgatggtattagaaagtgaggccttttggagatgattatgtcatgagaaatctgatccaatgaatgggattagtgcccttaaaaaagaggccccagagagctgccttgccctttccaccgtgtaaagacacagcaagaaggttgtttatgagcatgggtccttatcacacacagaatctaccaattccttgatcttggacttcccagcctctgcaaccatgagatataaatttctaatgttcataagctaccgaatctaaggtgttatgttatagcagtgccaatgaactaagcaggggttctcaaccctcggctgagactactgacattttcagttaacaaattctttattgcatagggctgtttcgtgcattgtcgaatatttggcagcatccctggcatccactcacttgatgctagtagcaacctctccccaaccccaccagtgtgataatcaaaaatgtctccggacattgccaaatatccccaggggagcaaaatcaccctcagttgagaaccactggaatagagggataacatgacatgacatcttttaataggatcactctttgttgagaacagactgcagacaacagagataccagttaggattggagatgacaaaaaaaaaaaaaaaaaaaaaaaggtcaaacttgaagttagagcttgcagaacttttcaaagaacagccatgaagtgggagaaaaagagtcaacaatatcatcaaggattttggcctgtaacaactaaaattgagttgccattatcagagatgggaagatagcagagtggctgccttggtagttgtttggactggggagtgcagataaagagtacatcattttggacgtgtaaaacttgagagcctttgtaagacacccagatggagataccaagtttcattgaatagaaattctggaaattagggggagaggtctaggccgttactgtaagtttgggagtcattaggcttataggtaatattaatgagtttaccaagaaagcaaaaaaagagccctgagcaactccaaccattccatgtaagggataagagaaggaacca

SEQ ID NO: 441 - DNA, 40430 bp, Homo sapiens
aagggaagggttaaatgacctgtgtgatagttgattgacattgaagacatcaatatgaactcatgtttagcttaatatagatataggcagttgcatatagaaatatttagaaatatgtgtatgtacattggttagtatatacacataaaccttcttgctctgttagctgagagggcccaggagcaatgccaccccagtaacatgaacacatctaacacacaaatcttggtttcttataccattttccaattaaagagaacaagggctccttatagaaatggctgataatatgactgggaggaaatgtacaagatgagtctggggcatcttgtacttctataaagtgagaaagtgcttttaaaaaccaccacaatgacaagggcatgtcaaagtgatacaggaaccaactaaaagaactcccaatgaccacagttggaacaaattagtattggattacaaaacaaagtacaaaatacatagctatgagaccatactgatataaattattgaataaataaataaatgagagaaaacagagaattcaaatgatttatatagataaactgcctttaaggacattgtcccttcttaagtgtgggctgtgcatttgactttcttcccaagcatatagtatggaaaggaagggaaacaataaaacttcgtagtagataaacctaacgaacaccaaggttaatgtcaaacattggcatgaccaaagggaagtaatttatcttctctgtgattcagtttcatcataaagtggagatttcaaaatcaagcagtctgattccagagattttgcacacttaatcattctgttggactcttacctagaaagtctcaaaagtgcatgaaattgactaccaaattggcaataatgtcacagatttatttgttctgctaaattgtaaaattgccaacttttactcaaaataaaaaacaaagaaaacaatgtctgtgtctttccaaggaaaagtctactagtaccatggccaaattacttaaatcactctatccctacttatgaaattctccctgacccgtctatccctgccaggaatttcagtaatgtaccaaaagacagaaatatgtgaccattctcaagggcaatctgattaattttgctaagtgaagtgtctttctagccgaaggttattctttaatgagcagctacacatgctatactcttgctttgttgaatcttaattgcattgacaagaatatagaatggaccaggagatttgaataacatttattcaatctagaaggctccccaaaagtatttttacccatgattcattttctctgaccttagccaaagcaggttattctaccctttccactctgaatacattttttcttggagatagaaacaaaagtttagtctcctctgtgttgcttgtcagtatttgatgctctgcctctgttagcagatttctccattctttgatcttcctctgcctcttactatatcaacaaacaaaaaattccttttggccattcttagaaaatttttaatcaaaaagttcattttattttttatgctactataaaacttgcatttacaccacactttttagttatttattttatcacctatatctattttttagaaaacatctgaaatctttgaaaaaatcacttgaaaacttgtcctcttggtatgaactgatgttgtttcatgttcttagaactatctttccccagactttgtctaacttactcctactcattccttaattccccaaatggactttacctgctaagggcatctcctttcaagtccagattagatgctccacatacatgtacggtgtcatcatcaaatttgccctatacatcacttgtgacactaggtttttatcacctctgttcttctctatattccatattagatcaaaaactctacaaggagaggcaccctgtcaacagcaccaagcatagtatctgtcataagcaataatttacatttttattgaatgaatgaaggaaacatggggcattatttgtgtaccccaaatcctccatgatacaacttgcagtgtattattaatctcacagtcagattgctgttatgagagctttctaatgcaatataccttcccttcataacttcccactaaaaaaatcatatctctcttttgtatgaatttagaaatccctgctatccaaaatactaagggacaggtatgcctttttaccatttgccctctatcacagtttctaaaattaaattgttatttttttattatactttaagttttagggtacatgtgcacaacgtgcaggttagttacatatgtatacatgtgccatgttggtgtgctgcacccattaactcatcttttaattttaggtatatctcctaatgctatccctcccccctccccctaccccacaacaggccccggtgtgtgatgttccccttcctctgtccatgtgttctcattcttcaattcccacctatgagtgagaacatgcggtggttggttttttgtccttgcgatcgtttgctgagaatgatggtttccagcttcatccatgtccctacaaaggacaagaactcatcattttttatggctgcatagtattccatggtgtattatgtgctacattttcttaatccagtctatcattgttggacatttgggttggttccaagtctttgctattgtgaatagtgccgcaataaacatacgtgtgcatgtgtctttatagcagcatgatttataatcctttgggtatatacccagtaatgggatggctgggtcaaatggtatttctagttctagatccctgaggaatcgcctcactgacttctcaatgttcttgtcggtttcaagaactgatggtcagattaaggatagaatagcactgaagatccctgataaatttccctgcttcccggaaatgatatgtcagcaaagaaattgagggcttattgtataaatgaatgtcgagcttgtttttaaatagttgagaccccctttcaccccttttcagtcatttgcttatatatatttatatattaaaagtcagcaggaatatactgtgtaagcagtagatcgggaatagcatgaatgtaccatctataaaagttcaactacacctaaaatacagtactttcgggattcatttattagttcacataacatgtactgaatacctactatgtactaacactgttcttggtgattcagtgatggaaagatagaaaaagaaaggctcacctctcacagatcttacatctttggaaaaaatagaaaataaacactcaaaatataatgaagacattttaaaactcaggagtataagaaagacatagagccaaattggctataagagtggtatatatgtttagatagagaaattaagtcaagcctctttaagaagttaaatttaagtcaattcttgaatattatgaaagtgccaatcatgtaaatacccttgtatccgcgagagcaccctctgcatcagtcattttactctctgcagccataaccttcttctgaactacaattcaatgtgatcacagtacttctttgcttaaaacttgtacatggctttcttgggtaaaaagtccaaatttatttatatttattaatgactctcctctatttgcatctttcccaaatctctagctcattgcttcttcactttctattctttctctaatatttaatattctagtaaaaattattttggagccttgaagacaccatattctcccgcatttcttatattttctctgcctagaacacttaccctcttctcaacgtatttcctcatttttgaacattcatgagcacttttttattttcagaagtagcaaaatatttaataataccatttcattcattaatgcatggagtaacatcagtaaggcatgcagttccttataattaacagctttggaatacatgagcatgaaaagtttcatctttttgcgtaatattagatgattccacttaaaatatttttggttttgatgtgagattttgcaggcatgaagcttggttttttaaatttaatttaatttaagtttcataatacatgttcagggcatgcagatttgttacacaggtaaacgtggagtactctctttttaagaatttgattgctattaataaaactgctgtgagccttctagtacatgtgtttttgtaggcagaaaacctcatttatattaattaaaattcctgggccctggcatagtcttttgggaagatttttagcttcagcttcaatttttttaaaaaatatataaagtatgttttatttatatgtcttaactcaattttggcaagttaaatttttatagagatgtatagatttagtcagtattaagcttcacaaaaaccttgactttcttatccagggtattgtaaggggaaaataaaataaatatctttctacttttgcttggggtgcataatgttctgttagcatctgtctcactagggtcttttatccagattctattttaaattagataccaagtttatatttatttaaataaaataatcaaatgaatcaaccaatctataataacaaaaaattatcatgtgtttttcctggtgcttacaacttcaaagaagtaattacagatatttaaaactataaatctcattataagataaaagttttgatttctaaaaaatatttttattcttacctcagtcagttctcaatttcttcctagaccagaattgctttctatatcggcaattaaataggatcctgaccatcagtgtcctaaaatttcttctgatagaaagatttggctgtgttctttcaaagcagacataaattgtgctgaacaaaatatccactaagtagatattaatgttacaatttttacagctatccaagtggctccatcttgttcctgccaaatagcacatccaacccaccttcaggaatatctagtcgaaggacgaaccaacttatctgtatatgcaaacaggaatatgaaaaatcaaaaggaagttattgcatcttatattcttctttctgtatctatcttttagcacagtggttgtcacaagtactcagtaattcttgaaacaaaaataaatttaaacagttggaaaaaggcatagaagaaagagcattttctcttatttcaacttctcagtaagtttggcatgaaaaatagatctagcagaataatttagttacatatgcccttttttaatgctatgaaagctttctgatgatatagaagtttaggaaacatcaccatcttgagttacatcgaactaactatgtttgggggatcccagggtacatgtctttcagaagcaaaattgtggtttgatttgaaaatacagtgtttatgagacaaagcccaaatgttgggagaattgaacttaaaacaaaaattttattctacacatttgattccataatgattcttgtgaaaagaaagctgaactttggcatgattagatccaaatgaccttattagaaaaaatgttgtatggatgtttaataacataacttcctggataataaaggggtgttagagttttaaagtgctcagtaattagtctataatgcaatcagttagaaattgcatctcaatgttgccaatttccatataaacaaaattccactatgtatatttttaaaaagaacaacaaaaacctttgcttgggaataggcagaggataaccattttcttcttcaaggatgtgaaaacttttaaacactttttatttaaatgcagagataaaaattgtttggttaaggagaaggtccatctgtcagatgaacaaggtgacctcctgccattaaaaagtactaaggctaaagctgttatataccagataattttgtacaagccatgaaagatacaaggctttcattttaccctacgtcatcaaaacaaggatttaattgtctacagtgtagttcaattgattccaataaaaagtatcattgattataatctctacggaactggaagggcaaccattttttattttattggcaggcaaaattgcgttttcttcatctcaggtcacttaccacccaaattagcaattgttaatagaaccagatcattagtttttgctgtactgatttccgtgtcactgcctgagtgcacatttcaatggatagaggatattccaggatggcctcttgtacatgagcaagaagtctggtgagttttgataaatggctccatttagagcatgaagaatgacctaactgaaaatgctgaccactgaattgggaaggctaatgaccaagaataaaaagtctagttcatatctatcaaataaatagaagaaaaactaaattattcaagataaggcaaataataataatgttaataataaaatagtaatcataatcacacaacaaagagttaccaattgagaacctactctgttcccagccatatgttaaatgatttgcaaacatgagtttgattaaccctcacaataacataataaaggaaatgttataatttcaaatttaatgatgaagaaactgaggctttgaggcaataatacaattaaaagtattacatgtggagagcacaaagcccaaactccttctgattgctcaagatgccaaattgctgttgactagtaatgcatagaaatgttttcttctctgttactatgtatgcatgtgttttgtttgtttgctgttattgttcatggaagtaattctattcattgccaatatctcttgcttagattgtaaggtaatttaaaaattaataaggttatagtagagaatgaattttgttttaaagagaatggctgaataaatgaacaaatgtataacctatggttttcagcaagaatataaacattggttgacattaccaagatctcatataaatcaggtagaatctcaccaccgccccccccccccccaccaaatattacatcttcggattttttttctctcttattacttcctgggtatccatatattgtgttgttaccttaaatatactttgacttttcaggaaaacatgaaagtttaaagtgtacttcaaacctatgttgttcaggggtcaactgtactttgttattagcttttgaaactcaaagccttaaggtaaatggctgcaaatacactttcaagtagaccaatttacttctagatcattttgtagaggtgtaaccatcatggtggagggataaatgcttctgcgtggaaagggaaatggaaagaatggaacaaataatacagaaaaatcactcagtcttattatataagcagtttttttaaaaaattcataatatacctggccatagatagtgctccagcaaaggtataatctcttccaagtacagaacataaaattaaaacacacatacacacatatactacaaaacagaatatatatattatatacttaattaaaaattaaaaacatatgcttaatttgacaaaatatttaacactgtgttccttcaaagcattgattatatgtctattttattttattaacttgcctcaggcaaattcattatctcttgacaccgcctctctctctctctgcctcactatcttatgtcctagcaaatattctacaaaaggagcttttctgcccaaggccttgtgttcattttttgataacactctctctgcttccatcttcattcatagccaaatagacatcaaactgcagtgcaggaacaggcactagggccccatgggccatcaaagtgggtggctgagtgtgagtagatcaaagatgtcatctcagatgaatgaatgtagcataggaggtacaataaccagagaaaaggtgtactgaataccaccagaggcatgaaaatgaaaagatcctttaggtggctacagaaaacaatttgtgcacaaatagtgtgtgtaatggaacagaaaccttatcaggaggaaccattacagttaagaggatatctgctaggaggtattttttgttgaccccccacagtagtgaaccagatgtccctgaggtacacaagcctttgttcctatttttcagaaatatgttggatgtggtagctgtggagtagtgtccattcattgctttagtaagtgtttactgaatatttaatgtggattcagtaaaatatgtaaaatgtggtctttgacttcaaggaaaccctgagggtaattgaaaaacgaaggcatgcacacaccaaaataaaacattcatttaagaccatgtgtcatgaagttttcaattgttggctttggaaatggacctcagaggttctccagtccagtggttttcctcctatattctcaagatctggagttccatagaagtagttcaaggattaaacagtgctcacaagggaaaggccaagctcatcgaaatgcactcatccttccatgtaacagagaagttgagttgacattagtctcaaagcattttcttttctttcttttttttttttttttttttttttttttttttgagacggagtctcgctctgtcgcccaggctggagcgcagtagcgcgatctcggctcactgcaagctccacctcccgggttcacaccatgctcctgcctcagcctcccgagtagctgggactacaggagcctgcctccacgcccggctaattttttgtatgtttagtagagacaaggtttcaccgtgttagccaggatgatctctatctcctgacctcgtgatccgcccgcctcggcctcccaaagtgctgggattacaggcgtgagccactgcgcccggccgcctcaaagcattttctaatcactcttggaggctaggatctaaatctctcagttatctacaaatagtataccatgtaaaggattgtatgctgaagatgtttaattttagaatgaacaataaggactgaatttgcctttctatttttctatcatgaaaaacataaaataaagttattccagggtataatatttcagtattagcataagtaatatatagcctaagtaatgttttattaggaaagtaaacttgtcatataaaagtcatatgattaacttaaaagctgcaaacaaatgatttctggatggtgtatttttttcatagtttatttccattagcaagaattattaaaaattagccttttttcattttcattgcatgttcaaaattactccttataaggctaattgatttgaagtggatatacaggcagaatgactaaacagaattgtatgtcctaaaaccatctttatgtgaagtttattaacttatttatttaaagagatagttgagaaaataatttaatatagtggtttgactcacagttaataaaacaagttgcttaattctaattattcttaactttttagttaccttttataactatatacatgaagatatataagaattgtagatatgtgattatataggaattatatagtccttcaaatatatggtaatatatatagggttacagtggtatcgctctttcaatactttacaaggttaaacttacatgtttaaagtacttagcacagtttcaaagatttacttagtaaacactgaagagatgatagcagttaacataagcaccacttacctggaagacactgtgctgggcgatgtagataaactaaaaactctcagaataatggaagaagatatgtatattaaatgattactcaagaaatataagcataggaaaagtgagtactcataaacttacttctgcataatggtggtgggaaccataaggaaaaatttactttgatgaaaagaatcaatatgtttgcccagaataatggttcaatgaagcattacaattgcctggaagaaataccatagatagaaagatgaccccttacaatagtaaaaaattcaggctttttatccatccctatgttaaatttttggaaagaagaaaaaaagagagagaatgatataataagtaaatacttatttttgtattttctagtatttttcaaatgattaaatgaaaatgtgatgttgtagaccaggtaccatgagaacaaggtaaataggtaggatgctgtgttctggaaacctcaatttatatagctctggagagtgttttctgattgaggtttcctgtgtgttctctgattctccctagaacttcgatataggtcaattgaagacggtggggggactctcagagtcccgatgctgaaaaacatgagaacctattcctaatatgactcagttttcttatgctaagtcagatatagactcctttttattttctcatgggttgccttggactttttcaattgttaggtatgtccacatggaataatcttcgaaactaagaattacacacatctgaattgcttttcatagccgcacacaattgagtttaatttaccatgagttttttttttgtatgtacagcatgacccttgttatgttacaaattttcaaaatgaatagaagaaactggacaggaaatacacaatgagttcacagtggatacctgtggacctgaggatgatggtgatttttgttttcctctattaactttttcttttacatttttaagtttacaacaatgcaaatatgtatttgtaaatatcaaaacaacttaattttctaaaaagtggactagatgctgtagttattggcagagccaaaatcagagtgaggaaggacatggtgaccgtgagccctgaatataagctgcccaatagcattgccagagctgcacgtcaacctagggtttaaaatatgcaccatgagcttttcaaaagcaatcactctgtcttgttcctaggtttacttctattgtttagtggaatgcttgacaaaggaaggtattaataaatatctctggaattaaaattcagttgttttatttaacaaatactttttgagtgtctccataatgggcactgtgaaaggcgctaaaggtaaaaacaggaaaatagtacaatttctgctctcaagcagcttataactgaacatggagaaagacatatatattaataatatatgtgacacagaatggaataaatgcttcaataatggtaaattacaggaaagagtagaaaatacacatctattagtctatattagaaagtatttcccaaagaaaaattgagatatggcttaaataatggattaaatttgggtgtaaaatgtgaagagtatttatttatcttttatttttctttttctattgctaggtaactgatttgctaactgatttgcttttttttttttttttttttttttttttgagacggagtctccttctgtcaccagactggagtgcagtggcaggatctcagctcactggctcactgcaacctccgccttccgggttcaagcaattttcctgcctcagcctcccgagtagctgggggacaggagcacactgccatgcccagctatttttttttttttgtattttagtagagatggggtttcaccatgttgcccaggctggtctcaaactcctaagctcaggccatctgcctgactcggactcccaaagtgctaggattacaggcatgagccaccatgcccagccctgatttgcatttttataagtccaaatactactttatcttctgctttgttaattaagttaaaaatataagtgaaaatatgagacttagactaggtagatgagaatttaaaagtctgattaaggaatgtctactgcctcagatatgattgtacatgagcataaaattccctttgaactctagttagcctctctcttatatagcattctcaagttgaactctcacccatcgtatctctatctccttggcatattgctatcctgtgctgtgaaaagataggcacttcaaaagaaagcacatttgttaagcatcagttgcaccttaatgggccacggtatttgaatgatactctgcaatgacattataaatcttttctttagactgttgggggaatatgctacacctcactgaaaatctgtgatgtgactttgatactaataattctttcttagaagaatcaattgaatagagagatatattttgagaacaaataatccagaatgaaagcaaaaatagaataatgtaatgggctcaatattggagtaaacataatctgttgcggaaaagatatgacttagagagatggaaagagggaaggggagaaagaatgagcattaatatgaacacatgaatcacaaatgctgtgttatttttctgtcttctttattagatgctcacatcattccatcttcaatcaagtgaatagcaggtggcatttttatgtggctgaaagagaagactaaatcagccaagtgagtaatagctagctgtaagcctggccagttttactcagctatgaaaaaactgtgactgcataactgggtttaaatatgatgcactcaccccatttttctctcagttgtactatacaaggtaccaatgttagcaagtgcaccaggactggcagaagagatgattcaaaaagggacagtgtaagactgtaaatttaagggtacataaaagaagcactaacattcttctatcacctgatgcttgtttatggtggtacacactcttgaaatgcatacgtgacattaggcatttaaaaggaaagtgttatgaaaatagaaattgaataactaaaatttctaatgagatattagtgattagtagaaaatgttttataaaataagtaattgcttataggatgcagaaagggaagataaaagagcttggaatgtctgaaggagggaaaagtacttgatttttttttcttttgatttgtattcatttattcaacacattaatttagcatctactgattaccaggcactaaaccaggcactggagattcagcagcgaacaacagattcaaaattctgtactcaaagaaatttacattctggtgaagtctttggggagaggaaagaaagaggattcaagaagatattttaaaaagtaattaaaatataaaacatgttagatgagtcaaagcactatggagaaaaacagtggagggaaaggaaaggtaataatggagagaggcctgaaatttaaattacggtgtttggggtagcttcactgaaaaggggacatttgagcaaaaaccaagagtaggcaagagaatgagccatgtggacatctatgaaaatcgcattttaggcatagggagaaacatatgcaaagccctgaggcaaaaatgggcttgatgtatttgaggagcagtagggacggtgtggctggagcagtgaacagtagggaggggagtaagaaatgagatcagagaaccaaggggaagggatacacttcctaggactgtgtgggctgctgtaaggaatttgcttttattttgcatgacacacgaaggtatacttctgtgttgaagacggattgtaggggacaagaacaggagcagggagaaaagtcaggaagttgttgattaatccagatgagagacaatggtagaagtggagacctgtggtcagatcctggatgtgtttggaacagggatgtggatgaattagatatggcatataagagaaaaattatacttttaaaaaacaactattggaatgatggtgttgccatttacctagaaagggaaaaatatagtagaagaaagttttgatagggagatcaagactacaattttgaacgtgtgagtttgagaagcctactggacccacaaatgggacatcaacattatttttacttgtacatttttatatataaatgtggagatcagaaagaactctgacctgaatgttatcatcagatgctattcaaaactgtaatattgggtaagattgacaagcgaataagtatagaaagagaagagaaatcatacaagtgctgagacctgaagcatcttatattaaaagttgaggaaagtgagaaagaacaagcaagagtctgattggaaggagccagtaaggtaggaaaataatcaggagagtgtagaattaggaagctgagaggagagagttttgtcttattttctctcccatggaaaggaataatcagtggtgtacaatgccactaataagtcaaatgaaatgaagatagatttaaccattggaataagcagatcataaattattttctaccttgaataagagttacagtggagtagtagaaggaaaatgagtgggttggagaaaaaacaagaggtgctaagttggaagaaaataagtataaataaatctttcaaaggattttgtcgtatgaagtcacaaaaatatagagttagctggaggagaaatggaatcgaaagagaggatttttttttttcaatgaggtgagagaagcagaaattacaatgtgctgtgtgaagatggaactgatgaagtaggagaatgaggaaaaagtgtgtgggcagtgtccttaaataggggagaagaaatgggatggaactgaaaagtgaaagtagtggtcttacttggtgtctggatcatttacaaaagcatggggcaagctggtgggaaggcagattatgtgggcacgagtgtaaagaaggttaggtagatgtggtgttaagactgggtagaagtgaaattgaaaataaaatcagtagagtgactatgaggagaagattttggagatatatgaagaaagagtatgaaatatggtaattgggagagtagcttagagaaatgtagcacaattgcttgacagcaatataatgcaggcatgtgtcacttaacagtggggataagttctgagaaatttgtcaataggcaatttcatcattgcacaatcatcatagagtggacttacacaaacttagatgatatagcctctcacacacctaggctatgtggcttagcctattgtttctaggctacaaacctgtacagcgtgctactgcgatgaatactgtaggcaattgtaagacagtgatatttgtatttgtaagtatagaaaattacagtaaaaacaatataggataaaaggttaacaaaggtacagcaaaaaccaatatggtataaaagataaaaagtgatatacctttatagggcacttaacataaatggagcttgcatgactggaagttgctctgggtgagtcagtgagtgaatgaatgtgaaggctgaggacattactgtacgctactgtagacttcataaatgctgtaaacttaagctgaattcaatttataaaacaaattcttttatcagtaataaatttaacttactgtagttttttcattttataaactttttaattttttaaaacttttttactcttttgtaataacagtttaaaacacaaatacattgtgggaggtggaacaaaatggccaagtagatgcctctagctactttcctcctggcagaaacaccaaattgaacaactttctacacaaaaagtcaccttcataagaaccaaaaatcaaatgaattatcacagtacctgcttttaacatcatatcaaggcaagaggcactgaagagagtaggaaagaaggtcttgaatcacctacactactcctccctcatccctcagcagaaacctgagtttcgacaagaccttccatggcgggccaaagtgttctggggttcaaaataaacttgacaggcagtctaggccacaaggactacaattcctggggaagtcctggtgctgtgctagtctcagaaccagtggacttgtggtacgtacaatctagtgggacaccaggtgaggcatccaagggagtgcttgcattacccctccctcaaccacagccctgggagactacttctctttgcttgaggagagaagattaaagagaattttgtcttgcaacttggagaccagctcagccacaatagaatagggcaccaggcagagcccggaggccccctttctatgccttagctcctccatgagatttctaagcatacgctgggccagaatggaacccactttcttcaagggaagaatgcagtcctgacaggatttatcacctactgaataaagagcccttgggctctgaaaaatcagcattggtagccaggcagtacttgttgtgagcactgggtgaaattcagaggccttctggcttcaagtgtgactcagcacattctcagctatagtggctatggggataaaccccttctgcctgaggaaaggagaggaaagagtaaagggaacttagttttgtggcttgggcactaactcggccacagtggggtagagcaccaagcaggctcctagggtcactgattctaggccttagctcctagacagcattgctagaccttccctgggccaggggagtgcccactgacctgaagggagagactaaggactggcagtatccaccacaagatcactgaagagcccttaggccttgggtgaacacaggcagtagacaggcaatggtcactgtgggctttaggtgaaacccagtgctgtacttgcttcaggtcggacccagcacagtcccagtggctgtggccaagggcatgcttgcatcacccatccccaataccaggcagctaagcacagacagagagagtctctttctttggaggaatgtgaggaaaggagaacaaaggtccacctggtaatccagggagttctttcagagcttactaagaccaccaaggtggtacgtctatgagtctgctagagctggcaaattactgggcttgggatgccccctaaagcaaatgaagctggagtgttcaaagacttacatcacaatacccaagtttcttcaaatatctagagagccatcctaaaaaaaggataggtacaaacaagcccagagtatgaagactaacataaatacctcactctttgtgtaaggctgttcttccgttgctataaagaaatacccgagactgggtaattattttttcaaaaagaggtttagttggctcatgattcttcaggctgtacaggaaacatgatgccagcatctgcttggcttctggagagacgtcaagaaacttccaatcatggtgtaaggcaaaaggggagcagacacatcacatggccagagaaggagcaaagtagggagaggttctacatacttttaaacaaccagatttcataagaactcactcactatcttgaggaaggcaccaacaggatggcactaaaccattcctgagaaatctctactatgattcaatcacctcccaccaggccccacctccaacactggggatcacaattttacatgagatttgggcagggacacagatccaattcacattattctgcccctggccccttctcatgtccacagatccaaaccacattactctgccctggccccaaatctcatgtccttctcacatttcaaaatgcaatcatgccttcccaacagtccccccagagtcttaactcattctagcattatctcaaaagtccaaagtccaaaatctcatgtgaaacaaggctagtcccttctgcctgtgagcctgtaaaatcaaaaacaacctagttatttccaagatacaatggaggtataagcattgggtaaatactcctgttccaaaagggataaattggccgaaaggaaggagctacaggtcccatgcaagttagaaacacagaagttcagtcgttaaatcttaaagctccaaaataatctcctttgactccatgtcccacatacaggacacattggtgtgagtcaccccaattaaaatggcttttgtccaaagacagacaatagcaaattatggtgaggatgcaaagaaaagagaacacctgtacactgttggtaggaatgcaaatttgtacaaccactatatagaacaatttggagattcttcaaaatactaaaaatagaactaccatatgatccagcaatccagctgctaggtatatgctcgcccaaaaggaaatcagtttattgaagagatgtctgcatttccatgtttattgtagcactatttgcaataatcaatatttgtaagcaatctaaatatctaccaacaaacaaatgcataaagaaaatggtatacatacacataatggagccataataagaatgagatcctgtcatttgcaacatgtatgttaagtgaagtaatccaagcacagaaagaaaaacttcacatgttctcactcatttgaggcagctacaaatattgaaacaattgaactaatggagatagggaggagaatgatagttcccagaggctgggagaggtagtggggtaggaagaagtggggataattaacaggtacaaaaatataattagatagactgaataagatctagtatttcataacacaacagtgtcactgcagtcaacagtaatttattgtacagtttaaaataactaaaagagtatagttggattatttgtaacacaaagaaaggataaattattgaggtgatggatactttatttactctgatgtgattattatgtattatatgcctgtatcaaaatatatcttgtactccataaatatagatacctatatgtctacaaaaattaaaacacaaaacacgttgtatagctacaaaaataatttctttatatttttattctacataatttttctatgtttaaaatttattattattttactttttaaactctggtacaaactaggacccaagcccacacattagcgtaggtctacacaaagttggaattatcagtattgttgtcttccacctccacatcttgttccatggaaaggtattgaaggacaataatatgcatgaagctgtcatctcctatgatcacaatgcgttcttctgcaacacatcctgaaggacctgcctgaggctgttttacagttagctttttttcacccataagtagaataagtgccctttaaaataatcattaaaaagtataatataatatagtaaatacatgagctgttaacatagttgtttattattgttatcaagtattaaatactgtacatagttgtatgtgctgtacttttatgtgactggcagtgcagtaggtttgtttacagtagtaccaccacaaacatgtgaataatgcattgtgctgtgatgttatgatggctacaacagatgtcattaggcaataggaattttttgactccattacaatcttatgtgatcactgttatatatccagtttatcgttgactgaaaggttgttatgtggcacatgactgtagtggtcttcagaataagatcaggatcatgaatgtaaagagatatttgtgtgtggttgtgttttctaccaactatgttcagctgaggaggtacagttgtgtagtgtggatcaatggatgtatctgcagtatggatttttctcaagcaactaaggagtaaaagaaaaatgaagaagttcatggtatatataaggaagtaattttaatgatgagcaatgaaatttaaggggattaaagtgagaagtgaatgtagaatgaggtttagggacagaaaaaagatattgggatcaatggatagcagattctagaacgctgttataagagaaagtgccagtcaatcaggatctagaagcttataggcacaaggaggtgagaaccaggggcttatagatgtcaactgaagaaagatgaggttcatagatttggaaaggtgagctttatttctcataaaagcttatagcctgcagggtggccattctgacaggctggaaagtgtagcctctgtgcagaagccagagacaaacacttggaggaatttatgctgagctgggtggctgaacatatatattcagtaaactataggaggaatcatgaatatttattaaaggtgaaatgtgcacgtgcacaattgggctttatgctccttcatgggcctcaggtacaaaaaaaaaaaaaaatacatgacagcattagcatgatccatgggtgcagttttcagccttctaacatcaaacagtgaagtagaggacatgaaaacccttattgcacattgtccataatctggccagaaccactccatggttggtggtctcttatcagggaaaaaaggaggtgcagtttcagaaagttggttgatattggttgtggagtcttttgaaaggactgctttctgtttaggaagaaagactagtagtggttagcaaggaagggactgtaagagggcatgtctgacctcctaacctctttcagggctgaccaagcttattccatggtccccatggccaagagatgacccattcagccagttggagggcttagaattttcacttttatttctcatagataagtatggtaaaaagaagtaaagcgtgttatggccttatggaataagattcaaagtttgtgggattttaagaaggtttatttgaaactgacaatgaagatcacgggacacatctgtctcccatgtagagcagaggagtatagactttccccacttgaaaagactgacaaggaaaaaaagtgctctaagaaaaactggtttccataaaagcaagaaaacataggaaatattcagagtagaggttaaagatatacaggattttttttctgatgaatgataatgggtttcactggatatagtgaggggatttttggaagtagagagtggtgggatataggctttaaaaaaaaggtactataataacctatgataggattagaatgtggtcataaggcctgctttgggagataaagggtttttgttgtcttttggttttaaaatgactcatgagaataaggacaaaggcgtggtataattgttgttaatcatctcaaagcaatggtatgaatgccaggccagggtattgaaggggagcagaaaagaagatctctccaggacaacatagaattgcagagctcatatttgacttctgctaaagcaagatgttgtggtgcgggtatggagtactgtcttactctgatttcacatagttccaggggtccctcttgaatattgttctgatatagattcagatgcatttataactagtccactactcaagcatgttattgatagtttcctatccacttgtttgccttaataaattctaaatattaagactagtagatacatgatatatctactaaatattcagtgggacaaaattgttgatgttttcatatatctgaaatctagggcacagttttaaaagaatgggatcaaagttatcagttttcaccaaatggtgacatgcaaggacatctttgtgtctgatgtggccatttatgctaacccaagagaaacctctaccagtaatctgctactggttaccatatatgactcaccagtcagaagaaagttattatttggagatgaaagaccaataagaaggagatgcatagggcaaagaaatagaaagtaaaaagaaagccactaaaatagggatgaattctcaaattttagctaacaagaggcatgtctcacagcttgtatggcacagctgagacagagggttttgaaacacattaaagacttttttaactttttagatccttattcacttttggacttggagaatcccatggctttaaatgttcattttatctttagagattaatcagtagggaggaataatgcatgctggcagatcatgtctgtctgacatgtactatcaaaactttgaacttggtagttggcagcaaagtaatgtcataaaatgccatcgggataaagaactcaactcccacactaaatattgggggagtctaatgactatcatttttacagttatatagtgaaactactttttataatagatagtaatttacagaagagcaaataaattcggtctttttcattattgtattcttaaagattagcacagagtcaaacagaagaaaaaaaagatagtgaatatgatatatctatgcaattcacaatataaaggtagagctccatggtgctattcacattgacttcaatatgaataatgccccctaaagttttacaaattggttcatctacgcttttctttgctgaatgaattatatatcctctaacatttattacgttcttattgtgtgctaggcatgtgctaactactttacatataagatcctacttagtccttataagaaagacagtgaagcaaataacacttgtatgtttgcccaaaattatgtagctggtaagtgagaagccaagactcgaagatcagtgtgttagctggcttaggtatctacagattcctttattaccattatcagaggtatgatatgacactgatgcatttgttctcaaagtatttgtgttccagctgggggacaatttaaacaaagaaagaaagatacaagccaaggttcccaaagatagcagtacaaaaaggaggaagacagccctttttgggatggaataattgaattagtaatttccagagaaagataacatgaatttggttctggatgatacctgtggtttggggagacaaaaggggttctaaaaggtctccatgtagaaggaacagcttaagcaaaggtagagtggagaataagagagggccttcatcagattagagaacagtgtagaaattatgtcacaggacatttttcttaatattttggtggcttttaggttatttttatttaggcagaggtaggagtcagcttctccatttttcttgtggcctttgtaacttttgaatggctataccaccagatattcccatctagttctgctctctatcttaattgggaaaatgcaggataatcagttttcaagggtaatgggcttgcaaaaataaaaattgtgaaagccataggtaactgttttttaaaaattggaacgttaatggagaaggccaagctttctttgaaaatgcctacggtgtatcttgtatctcttctttccaggtcccagataagacatggctatatttttcacagagcttctttctgtaagagtatcaaagagaaaacattacatattcttggtttccttctgagggactgatccaccaggtgtctaattgcatctgggggctattttttttgttccatatgaataattgaacatttctgaggcttggaataagtatgggttcttatgtctctctttaaatagaaaagttaaaatagaaaatatttagaaaaatgttgctttccttcttctcaccccagttccattcattgcagttcttttcttagagttttacattttcctttcagatgtatagtggagggttttaatttgaacccctgagtttctttagtgttataatttaaactaataatagctaacacctccctttgagtttctatagcagctattacagtggtacctactgttattaatatttaagaaggaaccattaaaatttgaggtatgagacaaattgaaaatgttagcattaattgaacactattgttaatggcacctttgctaattcacggtgaagccaacttgtattgcttcattagagacagaaacctaaaagtacagtggtgggaataatttcaatgggcaacagtctttcaagtgcagcaatgtaacaaattatatttcactctcagcttaaaatcctgaaaacattcagacatctgaatattgtataaattaaaccctacaacctccagacatctgaatattgtataaaaatggccagtctagtagtttaagaagctgaaaggaaatgcttaatctatcagtctagctactcctctagtaagcacatctttgaacaagtacataggaaaggcctcatatgcatagatattctttaaaacaataacattcaaaattttctgctttttgtagaaaaatgtgttataagtctagtttggtatatttcaaggtttttataacttctttctaataccctttgtgttcataaaatttatatgttttgtttcttcaagatcagttgatactattgttgttggcttggaaagacactccacgtatatgaaacaaaggagttgggttttacacgtttataggaaagtggataaagaatattggtgggattatcagggaaaggcctatcaaaaccacaatgagatatcatgttaccccagttagaatggttattatcaaaaagacaaaaagtatcaaatgctggtgaggatgtagagaaaatggaactcttatatagtaagtcttgacttaatggtgtccattaagttcttggaaaatatgactttaagcaaaatgatgtatagtgaaacatttttaccatctgtggggagaatgtgcaaactccgcatggacaatggcccggccaggaatcaacttttttttatcccatcaatgttataatgaagcgaccttgaacgacataacattatttaaggacctggtgtacaccattggtgggaatgtaaattagtatagccattatgataaacatggaggtttctcaaaaaaacaaaaagtggaactaccatatgatccagcaatcccactacttggcatttatccaaatgaagggaaattaatgtattgcaggggtatctccaccccctatacctactgaagcactattcacaatagccaagatatggaatcaacctaggtatctaacaacagatgaatggataaagaaaatgagatatatatacaccatggaatagtattcagccataaaaagatgaaatcctgtaatctgtggaaacatggatacgccctgagcacattatgttaaatgaaataagttaggaacagaaaataaatactgcaggttctcactcatacgtggaagctaaaaatttaattcagctcatagaagtaggaaacagggctgggcacgatggctcacgtctgtagtcccagcactttgggaggctgaggcgggcacatcatttgaggtcaggagtttgagaccagcctggtcagcatggtgaaaccctctctctactaaaaatacaaaattagcagggcgtggtggcgcatgcttgtagtcccagctacctgggaggctaaggcaagagaatggcttgaaccctggaggcagaggttgcagtgagccgagatcgtgccattgcactccagcctgggtgacagggcaagactccatctaaaaaaaaaaaaaaatgtagggagcagaattgtggttgttaaagattgggaagaggaaaggggaaggaaggatggagagaggttggttaatgaatacaaaattacagctagatagaagaaataaattctagtattttacagcactgtagggtgaatatagttaacaataatttgttgtatatgttcaaaaacttagaagactgcatcttgaatgtttccaacacaaagaaatgataaatgtttgaggtaatgaatatgctaattaccctgatttgatcattatacattgtatacatgtattgaaatatcattctgcatcccataaatatatacaatcattttgtgtcaactaaaaataaaataaaaaaactctgacaataaacaaacaaaaaataatatttgtaggaaaaatgacagaaaagagatccagaattcattgggtggttattctggtgaccttggaatttctacagtcttcctgtgagcacatttgagtgtcagaaaaattttactttagactccagccatctgcccatttctccctttttatattggcctctagttttgtcctctttctggagacacaaagctgaatttctccaagtctattggacatctccaaattacctctatacttaacatgctctacacagaaatccaacttttccccaaatccctgcttccttcttttgcccttaaccttgttaatcaccattctctcagctgattagtgttgagtatcctccttactcaattaaattcatatcatgaatagtctctgaattcttactcagactattggattggaacactaatcatgatgtgaagatgaatttaataaaaaagattttatttcaaaaattaaatgcattttatgacagaacaaaagagtgattattaaaattacacagcacagcactttaagaataaattttcaacattgtagggaacactgaagaacatccagagagaaaaagcaaatgggtaccaaaagttaaccccaaattaattatttttgaaaataactaaaactcataaaaaagaattggatagcatatgtctttaaccattatgtcaaagacaggggtgtggtatctgtatgggccacatttaaaagtggaagaaatgaagatgattaaactttaaattttttttgagaaagatttgttctaagcaacagaactttatataaagaataagataaagttctttgtttctagaaaatgttagggagtgtctcctttctgcattaaattggcactgcgcatggattaaaggcattaaatttggatgcaaacaggtgtccctttggatgcaactttgtcctttactaactctatgaccttagataatttactaaccctctctaagcctcattatcttcatcagcaaactagcaattatagtaacacccaccttatcagatttttctgaggattacattagataacgtgtataaaatgttgaacatagtaaatgattaagagtaaatacaaaataaacgtcatctagttttattaaatctaaatttggtaaaaatgtataatgataatgtaatacttgttgaatactttattgcaggtatcaatttaaaacataaacacatttcatgatttttctctaacttatattacttaatgtctagaatttattctgtgagtggtaaaaccaaccaaagctaaaaccaaaaccaaaaaacaactccagtaatacaggatcattctctatgttcttagaggtacatttacattctggggagatttatatatgtcatggtatctgcctagaggatggatgcttggtcacccactctacccaaccccaccttttaaatgtatgggctcacaataaaagcagcattttttttttttttttttttgcctagataccttcgcaatactgcacatgggtaattttacttcttttgttccataccaggaagtggggaaactgcccagatggatcatacaaccatgtctatgatcttcctgtttctctgggattctgatatgaggtacgtttctccgcttttctgttttctagaaaattagaattttctataaaatttctatggaaaccatattttccattaagttaggagcctcagtcatcctttgccccactgaagctttgcaggagggagccccagtcgtaggtgcgcctcagactccttcctcagccatagtcacttcaatgatctctttactcccttctagctctcccccgcccctcagcaagaaaatattttctggtatttcacagtggtccttgcttttttccatctatttttctatattattttacttgaaagccagaaattttgacatatttttattttctttgttctgtttccttgtatcagtaggcatgcaattctatggtgaactgaagagcaagggataaaataaccaagagtgatgcataaataataaaaaaaataggcattttcatggtataataaatttgccttttttacctatagagttcagagaaatttttaggcaaatattattagccattgctaatattttgaactcagtttttaagtatcatgatggagtttacccatgttaggggagttaatctattaattatcagtgggactctaattgagtcctttatttaatttttcatcacatccttgttatgttaggagatggttcagagtggaaccttaaaaaacagttggaattcttcaaaattagtcctctacaaaaggttaaaattatttgacttttggatgataaagcaaacagtttttggaacaatcagctattgatttgcttttctagagtattttgaatgagagatactgggaagaaacaaaagtattcactaaaatgtgcctgccatgaggtatctaggttaaacataagaggcattttggtttatagatgggagatattggaaagtctcatggacattttacttttcagggactctccatgacaaataaacattacaaaatatcattgatcagcaactcttagtcctgcataatttgttctttatcctctagcatttcaacatagtactcatacaattactcccagattataaaagcataaaagctcaggattctttttatatagttcaggaatcacagtctttaatatttgtttgttcttgtctgtgggtcaggtcttagaatgaatgcatgcttcctaaattgttgttgcacttggtaatgtatagatattgtctgtcaaaatagaaatatttttctgtctgactcataagaacttttttagagtttcgcatgaaactttttcatgggaaaaagaattgggaaattattttaaagagtgcatagttaatgacaaaatataaatagattagcttgaaatttagagcagtctcagaagtgctataggactatttaaatctgattttttttctgcctctcaaacaacatatctattggctcaaatgaggtgaaagagaaaaagagtgagtagcaaagaggaataatttgacactccactaaatagtgatttagcattgaaggtagtgatagagacactaggagatacagcagacaatactttagggttatagaagagaaacagtggaaacatctcctcctcctcttgtttgtttctgttctagttcttaaaaattatggtagtggagaaagtttcctcagaatatgaagttgtgatgtatttttacaggtgtacaactgatttaatgtggttatcattaaatcatcatttgatttcttctgattgatttcttctgattgatatgactgtcctgtacgttgaataatttaaaaacagctaatgtttagataatgtttaaagaaacattctaagactctttttgaatctaataaaaagcatggtaatgcaaaggaggcaacatgttgtagtcaaaaggtcgtttgattttgaagcaaacagatttggatttaaagttgagttttgatagttattggtgacatgatttaggttgaatattatcttacctatctttgagtctttaattccttgtgtataaacttaggacttgtgtcttgttgtggataataaaatgataacgtgtaaaacatctgggagattagtcggggcttaatggatagaaattgagaaaaagcggccaggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaaccccgggaggcggagcttgcagtgagccgagattgcgccactgcagtccgcagtccggcctgggcgacagagcgagactccgtctcaaaaaaaaaaaaaaaaaaaaaaaaagaaattgagaaaaagcagaatggggtgaaactaagaagtgtctttccatttctgttaagtgaataaatatttttacggtggggcttagtgctacttgataaataaaaggtgaaatttgattgaaatatataaatttggagaaaagcgtttttaaaaattttaaattttttttagatgtcacgagtttaaacatagtataattttttaaatgttttggaaaaattaaaaaactcaaaatgcttctaacaatgcttctaataatgttttcaatgttttacagtatgatttaagtgtctcaaaatagtcctttagtttatctgataaagaaactacataccacaagctacaatgatagggaaataatagaagaaatctatctatctgtatctatctatctatatctatctgtctgtctatctatctatctatctatctatctatctatctatctatctatctatctccttagtcatatttttgtgaaggttcttaggaagccagacagtcgagttatgttgaaatgaaaataattgatattttaagccgtgctacaaaaaagcccataaatagcaaaggatcccaccttccctttttcccaacagaaacccaaatttactttcttcttttaccatttctctcttacatttgatgctgtaacagcatatacatttttgtaatttcagcaaaaaccacactttctttgttcagccatttctccatgctttcctgaggtttgtgcttctctttccccatccctctccctttcctcattcctacgcctcatctgttctctcttagatgcaataactcttactcattctgaaagaccgtgccacaatctgtacctccagagaaatctgccttatcctctaatattaagatgaccacataatttatcatgcaaacttgaactcttttgagaataaaaaggaacacaatgcataattacactgggaaaacaggtgtaaactaggaaaatcctggcaaatacaaatacatgtcatcttgcctaaaatagatcaggtatttttagagagaaaaaagtattccttcccactctaacatccaagagaactgtagtaagttattttggcctctttcatctctccacttattccactccaggaaggtgacatatttttgcctgataatttttctaagaatgagctgggcatgtgaggtccacttttctctttcttctctgaggtccagcatgccagctgagagtttgcaatcatcactgctctgggccatttcacaagtagagtattaagacccccttcccttgggatggctcacagttcttaggactggttacttctgtttcatcataggagttggtgaatccattttgccctcctgttgaactatgtaccacaaccccacaatttatcagtattagaaggtttcacttctagttatttgattcattgtcataattcaagagacaagtagaaaagagcagtgctatctacccttcaaggctccaacatttactagctctttgtgttttcaaattactctaataactctattgttacatttatttgattatttttgatgatttgataattatctgattatgtatctgtctacaggttaccaaaaattcttatgtacaggataaataagtgttggtttcttcatatgtgcctaggctcaatatgtcatgggttcatgtcataaagaaccaagaatatatataagcttcatatatggaaaatatctggcataaggtagtctaaatgtaaggcatttttactataatctatcatttaatttaaataataatactgcaaaacagctcttactgttcttagtctatgaataaagaaagtagatttagagagtaactgaactaccctaaagttatacagctgagaagtagtgggcatgaattcagttcaggactgtctgccttcaaagcttgcggatttttttttttttctatgccaccctgctatgacgatgtcttttctcaggtacaggcataataattcccattatacttttgcatacaaatcaatatgagattccccattaatgctgaagtgaaacttttttcactatgttgatggaaaaagatgagttacataaggggcccaggtgccttattatttccagaagagcattctgaaatgaggaatacgagagccaaagattgcactggagaatttctgatatttaaacacatagaaagtgtcatttccaggttttctggtttgaaaaagtgcaatatgaagagacgatgctggattatctcaagggaacagcagtgaaccatcttgattaaccttgaggagtccatagtatcacgtttttatctgatatgaaagagcaaaaaaaagttgatgcctggatatagccacatatggttgtttttctatatcatcattgtgcaatctcccatttcataaatttctaaatttaactttgtataattcaatttaatttaacctattttggctttctctttgtattcatattactgtgctagacaacagggtataaggagataacttctaataacacttacaaagatatttaaactcaacaaataatactaatgttgagtcaaactaatgcttaaaagagacctaagacattgctgtaaagatttagaggaagaaatatcacattttgaatggggaatggggagagacatcacagaggatgtaatattttgagtttagttaaaggatgggtaaagactgttactgaatgtaggaaaggaatcgtatcataaaaacgtatgtcacgtttaggatttaagagtgaacctgtgcggctggatcagtattttctgcaggcagtgagtaggtgacaagtctataaaagtgatttggagtcaataatagagccttgatgtcatgctaaatagcatggcaatttcatggaaagcattcaataggacaatcttttccccgactaagggctaatgaactgatctgctgagattttagtatctgctgaatgagttgaactatcttatattaacaaatgttaaacaatctctttactatagaacttctcacaacctttaatgttgttatgtctgttgggaatctataagagaagcctataatatgctttgtttccctatcttataatcatatgtgttgtttctcagtcttattaactatggggcatgatacaagaatagtattccatggagcatgttggaaaacacttatttaaaaagtaaagtcaaagagttcatattttagtaaggcagttgaagacccccttcttgttgttgccatctttttgaggcctttctttaatctacatgtacgtatatgcctgtgctcacacacttacatactaagtgagtgacagggtatatcttcagtaagattcctttgggtaggacccttgcagcctctaatcccattatggtgatttactccattttatttcatgactagcccttgtaatctagcttttagggctcgacttttttttttttttttttttttgagacagagtctcactctgttgctgaggctggagtgcagtggtgcaatcttggctcactacagcctcagcctcccgggttcaagtgattctcctgcctcagtttcctgagtagctgggattactggtgtgtgccaccatgcctggctaatttttgtatttttagtagagacagggtttcgccatgttggccacactggtctcaaactgctggcctcaagtgacccgtctgcctcagcctcccaaagtgctgggattacaggcatgagccaccacaccctgcagggctctactctctataatgacttcaggccacaggtttctgactcagattaaatacaaggttagctatttttttttttaatttttattttatttattgatttttggctcccagtgatttcactcccagactgaggcctgtgatagctcaggtgatttcctgtttctaaaccagacatgtccctgtacttgggctctgtgttccacgtctgccagcttgtctgataaagctttccttggtgcgcatgcctccaggcaccccacctgaattagggccctgctgaagcacaaactgtcagaatccaggggaaatgacgctgtgcaaaaatctgttgaaaaggattcataggggtcattatgacattgggcaatatcacagaatatgacccgcttgtagcacctctcccaggcaaagacgatggtatagagaatctatgcttcacctgttcagtataaaaattatagttgattcttaaggaaagttatagtaatattttgtgaaaatgactttagtcatactccttctatgaaataatggaaaaacaactcaaaagcaaacaatagcaacaatcataataatattaaagaaagaaaaagctgtttatctgcttatattcctaggagggtgaagtatcacttgtttgggtgatttaactgtgttgtcaagactctctctctctcctttccttccttccttccttccttccttccttccttccttccttcctttgtctttctatctttctatctttctgtcttttcctctatctggtttgttttctctctcaaaaaggctctgcctatgtggtaggcaaacgactggcagtagtctcagatgcatattctgtaagtaaagcaatcactacatagtgttttctcaaatcccagaatttgtggtgacactaggatgacatctgtaccccccaaactacatgcaataggtttcccaccaaaaaagattatgttaacagaaagaataggacagtgacactagaaaatgctgacaaataaatatcctccccaggccccatctgcattcattttcttacagattattttaagtgtgtttcctcttaatatagacatctgttctaataatcttcatcataactgcaactcatgtgctgcattcagctccagatcccaggatcaatgggtggtaagcattctaatcagtcttctctaaatgtggcttcacacagtccatagtctatgcctaaatgattaagttaaacaaattctcagatcttccataaggtatggaataaaaaaaaaaatgggctaaccacagtaataacacttatttagaaatgtaaaacaataagagaaagtgataacttctgttccactgatctattgctgcttacaaaaccaaccaaaacatagtggcttaaaacaaccactttattatattttacggttctgtgggcctgactagttttttcccttgtggttgcagtgtgatggcagctgcggctggccagcatcatctggaactacactggtatgctgggctccctctatttccatggagcaggtcttctctttatttgtatggtctctctacacagactctcttgatgtggtccctccggtcaggtagatagacattttacatggcggttcaggggtctctagaaggttcttctaggccttcttaaagtttaggctctgagctatcatagcttcacttccactgcattatcatagttaaagctagtcataaggaaaagcccaatttaactatggaagggaccacacaagaggatggatgttagtggttcactaagggacagttgtgaagcttggataaaacaaaatagcaccattctatagcatatttcaaaattttttggaccagaataacagggactaatttttctccagtggagttagcccctggtcttccactgcttgctctaagtcctgcctcccaggagaatatctgttttcattcatcctccgttacctcactttagtggggctagatatgtatttcttattttaggaattctatcacattaaaagcccacttcatattagtaaaaattatggggatctagggattgacatgttttgtgaacaactaaagattcaacattttgctgggatttaccataattactagttggttaattcaatttctggtcatagtttggtctagaaccaagccagatatcttatagaggaggggtcactaaaactgcatctgctcttacagcttctatcttttaatggcaggcctcagagctctactcattcctcagtctaaaatgatgaaacaaaacatatcagcccccactaacaggctacatcctagatgatggaggaacttactttttttgggcagtaaagtatttgagaaatgcctagcaagtcagactcatttctttcgggccttcttgatccagttttcattcttgtttcttgcctcctggattttgcaagcattagctttatcatcagacaaataattttgactttgcagttctgcaaaatttgtgatgaccaggtgatcagtattcttggatttctggctataggcaaaaaatgttttattgaagttctatttttttctatgttaagtcaggcaagcagtttgtctctttcttacagaacttatacaataagtggccaagcatgttgaacatcacatatatttctagcaagttgtttttaagttattgcttttccaggtacatgttttgatgtggcatgttaaccagatgctctcaatctcacaatgaagattatcaattacttggcatgtgtaagtataagggattcatacgaatctgtaccaacttgtgaaacactcaatatgttatgctcttattcatttgtcatccactgagcgggatgacatattaattattcaagacagatggacagtcaggaaggatggagtctcttacctctatcagtaaacttcctttcaaatgtggaaaactaaatccctcctgctgtatttcaaagtccattccagtcctgtcatgacctcagggaaggtagcagcctcattttagtcaattgttattcctccctgccctatacacatttgaaagcccattttggtcattttttagctccttcttttccagagaaaatgatcaatcctgtctgtgaaaagaatggacaagtaagatatcctctggaggcccagagactaatttattttagatatcaaattcttctatttcttcttaacaagcatactccagagcaataaatcttgacaaggagcaacaatagcaatagtagctgcatcatgctaagagacttatttcagaacaattttttatgtttgggcacatgacatgagcactatcaaaacaacagttggcacatcccaaccatcaacacatcactgcagaacattatcttcaaagccaggccaccaataaaaaaaaaaaatgaacttcagaaggaaaatgtgttttggctttagtgcttttattttttatttatttttatttttattttttggcagagggtgcagcgtattgaacatggtacctgccttctctaatagcaaggagaaagtaagtcctttaattctttattaactttctcttttaaaatttatcttctgagtttgagttaaaattttgtgacgtctcttgtaaacgtctactgtaaaaacttttctctggccaacaatcttcattaaatacgaatgagagtttgtgtttggggagagtggtggcaaagaaattggttcatttttttttcattcacctcctttattcaaagctatcctgatctttgagatcaggaacaatgtcttctttgattttcaacctcttatgcttagcacagtactagcacagaaagcataaactcctttagccaatttttgcttttttaatataataagggcatataaaataaacaaaaatttaaagaaaaaataagcatttcattttaacttgtgaacgtatttttctagacattaaacatagaaatgtaatgagagctatttgatattacataattactaatagactaacattgaaattcatgaggtagaggccagttgtgcctatggttcctagtactgtaaagtggcaagacacaaaaatctacaagaggggaatctacagaaatggattttcattatttctagatagtttctttcagactagaagttttataaatcaacttgttattgtctctgttgaaaaagaaatccaaaagattgtgatttattaaaataaaagtgttcttcaatcttgcttcaatatctgttgtgtagggaaaaggcatcattggttatcttagtaaatttctgtagacattatcaaggtgatatgtgcagatatgaaaatctgaggctgggaaatgtttattaattttgcttattaacattgtatagaaataaccatacccttgtattgtaagaattcaccatctgacttctttctttcctacagagttctttactgtgtaatgctaaatatcttgttgcggttacacaggagagctcttttggttatgtttagggaccctgtagggtgaggcaaatgggcccatgctaagtatatgttcaataggatgtcacataatcttataaaaatcttgtaaatcaacaaacaaaacttgtaaaatggcaaatgttcaaactccatgtgattaaattgggtgaatcaaaataacagatgctattttcatcttctgcagtgctgagagtttgttagtgttacggacacaacagctgcaaagataatttttatgttcattatatttactgtgttactgggagaattagaagcctctgaagtacttcttaaaatattttattactctataaaagaccctgtcactttaaactccattagttgagctctttggattagtaatgacattcctaggaggaggccctgggaagttgggtttaggagtctcagtttagcccttcacaggcagtgatgtatgttagcccatcctcagggagaagggtttatataaaaaagtcaatgaagttattgggtaataacagagtggggtttgttttaattcctcttttcacgccactgtaattcacattccctacttatgagtttccaaccactttattttattttttattttaaaacccacaaaagaactcagagtttacagcaattttaaatattgacaaaatatcatttaaatcagtagtggaccattccttttacttcatgtcaacaaacctatcatatgtttaaagcatggtaagaggtcaggggaatacccaagcactatacattttcttcattcgaggagcttaactactagatggggagcaagagtactcatggaatagtcaaatatgacaacttaatacttttgattgaacataaaaactattttttatatgaattctgtaggagcattttatagatatgaataacatttaccatcagttgactttaaataaaaggtgggcctcatttatcttagcctcatacaataagtaatacagtaatagatattacagctagtagtcaattaagtagtcagggaaagtcacatgaaagtcttgacctaggagatatgtggactgattttctccattatataaaattgcttttcactatgtacccagtttacagaacaggcaggattggtgtctataatacagatttctactcaagggagtatactcttggacaaacatagcttcatcattatagtgattgcctgttgtctctatcacggtacttggcatacatttgatactgtgacagtcagtccctatgtgtcaacttggttaggttatagtctctagtctttcaatcagaccccaaaagtggcattgtgaaggcatgttatagatatgactaatatttgcaatcagtgggctttaaataaaaagtgggcctcatttatataagtgagcctgatacaataggttggaaagtcttagaagcagaactgaggttttcatgacaaagatgaaatttcacttaccagctgcagcttcagctcctgcccaagaatttctagcttagccttcttcatggcctttcctgtgtgtttcagacttgcctggctagatcccacaatcaagaaaacaactccatgcaagaaatctctccttccctctctctctctctaacactagtcctgtttttgtagtgaaaacgtgacttatttgagcaccaaaagtggatttagaatcttgacaatgtgatttctgaattggttttgggtttcctagaatagattctctaatatggttacatttagtggcactaatgactctatttctagtggtaaagaaggcactggtagtccatggcatgatgtgacaatagaaatacacaaaatataaccattggatactcttaatgaaataattataaaagtcaaggttttgacttttataattattatacataaatatacatataattattatactatacataggtgaccatgtgttttataccacagaatattttcgttaaacttaggactgttaagatattgcctggttgcccctaaatgtgctagagaaaggcaggaaagaaaagaatgagatcaaggtttcaaatttccaattcaagctctacctaaataacctgtaagcatctgtgtctgacttgaaagcaacttttatttcctatagctgcagggctgagatttctaaaaataaaacccagaaaactcagagtttcatctagtgagtggttaaattataacataaatagaatgaccaatcttgtatggtgtctgctgttaaagtgagtgagggcgtatattgagaaggaattgaatccagaccatgggaatggggacaaatgaaaagaccctgatgaagctgaggatatcaaaaccctaaattctgctaagtcttttgtgcaagtagaagcaggcctcccaccccagtctgcaaaggttaaccctgaagaatcttgcctgaagaacatgtaatagtctcacttgatgtaattggcttaatagctactgctaatactattgccacctctctttgcttttagacctaacactagacacaagtcccagtagtttccaaagggtaaggtaccaagtgtgatgcatgaagaggtgtgatactcacctaaagagttttatgaatttccagtttatacagagaaacctggggaatatatgtaagagtaaatattaagggtgtaggataataatgagaggatataaagttggatcaaactgagtttattgatacaggtccagttagagattcttcattcaatcttatagcttgatgtgtgagaaacggctctaacaatttatatggttggatgaaatacagtcctaaagacggactacactatatgccagaacttctttggcatactgtagaggaagtcatccaaaggcttagagatattgaaatttttgagtagatttaatcacgtcagatctactcacccaacctaagagggttcataggacacactttt

SEQ ID NO: 442 - DNA, 40001 bp, Homo sapiens
ggaataaattatagaatatcaaaactctagagaggttttataaagattagaaaaggaatatcaattggagaagtaataaaagtgtgtattgtcatattaaaatgtgattggctattttatccaaaaatatattcagattaaaaaataaatattaactagacatatagtgttctttttaagtataattattccagttacaaaacttgtccactatgattcatacattactccaagtttagcttacattccaaatgtaatttttaagcaagtttctcaaaaagatatttattcttatatgaaatagtgtagtgttttcccccaaaatgcaagagccagtccagaaaatattctttattttccataatttcttaccatctattgaaccctgtatactttcattagataagattaaattataaatgcctgtcccatgatttttggtagctatgggatttgaaatcctgttatgttttcacatgttttggtctcttttttttttttgatcagctttatctaaggcaaattattaggctgactgattcccccaccaccaaaaaaaaaaaaaaaaaaaaaaaaaagcttaccatttataaatcccaagatggagctgggtgtcacctgaatattctgcactctgtccattaatattttgatcatttaaagttacagtgtcttcaaaattaaaaattgagttcttattatcactttacattcttgggaccaacctgatgtaaatatatccaacaattatgcttgtaacacgaacaaggctataactacattctaaaatgagttactgagatccaatatactttaaatacagtaattgattaagaataaaaatctcatttgaggaaatgaaggatttgaggctgaatagaaattgttgataattacaaatacttttttgtgttttgtattaatttcaaatgtatggtttgaaatcacataagcactgtatcataatgcttctctaaaatttatatattcaattatatgacactttttctgcaatacaatgttactacctctagaaaaagtgcagatatgataaaataaaaatgaatgttcactttaagaaagttacttgtattctagtattaatttccacactagctcacttaaagatatttgtctagttatttaatgtatcttgttataacactgttttatctcttgccacaacagctgatcatttaaatagagttggtgaatattttcttaaaggaccagatggtcaatattgtaggctttgatgatagatattgtagagattacttattaaggtctctgtcacaactgctgaacagtgatattgtgccacagaggtagtcatagaaaataagtgaacaaatgagagtggctttgttccaataaaactttatttgtaaaaacaacttctgggtcatatttgacccataggacatcatttgcctagcccagctttaaatagtaaaattgggctcaaggaattatgttccattttttaatagtccttgcttatcattcaaaagaaaggtgaacaataattggacatgatttgaagtaaattaacctgacgttacatcacagagtggatacttagagtatgttaaccctgtctaaaagatggcatcacataagggtggttaacagtcagtcctctggagccagaactacttgagatagatcttagattctccatttattagttgtgtactcatagaaagaaatttatcttcctttttaaaatttttattttttatgggtacatagtaggtgtacacaattatgaagtacatgagatattttaatataggcatgtgatatgtactgattatatgacaataagtgggatatccatcaccttaagcatttatcatttatttgtgttacagacattccaattatactctttcagttattgttaaatgtacaataaattattgttgactgtagtcaccctgttgtactaccaaatgctaggtcttattcattctgtctataattttgtacccattgaccatcccctcccaccttcacccactaccattcccaatttctggtaaccatcattcaaatctctatctccatgagttcaattattttaatttttaagtcccacacataaatgagaacctatgaagtgtgtctttcaggatgtggcttatgtaagttaacaaaatgtcctctagttccatccatattggtacaaaagaaaggatcttgttttatcactaagtagtagtccatttcgtatatgtatcacattttctttatctattagtctgttgatgaacacttaggatgatttcaaaaactgactattatgattagtgctgctaaaaccacaaaagtgctgatattacttttgtatgtggatttcctttcttttgtatataaacctagcagggaggtttgctggagcatatggtaacctaattgtagtatttgaggaaccgctctactgttattcataatggcagttctaatttacattcccaccaagagtgtactagggtttccttttctccatatccttaccagcatttcttattacccatcttttagataaaagtcttttataactagagggagttatttaactggaattttgatttacttacctctgatgatcagtgatgttgagcacaatttcatatacctgtttgccatttgtatatcttcttttgagaaatgcctattcagatgttttgtgcatttttaaatagtggtatggtttggctctgtgccccacccaaatctcatgttgaattgtaattcccacatgttgagggagggacctggtgggaggtgattagatcatgggggagatttcccccattatgttcttgtaataatgagagagttctcaaaagttctgattgtttaaaagagtgtgggatttccccctactactcctgttccaccatagtaagaaacacttgcttccccttcaccttctgccatgacggtaagtttcctgaggcgtcacagtatgttctggctgtgtcctcacccaaatctcatcttgaattgtaactcccacaattcccacatgtcatgagaggaactcagtgggacgtgattgagttatgggaaaggtctttcctgtgctgttgtcattataatgaatgagtctcaagagatctgatggttttaaaaatgagagtctctctgcacaagctctctctttttttgcctgctgccatccatataagacatgacttgctcctccttgccttctgccatgagtgtgaggcttccccagccatgtggaactgtaagtccattaaacctctttcttgtgtaaattgcccagttttaggtatgtctttatcagcagtgtgaaaacagactaatacagtaaattggtactgggggtggggcgctgatgagaagatacccagaaatgtagaagcaactttgggattgggtaataggcagggtttggaatggttttcagaggtcagaagaagacaggaaaaaagttggaaagtttggaacttcctagagactagttgaatggctttgcccaaaggctgatagcaatatggacaaaacagtccaggcagaggtggtctcagatggaaatcaggaacttgttgggaactagagcaaaggtgacacttgttatgttttagcaaagagactagcagcattttgcccctgccctagagatttgtggaactttgaaattgagagagatcatttagagtatctggcagaagaaatttctaagcagcaaagtattcaagaggtgacttgggtgccattaaaggcattcagtgttataagggaagcagtgcataaacgattggaaaatttgcagcctgacaatgtaatagaaaagaaaatcccattttctgaggataaattcaagctggctgcaggaatttgcacaagtaatgagaagtcaaatgttaatccccaagataatggggtaaatgtctccagggcatgtcagaggacttcatggcagcccacttcatcacagacccggaagcgtaggaggaaattaatggtttcatgggccaggcccagggtccctgtgctgtgtgcagtctagggacttggtgctctgcatcggagcttctcttgccatagctgaaaggggcctacctagagcttgggctggagcttcagaaggtgaaagccccaggccttggcagcttccacatagtgttgagcctgcaagtgcacaggagtcaagaattggggtttgggaacttttgcctagatctcagaggatgtatggaaatgcctggttgttgaggcaaaagtttgctgcaggtgtggggcccttgtggagaacctctgctagggcattgtggaagggaaatgttgggtcagagcccccacacagtgtacccactggggcactgcctagtggagctgtgagaagagggccactatccatcagatcccaaaatggtcgatcccctgacagcctgcaccatgtgcctggaaaagctaaacacacaatgccatcctgtgaaagcagcccagagggaggctgcatcctacaaagccacaggggtggagctgcccaagaccatgggaacccacctcttgcatcagcctgacctggatgtgaaaacatggagtcaaaggagatcattttggaggttaaaaattcgactgctgtgctcaaattcagacttccatggggcctatagacactttgttttgtccaatttctctcatttggaatggctgtatttacccaatgcctgtaccactattgtatttaggaagtaattaacttgcttttgattttacaggcttataggtggaagggacttactttgtctcaaaatcataattcagttcagcattaactcaaaagtccacagtccaaagactttgaagaactgttgggaaggcatgattggttttaaaatgtgaagacataagatttgggaggcactagggacagaatgatatggtttggctgtgtccccacccaaatctcatctttatttgtaactcccacaatttccacaagtcatcggaagaacccagtggaaggtgattgaattatgggggtgggtctttccagtgctgttctcatgatactgaatgggtcttttgagatctcttggttttaaaatgagagtttccctgcgcaagctctctttttttgcctgctgccatcgatgtaagacgtggcttgctcctcctttccttctaccatgattgtgaggcttcccaggcatgtggaactgtaaatccattaaaccttattttcttcacagtctcaggtatgtcttaattggcagtgtgaaaatagaataatacaccttcccagtcatgctttctgtagagcctgcagaattgtgaaccaattaaaccttttttctttataaattacccagtctcacaggtttaggtagttttttacagcaattcaagaatgagctatacagacaattgtattgaaagtgagatattgctataaagatacctgaaaatgtggaatcacctttggatctgggtaaatggcagaggttggaatagtttggagggctcagaggaagacagggagatgtaagaaagtttggaacttcctagatacttgttgaatggttgtgaccaaaatgctgatagtgatatggacaatgaagtccaagttgaggtggtcacagagggaaatgagaaacttactgagaactggagtaaaaatcactcttgctatgctttagcaagggaactggtggcattttttccctgccctagacatctgtgtaactttgaacttgagagaaataatttcaggtatctggcaaaaaaaaatttctaagaagcaaaacatttaatatgtaacctggctgtttctgaaagtatatagtcgtatgtgttcacaaagagatagtctgaaattggaacttatgtttaaaattgaagcagagtgtaagtttggaaaatttgcagcctgtccatggggccaaaaagaaaaatcctttttctggggagaaattcaagccagctacagaaatttgcataaataatgaggagctaaatattaatagccaagacaatggagaaaatatctatatctccagggcatttcagagatctttgtggcaacccctgcaatcataggcctgtgagcctaggagggaaaaattgttttgtgggcctcgcccagggccctgctgctttgtgtggccccaggacatggtgccctgttccccagacactccagctccagctgtgtctaaaaggggaaaagataaagctctggctattgcttcagagggcgcagtctccaagccttggttgctttcatgtggtgttgtgcctgcagctgcacggaaggcaagagttgaggtttgggaacttccacctaggtttcaaaggatgtgtggaaattccttaatgtccagacagaagtctgctgcaggggcagagcattcatggagatcctcaaccacagcagtgcagagaggaaatgtggggttggagccccagacagagtccccactggaggactgcctaatgtaactgtgagaagcgggccactgtccttcagaccccagaatggtaggtagactgacaccttgcaccaagcacctggaaaagccacaggcactgatcaccagtgcatgaaagcagccacagggctgtattctgcagacacatagagatggaactgcccaaggccttaggagcccagttcttgcagcagcatgaccaggatgtgagacttggagtcaaaggagattattttaaagctttgagctgtgatgattatgctgcagggtttcagacttgcatgaggcctgtacccgctttgttttggccaatttcttccactgggaatgggagaattgatccaatgcctgtatcccaattgtatcttgaaagtaattaacttgcttttgattttacaggcttataggcataaggaacttgcattctctctgatgagactttggacttgaacttttgggttaatgctggaataagttaagactttgggagactgttgggaaggcatgattttgttgtgaaatggaagaaggacatgagctttgggagggtccaggggtggaataatatggtttggctctgtgtcttcacccaaatctcataacaaattgtaatccccacatgtcaaggaagggacctggtgggaagtaattggatcactggggagctttccccagtgctgttctcattataatgagtgagttctcatgaagtctgaggatttaaaagtatatggcaggtccccccgccacctctctttctcctgtttcaccatggtaaaatgtgcttgcttccccttcatcttccaccatgattgtaagtttcctgaggcctcctattgatgcttgctgttaagcctggggaactgagtcaattaaacctcccttcttcataagttatccagtctcaagtagttctttagaaaggcttgaaaacagactaatacaaataggattattagttttcctcctgtagagttgtttgggctacttacatattttggttattaaacccttgtcagatgaatagtttgcaaatattttcttctattctgtgtgttgtttcttcatttcattgattgtatcctttgctgggcagaagctttttaactcgatgtgatcttttttgtacatttttgctttggttgcctgtgattttggggtattaccccaaaaatatttgcccgaaccaatgttttggatagttttcccaaagatttcttttataattttatagttggaggttgtagacttaagtctttaatccttttgatttgatttttgtatatgacgagagataggggtttagattctttcttctgcatgtggatattgttttcccagcacattttaatgatgagacagaaatgcatattcttagcatctttattaaaaatgagtttattgtagctgagtagatttatttctgggttctttactcttccattggcctgtgtgtctgtttttatgccaataccttgctgttttggttactatatttctgtagtataatttgaagtaaggtaatgtgatttctcctgttttgctctttttgcttaggatggctttggctattctgaatcttttgtggttctctgtaaaattcagggttattgtttctgtttctgtgaagaatgccattgatgatttgataggtgctgcattgaatctgtcaattgctttgagtagtatgaacattttaacaatattattcttctaattcttgaacatgtagtatcgttccattatttgtgtcctcttcagtttcttgaatcaatgttttatagatttccttgtaagaatcttttatgtctttggttaagtttattcctaggtattttattttatttgtagctattatagatgagattattttattgatttctttttcagattgttcatgatcagcatataaaattgctacagatttttgcatgttaattttggatcctgaaattttactgaatttatcatgtctaatagttttttggtggagtctttaggcttttctgaatagaacatcatatcatttgcaaacaaggataattttcctttttccttcccaatttgaaacacattttatctctttctcttctctaatggctctagttaggagttcaaatactatgttgaataatcgtgaagaaagcgggcatccttgtcttgttccagatcttagaggaaaggctttcaatttttccccattcagtatgatagtagttgtgggtcttttgtgtatggcttctattgtgttgatgtatgctccttctataccaagtagttttgggtttttatcatgaaagtatgttgtatttatcaaatgcattttcagcatcaaatgaaataatcctatggttttatccttcattctgttgataagatatatcacattgattaatttgcatatgttaaatgatccttgcatcctaggagtaaatcccccttggttatgaggaataaatgtatttaatatactgttgaattcagcttgctagtatgttttaaagatttatgcattgatatttatcagagatatgggtctgtaattttacttatttgatatgtctttgtctagttttggtgtcagggcaatactagcctcatagaatcagttagaaagtcgtcctttttcctctattttcataatagtttgagtagaattggtattatttctctttaagtgtttgataaatttcagcaatgcagctattgcatctcaggcttttctttactgggagactttttattacagcttcgattttattacttattattggtctgttcaatttttagatttcttcatggttcaatttttgtaggttgtatatgtctagaaatgtatcagtttcttctatgttttccagtttggggcatatagttgtttatattaatctccagttatcctttgaatttctccaggattagttgtaatgtgtcctttgtcatctctgatattatttatttggatcttctctcttttactcttagtctggcttatcttctgtcaattttgtttttatttccaaaaaatcaatttttgtcttgttgcctttttgtattatttgttttaatttcatttatttctgctgtgatctttattatttctttgctctactaatgttggtttcagtttgttctcgcttttctagcaccatcaggctgtttatttgaagttctctgctttttgatgtagatgtttatagctataagctttactgcttttactatgtccacaggttttggattgttgtgtttccatttttatttgtttcaggacatattttagttttcttaatttctttgttgacgtcttggtcatgtagaagcatctcggtcatgtagaagtgcttgtatggtttccaaagtttctattattattgatttctagttttattctattgtagtccaaaaagatgcttgatattacttatatttaaaaaatattttaagacttgttttgtggcctcacatgtggtctatctttgagaatgatccatgtgctgaggagaaaaaaagtgtgctctgcagcctttcgatgaaacgttccataaatatctattaggtcatatagtctatagtgcagattaggtttaatttttgttgttgttgttgttgttaattttctctctggatgatttgcacaatgttgaaagtagggtattgaactctccagctattactgtattgaggtctctctctttaagtctaataatatttgtattatataattgcatgcttcagggttggttgcatatatatttataaatatatcttcttgctgaattgacccctttatcattatataatatccctctttgtcttttttatgttttttgtcttgaaatctatttttttctggtataagtgtagctactcctgctctttatctgttttcatttgcatggaatgtctttttatatccctttatttttagtctgactatgtctttacagttgaaatgtatttcttataggcagtagacagttggggcttgttttcttaatccatccatcctttccttgtcttttgattggagcatttaatccatttaaatttaatgttattatttatatgtaaggacttgatactgccatgttattatttgttttctgtttatttttgttcttcttttcctactttgctttcttcctgtcttccttttagtgaaggtgattttctctggtggtatgttttaattttttgctttttttgtatgtgtatctgttacaatttttatgatttgaggttatgaggcttgcaaataacatcttataatccacaattttaaactgatgacaagttaacatggattgcaaatataaactctcaaataagcaaataaaaatgaataaaaactatgttttaacttcattctacccacttttaaactttttgttgtttctatttataacttattatactgtctaaatcctgaaaagttttagttcttagttttgacagtttcatctttgagtctttcttctcaggatatgattagtttacaaaacacaattatagagttacaatattatgtatttttctgtgtagttactattaccagtaagttttgtcccttcaggtgagttattattgattgtcaccatccttttatttcaggttaaataagtcccttcagcattttttgtaggacaagactggtgttgatgacataccctcagcttttgtttgcctgagaaagtctttacttcatttaatgtgtgaagaatatttttactagatatactattctaggataaaggttttttttttttttcagcactttaaatatgtcttaccactctctcctggcttgtaaggttttcgctgagaagtctgctgccagacatattggagctgctttgtattttatttgtttcttttctcttgctgcctttagaataggctttttatccttgacctttggaaatttgattattaaatgtcttgaggttgtcttactttagttaagattgcttggtgttctatgaccttcttgtactttaatattgatatctttctctaggtatagagaaaataacattctctgttattttccctttgaataaactttctttgtctatctctctctacttcatttttaatgccagtaactcttagatttatccgtttgagactattttctagatcttctaggcatgcttcattttcttacttcttttttcttttgtctcatctgattatgtattctcaaatagcctgttttcaagttcatgaattctttcttctgcttcatcaattctgttgagagactgatgcattaatcagtatttcaactgaatttttcaactccagaatttctcactgatatttaaagaaaattttaacatgtttgttaaatttatctgatatgattctgaattccttctctgtgttatcttgaattttgttaaattcaatttttttctcaaaaaaaaagtattttgaatttgctatccaaatggtcatatatctctgtccctctggtattggtcactggtgccttatttagttttttgatgtcatgttttcctggatagtcttggcccttgtagatgtttgtcaatgtctgggcattggagagttagcttttcattgtaatcttcacagtctgggcttgttttaacccatccttcttgagaaggctttccaagtattcaaagagaattgagcattgtaatcttagtctttggtcactgcagccatatatgcattagtgggtgccccaagtccaggaacactttgagttttgcagacttttagaggtaccatctttgtggtcttgcgtaagatctggggaaagtccctaggttaccagacagagtctttggtcctctctccttactttccctaaaacaaatggagtccttgtctctgtattgcattgcctgggcttagggaaggagtgacaaaaccacccttgtgaccattaccactgagactgtgctgggccaaacctgaaaccagcacagtactgggtctcacccaaggcctgtgatgaatattgccttgctaccactgatgtatattccaggaccaagggctctaaccagcagatggtgcatccagccacacctgtgtcttacctttcagggtgatgggctcccttctggcccaagattggtctagaaatgctgtccagaagctagggactggagtacagaactttagaaatctatttcttttatattactatagctgagctggtagccaagtggcagtacaaagtcccttttactctttcctctcctttcctcaagcaggagtctcttgtgtggctgccaccaccccaggcccatggtgagtattgcctagttattgctgatgtttatttaaggctcaagagctgtttagttcacaggaaataaatcctgccaggcctgggtctttctcttcaggttagcagcttaccttctagttcaagatgggtctagaaatatcatccagaggccaggcgtggtggctcatgcctgtaatcccagcactttgggaggctgaggcaggcagatcacaaggtcaggagttcgagaccagcctggccaacatggcgaaacaccgtctctactagaaaaatacaaaaattagctgggtgtggtggcaggcacctgtaatcccagctactcaggaggctgaggcaggagaatcactttaacccgggaggcagaggttgttgtagtgagccgagatcatgccattgcactccagcctgggtgacaagagtaagactctgtctcaaaaaaaaaaaaaaaaaaaaaaaaaaaaaaaatcatccagaagctaagacctagaacctagaatcagggatattagtgtctccttgatgctttattttaccgtggctgacctggtatccaagtagcaagacaaagtccttttaactattgctcctcctttcctaaggaaaaaggagtctttctccatgacaataacagctgggaatgcactgggtcacacatcaagccagaaatttactgggtctcacccaaggcccatggccagtactgcttatgtttattcagggctcaaggactcttcagttaataagataaattctgccagaactgggtccttcccttcaagacagtgggttctcttctggcccagggtatgtctagaaatgtcttccaggagctaaggcctgaaatggaagcttcaaggctccgcttggtgttttattgtgctgtggctgagctggtatccaagttgcaagacaaagtcctctttatttttacctctctttttttcaagcagaagtagtctcttccagagctgtaagctgtgctgcctgggtttggggaatgggttacataagcacttccttggctgcctcaattggtgtctcactgggtcacaaacaccccaagtccaccggtcctgagcccaacacagcactagaacttttccagaaggtgcaatccttgtgacctagacagcctttcacatttatttaggactctataccccttgagctcacagtgtcagggctagttggaactcaggtttcaacgactggatggagaatttcccttgggctagggctggtctaaatgctccctccgtgggcaccagctgaattctgccctgtcttgctttctgctgctacaggcagcctgatttccaatgcaaactcccatgatcactgtgcttcccccaaccctggccagcacatagggatgagggaagatggcattggaaatttaaggctgttttttctaccctcttcagtttctctttccttgatgtcatgttaaaaccaaatactgctgtcactcagctgatttttttcttttatttttgagacggagtttcgctcttgttgcccaggctggagtgcaatggcacggtcttgtctcactccaagctccgccttctgggttcaagaaattctcctgcctcggaaataaaggccattcaattaggaaaagaggaagtcaaattgtccctgtttgcagacgacatgattgtatatctagaaaaccccatcgtctcagcccaaaatctccttaagctaataagcaactacagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggatgtgaaggactcttcaaggagaactacaaaccactgctcaatgaaataaaagaggatactaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagaccaatggaacagaacagagccctcagaaataatgccacatatctacaactatctgatatttgacaaatctgagaaaaacaagcaatggggaaaggattcactatttaataaatggacatgggaaaactggctagccatatgtagaaagctgaaactggatcccttccttacaccttatacaaaaattaattgaagatggattaaagacttacatgttagacctaaaaccataaaaaccctagaagaaaacctaggcaataccattcagtaaataggcatgggcaaggacttcatgtctcaaacaccaaaagcaatggcaacaaaagccaaaattgacaaatgggatctaattaaactaaagagcttctgcacagcaaaagaaactaccatcagagtaaacaggcaacctacagaatgggagcaaattttcacaacctactcatctgacaaagggctaatatccggaatctacaatgaactcaaacaaatttacaagaaaaaatcaaacaaccctgtcaacaagtgggcaaaggatatgaacagacacttctcaaaagaagacatttctgcagccaaaaaaacacatgaaaaatgctcaccattactggccatcagagaaatgcaaatcaaaaccacaatgagataccatctcacactagttagaatggcgatcattaaaaagtcaggaaacaacaggtgctggagaggatgtggaaaaataggaacacttttacactgttggtgggaccgtaaactagttcaaccattgtggaactcagtgtggcgattcctcagggatctagaacgagaaataccatttgacccagccatcccattactgggtatatacccaaaggattataaatcatgctgctataaagacacatgcacacgtatgtttattgcggcactattcacaatagcaaagacttggaaccaacccaaatgtccaacaatgatagactggactaagaaaatgtgtcacatatacaccatggaatactacgcagccatataaaaggatgagttcatgtcctttgtagggacatggatgaagctggaaaccatcattctcagcaaactatcacaaggacaaaaaaccaaacaccacatgttctcactcataggtaggaattgaacaatgagaacacttggacatgggaagggggtacatcacacacaggggcctgttgtggggtggggggaggggggagggatagcattaggagatatacctaatgctaaatgatgggttaatgggtgcagcacaccaacatggcacatgtatacatatgtaacaaacctgcacgttgtgcacatgtaccctaaaacttaaagtataataataataaaaaaataaataaataaaaggaaattctcctgcctcagtctcccgagtagctggaactacaggcactagtcaccacacctggctaactttttatatttttagtagagacggggtttcaccatgttggtcaggctggtctcgaactcctgacctcaggttatccacccgcttcgacctcccaaagtgccaggattacaggggtgagccactgcgcccggcctcacctaatttttttattcttatgaatgtgctttcacatgtggatagtttttcaatttggttttcctgtgggatgtgggggacaatcgctggaggtttctatttgaccatcctaactttatctttctctatctagttttctcaacaagcaagacgaaattgtagcagttttaaaagagctttgcaaattctttgtcactcctcccattgagaattagggtctacgtctcttcctcttgactctgaactggacttggtgattcacttgtaaccaatagaatgcagcagactcattgctatgtgtcttccaatgctgggtcagaaaaagcttccacttgttttcctttgtttgctctggccaaagtcagcccacatgtaagaagtcaaactactctaggtgttcaaataatctatctagtcaacagccatagctgagtgcccagccaatagttcccatcaactttcagctgtgtacttcttggaaatttagtcagttcaggcttcagatagctagtcttagctgttatttgactacaactgcatgacagatttgtactaagagctacccaggtaagcccttatgaaattcctagcccacagaattgtgaacaaaataaaataactgttgttttacaacattaagttttaaatattttatgcagcagcagtaatcagagagatatgatgaaataataccacctcttaagattgttctaaaaattgaatgacttaatgtgtgtaaaagtacttagaacaatgcttgagtaagtattgtacagagtaagcacctatgccaaaatgcaggcttatattaatatgctggtcaatttccattttctaatgtaatggaaaatagtagattttcaggatgaaatttaaaaaaataaaaattactataataatgaataaaaagtatgtatatgcaatagagtggtttattcactggacagagtacctaggtcttatgatacatttagggacacataaatatgtcttaatattaagttcttttaaaatcagaagaaaaaatctcataatggtaaaaatataataaatacagtttagatgatattcctccttataaaataaattttatcattaaaattttaacataatttttaatattttaggagagtatgaaggcaacgtgcttaaagtccacaaaagtcataatgtggttctgaacatgcacaaattaatcatagattttagagctttttagagctttcagccctgttgttactctaaaattctttcttatatgcctatattttgttttttgaaattcatctgcctatttgagttcttgtccagtttcccactaaggtaaccctgtgtgacagtaatttatgggtgcaaaataaactgaaattcctaatttgaaatgttggtgaggttagaaacgatctcagaagaagcatttaggctgaagaatacatgcttgtaaagagatatgaaagttatcggaatcttatcccaaattcactcttaattttgtgcttagggtggtttccacttaaaatcgttttatctctgaaactataaagttgggtgatctctgtgtggtgttagaattttacatcttcatatcagctcaggcccatttggagatggggaggtttcaacttttgaaaacatcttttaagttggccaaatatatttggacaactgtacgtgtgtttagtctgtaatttatatgaaagtatatctctaattttgttggcattgtatgttgcatcagcatttagagaagacaggttttaagtggtatttctgattccttcagcagaatgaagtgctgccaattattagtctattctgagttgatcttaaatgaggtctaaaaggaaaggcaatttaaaaccctgaaagcactcaacacacccatgcattaagttctgggtaatgataaaagaatagccaaactatttaatatgaatgatatttgaaaaaattctttctgtgtacaacacttatactgctgctgtgaagaaatattagatatagttctcaacaacattgggtctagaaactagttgctgaaataaaaacttacgtatggtgccatgggcatgaaatttcattaaactgacaaaagaatcaggttctgattccaggtccataaagtcataattgaagaattcttatcaaatatattttctccatgagcttcactttcttcttctgctaagttgagaaaattaagctttccccatctgctgcaacatgtgtttatgaggggtaaggagagatataacacatgaaacacttaagcggtaatgtgagagagcagtgttggtaattgttgtaataatagtagcagtgttaatagcaagaaataacgaataaacataaggactgacattttaccgaaaatgcagatttagaaagaaacttcgcagatatgcatttgaattcaaaagcaacattaattaagcatgcactacgaaatggaaatcatactgcccccaggagtatgaaaattaataggaaaggattgctatcattgaagagttttcactctagaagagaaactacacaaaataaatataaaattctataaaacttcagtgtatagtaagaattaccagattactgaactgaattatttaataataattttaaattaggggacccacagtgttcaatttggttttctctaatgatgtttaaaactttatcataatttcatacaagaaagaacattttaatatctcagagaggaatgtcattaccttagaacaaagacaatcagcttagcaactttaaatataattaatcattgtctaaatttattttaatctaccatagaactttgaagacttatgtataagaatacacagctcatatgttgaagtttgggaaaccaaacgaggttcaaaatacagtgagataataaaaagagctgtggctaatttattccatagagttagaatacgtatattttaatagagtattcataaaggaggttacttacaaactgaattgtgaattatgccaggcaatataggatacagaaaggtagaaaaatatagatcatatagcatagtcacttagagtgtgggcatctcttagattattgtgatgattacataatatagataattcatgcaaaaattttaacatgatatctagcacatactaagtgctaaataaatattatgaacagtcttccatcttctccttctcctcctcttctcctttttcccctctccaccttcttcctcttcctttccctcctactccctgcttccctcctcccttttccctcttttttctttttcgttttcttcttattattactattattttatgtagctagtgttaaataggcagcaaggtgtgtgaaaggtgaagggaaatacaggcatgttccagaacagagattattttatgttatactagggatggggacctatgggagagtcaacctacattttatttttaggaagttcttttttatattagtgtaaagaacaaattggttgaggcaagaactgtaacagaaatattagtttggagcctgttgtagagtttaggtgacacagcatgatagtaaactgtggcaaaagtgccaagaagaggaaggtaatgacagattgtaggattatttagggaatggtgaataaatatactggggtaaaggaccccaacacatttgtaaagaaaaagaaaggatttaagatgcatcccagatttctgattcaatcatgctatattcattctatattctaaacacatttcagatattctgaacgaactatttgacatacattgaaagtgaattattattttataagataacactttgatcttcaatatctgaaacaaaaagaacaaaacactttagagactgaactattccacaaggtgggagaaatcaggtttaaatgtctgtaatttctctctgtagagaaaattaaaatgtcagatggtaaaattatgcagtacttgcattggattccaaaattttaaaggggagaatattggcttagttggcaattgttatttggggtttattgatctaaacggacagttttgtaataaggccaacctctgtcaaaaacaaatgcaaacactgctgaaagtaaaatgctagtggcattcactgtcagggagaaatatgctaaaaggcagatttagttaaggaaattataaatggaagcttcaagttctggtctagaaaataactttttagctctgcgaatagcagtgttatccatgaataaaaggtctttgcatttaaactttagttgtatgtaatacttcatgtattatactaatttattactaataaaataaaaaggctgaggtgaagatgtactaacaatttattggattgtccagatagtattgctatgaaatgcgtccgtggcaattgtgacattttaatagatgatatctaagatgcaagaagtcaacctatcttcctttaaaaccatgaggagagtaagtttaagatactaacagaatcattagttcctaaaagaattccaaaattatcttcaggcttaaggatttcgaaactttcttagaattttggtttaaatccacatttcaaaattatgtcactgaaagaacagactactgaccccagcgaagagcaaaattattcattttagtactattagcctagtagtcttcttaggaccccataaaacaatgaagggttctaattcccttgtcctgatttttacccagaagaaaaaaatgtctgagtgtaccaaaacatcttttatgatatttcaaccaaatgcagtttcaataaacagcaaacgaatactttagataacctggggctgaggcatggtatatgttgaaatgaacgttaagggactctgctttctttaaccaaataattggcagtgtttttaacttataagtaaatagaaaaatgaattgcaaaatgacaacctaatgaaacgaattgctcctttcaagtcttttggtcatttttaattgtaaaatgtttttgttgctcagttgtagaagttctttacctatggtgagccttctatcacgtatatgattttcaaatgttttcttcaattggccgtagatttttaagcaccgtgagatcaagggccatgtccatttttttcatcaatttatttgtccccagtggctggcatatattataccacttattcataaactttcaattatatgtttacattttcaaattatattttaaaactctgaaatttaaaatgtcaaatattaactataaaaatctcatctcctgatgatgagaaatatcatttttatttgaatcttcattcttctgtcttttccaaatgttttcctttgaaatatacatgtttatatcagaaagatattaatcctgcccaccacaagttcagtttagagaagaaatttcattatgtaaagaaattaaataatatttgcagctacaatgagaactctcttagatgtcctcagtgttgaattagtgggacctccttaatattcttgagaatgtaagtgccagacagagggctaagtattttgaatgaactgatactcttcttcacaacagcatttagtggaagacaccaatacattattttatggatggagtaactgaggtttaaagaggttaagtaaaaacctagacaaacaaatagttattaaagctagatattttgtataaaatcttattaagaacttgcctcctattacactaaattttactatcttaacaaaaggaaatttgctttatctaaattatcaaaagtgttcattttttttttattcagtcagaacagctctgagccagtactctaattattcctcatgaaacaatcaggtaaagcagaatagtctagtaaaaaccaaaggacttttttttcagaggacatgcatgaattaaaatttaggaaaatatcaatgaaaactgcatgtgcctaaaaagggaaagatcttgattgataattatttgtttcaaaataaaattacttatattttactgtaaaaattttggtgacttttaatgttgaaggaaatgttaatcgtaagtaaaaaatagaacattcaaatattcattataaaagtaaatgaatgtaaattatcaccactttggttaagttataatttcctgttaactaaggaagaaaaagacatgtagaattatatgtagctgttatggttcaaacaaaaaggatgcaaattattttcaggatattttccctgacaccaattctagaatgtattgattatgcagattttgatgtaagggtgattaaataacacaaagagcaattgctctaacttcagctttacagaggataaagggcccttctgatagacagtacatgtattcctttctggaaaaatgaaactgtttataagtaaatctacatatactgacaatatttccacagtggccttgaatattataatctagacaaatccagaatctgtgacattaaaaagagtttaaatagcttggaagaatatttcacatgtttccagtagctatctatttattgtaataattaccttggaaaagttttaaaaattcaacttccaagacttaaccctggacctattgaataaatatttcttcataggacccatgaaatctctctaaattatcaaatattattattgataattttacaagtatggattgcagtcattttattttataacagttcataaaaggttaatattttagattaattacataaagaagtcatattgtaaaagcaggctgtaaaaatttaaaagttaaggcagagttaattaaaattttaagagagaacgtgttttttttttggttagtttctacatgagtgtatgtatactagccattaaaaagtaggtctgaatctgcaaacgcatgcagacaagcattgcaatgctatctcacagttgtaccaaatagcagggaagcaattctctggttaccataaccatgaaggaataccagtatggcttcttcaaaatgtattgctaagattaaatattacagcccaatttttgcacatgttgcattaatatctccatttaaaataatattaatgtttaaaaatcatacagtaacaccacttcatttataaaaattaagtaactaaaatctctgtagtaggaatattttattgaagaaattgaaaccctatagtaaatataaaactatgcatttaaatgtttccaataagtttgtgaaaacctatagataaatatgtttctatttactaaaaacaaaacaacaacaaatagccacgtgttatctaatgatagggagctggacgttatccttatgccactgtataaatgacactcactaatggccataattaactgtaaatgcagttatggaatgcactgcatttgacttgggaatgtgactggtgattacaatttaaaaaattaatgacacacctacaagcacaccaattaccaacacaagactcccgttttcatatacaatatagaaaaatagaacattctcagatgttcaacaataccaccaccaccagcagcaacaacagcaaagctgggcaatcatcaaattcacaactattcttgaatccatcaatgaagtaagatcacaggccaaccaagtaactccaaatccatggaaagacaagtatatctaaggacagatgcagatcaagcagttgcttatctgggacagacaccagtggtcagctaaatattttgagaaattcttctccataatgctatactttgatgtttgtcccttccaaaattcatgttgaaatgtggttgccattgtgttggtgttggaaggtggggccttcgggaagcaattgagccatgagagctctacccttataggtggattaatgccattataaaaagtccagtttgttcctctcatgactttttgcctgttcacctttcaccatattagggatgcagcaagaaggctctgaccagaagctaatgccctgatcttggacttaccaacctctagaacggtttgaaaataaatttctgtttgtttttaaaatataaattacctaatctgtggtattctttgtacacaaaatgaacttttaacacaaaatgtactaagataggtggggtatgtactaacgacagaatatagatcctctgggaaggagaatgcatatacaaagtgaatgcatacctacttacaggctattctttagagacttctccaagtgctcaagaaaagtattggccaccgtagtgagaaagcatgctttgttgtatggacaaagaagaggcaaacagtagccactgaaggataaaatgtcccagagcaactagagaaaacaccccagctctctcctacagaaggaaaggcttaagccagtggggaagtcgaggggatagggagctgaagcattgtccttccctaaaggcattggtgaaaacccatgatagctggagaaagagaatggaacaataaaataaaatacctacactcttgagagaagggcagtaattcatgctgggtccaggtatacagcagggagtggaacagcctttgacaaagcctcactgcctgactgccgggtccgacccatagaccctgacagagtgacggatgaaaaaatgcactcagacacaggtatccagtgaaagagtgggctaggggactgagccgctcacagaaagagttgaagcagctgcagccctgacaagctggcactgcgggcatttatttagtacagatttaatgacaaaggctttgagtcaacacacttgcaggtaatcaacatggttgccaccgtccccctccccctgtgcccccccaccacccccagcccccattgagcagtcctgcatgtggatgattacaggccaggttccaaggcctaagtaaactaatgtgtctagatcagtttctttatacccccttgttatctaacctaagctttcaggcaccaggtaagagaatctggctgccttcagccaaatccttttccaaagcttttgtaaaacctcctggacttccaaggaggtttgcttctttctataatttcctcttataatttttcccaccacctgactgaactcctataccttccccttttctgttttttatatcaggtttgttgattgaagagtacagatgtgtgcagcaacaggtctctcaggcatggtggtcactgcttgtattctggctttgatcctagaattagtaaataacataagacaaacatgagtataattagcaacattcttttccaatcaagcagtgacctgcagtgttacttggcatttcagtttgatgagtgctgttactaaggaaccccactaggggtatgttaatccctcttagctaagcagtcgcatttgttagaagctgggaagggggtgtttgtctaagtaacaggacagaagaaaggcagatttagaagatggtcccaatagagtgtagcaggtactggttgcaggtagaatgagagaatttaaaaggatgaataaagcatagcaaggagcaaattatctggagtgaatggtgtctgtgtctggagtaggatttgctcagtcttctgacttgtctttttcagcatcatgtctggggcctgtgtcacctgaggaagccgcattgcctggtgttgttggtcctgtagggtcattttctttattactggtaccgggttgggtcctagccatgcaatggtatcgtttgatgtgtcgtgctggaatccaaagaggacctgagggaatgtgaacacaagcatatcctcttccccatgttaacaattcatttggaccacaccatacattactgtttacatgttaccataaaactgcaggttttatgtcttgagaggttttagcaaagtgcttttctacagctgattaaaatttatcatctaaattttaaaaattaaggtaaataaggcttgtgccaatagtattgcaagatccttactcatattccccttttttttttttgttttctgagcatatttttaaggatggaatggacacgttctactatggcctgtccttgggggttatacaggatgcctgtggaatgttggatgttccacatgtgaccaaattgttgaaattgtgagctggcgtaagccggaccattgtcagatttaatttttgtgggctgccccataaatgcaaaagttaaaagaagatgtttaatgacatattgggtgaactctccaggaaaagcatgagagctaattaagtgagaattggtatcaatggatacatgtacatatttaagttttccaaattcagggacatgtgtaacatctgtttgccataacggatttggttctagtcctctagggttaacacctcttgaaggaggggacatgcttgtgagctggcaatctgggcattgcaggctaatttgtttagtctctgggtaagttgaaattgttaggtaagtttctccagttttggtggaaaaattgatgtgactgggtggcttgaccaagcactgatgtcataacttgtaggtttgcttgatcatcgacataaaccaatgggccaggcagtgagatgtgggcccaaatgtgtgtaataaaaataggatgtgtacgttgatctagcaattgctgaaatcaaagaaaaagtacacgcagggtgggctccagagtggagttaatgagggctgtctctgggttctgcaataaataaacagagtaagcagagtcactaacaatattgatgagctgagtggaaatagttttccaaggccaatattaaggctcccacctcagctctctgagttctaataaatccagaacgagtgagggaattatgcaatctccaccaaacagctgcttttccatttttaccagagtcatcagtaaacagtgttaaaacattaggtatgggggattggactatttttgtaggcaaaaccacagaggtacgaggtaaaaactgaagaagttttttagcaggaatggcatgctctatatggcctgtataatcagagagtgctatttgcaggtccatagataagggcaacactgtttcgaattgctttttagataaaggaattctgatgatatcagggtcataacttagtaatagattgcattgtctgcggcctgaatggatgactttactaactaactggatatagggaaagagtgttttagtcccagtatgtgagcaaaaaacccattctagaaagcatagctctgggccatctgtcctattaaccctgtaggggagtgtttagtgggaaaaacaaataattgaattgaataccatggatctatctgatccagttgcctctgagaaatagcttgctctacttcctcaatttccctttgtgctgcaggagttaaatacccgggacagtctagggcagcattgccttttaagatagaaaacaggttctataacttatcagtagttatgcctaaggtggggcaaagccagttaatatggcctagtgatttttgataatcatttaaggtgtgtaagttgctagtatttaatttaaccttttgaaggtcttactgactgggaagttagtatgtacccaagatatttccaagaagacatctgtactttttcaggtgctatgattaagcctcttaactgtgtattctttacgacagaggcatataactttaaaagtactggcttcgttgggactgctacttaaatatcatccataaaatgaatcatcttgaaattaggaaattcttttctactggggagcaaagcctgatttacgtgatactgacacatggtaggactgttcagcattccttgaagaagcactttccaatgaaattggcaagttggcttttcattattgatggctggtattgtaaatgcaaatttttctctgtcctgtttgcaagggaatagtataaaagcagtcttttaagtcaataatgattataggccaatcttgatgaatcaccatgggggaggggagcccctgctgaaggggactcataggttgcaaattagcaatgatagcacataagtcatgcaaaagtctccatttaccagactttttaggaatgatgaaaatgggcgaattccaagggctgttggatggttctatatggccagcttttaattgctcctcaactgtctcatgggctcttcgtaatttctctccctttaaaggtcaccattctacctaaataaggttttgagagagccatgtcaagggtagtggaggagtaacagtggctactattagaaagaggtctgtagattgacctcaattaactcttttataattgggctagaggctctgttttctctaatgcccttttttatctgtttgtcttgttgatcttgcattgcctggcaggctaagagctccccttctaatgctgcttgcctaagacagggtcccatcgctgtagcgtatcccttgtcttttttccaatttattggaagagggggctcaggcaaaacctccatttcctctttgttatttttgtccagaaacagcaaggctgagggagatggaggcagtaaggtagttgacagttcctcctcccttccctttttaggctcttctgtgtagtgtgggaccagagccaccctacctaaagcccataatgttagagatgttactgtgacccattgcccttgcatatgatgtaagttttctccccactttttcccagatctctacgtctagtgtaccttcttctgggaaccatgggttatggaaaacaacagttttcattaggtcccttaattgagcctgtgaaaccaaagctcctctagctttaagcagctgtttcaatacttttatatactgttgctgttgagctgataactgttgtcccatgatgaaaccctagcctgaacacttccctcaaacttggaaatcccgagcaggcaccaatgacttactgacttactgactgcacagtctcttcacctttagttccaaaggtttcatcacgatctgttgtagcattcctcatgtggggcaccaccagctgggtctgacccacagaccctgacagagcgatggatgaaaaaatgcattcagacacaggtatccagtgaaagagtgggctaagagactgggccactcacagaaagagttgaagcagccacagccctgacaagctggcactgtgggcatttatttagtacagatttaatgacaaaggctttgagtcaacacacttgtgggtaattgacatggtcaccccaaccagagagagcagtcctgcatgcggatgattaaaggccaggttccgaggtctaagtaaacgaacatatctagattagcttctttacgtccccttgttatctaacctaagctatcaggcaccagataagataatctgactgccttcagccaaatccttttcagaagcttttgcaaaacctcctggcctttcaaggaggtttgcttctttctataatttcctcttataatttctcccaccaccctgaccaaactcctacatctgaccctcaggatgaggtacctgcctaatacttagacttaatcagaagagagaaagtccctgtccaacatccacccctctctaccccgaagtcaatgagcactgaggaagcagagacagcttgaatacctggaagcagggcaagaacatggagaaaggccctctatggaacagcacaaagaaaagatctaaagctgaaaatggagcagacatggggggcaaataaaaacaaaacaaaacaaaaatgtctctaactaaccactctaagcactgagtgccactatagaaaattagaacctgtagagctctgtcataaccaaacccagctcaactctgaatagatggacttatctcctcccacttcctccacctggaaggcttagctggaggtcaccacaggaggtttaagttaaggtttttctggtaatcagaaagtttatagaagtaaagtcttttacacttgactttttagtataaggacttgatagttgagctgtggggaaattgccatttttgataataaacaaagcaggtaatatatttttgttaatgaatatttaattttgatggaaaattttgattaagaagcaggggttatgaatattagtgccaaatttttcctgttaatacatattttcctcagtaatcttcaaatcattatcgtattaaatgatgagtgtcggtatgttgattattttgaaagttaatatatgaaggtaaaaaagaagttacagtgacacagggaagatttatacatgcagatcacaggcagtttcttggatcatgatgcttccaatagaacttacctatgtgttagcttgactaatgttttggatacacaaataatcctctcaggatttgctgaaatagatcctttcttatacacagtatttgcagtcacaaagaatcatatgtagcagccagcttacagccaggggaattgggtagactataaggaataagtgtaaaatagaaattttaaaaaaacttcttttttagtttagactggctaccagaatatagttcattctcttcaatctattttataataattttattgtcataaaattaatatttaacaagtctttccttgtgacctatttcctgtcttgagaaacgcatagatcagtgaaggaaacatacatacacatcaccatcatcattatcatcatcatcatcatcattgtcgttgttgtagttatcattgtcatcttaatgtcatgtggtaaaagcactgagggagaaatgcccagggtatgttgaaaacataaaaattgaaagaattaatctagccctgggttgaggtaaaataggaggaggttaagttgtctgagaagacttcgtgaatacctaatgtgagttaaactgaaaaatacatactcggtaaaaaaaaaaaaagaatgaaaaagtgtatactcaattctcattcttctcaagttgatccaatacaaagggagagacagatttgatatctctttgatttctcctgatgtttcataagaaaaaaaataatgccctcgttcctcactgtcattcacaaacatagattgcagcctgggatagacaactgcactgttcttgggttttaaaaggtaattttgaatagaatacaatgcatcaaattgtttcacacttagtaagggcaaatagtatatactgtgaaactttttattcagttaagtatatgtgtgtattctgggtccagatataaatgcatttcttactagcttttggtttataaaagtttaaaagcaagtatcctggcttacctgttttagcttttagacattaagcattagaacaaacatttttgctactagaggctattctttgattcagccattttccccttggtaacaaaattggaagatcagagatgaatggatttggagccagctgactgtaaggtctaatttgctcttaggttaattaggcttaccattttttttttaaatcccctgattccaatgaagcttactagaattcatcagctcttcaagagcaatctcttgcctcttttgccatttctgcctttgtgtacacttgtttggctacctcccaggtggaagagtaactaaaatatggcaaatacctggtgtctgtacatcttcatcttgtaatcaccaaatgggtcaaactaaggtcatcaaggagacaatattttatgttctctggttaaggaatttcatagaactttttctatacataggatcatgttcacacacatatacatatacatatacatatacaatgtattctcttccctccaaataaaatattatttaatatccctaccagaggaaacaaaagcacaataagtcaattaattgtcactacaaacaaaaaataataatgttaatagttattgtttattggctacagcacatatgctattcctatgcttactgtagccctgcaataatgtaattattagtcctgttggaaagatgaggaaacccaggttcaagaaatttcagtaaccatactgattcaaacattcattatcagttgctaaaaggattttaagttagatttagctcaccacaaatggcattttatctgtctgttaatactcctacttttaatatcaatttttcatttaagatgggtgttaatatctatgcacattaataaataaagatgttcatggggtgatataaattattatatttttaccacttttagtttatagattaagggagaacaaataagtctagtcttctttatgtttgtagttaatcaagaaaaatgcaaaaaacttgtttaaagactcaaggagctgtaagatacctataacaccggttgttttgatatgaattttaatttgtgactctcatattttatttatcattactaagatttgctcccaccattttaagaattccactgcttgatttagaatttgtatttgggataacagctccaacaggcaatcataccagttaacatagacatggaaattaagttatattcctgtaactgcaattgagatcagagagacctgattttcatactatcattatttttttcctaatcagtttcttcactgaatgactgtttataaagattattatatttatagaaggggtatagtatatgaaaaacaaatttaagcacaaatgttagcaaatctatacattctaggaattttgatttgcttcttcaaatctaactacgaatatttactcttgtaagagtaaatacttgtaagagtaaaaacttgtaagtttttattttactgaacaactgtgtgagcacataaacttcgtatttagggctctttagttcatcatgctcagaaattctgagaggttcatcagtgaattttattagaatctgctaaaccagctgtctagctaaactgaattagaatctaagactcccagttatttactaatatctttgtcttcaccacaaagttaaaatcaactctctcacttctccatctctattctatggcagtcactgaaacttacacttatagcagtggttcttttattttagttcataagaatcacactaaaattacagattccttatatacagggattctagcttaggaagtctgatatgagtcataaatatgtgttttgaaaattttccatatcctttgagataaaagatcatggattcctttttgagaaacagtaatacctaatcccttgtccccaaagagcacagtgcagaccactgcagccagccttgagacctagttcaaagttcaggccaggtctccttgccgatattttgtggacccagcatagtcacggatctcaccattctttactgactcctggttgtgccactgggcacaaaatagattaagttaaaatgagtgtttctccaatgtgttctgctttccaaaaatcagttaaaaataatacaatctgacaataatacaactttgtcactttctattgtcataattgctttttgcttaacatttattgaaacaagacgtggagcaggacaagaaaatccccctctgtacctgtctgggacctctcccaaatccccttatttatagttctttaggcgttgaagaaaagattacttacacccttgtttttcggcaatataagacagtttcacaaatcatgaaaactatttatgtccttctgttcctgtaggtaagcgcttgccctgtctatctgactgaaggtgacagcaaatattttttaaataaacgaaaacagcttttgggcaatttcaaatatttctatgtaattttaaagcaaaacaattctgtataattgtgcgctttctcacacacacttaaaattatactcaccaaaggtctaaatatttatggcaatagtctaactacattgatatcactggaaatcattgttaggactcaaaataggaagacatacaatgaaaaaggccctaggagttgtgtcctgtcttttcaatatctttcaattaagctagttcgttcgtttctgatcctcagtttcttcaaatttaaagtgggtgttgccggaagtggcaaactgctgttaatgaaaaatattgtatttattcctactttctaacaataatgatacaattaagatcagtgagaaaaataaatctttatttagttcaatacaacttacaaatagagagggggagagaaattaaagagaacaaaattccaaagcctttgtcatatcttctctatgatggacacttagacccagagtagatgggtatttgtttgtctgagcatattaattaatcactagatatctaaagagtagttggaaacagatgcttggattttctttgtaagaagaacaagaaattgagttcccaaacttatatcttgaggaagagataagtgagagagtaaaaggtgaaaaggagaaaatgaaagaacgacccaaaatcattgaaagaggaaattcacagtgaaggaagcagggatggtcaaagaactttaaaataaaaaacagaacatccaatatttgactttaagttgatgctgtgtaatgttgttttattgctattgccttcaaagtttcagtaagtcagccaaatacagcaaaccttgtctcttagtctgttttgtgctactaaaacaaaatatctgagactgggtcactaataaaaaccaaaaatttatttctcaatttatttaacaattctagaggctgttaaattcaagatcaaggcaccagcttctggtcttgtgagggccttcttgtggcatcatcacttgacaagtggcagaagggcaagctaaatgaatgttgtctaaagcttcaattataagagtcttgatcccattaacaagggaaaaccccttatggtctaatcatctcttaatactgcaatgtgggcaaaacctaaattttggagaggatgcattcaaaccataacaagcctgtatttcttcttcatagttattgcaaagcaaagtaatcaatcctaaggtgtgagctgtaagaaaatagaatatttagcaggtattggtaatttggaagagaaataactaggagacatacaagctttctgataattctgggagatactaggatagagagactgggtttccctaacatgtctgaaatgtgaatttaagtaattttcactcaaataaaattcgatgcataaattgaggaactagggattttcaggcaactattagttatggggatttcattatacccactctctatttcacagggcacatggcttgttataaggctcaaacaaaacattatgtataaactcttattgtgctttataaggtcataatcaagtgtgttcataaaatcatctgaataacataaaggctcatgattacagtaaatgtagaagagagattttcaaatatgttttatcacagaacacactccaattaattaaataatttattgttatactattttgatgttttaataaatgtctactttaagccagaaaacaatgacagataataaaagtgaatattcataggaaacagctagtgtgaatgcaggggaacctaataaatgtttattaaaaaccttcaaagtctaaaataatctttaaatactctagaagtcacataaatagcaaaactaaattaaattaattttcagtgactttaaaacaaggcatcaatttgttgctgctgccatgactgactgaatgtatctcagggtgggtaggtgggtcacggaccatcacttgaagtacaattctcttgacaattcagtcatctttaaaaattgatttcagtagtttctatatgaaccagagacaactcataacatattactttgttaatgcaaacttctaggctaagttatctattgatgacactacaattaaaaaaatcttctaaaattataaataaaatttaaagtagaatgttgaatatcacagaagagttaaagtcaaatgagaaatgatttttcagtattttaatttgaaactaaaagtagaagtgagatatatatgtgaaaaatatctaacaagcataatcaagatgaagcttatatatttattagttaaaataatattttttaaattaaagaggtttatattaccctaaaactgatatgcattatctcagaaaaaaaaacttgagctgaaaattaaaattataaaactattcagtgaaaagcaaattataaggtagtacatatttatacatttgaacatttatgttactccttggcatgctatgaatctgacgttagttttaatcatttattctttcagactgtaactaatttgctccattacccacacatacagatggatgggtggatgcatggatagataggtccatgtatagatatatacatacagtactcataacttgaaaatgaagatttttgtaccactctttcttgtcaactccaactaatgagtgataataactataatacagccccaactcattgtcaagaaaggcaaaatctaaaagcttagtatggttccaaaaatattttttaatgttttttctttgccgtttaaagcatgttttaagtgtttaacaatgatttgaaggattactcttcattaaaggaatactccacaaataaaaaataaggctaaaaaatcaaactactgctgatctctctaatgaagaggctcaaactctaagattaaggtacacatagaaaagaatgacagtagttcaagcaagagagccataaggtaggagaaactaccaagcatctgttctcagtcaagcatccaccctttaagatgcttctgatccagctgtaatggcactttccccagctcgcatttcatgctgtatatccatgagaggcaggagagtgcaatggctgggtgtggcctctggcatgagctaacctgactttgaaacctgaccccagcccagtgagttaagcaagactttttctgtccttaaggtaatgtcttacttttggcatgcatatatgcagaactagactttgaattatccatgctttactcattttttatcttttgcatttagcacaatgtataagcttttttatgagaaaggaaagaaaaaggtgagagaggatataaatttctgtgggttctcaagagtttgtataaaaattggattatgagatggttctgggtagattagcattaaagtgatcctatggatattgagacattgagaatctgtacctgaaatttactattgatatattgatgtccacggccaattaaacatatagaagaggatctatagttctgattagaacacacattttgctttaggactgcaaccagaaaaaaaatgccccacagaattatctttagagattaacaaaggtttaaacttgccaatgaaacaaggtagggaaaattaaagttttcacagaataaaacagagaaacaaattttctttcaagcaattgtttaaaagaatgcacctgtagtccagtttagatttttttccaagaaatcatttaagatatcttatgggaattatgaggaagaagagctttctaaggttttggaaatgtgacagaatagattatcagggatgtaatttcaggatggaaaattgtcaagtttattcaaaagtgacatatctcttatgaggaaaaaaacattttttaaaattttatactgacttttgaaaaagttgaagcaatttaaaattaatatggaacattatgtatctcttgaatattaaaaaagccatatttattttcttcctttcttttttcttcccttttcattcatttatttattcattcttcagaaaatgaataaaggttaatgaaaagtttattatgtagaagggttttttatgtaaaaggcacttttcacatcctggagaaatgaagattagaaagtcaaaacatcttcaaaaaacacagtttagtcaaatgggaaaaataataacaatgaattgtattaatatacaataatattactacaaaggatgattataataattgactcattcaggagtaaattagtgaattagtcagaaaaaagccatataggtaaatgactccaatgatactgggattaaaagaagaaattttacaactagaaagataaatgtaaccattttagcatagagaccaatatattctaacaaaagaggtaaagaaaaaccccacataatgaaccatagtgcttattcattcatttttaaaaatctttattaggttttttgtattagacactgaagatgaacagccaaaaaatacggactagctctccttcactagaatatcatgtgggaaacagacaagtaaaattgagtaatcacaacacctaatcataattgctaggtaggggtaatacagggctttaaggatggagagcaaagtacatgtaactcaatataggtaagatatatttcacaagatgttttttataaaaaggaacaagaaaaaagtctctgccattgtcacttaatgtattagctctattcctctattctcttttctcccctctgggacacaaagtgtggtatactagacattttgatggtaccccaggtttcttgaagcttttccatcttttttcctctttattttacattgcatatttttatggacatgctttgacatcactaattctctgtttttgtgtattctgtatattgctaaacccatccaatgagtttttaatttcagatataatattttttagttccaaaatacatttgattctttcatgcaaattataaagatatgttaaaatcttccaagtttttcattttcatttcgcatctttgcctgtttttgtatattttaattattttaagatatttatcttttatctctagtacctgaatcaattatggatatcttctatgttatagtttttctctttctttttggtcatttgttcctacttcttagaatgtctcatttttgactggatgatgaaattgtggatgacaaatttagaaaatattagtatttatgttttttataaagagaaattaattttattctgaatttcttctgaaatccagtaacaattgatcagcttgatcctgcctttttgctgcttgtttttcaagtaggtttattttataatttcccttactcctaaggtgaagcacttattcctaggaagttacttttaaggtatacctcttgctccaagtttgtggccttatgggtttttagctaaaaactcatgtggtttaccataatgtctccacattggtaaaatctgaaagtacaaccttgctttctaactctctagagcatctaaaatctttcttcagtatcctcccagctattgtgttgtactaggtatcttaaagttatgcctttattattgtatatgctcaggagtccaaggcttgagtggtgtttgcatatagatttaagggctccttctgtagagttcttccctttatgggttcgtatttcttaaatcacagccatttgatggaactagactataatgtctccaagttcaggaaggctgctgctttttacatgcactctacttcatacacaatgatttggtaatatccttgaggaaaaagacaaagtgaatatggatattacatcacatctgccctctgtcaaggattataggtcaccaagtcctgtgtgcattgatcactttccaa

SEQ ID NO: 443 - DNA, 43015 bp, Homo sapiens
tgacaatcattttctttcagcacttgaaaaatgttatgccatttcctcatggccttcttggtatctggtgagaaatacaccatcattcaaatcgtttttcttctctacataaagtgtcatttttctcttgtgggttattttctttgttttagttttcagaagtttttttctaatgtgtttggtgtggattgctttgtgtttatccttttgagtttcttcaggttcttgaatctgcatgttgctgtcttttgctaaatttgaacatttttagccactatttcttcaagttttttttcagccctgtcctctttctcctctcctttcaggactctgatgatatgaatgtcagattttttttggtgtatgttacaaatcgacatgtccttaagcctctgtccatttttttcagtctatttttctctctgttgttagtactgagtattttttttttgttctatcttaaggttcactgattcttttctctgtcccctctattatgctgttgaatccatcaagtgagttattgtatttttctgttctaaaatttccatttggctctttatcttctagaaatttccatttggctctatatcttctagaaagatatagaaatgtattctatttctttcctttaacctactatttctttacttacactttcctttctttttttatttgtccgaagcctgctcatgaattgttcattaaagtacttttatgatggctgttttaaaacctttgtcagacaattctaacatcttttttatgttggtattggtctacagagtgtctttttcattcaactcattttccaatttcttgcatgatgagtgatttttaattgaaacttgtaccttttgaatattatattttgagactgagtgttatttaaatcttctatttcagcttttctcccccttgatatggtttggctgtgtgtcctcacccaaatctcctgtggaattgtaattctcagtgttgggggaggggtctggtgggaggtgatttgttcatggaggctgtttcccctttgctgttatcatagtgagtgagttctcatgagacctggttgtttgaaagtgggtagcacttccctcttcgctttctttctattctgccactatgtgaagacctatttgcttccctttcacccttctgccataattgtaagttttttgaggcctcccctgccctgtctcctgtacagcctgtgaaactgtgagtcaattaaacctcttttcttcataaattacccagtctcaggtagttctttatagcagtgtgagaatggactaatacagaaaattggtaccagagaagaagggcattgctagaaagacacctgaaaatgtggaggcaactttggaactgggtaacaggcagaagttggaatagtttggagggttcagaagaagacaggaatatgagggaaagtttggaacttcctagagacttgttgaatggttttgaccaaaatgctgattagtgatatggacaatgaagtccaggctgaggtggtcttaggtggagatgaggatcttacagggaactggagcaaaggtcactctttatatgctttagcaaagagactggtggcattctgcccctgctctagggatatgtggaactttgaacttgagagagatgatttagggtatctggtagtagaaatttctaagcagcaaggcattcgagatatggcctggtttcttctaaaagcctatgctaatttgcataagcaaagagaacttacatttaaaagggaaaaagagcataaaagtttggaaaatttgcagcctgaccatgtagtagaaaagagaaacccattttctggggaggaattcaaggcagcagaaatttgtataagtaaagaagagctgaatgtcaatagccaagacaatgaggagaatgcctccagggcatttcagaggccttcatagcagcccctctcatcacaggcctggaggcctaagagggaaacatggttttgtgggccaagcccagggctccactgctctgtgcagcctcaggtcatgacatcctgtgtcccagctgctccagctctagctgtggctaatagaggccaaggaacagctcaggccattgcttcagagggtgcaagccctacaccttagcaacttccacgtggtgttgggcctgcaggtgcacagaaggcaagagttgaggtttgggagcctctgctagatttcagaggatgtatagaaatggctggatgtctaggcagatgtctgctgcaggggtggagccctcatgaagaacctctactagggcagtgcagaggggaaatgtagggttggagcccccacatagagtacccactggggcactgcatggtggagctgtgagaagagggctactatcttccagactccagaatggtagatccactgagagcttgcactgtgtgcctggaaaagcttcaggtactcaatgtcaacccatgaaaacagccatgggagctgtaccctacagagccagaggtgcagagctgcccagggccttgggagcccaccccttgtgtcagtgtggactggatgtgagacatggagtcaaaggagattattttggagcttcaagatttaatgactgccctatggtttttggacttgcatggagcccgtagcctctttgttttggccaatttcacccttttggaatgggagcatttacccaatgcctgtactccctttgtatcttggaaatagctaacttgtttttgattttacaggctcataggtggaagggacttgccttgtctcagatgagactttggacttggacttttgagttaatgctgaaatgagctaagacttgggggattgttgggaaggcatgagtgtattttgaaatgtgagaaggacatgagatttgggaggggccagggtgaaatgatctgatttggctctgtgtccccacccaaatatcatgttgaactgttatcctcaatgtttggggaggggccttgtaggaggtgattcgttcatggggctgtttccgccttgctgttctcatgatagtgagtgagttctcatgatagtgagtgagttctcatgtgatctggttgtttgaaggtgtgtagcacttccgttttcattttttctcatgccaccatgagaagacatgcttacttccccttcgcccttctgccatgatcataagtttcccaaggcctatccagctatgcctcctgtacagcctgtggaactgtgagtcaatgaaacctcttctcttcataaattacctagtctcaggtagttctctatagcagtgtgagaactaatacgcttcttaaacaccattccagcagaagggcacttacttattgccatgtggaagcagaagccttggctgcccacttgacctctcaggacacctgagagagggtgatatggtttggctgtgtccccacccaaaaatctcatcttgaattataatcctcataacccccacatgtcacaggcaggaccaagtggaggtaattggatcatgggggcgggttcccctatgcttttctcatgatagtgagtgagtctcatgagatctgatggttttgtaagcacctggcatttcccctgcttgcactccctctgtcccgccaccctgtgaagaaggtgcctgcttctcctttgccttctgccatgattgtaagtttcctggggcctccccagcaatgcagaactgtgagtgaattaagcctctttcctttataaattacccagtctcagatatttcttcatagcagtctgagaatggactaatccagagggatcctcattatggctgagtgggggtgggatttccagctcctcactaggcctccaccgataccttttatctgggaggggtaggagtgcctgttgctgctttccatgtttcctgctgtgacataaactctgcacagtgggggaggggtatctcattgttgctacatgcatgtgaattctaggtccctttttgtctccacctacactctgagggaggttatcttgtaaccatccaatgagaataaaagtcccagtttctttcttggccttctgtgactgcaccctgcaggggtcttggtggtgcctgatatcagcctggtgaggatggtgaagagtagctcccctctggcctttgctggtgtgggtgtgagtggagttacagttttttctgggatgttttggctggagtagaggagttattttctaaaagtgtttggtcttgctaggctgttcctttccttgggctagagagagcaggcctttgctggggggcttgcctgtcttattttctcttggctgtattcttcagttccaactgtggtatagttgaggcaaaaagaaagcccagattgctcatcactgttgtccttgagtcccaagattcctagctgatttgcctttttctctccagctttcagagttctcttatgtttatattatatagagtattcagggcttttagttgtacttagtgggaggaataggaagaagtatgactaccatatcttccataaagcggaaattcagcactccttttgaaacctcacgaaaattactgcaatgatctaaattagggcttggaatcctgggggaagggaagctttataatttttttaatttaattttttttcccaagactgtcataaagcagcataattattttatactttattaagtgcacatgtatttaacactgaatattaagatttaatagccaggaacgatgcaggctgctttaccaatgtcatcttattgcatcctcacagtcagcctctagggcattgctattaccctgagtttacagatcaggaaactgggtcttggtaagaaggttaccaagggttccatgcatggtgagggcagggctgggctctgaatctgcccctgattcaaagcccaagattctcatcactgtgttttctgttgggaggcctggccggctgctggctcactgatgggttgttaactgaaggagttacgtggttttgccagaatcttccttgctgtgatccttggcacctgtcaggatgccactgtcccaggaagacacttggacatgattcttagagggtcaggttgtgcccaggatctgagggccatctctaccctgtttccagtctccaaacccaaacaagtcattttctgtggatgaggtctgtcttatctgtctgcctcacaggaaattagacttgttttgaccaggccactcaaatctgtacttgacttagtttgtatccccgagtttctgaaaagtttctagaaaagaaaaatcttccttcatgtaaggagctctctggctgtgcccatgaatgtctgtaaaaggaggagtttcccttgcagggttttcagctcaggaggcctggtttaaaaacaaacatcacgcatttgtcttggatcttgaccagctccaccaatctgatactgactttaaagtgcagtcgtgactgcaaagcatgtggtaaagacgaaaaaggaaaacccttcctacttcacatctctgtgcctgctggggctaagagcccccttgcacactgttgcctgtgtgaggcctgctccttctgggggagcggcttgtgctggggggagccaagggcccgattgttctccttgggccacgcctggggcttatactagtgctgcagacatgaaatgcagattgtataagtccctgggaaatttagctgtatgtgaacagacatgggagttctctctgattcctacccctgtgttttagaatctgggatgaacttacaggcagaaagaattgtgttgaacttgaggagatgaagaaaaagggcttcggattagagacatgctagttcaacctcagcttctccagttgtaattttgggtcacctggagggttctttaaccttttcagcttcctcagctttgaagtgaggatagcaataattgactgcagaggaaatgcttggtacatagtaagtgctcaatacgcagcttctgtgttagtcagggttctctagaaaaatagaacccataggagacagctattcctagatatctacagatatagctatttacggatagatgtatatatataggatatctatagataaatataggagatatctatctatccatatcctatatatatctatctatagatccatatcctatgtatatctatctacctatagatatacataggatatatatatctatcctatatatctacctatccatgaaaaatatctatctatccatctatctatctatctatctatcgtctatcgctatctgtctatagatatagctacaagagctaaagtagctatatctatagatagatagacagctatagccataacatattatggctgtatctagccataaataggtatatctatagataaattgatatcctatctatctatcatctatctatttatctatctatctatctatccatagctatatctatagatattgatttctatatttgtctctatatatgcaagctggagacccagagatgcaggtgtgcaattctgtctgaattggaaggcctgagaagcagaggagatgatgttcaaagacaggagaagagggataaccgaactcgagagagagaaaagttggccttcctcagcctttttgttctttttggtcccacaatggatggattgaatgccacctgcccacactggtgagggcgtatcctctttacccagtctgctgcttcaattgctaattttttttcagaaacaccctcacagacacacccagaaataatgtgtcaccagctatctgggtttaccttggcccagtcatggtgacacatcacatgaaccaccacagcctctgcgctagatcactttgagtgcatacaactcatggcaggatcaaaatgcagtttcatatttcttgtgtctcattgtccctttaaaattattcagtgggtgcaatattgcctgcccaccctagaaggaaacatgaggtacatcctgtcaacactttaagtccctaatctcagttcagaaatggcaatgtccagtgcaagatactaataaacatttggaactagatttaatattcagtcttcccgattggctttaggcaagagccacagtgcagtcttctgaggaatgcctggaagccccttctcaccagacttggggtaagaaggtaaccccacatgggagaggggtgagatcgcagctcatccacggctctctccacagaaatcctgaacccttccccacaactctctgtcgacttcctgtattactgatctgcccaaatgttccagggtggtgcagtttgttctgaaacattcactgtttgaggtccccacactgggactggtctcatgctcacagtggtcccaatttttattttgtaggctcttctgctgaaacttttattttggtatctttttatacatttaataggcccagcatttcaattcttttaaaattgtagttacactccccctccctgtcaagtcctcgttgatttcttccctctctgccctcctgacaaatggccagggtgtggttaccccatagcccctctctgaggcttaccttgttccctaaaactttggagaactggcctcaagggattctggagtttgtggagttctctgtgctgaactccagactcagcagggggtgtcacaggtggacgctcagtttagagaggacgtcaccagagcctcagcacagaggatggctggatatccggtgtctggtccaggtcggaaatagggaaggctgcacttgggaggtcagaaggggtaacattggagaaggctcttctccaggcagctggttccctgggcttccccaaatggcctggagtttttgggctaattttctgtccccaccttgtgcctggggaagaacctcagtagggactgtgaggggagaagagggcaggtgggtaggaaggagaagttgggcatggagctctttttccagactgcccacagaagcagatgaatgggcccctggctggttcccattgcccccggctcaggatgtctggtcgtgaaagttggctgtagcctgagctctgagctggcctgcggaggagccctgcccatccttccctatctgggttgatgcctgtgtgctggctcaaacagagctcacacctagttctcatgctggggctcaggccaagtggcctcacttccccttcagcctcttcatggctccagctgatgatttatggctgcccattgactattaaaatggctcagctctcaggaacatctgctgtgtggtagagcaagctgtgttgtttgcagggacatatgggcgggctcttctggggacagattaggctcatggagggacagattcctggacttttgctgcctggggaaagccaggctccctactaactcagcagagggcagacagaccttctccttcccttcagccattgccctactgtgtgcaggttcctggggctctttctgcttggccctctcacccccagcacctgccatcctattccagttctcatggagggagggagggagtccagatctgtggttcttaaacctggagagcttgggaaaacacagattgctgggacctatcctaagaatttctgatttagtaggtctagggtctagaggccaatattttgcatttctttttttgagatggactgttgctctgttgccaggctggagtgcagtggcgcgatcttggctcactgcaacctccgcctcccaggttcaagcgattctcctccctcagtctcccaagtagctgggactacaggcgtgcaccaccacgcccagctaatttttgtatttttaatagagacggggtttcaccatgttggccaggatggcctccatctcttgacttcatgatctacccgcctcggcctcccaaagtgctgggattatgggcatgagccaccgcacatggcccaatattttgcatttctaacaaattcccatgtgatgttgatgccattaataggtctgggagccacactttgaaaaccactggtcttgaccaaacctggaactgggaacctctcttgtaaggtaagagagccaccagggctgaagtggaggactgattggctccgggctaggaagatgaaagatagatatgagtgagaaagctctgagatgctgagttctaagcagagattcaaagactcagattgccaaataccaagttgttctggagtatagatctcttaggattcagagtgggctggaggcaaattgcacagattgatttaagtgagagtcagctccagatcagtctcagaacccaaataacagaatctgggcagagagcccacacagcttggtttgtgggcagatggttgtatgctcttgcaatctgggttctgtgagtgcatatgacctgcccagtgagcccacaggaagagtccacattgcagatgttgggtcatctgatagaaggactgtctactagacaggccaagggactccaatattggctccccaactctgctccagggggggcttcctgcctttgggcaccttcttcccatctcccctatcacccccactcctcagaatgaatggaggttctgcttcctcatcaccaccttcagtgaaggaccaggttcaaagcacctgttctgaatccaatctgcaggttcctgaacaggggcccaatggcttgacaaggtggctgagtcagctacccgtgggtcccatttccatcacgagctcttaggaggcagatgtggcctctgtccctgtttagcatagtgctgggtgcagttcacgctgaggctgaaaaaagtgatgcagtgatttgaagcacagtgcttgggctagggggaggaggtgacatctgagccaacacggctactcatttttcagcagagctgaaggagcagggcaggttgggcttgggccgtggaccagcatagagatggacatcttgaaaagtgacaccctgcactgaaatccatccttgaacgcttcctggccaggcagcctgggaaggccatgtgaggacaccctcttcctgcagaagctccctctgtcctccttccttgctcctcccttgttggttaggctttggtaattctcccttctccagctgccaccccttggatgtgaagtttgtggccaatgtagagattcatgaaggtgagagcggggagaaggggagcagtcaaagttcgttctgtgtcgctttttggtgtagctgggtattgcagagcaagagaaataacagaggagaaaatgaaggctggacaaaagctatcagcttggccaaggtagctattagtaggcagaactgggatttgattccagaaactcatggctctggagcctggattccatttgttccacctcatctgagctgtcctttgaggctgtatttagagtcaccattccacactggggtagcaggagggctattgtgcttttgcatacaagttatacctgtgaggatgttaggtctacaaatgtagaaatagcttggagccaagctgtcgatagaataattgccacagtatgtttttgattttcgaggtcagtagacagtgtctttaattctctcctacttactttcactgggttcaaagacttacagtagagaggacagaggaaactctagggattcctatatatatgtgtgtgtgtgtgtgtgtgtgtgtgtgtgtgtgtatatatatatatataaaatctggaagtagaacctctctactttaaaccaaaatgaatgatttttccttaaaaggcaaactcctcatgacttgcccttcaaaggctttgccctgagccctataaccaggaggatcaaatgccctagtttgccccagtttcaatttacatctgtcatcacagcataattactaacaatgcctccttgcactctcagagtttgccagtttggatgacaaatttcccacagcgactggcctttcagctcaacattgagcatgcacttgggggtaggtgaagagggtaagtgagctgagcacagatgaagcagggctgggattccctcaactcccccagctcctagcacccacctctgtcacaccaggggccaccaggcgcaaaatcaagacctggagccagaatggggagaaaagcagaagagcttcccctgttcagctgcctctctgctttccaggaatttcaggaaaatacctgccctgtgtttctgcccttccaatccgcccatcctcagcacctgggtttgatgtttgctctgtggagggaagtgctggctgaggcccccaaggcacagtgcatgctggcgacctcagcttttcctaaggctgtcaggctgagtgccatccagggtctgaggctgcacttcctttccttggctattttcagagcatgttgctgttggggaagggaaggcccagaggggctggaggtggggtgtggtgtctccagggacccctggagctgcagggaatgaggcttctccagcaggaggggcctcaagtgccccaggcccccagagcacagatattttggcaggtccttctgaggaggcaaagcatggcccctggcttctcaggaggtgaatgagctattgttttgagactcctgttcctccactggcagctcaggcatataggccgaacacagagtacaatgttctgcggtggttgcagcctatacttgcatctgagcgctgccctttacctgctgtgtgatttcagaccacctgcttacattctctgagccagaggggggctcttcttcataaaatggggagaataataatcaccctgcagtttgatgtctgcattaaattaaagaaagtcctctatgatgcctcgcacagggaaggtgctcagttaccacctcctcctcgtggctcaaagtcatttgcttcattcatttaacattttgcagatctgtgtggagccaggtatagctccacctacactttcttgaggaatctactttcataaagtcagtgcttaattaatattcaagacttttaacgtctatttccttcaggtcactagttcaagccatgaatgaatgaatgaaaaagaaaccacttgctttgttaaagatgttacatgctgtgggggaacaatcaaggtgaatctgccttcaggaagttttcgggtctcacaggagaaaacattcttccagcaattatagaaactagaaaggttgggcccaaccaaagaagcactgtgattagagaagagaaagctgaggctttgttaggaaggatgggatggggccttgggcaagtgacttcacctctctgaacctcaccttcctcctctccactattgggataacactacctacctcccagagggaatataaatatccgctctgtcgcccgggctggagtgcagcggcacgatcttggttcactccaacctccgcttcctgagttcaagcgattctcctgcctcagcctcccgagtagctgggattacaggcacccgccaccacgcctggctaatttttgtatttttagtagagacacggttttgccatgttggccaggctggtctcgaactcccgacctcaggtgatctgcctgccttggcctcccaaattgctgggattacaggagttagccagggttcctggccaagacgttgtttacttacgtcaattaacaagctgcctgacactaagcaatcatgctatggcacttttccgtatgcgggggtattctcagccataccccagatgtagcaccaccactgttctcctcagcagcctctaagcccttctggcacatttccccttctagtcttctctaggttacttttggtcacttgacatgctttccatccatccctttccctgcccaagcgctttaagaccccattggagtcccatcttcccatgaagactcctcaagttcatctcctctgagcttcttccttggcttggcatgcagccttggtcctaaaaccgcctttgcaaaattatgacagtgagaaaaatctaacatggctgcctccatcttgcttctaacctccaagctgtccttggtcattaccgggcatgggccaacctaactttcagaggaatttagtttatagtttaaccttaaagcaaggatgataatagtgcttctcaaaactaaactgccttcataaaactaatgaaaggccacaaggttagggttatgagaggggcctgaattctgctaaggtgtagctgtggttaaacgataaccagccgttgttccagaggtcacaagatttataacatccccaatcactcctgtacataacatcactattgtagaacctaagattggccttttgagatgtcttttcagacttttgcatttctgatgattggctaattctacctagacttgtgactcatgatacaacgagacccatggcctccacccagaggtggactcagtgcataaggaccaatttccacacctctgtaatttcatcccccaaccaatcagcactccctagccccctgcccaccaagctatcccttgcccaactcctaaccttggaacttccagggagattgatttcagtaataattctgtctcccacgtggtatggctggtcttgcatcagttaaactctttctttattgcaatgccatggttttggtgaattggttttgtctgtgtgataggcaggaagatcccactgggctatgtcttctctctccattggatggttggattcttatagatagaatagttggttccttatagacaggaaatctttctttttgttctcctcttagtgcccagggctgggtcatgcatatagtgatatctatggataacttaaagaacgtcagaaacggcctcctcctagaaccaagtttttgtgggaagacaaactagagaacagctgagtgattttccacaaattcttctatttcccagcaatagcttcaagatcacatctctcctatcctctaccccatgtttcccaacacagagttctgggtttgcagaaacccaaaggattaggggaccccagggtccaaggaggtagcagaaagctgtgtttcggcattctggagcttgatgctgggagtataaacatccttgccagacaaaatattggccccagagcaaaggctggtggccaccttggccttctttgccattcaggcctggtatctgcaagtagccctttcctagccaagaacaacaagccatggcttagaaggaacgacatgtgtgagtatgtgtaagagtgcagagaaggctgaaggggaggggaagaggtggggccaaagcttcatacaggttgaacctccaagtttgggtagaagtggagatatgggaactgcatgaacatgtttttagctatggcattcttccttcaaactaaagtttacttagtttgtacataaaacaaaccaaggtggagccgctcagggtgaacctggggctgagagcggaccgtggaatctccaccaagcacacggccagaattgctggcatcacagacctcattcttcttgccaaaaaaggagggatattagtgggtttttttttctgttttgtttttgtttttgttttttttttcttcctaaaattcctagaatagatagtacttgacatttagcgtgcacttgggtttccccatctttccagggggttatgcaacctgaaggtcacattcctgctttaggctccggtctctcccttctgctatagcacaacgcgtctgagtgtgatggcgagtggatggaaggttctgcaggctcagaaaaagactgttaagtgggccatgtacttaacagcattgtttttgtctggggtggaggcagcaggataccccgagagggactgttgtgtgtatcatggtgtgtgaggtgtagcgatctgggtgtctgtgtgaggcctggtctctcccttctgctatagcacaacgcatctgaatgtgatggtgagtggatggaaggttctgcaggctcagaaaaagactgttaagtgggccatgtacttaacagcattgtttttgtctggggtggaggcggcaggatatcccgagagggactgttgtgtgtatcatggtgtgtgaggtgtagcgatctgggtgtctgtgtgaggcctgggtggaggcctgtgcacgtcttctgtgtgtggtctttccagcctcacactcacggaaagctctggtttggatgtcactctcagcattagaggcctttgggctgcttccagcggagctggttggtgttgaaggattatgggtgatggctgtgggaatggcaccgcctgcctggccttggaggtggctggtttcctctgtatccctgggggtgggcagtggtgtcacaagctgtgtgggaaaggagggctactcggggtggagcacaggacagcttgggtgttgcctgggaggcgtcagggaggaaggcagacgtgggagtcttggggaataaggagaaaagggtttgaaaaccaggataaggcatttatccagcacttggctgtctttatctcttaaaattaaagccaggcctctcctggaacgttccacttgggattctgctgggaaattaaaaagactggggaggggtgagtggtgagttggacttttctgcctcagttgattgtatatgtgctgggtagggtgacccagaattttggtatttattcattcatcagttagtttttgagtgtctgctgtatcctaaacactgacttaagagatatgtaaaatagaagtcatgatccctgctctaaaagagctcactgtctagtggagaatgcagacaaatagacagatgatcatatgatatgatagcatcttcatttattcatgctgaaaaaatcaatagtttatatactattgatataatatccttggagctatatatatgtgtatatatatgtgtgtgtgtgtatgtgtatatatacatatatatatatatggtatatatataaatggtgtatatatatatatatatatataaaattctcacatggctataaaggactacctgagactgggtaatttataaagaaaagaggtttaattggctcatggttctgtgggctgtatgagaagcatggctggggaggcctcaggaaacttacaatcatggcaggaggtgaagagggagcaggcatgtcttatatggccagaaggaggaagagtgtgaagtgggaagtggcacccacttttaaacaaccagatcttgtgagaactcactatcaggagaacagtaaaggggaagtctgcccccatgacctaattacctcccacgaggcccctcctccaacactggggattacaattcagcatgagatttgggtggggacataaatccaaaccctaacaaggacaatggcaaagcacttggagagacatacgtaagatatacattatatatacagtacttgggtatatgtcatatagaatacatatgtaatcttcaagtgctttgccattgtccttgacatctaccaattcagataatctctgcaacaacctctgctaataagtggcatagctggacttgaacccaggcactcttactccagggttcatttcttttattaattaattaatttttatttttaagaattaacagatatggggtctcactacattgcccaggctggtctcaaacctctgggctcaagggatccacttggcctcccaaagtgctaggattacaggcttgagccactgcacccagcctctatttcttaattactcccccatacagtctctcaacagaggtgggtacagggtgcaagacgagattacatatatgaatagagtcagctctctgtgtccatggggttccccattcatggattcaaccattggcagatctaaaatacagtattcttggcatgcagagctcatggatgcagagggcagattgtttccatatgaaggttcacagggctgagttcttgagcacctgtggattttggtatctggggggtcctgcggattttggtatcctggtccagaccgctgcagatactaaggtatgactgtatttaactccgcttcagcgagtcaggcgaggcttcacagaaaatgcattatcttgtaaagactagtgttcccaaattgtgtctgcatcgtgttggggctggggagtgggagggcagtgggaggtagtctaagtaagagagcagaactgcccagggagtggaagtgagggagagcaaagcacctcatttcaggtcggcccagggctggcccagggagcagagtggctcccggaggatccagcccaggccctcccgccttacgtcagagaaggctgagtcacggctcctatcagctgactgtcggccaggctccaggccctcctgatgacagcagggctgaatccagccagtgaggggacagagggacagcaggagggagggaaaggtataggaggtgggggtgggggtttcagccagtctctttcccagcagtgatgccgtctcagccaccagttctctgccagcggggtcagcacaggcatggtgagggggagaggaaggagctgtctgtaacactgcttaacctctggcacgtggagtctgattgcctgggtcagctgctatctgtgtcttgtttagcatcctttctcctgtgtgtcctgccctctggcccatctgtccagctgatggtggggtttgcaagcagagggatgcctgtctcccagctctggctgtgttgctctagcccaacagatgcttggaacaaataaacaggccagcaagtcttggagaggttgtcaggctgagttgagacatgctgtcccttttgaaagctgttgatgtacttagaaggatcagcatctggggccagatcatctctgactctacattaaagccagagttctcatcttcttcataatgatggtatgtactagtgtttaatgctgcattcttttcaaagtcccaagatcaccagccaacaattagttaactggggccctgcagtcagggtcttggactccaagtcctgagtgcttttcctggccaatgcagattcacaacttcgggggttagtctcgagagcattagaagtccctcagaaattgtgagctgtgaggggactgactgtgatttcactggggttacatgtcccttgcttcttttaggagaacaagcttgggacactattggacacacttctgagggtttggatcagaggggcaggggcatatggaggactgatccccagagtcagacctcaaccatgctggggtgtagaaatgagccaggctcaggaatccagcagacacatgcttttgagcactgcctccatttggcaggtcctaaacttctctgagccttggttttcctccaggtaaagcgggtatggcatacatgatagtgcttggcgttttgtgaggatgcactgggtgagcattcagcaactgtaacctcccttcctatttctccctggcttgttcctcaagtcccttcttgcagaaagaccacagccaatctcggcccttttcttctcccttgccttggctgcctcttgttcatgttggtcggcactcttaaccagccccctcgtagtcacccgtgagattgagcacgtggctgccgcacagccccccacaaacacgctggtaggggctgagaggcttgaatgagacaactccgattctgtgctcagcagctcggtggccggcctgttgggtgcatgttaactgtgattattgttatgcaggactcacgagggaaaacttcagtgactcacaaagtcttggggttggaagggacctttgccatcattcttccctgtttcctcttttggcagatgtggtctcagaggcagagtcacttcacatctgggaataaatcccagtcctacctgattcattcatttatttcacccacacttattgaacacttgctgtgtgcacttgctgctccgagtgttggtatatgacacagtgccggctgctaaggagcccatggtctacttaaggggacagacacgtatgggatgcagtgccccggggtaagtgcaacaatgctagtatggggggcatttggagagcgtagagaaagagcctcccatacacccttgaaaggccagcaagtgcttcctggagttgatggtacctgagctaaatattaaagaagtagaagctggtcagattatgtggaggttgctgggtgtgagcccacagtgggtaggtttgctatttctggtgagagagacaaacacaagtatattcagagaactaaatggtttcctggctgctgcacctggattctggagaagtagatcttgagtgtgagtttctaaaaaatgagataagttaatgatctgtaatctcagctactcaggaggctgaggcaggagaatcgcttgaacccgggaggcggaggttgcagggagccaagaccgcaccactgcactccagcctgggcaacacagtgagtgagactcagtctcaaaaaaaaagttaattggtagagtgaacttttcctcctgaatggggccttgaaggcatcatagggcatggcaaatgggttggggttgccaggccttgatcagatgactggtggaaactggccgtgggctttgagctgtacttcttgtcagactcttccctgtggattacagaagagcgcttatatctcccaattcacatttgctaaaaacgacaacaacaacaaaccaaaaaacaaaacaaaacaaaacaaaaaaacgaagaatcaaacaaacaaaacactggaagaaaagggtaaggaacagggcaccagataaccaggttgtctttgagtgtgcagagtgtgtggctgagtgtgagcatgtcatctcccagagggcagaatgcctgaggacagtcctacgtggcctgtgcagttaatacaaccgtcacaattttctcagttacctgctcactgcccagagaggacacggtaagtgtcacctggacttcttggcactttaggggttagacggtcacctcgcaacaagccgagggttcttttctgaatcattccctgttataattcagcattaaggttcttggttgtgaattaaaaaaaaacaagcagaaggcaaattgattggaagggtatttggtagctctttgctatctgtgggtagttgagcacaccagtctgagcacaaacaaaggtcagcaaggcccagggacatcctaccctgggtgctctgggcttagggtgttgcttctgggttctcactgttggatgcaactgtccctggaaacttttatcacatgaatggcctcctgataacctctaactgatcctggactttgctgcatggacacggaattaaaacctgagtggaagcctctgactggctgtgcccaggtcacatggccttgctgaggaaggagagaagggaaccacgtgccctctttggctcccttaataaaggaacctgtctcccgcctaatttgaaatgtcccccccggaataggagagtgtttgaatgctgaatggccccaaatgccaagtaactaccatgttttttgaccttccagacccgactttcagacacattttgctccccagcgctgcccacctttggtttcacagcagttctgaggcctgagaaactgaggagtttttctggccacttttgggagaagccatcttttaaattcttgatcagtttcttcagccccttccctggaaacagacaccatttctctttgagggaaaagagaagtcattgcctatctgtgaaggggattccacttcctctgagagagcttcctgtcaatagcctcttcttgtctcatattgtgtacatcagaggcaatgaattgagcaggaggaaaggggccacttagtctctgactgtttcagttttttcctgccttgacaaatggcagaaatcatactgtctcattgagtaggcctcaagttaaaacactcagggccacttagactattcttttctttttctttttaaacaggtttataattgacatacaaaaactgcacctatttaatgtatccaatttgatgagtttgaacatatgcatgcccctttgacaccattaccacaaccaaggtaatagacacagctatcatctcaaaagttcacttgtgtccccccattcctttttttaagggaaagaacacttaacaggagacataccctcttaataaaattttaagtgcatgatacagtattgttgactgtgcaatgctgtccagcagatctctagaactaattcacttgtatgactgtaactttatacccattgggcaacggatccccatttcccttcccttcggcccccggcaaccacctttttattctttgcttctatgagcctattttagatacctcatccaagtggaatcatgcagtatttgtccttctgtgcctggctcatttcacttagcataatgtcttccaggttcatccatgttgtcgaaaatggcagggtttccttcttttctcaggctgaaaaattctattgtgtgtgtgtaccacattttctttatccattcatctcttgatggacatttgggtcgtttccataacttgactcttcttaaccttgttgcagtgaacacgggagtgcagatatcttttgaagatcctgttttcaattcttttgggtatatactcggtagtagggttgcaaattaaaaatggagctctcacagaccattattttcttgatcctttggtgcatttactttgggttgcctaggaactcctccgtctgtggatttaccttgtagagtcagaggggatgattggggaacctgcatggcgatgtgggttttgagcctctttggaattcaaacaatactgatttaccagaacaagaaaatttggctttggccccaatacaggctgagaaagttcatctttttaaaaggggccagttcttgattagttagggtactggaatggtccagggagggataactcaggccatttgctttgcctccttccctttctttctgtctgatctttggccagttcatggctttctaatcctgccactgggggatgaaggaagattaaacttgtgccgttgcctttgcatgttatgagctctccagaaaaagtttgcatgggaatggccgaagatgtggtaagttaaagcaaaatcaatacacagtttactatccatgtctttctgctaccctgcaaattttcttcctctccatgtaatctctttattgcagcctaggaactttgtcaagggctccatgaccagggtctttaggaaactccaaagacctgagatttcaccagcagaaatgacagctgttccaaaaacagaaaggaggtaatttcttgtgtttcaaatttctccaaaggtgagagttaagactcactctcaagatctttatgtcacataggtaatgagaggaaggggtagcattttaacagatcacattcccaaggccaatccaacgggagggctggaatttggggaggctgcagggagcaggactttggtgccgcaatcactggttaccctgtaatagtatctcaggagactttcctggttactgaggaccagaactgtagctgattttcagcccaatacttggtgggttctgtggagtccagcattcaaagccctaccatcgagtgtgacttcagtgtcacaggcagatggtgtcaccaaggcataatgactcctgacctgtggctctgctcttcctcctttctcttcctctctccccttccctgggggcctgtggtccagagctgcattcctttgttatcacacttccttccacagactgcacacgcctgttcaggacaccaagctgtgtgaaagcactccaggctggtgggaataccgctcccagaaagaatctgacttgtttcagaagcttatcttctggcacttgctcttccaaagaaaaaggctgcagcaggaggataaaagaggcaatccaggagtgtgtgagatggagccagttacatgcatctcagcccagggagggagtgaggagggaatgaatgcggcctaagtccctcacctgcaatgtgtaggaggtaaatgaacctgctcaccctccctctcacccagccacattcagggtcatttgctgtagctcaggtggctgcggctagggtggggttgccaggtggaataatggtcatgcacagctgcccctccacaggggctgagcccagggtggcttcactggaagagggtgtgggacaagctgggtatcctggctgacatctctgctagctgtcggaaagttgagtgagggatggggtagctgtatctgtgtgtgtatatgtgagagagtgtgtgtttgctgggtcctcgtatgtgtttgtttcagatggatgtgtgtgggtttgaggccaggggaatggtgagtcagggcagccctgggggcagggaggggtgggtgtgagcagggcgagtgaagtggctgcagcaggaacaggggaggcatgcggaacatgggtggcatgagagctgacgctacgactgaatggattttgaaaggtctttgtctgcctcaattaaaaggatagatcctttttttctttaaggctgaataaataattttttcccttttcttctttggttcttttcatataacaatttgtcaaactccgtcaaaaacaaacacaaacagaaaaacccaaaagtcttcttgaatgggttcaaggtgcaggaggcacagctgagctgtggggagcagcggtgcaggagcggggtgctcggtggactctggacctgctcttggggctgctggcccccttcttgcccgtgtggccagggcagccctttggaaaagctgtgctgtagcttcatcttttgttttggcttttattggcatattcttttgttctctttaactgcatccaatcaaattggcacatctgaggttcgggaagatggtttggagccattccattactctgcctatcgaattctgggatttctgcttcctgccctgtcctgtcttctgtccccagctcacccggcccctactgatgtcatgctttatcagctttccactgtgcatgtaactctgcctggcatttggtattggggtgggtgtggtgctttgagagaggcacagcagaaccactgagagaaaggacggtgtttttccgtttagaccctcattcatcccctcctttctctattttgcaggtgcagaacattgagttatgggggtccagggtaaacttggctaccttggtaaacatggctacaaggtaaacatggctgctttaacgaaccaggaatcagtgtggctttctgattcctcatttggttcttggaacacttatttccttttcttacccaattttagctactcagggacagtagaatcataaaattttacagttggagggatgcttaaagaacattagcatacaggggtcttcaaacagcgatgtggagaaacccctcagaagtcacccactccacctctcagagcagcgccgtgcttactgattttgtagcttgagctttggcaagttgggaacccatctggtgtatttcacgcacctttcatatttaaaagatgagtaacataaacccgtcaattaagagaaaaaataccagacacaaacatttttaatcaagaggcctacttacttattcactactgaaaaaaatacccaaactgaagccctaatattttaagatttaggtgacatttatcaaaacaagaattgaaaatgctttacataatcctgggggaaaacaatctgaatttttttatataaaatgcttttttgggggggggcagaataagagaaggttgttattcctacaaacgaacaaagcacaggacaagcttcatttttatattcttaagaacatagactgggcgcagtggctgatgcctgtaattccagcactttgggaggctgagggcggattgcttgagcctaggagttcgagatcagcctgggaaacatgatgaaactctgtctctaccaaacaaacaaacaacaacaaaaaattagcctgacgtggtggtgcgtgcctgtagtcccagctactcgggagcctgaggtaggaggatcacttgaaccggggagatggaggttgcagtgggcctagacatgccactgcactccagcctgggtgacagagccagaccctgtctcaaaaacgaaaacaaaaagccaaccaaaaccaaaccataaatggtggtgacatagtcacagaagataaggtttaaatgttgaataccaatgttaaggctgatgattaaacaacttcattagggacaagtgattttcttcaggtgttgaaagtaagtctgggatgaccaactggtgaaagaaaggcttggtgatcacctggtgttatttcccaccatgtcttcttctctgctagaaatacttggctgttgtgattctcacctgaaagatctcacttggcctccaagaaaggggatgggtagccacatttaaaacaaaacaaaacaaacagtcagagaatcctctttgaagctcatctatgcaactgtggactaaaatctaatttcaacatattctaatatttctcagcaatagcttgaaacaattgagaattctttaaattttagaccccagaaaatatcagcattctgctcacccattccatctatctatctattttacctttcattaattcttagtccatctgtgctgctataacagaatgcctcagattggacaattataacaaatagaaatgtattggttcacagttctggaagctgggaagtccaattccaaggtgccagcatctggtgaaggccttcttactgggtcgaaatgtggcagaaggcgtcgtatggcagaagggcaaggggagggtgagagagggcaagagagagggctgaactcatcctttataaggaacccaccctcattaatggcattagtccattcacagacagagccctcgtggtctaatcacctcttaggggtcccacctctcaacactgttacaatggcaatttgtaagtttcaataaaagttttggaggggacagacattcgagccatagcaaattccttcacttgttcaaaaattactggaatctaggaaactttcaacatggaatttggaggaaccatacagattttctggttcagtggttgcaaactattctctggggtgggagtaaagagagagagagagagaaagagagagttaaggggaagcaggtggtgccaagtaaatgtctttgggctcccccgccctgcctcacccagagaggccatcctgtggttggctgctcacagtacactggcctggtagagctttgtaaactacaggcagtgatgcaagcagaccttactctgattaagtcatgtttttcaagcttttatttagcaatggaattattttttttttctccacaaggtcacctggttatatctacattatttatactatatattacatgtgataaaatatatgtgataaataaaatacagaaaatacgtaaaaccagtatggacctgatgaaagaaagggtgaagggtcagactcctgtcaactttgctctccttggtcttctcagctcctttatataactttaggtttcgggacacagcatggaaaccactactctagacgacaggtacgtacagaaaatgttgtgtgtaagtggggtctttgcagatgaatgaacatcttatttgcccaaggggaccctctgtgtttttggctgcaaactaaacagactcatgaaggaatactttagagagactgtgaagctgcatttctaatcagggagtatagctggagcccctgagaagcagaggggtagatgggccagcttgtttaagatcagcaggttactgggtacagcctgtggtgaaactcattgtgaaagtgagtgagtgtgttgttggaaacacaaagaagccaagctgaatgccgcccgaggcactaagctagtggtagctccagcaaatccccaggatgatgttggtgtatacatggcatggaaagacttcaggtcaccaccagtgccctcaaaagtccattttctgacactaagcccaatgatttgctctttttgcccctgcctccggctctgtctccttccattggcctcactctgcacctgtcccacaggcaggcagtggcatcctcagctcccggactgctggggccaccaggtcagctggcccctcacccttgcttggacatttggtttgcatgctgaaatcaggattcctgagtgacgtgaggtcaggcccaggatggagagtcacaaggaagaggtggaattccataggtggaggttgaagaaagtgtttggttccagctggggactagagagcaatgagatttttaattttttaatccaactataagattttctgaattaaaactacctgatatgctttggatgtttgtcccctccaaatcacatgttgaactgtgacccctagtgttaaaggggggttctggtggaaggttttggatcatagggtggaccccttgccaatggcttagaatcacatgttgaactgtgacccctagtgttaaaggggggttctggtggaaggttttggatcatagggtggaccccttgccaatggcttagaatcacatgttgaactgtgacccctagtgttaaaggggggttctggtggaaggttttggatcatagggtggaccccttgccaatggcttggcgtcgtccccttagtcgagtgcgttctcagttagttcacaccagatccgattgttcaagagtctgggacctcctccccttctctcttgcttcctctcaagccatgtgacatgcctgcccccactttgcctcccaccacaattggaagcttcctgaggccttcaccagaggcagatactggcaccatgcttcctatacagcctgcagaacggtgagccaattaaacctcttttcttacccaacctcaaatatacgtttatagtagtgcaaatggactcctacaccactgacagagattttgtggctcatctgattgctcttttttactctagggaaatctttgaacacctcagtttgtcagtggccacatctgtacaacgggctactggaaatgtgctcaccttcagaagatgctatttcaaacccacgcatttgccctgagccatctgctttctagatggcccatcttgtagcaactcatagatgactttttcagatacttggttgggggcggggtcaagaccgtgttttgagaatagactttttccctgtgggaaactgaaaggcttgtggtgtaatgatccctggcctggggcctcctttgcacagttaattaattccaacgacaaatatttactgtgcatcgagcgtagcaggcagtgccctgactgattaagatgatctgatatggtaatgcagggtggacttgagaaattaatgattttaaaatgtagttagcaacctagggttctggagggacaatgccagactttcttctggtgttcaaaccgtcccagactgtgaaggaactggtccgtgatgtctgcctgggctgctttgcctctgctccatagctgagggaaggggcagctcttggctctctgccagtgtttgtaatccgcacagcaggctcccatgtcttctgggtgggcctgcatcttttgttacatatttgtccccgaatccagaccacttctgagctctctggggagaatgtgcccaagagctgttcagtggggtgggcaggctggtggaagtcctcaagcctaatttgttccgcttcccttcagcccttcagtcctaattcatttgtttgtatttgggggaaaaaaaatctctcattattgtctatcctttatttcctggaattcaacatgaaagttgtcattgttttagtttgtggcctccaaagaaataaaccatttgagcaacaactgcaacaatagcaacaattcttcatggcatgggcgtcagaccggttgactttggaatctaggtgtccattttgttagaattgaatgtgcactgggtttggggtgggtgtgagggaggctgtatttatttttgaacttctttcgcccataatgaaaaccagctgcctctccaacaagtgcattactcttcccatagaaagcctcatggacagactgaagctacaggggtggcaagtcacatagatggatgtttctaatttgatctagtgagcttcaccctctatctctcggtcctccagtccttgctcgtgggttgatggacaccttgtctccttccatacttgtggaacctaggggtacttttagttagtggaggagaaatgtgtctcttctccccactgattcgccagggtggacatggaggggacctccccaccctgggaaaggtggccccattcagcttgagtctggagtgagaccaaactttcctgcctgctgcatacaacttcaactccaagtccaagctgggcccgttattttggctgcttggagaacattccttcccatgtgctgatgcatcagggtatctccagcttccttttctctggaggggtggcactgagttaaaatccttccctaggtgcatgggcagacgagtaggagggctgaggtgcaggaaacgcagccgagtggagagcaggacggcagacagtgctgtgctggccacctctgtgggtctggccacaggagaatgcacaagaatgatttactaggtgcttcctcacctctcatgggtggtgccgggagatgatggaatgcgcttttttccccgtaagagaatgcttttggcagagacatttcccagttattaaaaaacggggcaatgaggtgagctataaatgcaaacctccatataggaaaatccagaagaaatgagtaaggacgaggtgatgcagtggagattgtggggagagagaaaagattaaaaacaggcgaagagaagaacaatgaagctgtgttgagactgaatgggagagagcgggagttctgtaaaggcaagaaaaacatcagcaatggagtcaaggaaagctcagcggtgactttgctccttgcccgcagtgtagaagcagatagaaggctggggaggggttgactaggcaggttgaatttgtaggtcagtggaagaaacagcaagaatgagaaaaaggagctcggggtgcttaggtcattggacacccttgaagctgtgggtaatgtgcactgcggaaagatttgggcgaatttccacagaaccaattctgagaacacgatatggtgtgtcttgactctttatggggggacgtgccttgtaggaccagagaaatgcgcacagcttagcctttacagctatatccagtttccacggagttctcgttctttcctggttcccataacgcttgtctgtgttcaaatatatttacctcttgatactctattcagcatagtgaattgttcctgttattcgctgagttctttttagtgtattttctcattctttacaagtctgagattcttagggacaaggagagtgtcttgtatttcttttgtgttattcacagtcttgcagagtggtgaggaaagggtaggtgtagacagcgtgaaattaaatcggacctaaagctgcctcctacgtatttcaggtttggcctgaaggtttctgcacacccagccaactgccacctaacaggatgcgtaaacagactgtaacctcctagtaacaagtcactgagtctcagccagtcacaggcggtaactgttcaaaccctgctcaaatcaggcaaacactgaactgtaaccagtctggctgtttctgcaccccacttccattttctgtccatcaccttctgtttcctatctgtaaatgttatctgaccctgtggcagccctgcggttgctctgaacctgttctggttctgggggctgcctgatttgtgaactgttctttgctcagttgaactcttaaatttgacttgtctaaagtttttcttttaacaatggacagtgctgaaatgaggactctgtaggagaaaaccagccagccaggctgccccttcccacctctcacttccttcccacatttattgaatgcttactgtgtgcgatgccctgttctaggccctggacacgagcagtcaacagacagatgagctctggtgaagcttccgtgtcagtgggagagaaaggcaggacagcagaaggagtgcacgcacaaacgctccaagcagggatcagtgctatcagggtgagaaggggagagagggccaaggggctgcaggagagggtgtgtgactgcagtttacacagggtacagggaatgtcctttttctttccaatgtcagtgacacttgcttagagacctgaatgaaacaggaggctctttggtggagaagccatgctcacgggagcagggaggtgctgaggagaaaggtgccagtgtgctcagaggacaaggaggaggctgtgggctggagcggagtcaggaggggtggatgagatcagagagggaacaggggctggaccaccgcagttcttgtagtcacagcaagtgaggatataggatccttttctgggtgaggtagaagcttcggggtggaggagggactgagaccactggggctgaaagagttgagaggcaggaatgggtggtggcttgggccaggtgggcgtgactgaaatgaaagaagtggttggattctggatctttttggaagatggagctgacaacattcgcccatctgaggaatgaaagaaggaggggagttgaggatgactcagggtttttggctttgtcagaagatgtgtttagcttgagctttgggactggacaagttgttgagcaaaggaagcactggaatgagcctacaccttgatttcctcagtgacttgctggaatggtgtgtacatgcatggttgttgccaaactctgcctcaggtcagatgaggatgctgaggtaacaggctcagaggagttattcactccacaaatgtgtatagagtatccgttacagcaggattctagatgatattttaggttgttttgcctcctttatccaggcagagtctgctattgttttgggaccagaactcattctgagtaaaagaaaaaaaaagtctaatccaattccacttcattgttgctgcagggtggtcagggcagtttattttattttgagttccagggtacatgtgcaggatgtacaagtttgttacacaggtaaacgtgtgtcatggtggtttgcggcacctatcaacccatcacctaagtattaagtcccgcatgggcatgcattagctatttttcctgaggctctctctcccctgtcctcctgccatctccgcaacaggccccagagtgtgttgtttccctccctgtgtccatgtgttctcattgttcagctcccacttatgagtgagaatgtgtggtgtttagttttctgttcctgctttagtttgctgaggataatggcttccagctccatccatatccctgcaaaagacatgatctcattcatttttatggctgcatggtattccatggtgtatatgtgccacattgtcttcatccagtctatcattgatgggcatttgggttgattccatgtctttgctattgtgaataatgctgcaatgaatatatctgtgcatgtatctttatagtagaataagttatattcctttgggtatatacccagtaatgggattgctgggtcagatggtatttctggttctaggtttttgcggaatcgccacactgtcttctacaatggttgaactaatttacattcccaccaaccatgtaaaagcgttcctatctctcctcagcctcgccaccatctgctatttcttgactttttaataattgcctttctgactggtgtgggatggcatctcactgtggttttgatttgcgcttctgtaatgatcagtgatgttgaggttttttcatatgtttgttggtcacataaatgtctgtttttgaggagtctctattcatgtcctttgtccactctttaatgaggttgtttggtttttttcttgtaaatttgtttaagttccttgtagactctggatgttaggcctttgtcagatggacaggttgcaaaacaggttgcaaacattttctcccattctataggttgtctatttgctctgacgatagttttttttttttttttttttgagacgaagtctcactctgtcgcccaggctggagtgcagtggcatgatctcggctcactgcaatctccacctcccgggctcaagcaattctcctgcctcagcttcccaagtagctgggattacaggcatgcaccatcacacttggctaatttttatatttttagtagagacagggtttcaccatgttggccaggctgctctcgaactcctggcctcaggtgattcacccacctcagcctcccaaagtgctgggattacaggtgtgagccactgaacccggcctgatgatagtttcttttgctgtgcagaagcttctctttagtttaattagatcccatttgtcaattttggcttttgttgccattgcttttgacatttttgtcgtgaaatctttgctggtgcctacgtcctgaacgatagtgctgagattttcttctaggggtttttatagttttgtgttttacatttaagtctttaatccatcttgagttaatttttgtcaaaaatataaggaaggggtccagtttcaatattctgcatatgactagccagttctcccagcatcatttattaaacagggcatcctttccccattgcttgtttttgtcaggtttgttgaaggtcagatggttgtagatgtgcagtcttatttctgagttctctattccattccattggtctatgtgtctgtttttgtacaagtaccatgctgttttggttactgtagccttgtagtatagcttgaagctgggtagcgtgattcctccagctttgctctttttgcttaggattgtcctagctatatgggctctttttggttccatatgaattttaaaatagttttttctaattccgtgaaaaatatcaatggtagtttgttgggaatagtattatatctataaattactttgggcaatatggccattttcatgatactgattcttcctatccatgagcatggaatgtttttccatttgtttctgtcctctgttatttcctcgagcagtggtttgtagttctccttgaagaggtccttcactctccttgttagctatgtccctaggtattttattccctttgtggcaattgtgaatgagagttcattcatgatttggctctctgcttgtctattgttggtatataggtatgtttgtgatttttgcacattgattttgtatcctgagactttgctgaagttgcttatcaacttaagaagcttctgggctgagatgatgggggttttctagatatagaatcatgtcatctgcaaacaagataatttggcttcctctcttcctatttgaatactctttatttctttctcttgcttgattgccttggccagaacttccaatagtacattgaataggagtggtgagagagggcttccttgtcttgtgctggttttcaagggggaatgcttccagcttttgcccattcagtatgatattggctgtaggtttgtcataaatagctcttattattttgaggtgtacctaggtgtaccttcaatacctagtttattgagagtttttaacatgaagtgatgttgaattttattgaaggccttttctgcatctattgagataatcatgtggttttgtctttagttctgtttatgtgatgaattatgtttattgatttgcatgtgttgaatcagccttgcatcctggggatgaagccggcttgattgtggtggataagctttttgatgtgctgctggatttggtttggcaatattttattgaggatttttgtgtggatattcatcagggatattggcctgaagttttctttttttgttgtatctctgccagggtttggtatcaggatgatgctggcctcataaaatgagttagggaggagtccctccttttcaattgtttggaatactttcagaaaaaatggtaccagcttctctttgtacctctggtagaattcagctgtgaatctgcctggtcctgggctttttatttttttggttgataggctatttattactgcctcaattttagaactcattattggtctattcagggattgaatttcttcctggctcagtcttgggagggtgtatgtgtccaggaatttatcaatttcttctaggttttctagtttatgtgcacagaggtgtttatagcattctctgatggttgtatttctgtggggtcagtggtgatatcccttttatcattttttattgtgtctatttggttcttctcttttttcttctttatacatctggctagtggtctattttattaaattttcaaaaaaccagctcctggatttgttgattttttgaagtgtttttcatgtctctatctccttcaattcccagtgcactttaaatagatgttatttttagaatgattttaggtcacagcaaaattgaggggaagatgcagacttcttatacagcccctgtccccacacatgcacagccttccccactatcagcatccctcagactggcactttttttttttttaaacaatcgagaaacctacaatgacacatcattatcacccaaaatccgtagttggcattaaagttcactcttggagtcatgcattccatgggtttggataaatgtataatgatgtgtatccatcattatagtatcaaaaagaatggcttcattgtactaaatatctcctgtgctttccctattaacccttccctcccattaatcccttgtaaccacttatctttttactgtctctatagttttgctttttctagaatatcatatattggagtcatatagaatgtagcctttgcagattggcttatttcacttaatacactaaagggtcctccatatctttttgtgacttgatatctcatttccttttagtgctgaatacaattccattgttgggatgtaccacagaatttttatcccttcaactactgaaggacatcttggatgcttccaagttttggcaattatgaattaagctgctgtaaacaggttctgagtggacataaagtattgaactcattttggtaaataccaaagagtataacatacttttactatacagttcctggattatgtggtaaaagtatgttcagttttctgccaaactgccttccacagtggctatactactttgcattcccaccagcaatgaacgagagttcccgttgctctacatccttgccagcatttggtgttgtcagtgttctggattattcaccattttaataggtgtttagtggtatctcattattttaatttgcaattacctaattatatgatgttgagcttctttctatatacttatttgccatctgtatatgttctttggtgaggcatctgtttagatcttttgcccatcttttaatcagattgttcattttcttattgttgagttttaagagttctttatatattttagttaacagtcctttatctgatatatcttttgcaaatattttctcccagtctgtggcttgtcttaattctctctacagagtattttgcagagcagaagtttttaattttgatgaagttcagctcatcatttctttctttcatggatcatgactttggtgttgtagttaaaaagtcatcaccaaaaccaaggtcataggatttctcttgtgttacgtcctaagtgttttagagttttgcatcttattgatgcactttaaaaactttctatggcttctgaaactcttgactcattttccccaatgtcctctccttctggcctcttctttaatgccccttgccacccaagtaaagggtagatattgcatctcaactcccaacagatataaattcctatacaacaacagatataaaagaatattcaactctaattaagtccgctgggagctgctgggagaccaaggccaacaggctagtccttattttctggactgttttcttcagaccagcttttcttattactgtgcctgccatccatgccctgcccacccctaacctcactcttagcttctctccaattccgtttgagtcatgaatcaactcaaatggagctggcttttgaatccttttggtcaagacttcttgtccaatgcttctaaaatgttgacaaagttctggaaatcacagctgtgaagccaactcgtgtactatgtttcagtgaaaagttctgaagaagctgtgagcaacagttccatgaaaatctccatcccctctgtacctacactaaggttatgggttatgcctgagtgatctcagcatcattttgatccagtttgcatctagggactgaatgccaatttctttcaaaatcctgggctgactgcataaacccaagaaaagttggcttttattcccagttgccttgatttttggctttgcttttgttatgtgctatgcttaaaattttttttaggattccataggtttaactttggctcatgtgagtaagtagcctgtttatgcactgtggccctgaggaaccagaaatccattagtgcaactatgaaaaccttctgaagaacaggatattcatccttctgaggtaaggttcaagattggataactactgtatccctcaacccaaaagtgactatggcagaagctggtgcatacttagctgaaaggatggagttgaagaggaattatggtatcagccaggatggggcagtggtgaaggcggtgctttggggtgttaaaaaatttaattggggctgggcacggtggctaacgccggtaatcccagaaatttgggaggccaaggtgggcagatcacatgaggccaggagtttgagaccagcctggccaacatggcaaaaccccatctctactaaaaatacaaaaattagcaggaatggtattgcacatctgtaattccagctacttgggaggctgaggcatgagaatcgcttgaacctgggatgtggaggttgcagtaagccaagattgtgccactgcactccagcctgggcaacggagcaagactctgtctcaaaaaaaaaattaattgggataccattaggctaggatggcaccagtgccttgggttcatatgtaagcagactgaagtccagtcaaacaataaaataagacacaagctttatcagtcagaaaccattagctaaactcaactgggggctttccatcagataataagacaaacacctggctttagctaatcaactgatcaaggattttgcttttgcattcagcctgtaaaagcctctgctcacactgcgagggtagagcttgcagaacctcttccagttctgagtgctgcctgattcataagttgttctttgctcagggaaactgctgaatttaatttatctgaagtttttcttttagcagggaggagaaacactgcttcttccagcaagttgtatgaggaaaggactactaacaaaattctcaagtattattaaaaaggagtattaaaatataaagtacatgtgtttaattggtaagcagatagacaagaatgtattagaagagagaagggtatagctttatagagattgctcaacaatagtattgaagcaggtaaaagaattctccctggggaatggaggagaaggggaggctggagagagagggatgtggcacgtctttcagacgtgactctggggtcagccataaactggttccatcatcatcaccagggagcttaagaatttagctcaaagagtctgattttctgggttgggttagaatccaggaaactgttttaaaatgagtcccctccccaaattcccaggtgaggctgattaacatccggatttatgaagtcattggctgggggtctgtgtcctacagcctctgggcccaatccagcctggagcctgttttttattttattttttaactttataaactttttttttgtctttatgtgcagtctttatttcaactatttattttttcttttttttgagatggagtctcactctgtcgccaggctggagtgcagtggcgtgatatcggctcagtgcaacctccgcctcccaggctcaagcgattctcctgcctcagcctcccgagtagctgggactacaggtgcccgccaccacacccagctaatttttgtatttttagtagagatggggtttcaccatgttggccatgatggtctcaaactcttgacctcatgatccacctgccttggcctcccaaagtgctggattacaggtgtgaaccactgcacccggcctcaaatatttcttaaaacactgtagttatttcttaggacaagagcaaagatcaccccctgcagaaactcagtaactatatacagagctttgcagaacagagacagtcactaaaggctggctgctggccagggaatggcattctgactggactcaaggaacaaaaagaaaccaggttggaaaggggcaagcgctcagctgaattaaacttcagcttccatcagggcatatcttgtgatgctcacaggctctgtttctagaaggtttgggttcagcacaagattccatttgtctgcttggctacacccccagctgaagtgccaagaggtcactgtcactcatgttcctggccagccaaactcctgaagcaaagagtcccgaattgaggattaagtatctctggaaatcattcctatcagtggcaaagccatagctgccatgaagccaatttcccacattgcccagattttgggtgatacatttgctgagctggcagtgctcacagtgaccactggaagccatagtagtgcttttgggctctgccaactttaaaaagtggatacataatatttacacaaatttgtggggtacatgtaatattttgatacatacattgaatgtgtaatgatcaaatcagggtatttaaggtatctgtcacctcgaacgtttatcatttccttgtttggggaacacttcatatcctctcttctagctattttgaaatacacaatatgttgttgctaactgcactcaccctattgcgctattgaaaactagaacttgttccttctttatatttgagacagggtctcactcagtcacccagtctggagtgcagtggtgcaatcatagctcactgcaacctcaaactaaatccctgggttcaaggattctcccaccttagcctcccgagtagctaggactgcagacctgtgcggctagtttttttcttttttttaaattttctgtagagataagatcttgctatgttgtccaggctggtctcgaactcctggactcaaatgatcttcccactttggtctcccaaagtgctggagttagaggtgtgagccaccgcgcctggacagaacttatttcttctctctaactgtatgtttgtgtccattaacagtcctgtctttatccccctataagtagcttacagctaagaatgttttttacatttttttctcctttttttttttgatgggattgcacagtttatttccaaacactcagaggatagggagtggcctgtgggctccttctgcctcccctccctgcatttggctgaatcaagaacttctcccccttcacccccaacaccctaggctgtgcccgatagagaaggtactctcacccccacactgaggagagacccagaaaggtgaggagcatggagggtcgggggacagagttcaggtattcacagttccctatctccacccctggattacactgtgccagagccatgagggaggatcccacctctgggattcctgtggtgttgatagtccttctcccacttagaaccttccagatgaactccctactccttatccctgaaataacaaaccaagccctaaaccaagccctgtagtctgggcggggaggggccttagcgcatcactcacccaaggcccccagggatgggggtgagggccttcacctgtagtgaatgggttgggagcaagtatctataaggagagaggaagggagagagctgagaggaccttgggaggcaggcttggaggcttctgacacataagttcagacagctctggcctgttactccacgccgccccacaccccaagcccagaatccctgagagtccaactgcaaaggcagtatggccggagggaggaatgggggcacggggagagctgggtaggaccttggtccccctctcccagtcagtcctgctcctgggacacatgatgcttagggacggccaggaccaggatcaagtcctagctcttaggctctgatcttccagaatagctgaatcctggggcacgtagtgtagacccaccaacccccacaccccagacatcccggccttgggtagaatggtgggaatgggctctcccaagggtattataaaaagctaaaaccgttaaacacttactggggaggagtggctcccagtctcttgcttccccaagttatcagcctctgcagcgcctagcagacaagactaaggaggtcccagagagccaagggaggagggcacagcccctgggcccagagagagggcccactagcaccgtgcaatgttgaggtgcctccgcagcctgactggcccccacgcaggggccctccgcagcgggggtgcacacttgctagagcttctgtacttttgaagggtgacccctgcaagggagtggggaaggcaaagacttggcttaagtccaggcaggggtcacagctgggaccccaaaggacacccctgggagtcatgatttgaagaatcttcttaccacaaactggcccagcagaaccacacccacaaccaccagcacgttcaggatgggactattgcccaagtccagggctgccacccagccgcccctctgcgagatccaccgggcgatgccttgttgcagcatgaagaccacgaagcgggtcaccaggcccaggaagccagtcaagccgtgctggtagacatgtaggaccagacggtagccgaagcccaggagagccaccacacggccccggttgatgccactctcaaacaggctggaggcgatcttggtgaagtactcgtaggcgttctctgccgtgggctgcaggtgctgcagcatggtctggaactccgaagtcatagtgccggttgatgtcgtcctggtgatggcgagctgccgtcccacctgccccatggtgctgctaggttggaggggcaaggtgaccatctctgggtcggcaggggcggccgccccttcagcctcctgttcctgctgatggtggtaaaaaacgtagctgcggaaaacccctccatgtcctgggctacctgctcctcagaagcagagggcagggcaggctttccgcactcctgcctgggaggccctgggccttgccccgatgccatttttcaggtctcagtggaggacagtgtcagcctccagggatgctggctcaacccgcgtgggtcagcagggtggagttgaaggtcccaaggggctggaggctgctgctcccaggggctgagtgggagcccagcttccaggaacgggcgtcagtgcatttctggtatctggatgtagcctttgcttgtccctgtgtggcccgagggacccgtgagactccagtgatcatctgtttttttacatttttaaagcattgtaaacaaaataatacaaacagggagcaaaaaagaatacatgacaaaactgtaagtggcctgcagagcctaacatatttatcatgctacttggccctttacagaaaatgtttgactatccctggcttagatagggaaaattaaatgcataaatgaataaatagatttttcaactgatgaagaggtaacgaagtctgcaaattttctaccatgggtcactctccacacaggcgagggaacctttgctctgagtgtggttcttattggaatgggacgcactgtcactctttaaacaatgtattgtgcctcaggtgctgcaaggtactgctatgctcacatggacaaattaaggctctggctaaggtaaaaatcaaatgggctgcccactaaaaggggtagttcaaattatttcaacttcacttttgttcagctagggagggagaaagtagactaggccttggaaggtcaggggaaaaaaaaataccagttacacaaacataaggctcttaa

SEQ ID NO: 444 - DNA, 40001 bp, Homo sapiens
cgagaccagcctgaccaacatggagaaaccccgtctctactaaaaatataaaaattagccgggcatggtggcacatgcgtataatcccagctactccggaccttgaggcaggataattgcttgaacccgggaggcagaggttgcggtgagccgagatcatgccattgcactccagcttaggcaacaagagtgaaactccgtctcaaaaaaaaaaaaaaaaaagaattatacaccacaccaactggggtttagtccaggtatgcaggactggttcaacatttgaaaatcaattaatgctaggtgcagtggctcacgcctttaaccctagcactttgggaggccgaggtgggtggatcacctgaggttgggagttcaagacaagcctgaccaacatggagaaacctgtctctactaaaaatacaaaattagtcgggcgtggtgacacccgcctgtaatctcagctgctcgggaggctgaggcaggggaatcacttgaacctgggaggtggaggttgcagtgaactgagatcaactattgcactccagcctgggcaacaagatccaaactccatttcaaaaaaaaaaaaagagaataaaataaaaacaaaagaaaatcaattaatgtaattaatcacaccaactgactaaaaaagaaaaatcacatgatcatattaatagatgtagaaaaagtatttggcaaaattcaacacccattcatgataaaaactctcagtacactagataatttcctcaatttgataaagaatatctacaaaaagcctataactaacatcatacttaatgataagaaagtagaagcactcccactaagattagaaacaggcaaggatgtctcctgtcaccactgcttcatacattgaatttgcattcagtatgaacaagtcttagcagtttcccagtctttgctaggaagtcctagtaaatgcaatgtagttccttcagaaaaaggaaatgaagggactacagattgggagtgaagaaataaaactatctctgtttgcagatgacatgattgtctatgtagaaaatctaaatgaactgaccaaaaatctgctggaactaataagcaattatagcaaggttgcaggatacaaggttaatacataaaatgcaatcactttcctatgaaacagcactgaacaagtagaatctgaaacttaaaacactaccatttacattagcacctaaaaaagtgaaatgcctatgtataaatctaacaaaatatgtacaatatctattatgaggaaaactacaaaactgattaaataaatcaaggaactaaataaatgaaggggacaagcgcggtggctcacgtctgtaatctcagcactttgggaggctgaggcgggtggatcacttgaggtcaggagttcgagaccagcctggtcaacatggtgaaaccctgtcactactaaaaatacaaaaattagctgggcatggtggcacgcacctgtaatcccagctactcaggaggctgaggcaggagaattgcttcaacctgggaagcggagtttgcagtgagctgagattgtgccactgtactccagcctgggtgacagagcaagactccatcttaataaataaataaataaatttataaataaatataaaataaatagatagatagatattccatgtttatggataagaggactcactatagattcaaacaatcccaatcaaaatcagttgtgaatatcaacaaactaattgtatagttagtttatatagagaagcaaaagacccgcagggcgtagtggctcgcgcctgtaatcccagcacttcgggaggctgaggtgggtggatcatgaggtcaagagatcgagaccatcctggccaacatggtgaaaccccatctctactaaaaatacaaaaaattagctgggcgtggtggtgggcacctgttgtcccagctacttgggaagctgaggcaggagaatcacttgaacccaggaggcggaggttgcagtgagccaagattacgtcactgcactccagcctggagacagagtgagactctgtctaaaaataaaataaaataaaataaacccaaaataggtgacaaaatactgaaggaaaagaacaaagtcagaggactgacactacccgacttgaagaattactgtaaagcggccaggcatggtggctcacacctgtaatcccagcactttgggaggtagggtctggtggatcacaagttcaggagttcgagaccagcctggccaagatggtgaaaccccatctctactaaaaatacaaaaattagccagatgtggtggcgggcccctgtaatcccagctactcgggaggctgaggcaggagaatcgcttgaacttgggaggtggaggttgcagtgagccgagattgcgccactgcactgtagcctgggtgacagagcaagactctgtctcaaaaaaaaaaaaaaattactgtaaagctacaataattaagacaatgtgttttggacaaagaatagacaaatagatcaatggaacagaataatgaacccagaaatagacccaactgatctttgataaaggaacaaagacaatacgatgtagcagagatagtcttttcaacgaatggtgccagaataaccgggcatccacgtgtaaaaatatgaatctaagcacagaccttccaccctctacaagaattaattcaaagtggactataaacctaaatgtaaaatgcgaaactataaaactcataaatgataatataggagaaaatctagatgaccttgaatatgcttacaactttttgtatacaataccaaagggtacaatccatgaaagaaataataaactggattttattaacattgaaaacttctactctgtgaaaggcaatgtcaacagaataagacaagccacagactgggagaaaatatctgcaaaagatgcatctaataaacagttgttatccaaaacagacaaagaatcttaaaattcaacaacaagaaaataaggccgggcgcagtggctcacacctgtaatcccagcactttgggaggctgaggcgggtggatcacaaggtcaggagtttgagaccagcctggccaacatagtgaaaccccgcctctattaaaaatacaaaaattagccggggcatggtggcgcatgcctgtagtcccagctactcaggaggctgaggcaggaggatcgcttgaacccgggaagcagaggttgcggtgagctgagatcgggccactgcactccagcctggaagacagagcgagactccttctcaaaaaataaataaataaataagtaaccccactaaatatgggcaaaaaacctgaacagccacctcactaaagaagatgcaaaggtagcagataagcatatgagaagattctccacatcttatgtcactagggaaatgcaaattaaaacaaaaatgggatatcactgcacagctactagaatggccaacatccagaacactgacaataccaaatgctgatgagaatgtggaacacctattcattgctggtggacatgcaaaacagtatagccattttggaagacagtttggcagtttcttccaaaactcaacacactcttaccatatgatccagcaattgcaatccttggtatcttcccaaatgaattcagaatttgtgtttacacaaaaacctacacaggcttttttttttttttttttttttttttttgaggcagagtctcactctgtcactcaggctggagtgcagtggtgcgatctcagctggctgcaacctccgcctcccgggttcaagcgattctcctgccttagcctcccgagtagctgggattacaagcacctgccaccatgcctggctaatttttgtatttttagtagaagtggggtttcaccatgttagcgatagccaggctggtctcgaactcctaacctcaagtgatccactcacctcggcctcccaaagtgctgggattacaggtgtgagccactgcgcccagctgagtggctttatacagaatgatacgtaatgccaaaacttggaagcaaccaagatgtccttcggtaggtgaataaaataaacagtagtacatccagacactggaatattattcagtacttaaaagaaatgagctatcaagccatgaaaagagatggaggaaacttcagtgccattactgagtgagagaaggcaatctgaaaaggctacatattgtatgattccagctatgtgacactctggaaaaggcaaaacaaaaagtcagtcattgctaggggttcagaggggaaggagcaatgaagaggcagaatgcagaggatttttagggcagtgaaacttctctattatgctatgctatgctatgctatgctatgctatgctatgctatgctatgctatgctatgctatgctatgctatgctatgctaatgctatgctatgctatactatactatgctatagcggtggaaacatgttattacgcatagaatgtttaacaccaagagtgaaccctcatgtaaactgtagactttgggtcataatgatgtgtcaatgtaaggctcatcggttgtaaaaaaacaatgtaccattttggtggaggaagttgataatggggagtctatgcatgtggggcaaggggctatatgggagatctctggccttccttctccattttgccatgaacctaaaactgctattacatatatagttgctattctctctatatataactgctattatatattatatataatatatatataatatataactgcttatatatatatatgtctttaaaaacaataaaacaaacaaacaaacaaaaacactcccagagtactttgcctatagaccttcttctattcataagtgtttttacctccactcccatctcattctatctgtatctcgctctacttaacctgagctatactgaatttgcattcggtttggacaagtcttagttcctcttttggcagatcatcttcacatttccatcaacatgcagcacaggtggaaaaaaaggggccaataactggatctgcctggggaatctggaagcccaagaggagctgcattttgggaaggagccaggctaggggcttaaactctgtacttgggggtagggttgcaacactggctcgaaggggaagaaagggattatcctcaacctttcacacatccagactctgggagatgcgcaggcttagctccctggcagggctaccagtgaaggcagggagaagggcagaggcttggaggccacagccacaggccatagaacagaaggagcagctccaggcatccagctggtggaggccacctgccctgagtgctgtgcgccactcttcacagccagctgtgctgctgctacccatcccagtctcacaggtcttgacctggagatacatttgcaacattgattatagaggctcaagttaatgttattttagattagagtttcccaaacttcagttgtgccatgttcagggtttcaacgtctcagtgcagtagtaggtgcgggcacacacacctgtgatccatgtcacccagggctgccgtacttctgaacaggtcagacagaaacagttactaagacattgagggtatgcccaggtcatgtgcaaggactgtataaaggtgtcaaaaaacttcctgccacttacttgaggctcatcctaagcaataaaaatgttggaattgcctggacatgtggctcatgcctgtaatcccaacactttgggaggccaagacaggaagatcacttgagaccagcagttagagaccagcctgggcaatacagtgagaccccaatcactaaaaaaagaaaaaaaaaattagctgggcatggtagtgcacatgtgtggtcccagctatttaggaggctgaggcaggaggataacttgggcccaggaggttaaggctgcagtgagccaagattgcaccactgcactcctgcctgtgtgacacagcaagatcctgtctgttaaaaaaaaaaaaaaaaaaaaaaggaatcacaggtctgataagttgttatgctttctttcttttttcttttcttttttttttttttgagacagagtctcaaaagtgcagtggcacgatctccgctcaccacaacctctgcctcccaggttcaagcaactctcctgcctcagcctcctgagtagctgggactacaggcgtacaccaccacgcctagctaatttttgtatttttagtagagacagggtttcactatgttggccaggatggtctgcaacccctgacctcgtgatccgcccacctcagactcccaaagtgctggggttacaggcgtgagccacctagcccggccctgttatgctctttctaatgaatactgaaactataaagatggccagctatggtggctcacacctgtaatcccagcactttgggaggccgaggcttgtggatcatttgaggtcaggagtgcaagactagcctggccaatatgatgaaaccctgtctctactaaaaatatgaaaattagccaagtgtggtggtacatgcctataatcccagctacttgggaagctgaggcaggagaatcacttgaacccaggaggcggaggttgcagtgagctgagattttgccactacactccaccctaggcgacagagtgagactccatctcaaaaaaaactgtaaaaataaacattataataaaaagctgtcagccattgatgtacctttaccacccattggtgataattgtaccacattttggggaaacattgttttaactaaagagtgttattgttttgtttttagagatagggtctggctctgccgcccaggctggagtgcaatggcatgattgtagctcactgcaaccttgaactcctggcttcaaacaatcctcccacctcagcctcccgagtagtggggactacaggtgcatgccaccatgcctagctaattacttttaaatttttaatagagatagggtcttgctatgttgcccaggctgatctctagctcttgagctcaagtgatcctcctgcctcagcctccaaaatgctaggattacaggcgtaggccaccgtgcccagccaaaggtggacaataaattgtagaaaataatggataaccttctgagcaaaggaaaatgtaagatacaagaattaaatagcatattagaagagagtgaatgacaaatgaagagaaaggtacactaacacctcagttacctgctagagagagacattcatccagcctagccagtcatttccttctccttcctcccaccacctctttccttctgaacctctggttcagatgcagagtccttagcctgtaactctggatcgttcaacccatcagcacataagaaacttgctcttctgagaatgaaaataagcagcaacacaatttccttaacaaccaaggatcttatagaggcaagaactagaagtaagaagaaaacacatactagggacagaagacatggactggaggtcttgggccaattaggtgaccttattcctatctcagagcctctccaactcatggcttcctcaactcattcatttaacaaatgttttctaaagcaatgaccgtgtaccaagagttgcctcatgcactcgggctgcagcagtgaataaaacaggagaggccctgccctcagagatcttgtgtcctagtgagagtgacaggcaatacatactaaataaataagcagtgtaactttaggtggtgagcagtgctatgaaagaaattaaacaaatgataaagacaaattggggaggaggcatcctgtgaagaggttggtcaggggagggctcctgggggaagtaacatttgagctgagacctgaatgtactaggaagggccagccaggagataagccagggaaagaaggttccagacagagggacaagcaagccttgcggtgggaccgctctcggggctggctgccaatccaggaaaacagcactgggtatgcagttgtactaggtgaatggttttgacacagcacaccaagcagtcctacagttccctggtggtgtctcaagggcggaggggccaaggacagagactctgccagactcacgccaccctgcccaaaacacacacagagaacgagagagagagagagagagagagacgcgtgcacatactctgcttcaacaaaacagctcttctttaatccgaagtgtatattgggtggctgcttaagattttgttcgaggaccaggttcagggatcagaaattcttgatctcaaaagtccttttccacactttgtttgattctctgcaatgttacacagcctcagcagtggtcatagaagggttcgttctattctatccattggcaaggagtcacagagtgcagctcccagcaatctggctctcctctcaccgtaacatcccaccctttcccctccagcagtggactggaacctctgatgccttccaagcccatcccagctacagagggacacacatctctgcctcttcctaggagattagactgatttcctttccttgcactgtccaaatgagacgctttctgtcctacacagtagagctttgtgaagacagccgagaaacggctcaagttttttccaacctgtaaaatgcaaagttggccagctgcctctcttcctagcctcaaaactcatatatttcctgtctccccggcagctctaagagaagtctctactgtcctggggtttggggaaagcactgctcagaatgtgaaatcattttctggtaatacggatctaattagctctttgactgacaagaggaagcagaggccaaaagggagttaaccaatctgtttttcagatatttcaaaacaagtgaagaaccagatagggaaacagagagaaagagaaaataaagagacaaagcctagggagcatttggagaagggagtgagtaagaagagaacggggagggagaatatcaagtgactaaagtatcaatcctctgttcttccagcttcacctctactcccggtctcccctctgctctcttccagagagaacttacttgaaggtcgatgttttctcttgctgattccatctcgctgccctcaagtcccttcacacgcaccgggtgccgggaacagactgcgtgggctcctccaggctccgccgtctgagtctctgctgctttcttcgggtgggagagagcacacagctggcgggacagacctgccattcatccctctgatgtgggatgcccgtcttggctgcagcctctgggggaggtgtgcacctgcacacacgtgtgagtgtatgtgtgtgcacatgtgtgtgctccaggaggtggcacatggcacactgataggtgaccttttgagttggtagtgacagcatcattttcaccagtggctccagtgaccttccagtcccagcggagccatctgaggtcacccagcctgctttgagctagtagctttatgactggcaaagaaatcctgcatgtttatcaagcaaattgaaaaacagcctgaggacaacgctatctgacttcaccgctgggtccagtccccagtcgccacgggtggagtgacctccagcacagtctcaatactgaggcagagggatttccgttgttctttgctttgttccctatatccctaaaagtttttaaaaaaattgtagtttacctaataggctccaaagcataggctttgttctgcaaagtgagtgaacaatacgtttttactgacggattgtttgattccttcaactcctcccttgattagccatagagggagcagggagtagttgtaccttcgaagcttgtttatgcaaacagtggtattctccctacttttaaaataaaattaccaggagggagtctttttttagaaagttttttttttcctctcctgtttaccttagagcccaaaactcttctggcttgttcctgaagcaaggtttagacacaagcttgtgcaggtgtgggtgtgggtatgtctgtagacgtgcatggcagggtgttaacctgtaatccaattcagggcttgaagaggtgcgggcaggaggaagacaggcagagtcaacacgtttaccctcaccacattcaaatgtaaaaaaaaaaaaaggcgatttcttcagttctatgaaatgcctttataagttcccatccctctggacagtggtgcgagggagggttggatgattggatgggggccatattttagtctaatctatgaagcatagttggatttaatcatttaaatggtaaacagtccactttagacacaatgctcagtctttcggatttgcagaagatggcacctaggtgcacaggagggcggggtggggacggttcttgcatctatcctgtggcctctccatctcggctcctttctgttctggagctgctgggcccacgggcccgcccgaattgctgactgctgaggagacacaggtcctgctcctgggtcttctgctggccttggtggctgatgtctgatattaggccagagtcactcatgggtgattctctttctgcctttgagatccagtgttctcccttgctgtctgcgctaccttggctcgtggcaatgtggaccatcctgagacctggctttgacttgtatgtgcccccatcccactgtatccgctcagtggcccacatctctaagataagcccctcgaaattttcctgtgagatgcttgaccagtgctcctgagcccccttaggcacatggggactgagggctgctgacgaagggcaggggaaaggcaagctcagccccacttccagcagagtttgctctgatgtggctgctccaactgacacagggcagtctgcgaggtgatctccttccacattcctgaatggaaatgagacctggaacccactcttctcagcactccttaaaaagtctaccagtaatatctatcaccccaccgctcataataataccactatgtatcaagcactattctaagcacttttttttttttgagatggagtctcgctctgttgcacaagctggagtgcagtggcgccatctcggctcactgcaacttctgcctcctgggttcaaacgattctcctgcctcagcctcccgagtagctgagattacttcttcccatagtccccttaatctagaatcagaaaatgtacgctttgtcttctttttttttttttttttcctgtttggctgggatgtatctgatgtagaactctatgacaacaattcaaagggaaatgaagaaatttagaaaatcctctctctcaagaaaacctggttgtcaaaaatattgtcttggctgggcagcatggctcatacctgtgatcccagcacttcgggaggccaaagccggaggatctcttgagcccaggagttcaagaccagcttgagcaacatagtgagatcccatctgtagaagaactttttggctggacatggtggctcacacctgtaatcccagcattgtgggaagtagaggcaggaggtcacttgagcccaggggttcaagaccagcctgggaaacacagtgagatcctgtctctacaaaaaaaaaatttttttttaatttagctagatgtggcagcttgcagcacctgtagtcccaggtacttgggaggctgaggtgggaggattgcttgagcctgggagctgaaggctgcagtgagctatgatcatgacactgtactccagcctgagttgacaaagcaagaccatgtcttaaaaaaaaaaaaaaactttctggaaaaccttatttcggatgccagaagcaaaatattaactatttatttctctttgcactcctgttgtgaaaatcctcattatcttttaaataatatggatacatctggctgaatagagggaaacaggaacaaaaaaatgcaaaagagaaaagtactcgaatatatttcaaaaaatttcctattaataagcacattggtttgaaaaggaaacagctgtaattggttataataatggttttggtttggcaagatctttctggatttggacctttccccatctcataagcatcatttggaagtaaacagaaaaaaggctttggaaaatggtttatctaccatatcacgctgtaaccctggaccaggggtcagcaaagtttttctttttcatttttcccttttataaaattcaaattgctatatgaagcttttttaattttaattttaattttttgagacggggtctcactctgtcacccaggctggtgtgcagtggcacagtctctgctcactgcaatctctgcctcctgggcttaagtgatcctcccacctcaggccccaacccccagcccagtagctgggattacaggcgcgtgccaccatgcctggctaatttctgtattttttgtagagacgggggtttcgccatgttgcccaggctggcctcaaactcctgagctcaagcgatccgctcacctcgatctctcaaagtgctggaattacaggcgtgggtcaccatgcccagccagtaaactttttctgtaaggggccagagagccaatattttttagcctttgtgtgtcatatggtttctgctgcgatgactcacttctataataatgtgaaagcagtcatagacaacatgtaaatgaacgagtgtgggagtgttccaataaaactttatttacaaaaagagtcagatattcataaaaacagaccggagttggctccacaggctatagtctgctgacccctgctctaggatttaatcagagtctttgaagtctaattcccacttgagaggcaactactgagtctctaccacgtggatattgggttaaacactgcggggatataaaagcaccacatgcacgccctggtgagacaactgatggcaagggaagctgtagtgaagagtgttgctgccatttggctggtgctgaaactgcacctacgtggaggttatcactgtgggtggaaatggtttctattgttctttactgctagggtgatttttgtggtgtaaagccagagggacatttttagggagactgtctcttggaaagcatattttggaatatccttgaacttacagataagtagacactcagagtgactcagaaactactctgagtctagtttcatggaatgaggggtctacaatgagaccctaggtatcttgctatgtagaaggagcaaagcattgttgtagggtactgaagaaggcaacagcaagaagatcctttaattttgaattgtgggaaaagctctagggtgaaagccaggtggcctggattcctctctgtgtgctgagtcactgtgtttttaggcaagtcacttaacttctctggggcttacattcttgtttgtgaatgtgaagctatcaaaagagttgattcctaagatccctctagctcttaaattctgtttctaatgtgtgttttggccaggtgtcgtggctcacacctgtaatccagcaccgaggtaggcagatcacctgaggtcaggagtttgagaccagcctggacaacatggtgtaacccctctctactaaaaatacaaaaattagctgggcctggtggtgcatgccggtaatcccagctatttgggaggctgaggcacaaaagaatggcgtgaacccaggaggtggaggttgcaatgagccgagaccacaacactgcgctccagcctgggtgacagagtgagactctgtctcaaaaaaaaaaaaaaaaaaaaaaagtttatattaaatacttcctgtgtaacaatataaaatctcagatacaggtctgaatttcagtgtgtaaaagttgagggctagaaattattggctttttaaaaaattgaagcagagcaagaagaatctaatgcttttagtttaattttaccaataagaccttccctgatggaaaatttatgtaattagaaaaattttagggaaaattaccactgtctgttgcccctgctcatggagactgagtagggcatacccacgtcaaacaagatacagaagtgagaataaaagctgacttcaaaacattcttacaaacttgcttatgcccatttacacatgaactcagctgctttcaaattcacttctccaggaatcccagggccaacagggatggcaaagggaagctttctgagggcctatggagggagctggtagtgcagtaaatgttattgaacatttccatcttcactcttcaatatagtagccattagccacattagccaattgagcacatgaaatttggttggctgagtaggaatttgagttttaaatctgatttagtttcaataaattcacatattttgattttatttatttttaaatttattttagagacagggtcttactctgtcacccaggctggagtacagtggcacaatcatagctcactgcaacctcgaactcctgggcttaagtaatccacaaccttagccttcccaagtgctgggattacaagcatgagctactgtgcctggcctaaaatcaccccccactttttttttttttttttttttgagacagagtcttactctgtcccacaggctggagtgtgctggcgtgatctcagctcactgcaacctccacctcacaggttcatgcaattctcatgcctcagcctcctgagtagccaggattacaggcgtgtaccaccatgcccagctaatttttctgtgtattttcagtagagacgtggcttcaccatgttgaccaggctggtctcgaactcctgacctcaggtgatccgcccacctcgacctcccaaagtgctagaattacaggcgtgagccactgcgcccagcctctaagttcacatttacgtggttacatttaagtagctagtagccaccttctcggccagtggagctatcaaccaaaattccacatttagaatcctgtcattgtgtatgtgtcacttctatttggctgctcacgccttgatagatgctcacggggcctgacttcacacaaataggaagtcagggcacacagctctcgtgggaatgccccacgaggcctggggatgctcttggtggtggtgagtaaaatttcccttcactctttcacattcagaggagggggattttaactgtgactcactgttcaatgaatgattaaaaacagagcctccggttgggcgcggtggctcacacctgtcatcccagcactttgggaggctgaggcgggtggatcacgaggtcaggagttcaagaccagcctggccaagatggtgagaccccgtctctattaaaaatacaaaaaaagtagctgggcatggtggcgcgcgcctgtagtcccagctacttgggaggctgaggcaggagaatcgcttgaacccgggagggggaggttgcagtgagctgagatcacaccactgcactccagcctggcgacagagcaagactccgtctcagaaaaaaaaaaaaggtgcctggcactctcttggtggcttaagggagaggaatagatgatcttttcttagtgataggagagagacaaagatcagtggtttgcaaactttttaaagataagaaatccttttcttaaacgtaatcttatgtggaagttaacataaagcagattaaagtgaagctgtttgaatgctagagtcacatccacttctgccctatctgtcccgccacctaccccccgcaactgccccgttccatttctcgagctgccccttaaggcacctcttgggaaccaatggacttctgctcaggaggcatatggtaataagcctctaagggctggtgtgtgggggggctgggcaaccccaagtcacacaaaattgtgtggaggtttcaagtcttgaagtgatatttaaaaaaggaaaaaaaggccaggagcagtggctcacacctgtaatcccagcactttgggaggccaaggcggttggatcacctgaggttgggagttcaagacaaacctggccaacgtgatgaaaccccgctctactaaaaaaaaaaaaatacaaaaaaaaaaataattagccatgcgcggtggcaggcgcctgtaatcccagctacttgggaggctgaggcaggagaatctcttgaacccggaaggtggaggttgcagtgagccaagattgtgccactgcactccagcctgggtgacaagggtgaaactccgtcaaaataaaagaaagaaagaaagaaggaaagaaagaaagaaagaaagaaagaaagaaagaaagaaagaaagaaagaaagaaagaaggaaagaaagagaaaagaaaagaaaagaaaagaaaagaaaagaaaagggaaaagaaggtttacaaagcacagtcaaaattatagccacttatccaggcagcagacaggatgctggcccacaggacctttttaactgacaaagtgttcctcagacaccccacctatgaagcattcttgccaaaaatattgaaactgaatatgctctagatctaatttccagtttataggaaacacagggaagacaggaacatattacagacactcagggatggattaagcctgggaaattctacagtgcaaacaacctgacctggtttcttcaacaaataaattagaggaaaaaagaaaagaaggaactcatagatgaaaacttaagagacaggcccgggtgcagccgctcacatctataatcccggcacttcgggaggctgaggcgggtggatcacttaagtccaggagttcgagactagcataaggagattctctctctacaaatgattttttaaaaaagtgagcctgggctgggcatggtggctcaagcctgtaatcccagcactttgggaggctgaggcggatggatcatctgaggtcaggagtttgagaccagcctggccaatgtggtgaaaccccatctccactaaaaatacaaaaattagccaggcatatggtgcatgcctgtaatcccagctatccgggatgctgaggcaggagaattgcttgaacccaggaggtggaggttgcagtaagccaagatcgtgccattgcactctggcctgggtgacaagagcgaaactctgtgtcgaaaaataaattagcctggtgtggtggcaagcagctgtatgtagttccagctactcaggaggctgagttgggaggactgcttgagcccaggaattcaaggctgcagtaatctgtgatcacaccactgcactccagcctgggtgacagagggagactcatctaaaaaaaaaaaagacctaagagacatatcaaccaaatacagcgtatagactttgtttggattatgttgcaaacaaaccaactgaataataaaacctatattggataaccagggacatttgaatactgattagatatctaatattattaaggatattttgttaactttaggtgatatatggtattttggttatttttatttttattttttttgagatggagtctcgctctgtcacccaggctggagtgcagggcgcgatcttggctcgctgcaagctccacctcccaggttccagtgattctcctgcctcagcctcccgagcagctgggactacaggcgcccgccaccatgcccggctaattttttgtatttttagtagagacggggtttcaccgtgttagccaggatggtctcgatctcctgacgtcatgatctgcccgtcttggtctcccaaagtgctgggattacaggcgtgagccaccgtgcctagtcagcattttggttatgttaataaaaagagtcattgtttttaaagatattttagatggaacaatatgatgtatagtatttgcttcaaaataatccactggtagggtggtgagtgggaatacaaatgaaactagattgcttgtgtgttgataattgttgaaaatgggttttgggcacatgaagatatattactctctctgtttttgtgtatgttggaaaatttctacagctaaaggcttttctaaatggcagggaaaccacaaagtgttcctcagacagagatgtctgaatgtcactgatgcactgtgtcttgaattgcacaggggactccggtcggggtgtggggaggatgcaagctcgaaggtggcagtggagagtggacagaagagacagcagccaagtctttaagactggatggggacataggaatggagttctgagtagaggatggaagtcagagtttagagtctcaagaaaaccacaacaaaccctccaatggaagtaccagttcaactaccacttcattttacaaatgagaggagtagttcagtgtcaaggtgggactagagacttacaagacgagtttcctggctatccctttaaatcacacagatgtatacatttgagagtgtgtgtgtgtgtgtgagagagagagagagaaactaatacaggagtagttgctttcagagtactttatgctttcagagtactttgtacatattttattttattggatcttcacaatgacccagtagcaatttacagatgaggaaactaaaaccaaagtgtcctgtccaggatcacacagctggtgatggagccaggactcagtttgagatttcttccttccaattctttcttttttaacacagaccccctcaatcctcaatacatgcacagcacatgtgcacacacgcacgcacacacacacacatcattattgctacctgtacggtggagttcaacatgttgttgataataactcaccatcacctaaggagacagacctagtcttaactcctggtcctactatttactaggggtgtgtgtgtgtgtgtgtgtgtgtgtgtgtggttacatagactttgttttttagagctgttttaggttctcagcaaaatcaatcagaaagtacagagagttctcctctatcaccccaactcatggcctcccccactgtcaacatcccacaccagagtggtacatttgttgcaatcattgaacctacattgacacatcattatcacccaaagtccacagtttacattagagttcactcttggcatgatacattctgggggtgttgactagctgtgtttttgagcaacttactttgcttcctttctccctgtgaagatgggatcgtagtgcctactttagaaagatcactatgagaactaaattaaatcagatcatgcatatcaagcaaattacctgcctggcacagggtaaaagaacccagtaaatggagctgatgttaatattcatgcaaatcccctcactatgagcccagctgtgtaactgctgaatcttccccttgttctctttgatctcagcccagaacctctcgtttgcacctggatgactcggccagagatgatttctagaagttccttaaagatattagtctgtgggctgggcacggtggctcacacctgtaatcccagcactttgggaggccgaggcgggtggatcacctgagatcaggagtttgagaccagcctgaccaacatggtgaaaccccgtgtctactaaaaatacaaaaattagctgggcatggtggcgggcgcctgtcatcccagctactcaggaggctgaggtgagagaatcgcttgaacccaggaggcagaggttgcagtgagccgagattgtgccattgcactccagcctgggcaacaagagcaaaactccatctcaagaaaaaaaaaacatgtattagcctctgaagatttactgtgctgctgagaggaacttaaagtttggttcttggggaaagagctgttaggtaagctgggatgcaatagacataggttcacagaatgaacccttatggtgggctgtgggacaaaaaagtttccaatttggacccctcaccaagagaaacagaaggggaagagaaagtacaggagggaaaaatcaaagcgtgggggcgagctgctgcttttagccatggtgaaggtgaaatcaggaaacttcagtggggtttgtcaaagaagaccttcaatacatactatgaactatggaatatgcaaaacgagaactattttgtgcatttctacccccttctccttcatactgttgaccttcaggtgcctacacagggtagctgggggaaattaaaaggagcagagcttccagcattttttcttttgtgaacaaccctggtaaaaagattttgtgccaacggttcttggtttctcctctgacaaccagttccttcccctgctattcttacagcattcagagtctgcacaacagcactgacatccctgcttcatgtgcaactgtgagtacccatctgtaagcctttgagaacagggactgtggcttctacttctgaaactcccacagcagtgagcccctgcagataagcacatactaactgatactgggcttctgagggggggcccccttctgcatagtgtagtgctaggtccccagatcaagtcagatgccaacgagattcttgttagaaaagctgtgggtaacacagacccaagagagtggggtgcaaaaatggaaatgcagtttcctgaacattgtcataatgtgacatcgattgctgtgtgatcttacgtgagtcatttccttcccatctgttaccttggtttcactcatctgcagaatgagaacagttttgtaaaggcacatgcatatattcattttttttcctgattagaaaagtaatatatatttcttgtagaaaatatagaatatacagaagaatgtgtgagaaataaaagttcccacttaaaaccacccggaggccagacacagtggttcgcgcctgtaatcccagcactttaggaagttgaggttcgaggtgggtggatcacttgagtccaggagttccagaccagcctgggcaacatggcacaatcctgtctctacaaaaaatataaaaattagccagacgtggtggcacatgcctagtcccagctacttgggaggcagagttgcagtgagccaagcttgtgccactgcactacagcctgggcgacagagtgaaccccccacccccgccccagaaaaacaaaaaaggaaaaagaaaaccatccagagattaaacattgtttacatttcggtttactgctttttgtttttatttatttctattaaacatttgatgtaggccgggcgtggtggctcacacctataatcccagcaatttgggaggctgaggtgggtggatcatttgaggtcaggaattcgagaccagcctggccaacatggtgaaaccctgcctgtactaaaaatacaaaaattagccaggcgtgatggcgggcgcctgtagtcccagccactcgggaggctgagacgggagaatcgcttgaacccaggaagtggaggttgcagtgaaccaagatcacgccactgcactccagccacagtgacagagcaagactctctaaaaataaaaataaaaataaaaaatagaaaatagaaaaaattgatgtaattggtttattgctttttaatcttttctgtgtgtgtgccgtgtgtgtgtaatttgcggagtccagtgcaaaatgaaaacctaggccccttgttcccaaattatgaggaacttcaagaaggccacagcagagcattgaacccactctggagtcctgtttgactgcgtggtcacgtgcccatgaagtgggctctttgtattccctactcagaataataagatcatttattgagggttctctgtgtgtcaagtatttcatttaattagttataatttaattcagcttctttgatataaatacaattcttccccctcctcatttttgcagataaaacaactggggatcagaaagtttaagtagcttgcccaagttcatacagctagtcagggcagagacaatattcatacctgagtctttctggcttcaggtctgtgcttttaacattgcagcacattccctctaatattaacttttttttttttttttgaaacggagtctcgctctgttgcccgggctggagtgcagtggcacgatctcgactcactgcaagctccgcctcccaggttcacgccattctcctgcctcagcctcccgagtagctgggactacaggcatgagccagtgcgcccggccctcatattaacttttataaattcatttaaaaattattaataaagttgagattatactatacataaaatcttatattgcattttttttcattttatatcacgattgttttttcttcctctgttattaaacagaggagaaaaactgcggctatttatgagaaagagtgaagtctaaatgacaaagctctgagaagaatttcattgcaagattagattaaatacaaaacatcaatgatccaaagcaggagcacgtggtcagtggagacttggcaaaggctaggctgctgtatttaacccacagcccccgactgataaatagaatataaacatctcactctccctgctctgaacatcctccacattaaagaggatacctttgcagatccccgacagtcaagatttctgtccaatttacttttcacaaaagtaaaagtttcattgtaaaatgaaagcaatgggtcctttttcaagcataaataatattatatggaatataagtttcaacctcctccttacacacacacacacacacacacacacacgctcgaatacccttatgggggtgtgcagccccgtcttccttggcaatcactgagttatatgtaaaacagagccagtactgaaggtaatattaaaaatgttactatgcaccactgcagactttgggaaactgacttactctctctaagtctgaggagccatgtgtgtaaaatagagctcataagagctacctcaacagaatgaggaaagaacctaatgggtaggcttttcctgaagctgggacttctaagccaagagtcaagcttaggttactgcgcattagattttctttgtaggccttaattcctcaacgaaaactgcaaccatggttagggtccctgggatctggggctgaggaactgggggagaagaggagtaaggcctattcttgtacccatctccttttgtttgtcacagttcttattttctagggaactgtggttaaaaggaagacagagtacagctaccttttagggagagaaaaaaaccaaaacacaatcctcagctttcaaggtgtatgagggagagagcaccaaggtagtgatttacccctgaagtcagctgagtcttggggaatttaagcagctaagggacacaagcttcaggccacagaaagtgaggaccactggggcaggaaaaaaaatccctcttcgtttggtgttaagtttccacctatcaaaatgcgtctttctagatgacttgctgccctttgctggcaagctctcccaatgttgtgcaaagagatttaataagaaataacaggctgggcatggtggctcaggcctgtcatcccagcattttgggagaacaaggcaaaaggatcacttgagcccaggagtttgaaaccagcctgggcaacatagcaagaccccgtcactacaaaaaacaaataaaaataattagctgagcatggtggtaaattatagtgagctatgattatgccactgcactctgggtgacagagccagaccttatctctaaaaaaaaaaaaaaaaaggccgggaacggcggctcacagcacccagcactttcggagcactttgggaggctgaggcgggcagatcacctgaggtcgggagtttaagaccagcctggccaacatggagaaaccctgtctctactaaaaatacaaaaattagccaggcgtggtggcgcatgcctgtagttccagctactcagaaggttgagatgggagaatcactggaacccaggaggcggaggttgtggtgagctgagatcaggccattgcactccagcctgggcaacaaaagtgaaactctgtttcaaaaaaaaaaaaaaagaaagaaaaagaaaaagaaaaagagggccgggtgcggtggctcatgcctgtaatcccagtactttgggaggccgaggcaggcggatcatgaggtcaagagtttgagaccagcctggccaacatggtgaaaccccgcctctactaagaatacaaaaattagccagatgtggtggtgcatgctgtaatcccagctactggagaggctgaggcaggagaatagcatgaacctgggaggcggaggttgcagtgagctgagatcgtgctattgcactccagcctgggcaacagagcaagactccatctcaaaaaaaaaaaaaaaaaaaaaaaagaaagaaaaagaaaaagaaattaaaaaaaaacatgattagactttagatacatacagtgcctgtccggtgttccccccaaatctgtctcctgaggcccagcaggcacgtaaccccaggtcactcacagtgaatgaggaagggatggcgatgggtgggcccctgtgtttggaggctctgacgctgttctctcatgcactcttcccactgtgccccagctgggagtttttttctctttctgctctttactagcactcctctggtgcccttttctctctctctttttgtaccttcttcaagaggctgaggtcaagcccttttctcattaagactaagtaacctgcggacagaacctctgtgttctccaaatgttttcctataatgtcgtcacacatgggtcacaggacgaccctgcgtacccctttatttcacagaccaggctgcgccaagagcccatggccaaacactagcaaaggacagagccacggcttccacgtgagtcgtggacatcgactctccctgtattctttcctctgttccttgctgccttgctcccccaggcatacacacctcctattccaggatacccttgcccttggccaagcctccctcttccttcctcgtccattctgttcctctccttccatcagcagttcttcctctttatgcttttccatcacagcatctggccacgtcctcccccattttccacgtaaagcttcagttttctaacactttcgacttgactttgaaaagcttgcaagtgggaaagacccttatgcttttctgccttggaattttccccgccccctttactgcttgagatgaacatctacttgagaaactgagaatccttatcatcacagtgggttacattttggttttacttctcattatgatttttgaattattagtatagtgtaagttcattgcagaatatttggagaatagagaagggaaaaaataccgtaaacaacgtcataatcccaacacccctgcacttagtctattttaataacgatgatgttttaagaagaaattgactctccacttactcctataattaccacactatttttgcacttaagaatgtcttttcagctcatggtccctttgcaagacactactgtccattcatgagcacagggcaccattgactgctcagccttggtctgttagagagtaacataaattcagtttcatttaaggaactggtcagcttattttaaacacttccattgccttctaggtcaaagaagccctctgtgagaagggcatttggaccggctgatctttggataacaataactgttacttagggatagaaggaatatagaaaatgagtctatatatatagactcttgaacccaggattttgtcaccagcctgggcaacatagcaagaccctgtctctacaaaaaataaaacaaaaaaaaaaaaacaaaaaaaacttttttaaattaaaaaaatttgaaataaaaaaatatgtagactcattttatatattccttctatccctaagtaaccccctccatgaacagaggatgtattctgtacttgcctaaattgcaagaaatgtttgaatggctagatctggaaaatgttgtgttgggttaagcacagtcctgagctcaggagtctaagaccaacctgggcaacatggcaaaacctcgcctctacaaaaaatacaaaaattagccaggtgtgatagtcccagctacttgggaggctgaggcaggagaatcacttgaacccaggaggcagaggttgcagtgagccaagatcgtgccattgcactccagcctgggcaacaagagtgaaactccgtctcaagaaaaaaaaaaaggaaaaacatgaacagcccagcagagaaatgggcaaagaatttgaacaataccatgcagcagaaaaagaaactcaatgaccaaatatgaaaaaaggctccactcactagcaaccagggacatacaatttaaaaacaacactaagatacaatttcacacccatggaactggccaaaagtaaaatgtttgacaatagcaaatgttggcaaagaggtatgaaaatgagaactctcatgcacatctggcagaagtgtaaatgacaaggtcatttgtgagaataacttgacaatatctagaaaacttgaaaatgtccatagtccggctgggcgcggtggctcacacctgtaatcccagcactttgggaggccgaggtgagcggatcacaaggtcaggagttcaagaccatcctgccgaacttggtgaaacccccatctctactaaaaatacaaaaaagtagcagggcgtggtggcgggcgtctgtagtcccagctacttgggaggctgaggcaggagaatggcgtgaacccaggaggcggagcttgcagtgagccgagattgtgccactgcagcacaattgtgtcactccagcctgggtgacagagcgagactccatctcaaaaaaaaaattagccaggcgtggtggcacgtgactgtaatcccagctactcaggaggctgaggcaggagaatcacttgaacccgggaggcggaggttgcagtgagccaagattgcgccattgcactccagcctgagcaacagggtgagactccatcccaaaaaaaaaaaaattgtaaatagtttgttcatttgtaggagaatagataaataaatcacagtatatttctaatgtggaattctatataacagtttaaatcaatgaactagatctatatgattcagcattgataagtcctgaaaattattgactaaaaattgtacattataaaaggatgatcccattaacaaatattttctaaaatatgcaaatgaataccatctctattacagtgtatttgtagtgaaaatataaaatagggtctagatacacgtcacattcatgtggctgcttctagcgggagagggaagcagttctgggactgtgatagtcattaggcctctttaagagcctttctggccaggcgtggtggctcacacctgtaatcccagcactttgggaggccgaggcaggtggatcacaaggtcaggagatagagaccatcctggccaacatggtgaaatcctgtgtctactaaaatacaaaaaaaaattagccagacgtggcggtgtgtgcctgtaatcccagctagtcgggaggctgaggcaggggaatcacttgaaccccggaggcggaggttgcagtaagccgaggtcgcaccactgcactccaccctggagacagagcaaggctccatctcaaaaaaaaaaaaaaaaaaaaaggaatcttctggatttccttccagtacatggtaggattgtatgtccttacattctttgaagttaggcacaaccacatgacttaccgtggccaatacatgtaagtggaagtgttacttttgggtggaagatctaagaacgatatgcacaatttaccgagctcttccctttgctgtagtgatcatcaatgtttcagattcagtgtttcagtccacttcatccgctgggtcctggagtgaagacagtgtatgatagtttccaaatgacccacagtgaacatgaggcatgactgagaaatggatctctgcttccttaagccactaaaactgtgggagtatatgtttgttactgtagcatagctagcccatcacattgatacagggacttcaactttatctgtaatgtttcattccttctttttgtttttaaggtctagagaacatatgactaagtgttaacatttgttcattttgaatggagagtgttgagtcttatattaccctcattctttttcgttttttgtgaacatttttttaaagtcccctggaattggccgggcatggtggctcatgcctgtaatcccagcactttgagaggctgaggtgagtggattgcctgaggtcaggagttcgagaccagcctggccaacatggtgaaaccctgtctctactaaaaatacaaaaattagccaggtgtggtggcagatgcctgtaatcccagctactcgggaggctgaggcaggagaattgcttgaactcgggaggcagaggttgcagtgagtccagatggcgccactgcactccagcctgggcaacagagcgagactctgtctcaaacaaaaacaaaaacaaaaacaaaaacaaaacaaaacaaacaacaacaaaacaccaattctgatatgcatgttcttcatgttaagccatctcaaacctcttcagaaaacaaaagtgataaagtgtgaatcctctgtcacgtcatctccttttcagggcctccgccctgactatgcttcatttctcctacagcaaggggacctcggctgcaggggaaacctgctcatcagtccttaacacggccactgcgctacgtaaaagcctagtgtgagcagggtgagcctgtaacgtgggattggtcctgacctctcacgttggtataataaaggagggctctctgtggaaagagagctttgtgtctacttcgtatttgtaaaacagatgcttccatgacttccttttcttcccacacagtattttatattaaatatctaaatgagaaacacagagtcaagatcgctgaaatggctcagcaatacacctcacctataaatcaaagcaaaggaacgcttcagcagtgaaaaacagtctgtcccaagagacaggatacttctcttctatttgtgggtatgctattgtcctgccatgtgacctggcctctgtaggacttcacgtcctttctgtataatatgacatttctcctaacactaactttctatcaacactttcattttaaaaattagaagttattattttcttgtattattttaagtcctcaaaattaaaaaaaaagaaaaattacgaattaaaaaaataacttggccgggggcagtggctcacacctgtaatcccagcactttgggaggccgaggcaggcggataacctgaggtcaggagttcaagaccagcctgaccaacatggagaaaacccgtctctactaaaaatacaaaattagctgggtgtggcggtgtgtgcttgtaatcccagctacttgggaggctgagacaggagaattgcttgaacacgggaggtggaggttgcgatgagccaagattgcaccattgcactccagcctgggcaacaagagcaaaactccatctcacaaataaaataaaatgaaataacttaagaaccaaatagagttgaaatattacacattagtaagtatgtgatcaaaggcaggcagttccccaggcgtgtagcaacaagtgatacaggaatgaaatcctagtccccagggtgggactagggtgatatgggggtagaatgatttcggacatgggatttgtttttgtttttgtttttgttttagcattccaaaagcagctttcttttataacataaagaaatcagaagaaggctttcaagacagtatgatcaactaagacgctatttcccaaactagtgctctgagggacactatctttagagttcctaagtaggtatacttaatgctcacatgtggaaaattatgtatgctctatctccctcggagaatcatcatgcatgttatcttatgaaagactgagaaatcctacagaaaaaaaaaacccacctattttaactttgtttcatccggcgttcacaaatgcatctgtgcatggatcacttttttgctcactgccatcaccaccttccacgtcaacacggggagtgctgcgccaaggcagcgtcttggcctgtgaatcacaagccacggactcttttgtgtgtttctgccacagcattgctgagtaacctggtcagccctctgttggggtcttgatttctccacctgaaaaacgaggacgataacacttgtccacacttaagagagatgagctagataatgtccatgagggctttgaccctttaaagcaggttctatagaaacaatgttattatctcaaccacacaagcacgatgggataacaagtcacatcattagattctattatacacacccggaccccgcagaggcaccacacttagctttctgtcctggtccctgagggctttacatacatttcatatgctccagtaagcaaacccattccatgctggttcctgctgcaaacagaccaaaaaggaaagaaaggaaatacagagaagcagacaaagtgcagaaatagagaatgcaggaacagcaatggttaacagtgactgagtacttactaggtgttacccacgtgcaaggcagttgaaacacagtgtttaaatcatcccatctagggctgggtgcagtggcttacgtctgtgattccagcacttggaaggccgaggcaggaggatcatttgagcccagaagtttgagaccagcctgagcaacacagtgagacccacatctacacacacagacacgcaacacacacacagacacacacacacaaactgacccatctagccctcaccaaaatcctaaggaagacacacttattatgacaatattggaggttagagagtgtggcttgcccaaggacatacaggtattacctgaacaagcctgcctgattccaaagcctacatgacattgtttcctaaggtagtacacataaaataatcttaggtggtaaaaaaaaaattattttaatagttttgcattttaatgtatatttgaaaaaacatcatatgtattgcaaagccatggttccattaaaaaatatcataggtgaagataagaaaataagaaagtctaattaagaaaataatagtacaactgatatgtggacacgtcaaaaatcatgaaggtggtgtgctagtgaatgaagctggggaatcattgcaatacatccttctaccttccaaaaaccttctacctcccaaaaaagagaaggtaagccaaagcccagttagattcaccttaaccaggctttttgtttgttttattttgttttgttttgactctcactctgtcacccaggctggagtgcagtggcgtgatcatagctcattgcagccttgaactcctgggctcaagagatcctcctgcctcagcctcctgagtagctgggattacaggcgtgtaccaccatgcctggcagactcacatcaacaagcctttgagcttgtttctgactcctctaggctcaagtgcaagagaggaaatgaagttgagtgaaggctgaaggttggcaacggttgctatgtttatctgcggtggggaggtgggggcagagaggcatgtctgtgattgtgagatctgattcacagaaaatcacagactgacaagcaccatctcctacagagaaggaaacaatatctttaaattcttggcaaccctctccctgaccttccaactgtgcacagctgcctggttcatctttcagctctgtagagaaggggaaggtcttagttaagacttcttggttgcaaaagcaacccactcaactagttcaagtcaagcagaaaaaagaaagaagggtttttgtagatactgggttttgtacagaccaccaaaagatgggagctggagtgggagtcaggacccatgactgctctttgttttttggggtctctcatctctgcttctctgaggttctccttcattctctctttctgagcttcaccaggcatgaccatctggccctagccttacatcacttcttttttttttttttttttttttttgagacagagtctttctctgtcacccagtctggagtgcagtggtgcgatcttggctcactgcaagctccgcctcccgggttcacgccattctcctgcctcagcctcctgagtagctgggactacaggcacccaccaccacgcccggctaatttttgtatttttagtagagatggggtttcactgtgttagccaggatggtctcgatctcctgacgtcgtgatctgcccgcctcggcctcccaaagtgctgggattacaggtgtgagccaccatgcccggccatcacttcacaattctagcccctaccggacaaggcccagtgcttccaggcctcaattctaagctgccattagcaagtcagattggcccagctagagtcaggagttcactgctgcacagtgcattatagctagggtaggtcacggtgtaagcaattaacaggtccttctgaaatccagcatcctcacactcaatggttcctatgatttctaatgggcaagagctgggtcaacttccctgatactgtggccactatagtcccagctttcctgctctttcagtacggcaagttgtattttgacatttgaaataaagcattgggtttcctgcatcagtaacaatgcttctttcattctaccaactttggtcaccttgagtcttgaagacgattgatacttacagggcgataaacatgtaatcatttggcatagagaaaaagggttaagaagctgtgctatcaggaatggttatagagtacccactggcaccatgtaggggggctctgggaacagctgaagtgatgatgttgattatgatgctaaagatgatggtaacagcaataaaagaattgagaaggatgggtctcctgaaaaaacataagaatacagatagagaaaaggagcacaaataatagatctccacgtagtgaaaataatcttgagctaaggactcaaagacttgggttctagacttgtctttgtcccttaactacgtgagttaagatcattcacgtagtgatcttagactaatcacttggctagttgtggtccatatctgtaaaaatcgaaatgactttctaagccagaaatttctgggatcctacggtctataattctatgcctggaggataaagtggatcttggaataaatgagatgattaaagccaggcgaggattagcaaggtctggtttcttaggagatgaatcttcaagagagattcaaaaggtgtgaggacagcctttggtgtgcaaacccaaaagtatctgagaaaatctcattcaagccagtcgcagtggctcaggcctgtaatcccagcactttgggaggccgaggtgggtggatcatgaggtcaggagttcgagaccagcctgaccaacatggtgaaactatactaaaaatacaaaaattagccgggcatggtggtgcgcacctgtaatcccagctactcaggaggctgaggcaggaaaactgcttgaacccaggaggcggaggttgcagtgagccgagatcgcaccactgcactccagcctgggcaacagagtgagactcagtctcaaaaaaaaaaaaaaaagaaagaaaatctcattcaatttaaaaagtatattttgccaaggttaagaatgcacccatgacacagtctcaccccaggtggttaggatacagcttgcttttatacattttagggagatatgagacctcaatcaatacatgtatgatttacatcggtttgatctggaagggtgggacatctcaaaacagggggcttccaggttataggtagattttaacattttctgattggcaattggttgaagagttattatcaatagaaagaaatgtctaggttacaataaggggttgtggagaccaagactttatcgtccaagcagcaggcttcagagagaatagattacaaatgtttctttttagactaacaagacttaagatctgtgttaatgttaatgctggtcagcttttcctgaattccaaaagggaagagcatatatgaggaatgtcagacccttgcttcccatcatggcctgaactagtttttcaggttaactttagaatgcacttggccaagaggagggatccattcagatggttggagggggccctagaattttatttttgatttactggtggaagggaaaaggcaaggtctgggatagaagagagggcccaagataatggcttgggagtatgctgatctaaaggggaaaaactgaaaatgtaagcagagagttaatttgggccaagtttaagcactgcaacttggaagcatagattcaagttgccctgaatgtatgctctgattagcagcagttacaagaaagtttttaaaggaaaagaatagacgagttcctaaattgtttaccaagaaattacattcaaatgacataaaatattcattggctatacatttttctttgtatcaaaaattccaggaacatgaagacaatgggtgaagcagctagtctgaaaactacagggaagaaaagaaagaacaggccgggcacagtggttcatgcctgtaatcccagcactttgggaggccgaggctggcggatcacgaggtcaggagatagagaccatcctggctaacacggtgaaaccccgtctctactaaaaaatagaaaaaattagccaaatgtgctggtgggcgcctgtagtcccagctactcaggaggctgaggcaggagaatggtgtgaatctgggaggtggagcttgcagtgagccaggattgggccactgcactccagcctgggcgacagagccagactccatctcaaaaaaaaaagaaagaaagaaaagaaagaacaaaatgtcttcaaataattgtccctgggtatgggtgggggcatgcatgtgattgaagccccatactcatttctctctgggccagataaattttgcatacctcacaaagctctgactgctcttagctatttttatttttcatttctccctttcgatcagaatttttctcttctaaaagtattgatgatcagccggcacagtggctcatgccctgtaatcccagcactttgggaggcggaggcgggtgggacacctgagtcgggagatcgagacgatcctggctaagatggcgaaaccctgtctctactaaaaatagaaaaaagtagccgggtgtggtggcatgcgcctgtagtcccagctactcgggaggctgaggcaggagaatcgcttgaacccgggaggcagaagttgcggtgagcagagatggtgccattgctgtccagcctgggtaacaagaacaaaactccacctcaaaaaaaaaaaaaaaagtattgaggatcagcattttagatgtctgtcccacatcaccatgaagcacatcgaagggaaagaagaaacaggtactatggctcaagaacatagagaagtctcaagtccaaactgataggcagcacaaaggtgagggaggagaacagggaattagggtagccaagggttggggcagaagcaaaggaatagcaggtgcagccagttctcataagcaagagaacagcaggtgcagccagttctaggcaagattgtgcagcgtgcaggccacatcttcacttctgtggtaacaagacagaagtttccacttcagcttctgattgactgcaggccaagcctccacttcagcctctgattggtctgaggccaatccttcatagggtgtaaccaattggaggcctctaaagggcacctggggtgttgccaagttctttcagcttaataaaaaccctaattgaggagtctctagctgcttgctcacacctgcttttactctgtgagttgtacttttgcttcttcaataaatctgtgcctttgttactccgttcttttgttgttttgcttgtgcgttttgtttaattctttgtttgaaaccccaagaacctggacaactcacagtcaagaccttccgtccggtaacaaagcaacagacctcagtcatgtcatctgcttacaaaggagccacggtatgttgaatcacttcttttttctttttattatttatttatttatttatttatttatttatttatttatttatttatttgagacggagtttcactcttgttgcccaggctggagtgcaatggtgcgatctcagttcaccgcaacctccacctctcggattcaatcaattctcctgcctcagcctcccgagtagctgggattacagacaagtgccaccacacccggtgagctttttgtatttttagtagagacggggtttcaccgacctcaggtgatccgcccgcctcggcctcccaaaatgctgggattacaggtgtgagccaccgtgcccacccctgctgaatcatttctaagcatctagctatcatgattagttttttttgttgttggcttttgtgaaaggaaaataaacctcaggaccccaaagtcactagtccaaagggaagactcaagctgcgaactgcatccggcaaacatgacccccgttctattcctaaataagatagctacaaagagaaaaaaaatcacatacatccgtcacaatttgcccaaagggaaattccttgtggacaaaggacagccggaactcagtcatccctctgctcacgtgagacaaaagcaggcatatctaattacttcctttgtcctattgtctcactaagctagactaaggcataagtgactattcctgtaaaatgtgtattcagtgaaaggctaatcagaaactcaaaagaatgcaacccgctgggtgcggtggctcacgcctgtgatctcaacactttgggaggccgaggcgggtgggatgacctgagattaggagttcgagaccagcctggccaacatggtgaaaccttgtctctactagaaatacaaaaattagctgggtgtggtggcacacacctgtaatcccagctactcaggaggctgaggcaaaagaatcgcttgagctcaggaggctgaggcaaaagaatcgcttgagctcaggaggcagaggttgcagtgagccgagatctcaccactgcatttcagcctgggagacagaatgagactgtctcaaaaaaataaaaataaaataaaataaagaatgcaactgtttgtctcttctctacctatgacctggaagcctgctttgagttgtcctgactttcagaccaaatcaatgtacatcttacatatattgattgatgtctcacatttccctaaaatgtataaaaccaggctatatcccaaacaccttgggcacatgtgtcacaggtgtgtccttaaccttggcaaaataaactttctaaattgattgagacttgtctcaggtactttttgattcacattttagacacttagaaacataagacataatcaatttaagaattaaaaatattacgcaatcggccaggcatggtggctcacgcctggaatcccagcactttgggaggctaagcgggcggatcacgaggtcaggagatcgagaccatcctggctaacacggtgaaatcccgtctctactaaaaatacaaaaaattagccgggcgtggtggcgggcacctgtagtctcagctacttgggaggctgaggcaggagaatggtgtgaacctgggatgtggagcttgcagtgagccgagatcacgccactgcactccagcctggatgacagagcaagactcagtctcaaaaaaaaaaaaaaaaaaaaaacagattacacaaataaggtcaattattattcgagacaggatctcactctgttgcactggctgaagtacagtggtgcaatcagagctcactgcagcctcacccacccaggctcaagcaatcctcccacccctgcctccttagtagctgagaccacaggcacatgccaccatgcctggctaattgtttttttcttttttagagatgggtcttactatgttgcccaggctggtcttgaactccttgcctcccaaagtgctaagattacagatgtaaatcatagcaattggccttaacataacattattttaagagtttaaattcctgaaagcaattttgaaattattatacaagtaccctccccaatgtgttcctcagttgtcctgggtcccaagtacccatatggcactcagaatggctataaagggcagggaccatctgggtcctgaatttacataccaggtatagagctcaggacaggaccaagatgtaaagatgcctaaaaaggccaacccttcccagcatgtccccaggaggcacagctgggccagggaggacatattgggtttggccctgccctgcagctagtgtccttggtgctatggacatgccaatgtcttcaggcctcaccaaggccacctgtctagaccccagaacctaaaggctcaaaaccaaagatgttagctcactgtaaaatgtgtgcaaggattgggggaagcccagcagccagccctcaccactttaggtcacagacaaattcagcaggtatcaaaaatatcacagaagcaacagggttttttttgttgttttttggggtttctttttgagacagagtctcactctgttgcccaggctggagcccagtggcacgatcttggcttactgcaatctccgcctcttgagttcaagtaattctagtgcctcagcctcctgagtagctgggatcacaggtgtgtgcgaccacaccacacccagctaatcaagtaatccatccacctctgcctcccaaagtgctggggttataggtgtgagccaccacactcagctgaggcaacagttttataatcttaaaacatctagcagagacggtatacatctgtttgaccaatagaccacgtaaaaatgtttgaactatatttagtcttcaaactttctaatttaattttaacaacaatttaaaaactagttttatttaccaaaggttactaaaaatcgtgtgaacctgaaaagcatttgggcttatttacttagtttatgagtgctcacttatttataagtcaacttggtatcatgtagacaatataaaaacacagcatgtacacagatacacataaaaaatagacactgctggacatggtggctgacgcctgtaatcccagcactttgggaggacgagacgggcggatcatctgaggtcgggagttgagaccagcctgaccaacatagagaaaccccatctctattaaaaatataaaattagccgagcatggtggcacaggcctgtaatcccagctacttgggaggctgaagcaggagaatcgcttgaacctgggaggcggaggttgtgatgagccgaggtcgcaccactgcactccagcctgggcaacaagagcgaaactccatctcaaaaaaaaaaaaaatagacacagacacaaattaagatttttatagctttggctgtgtgcaatggctcacgcctataatcccaacaccttgggagactaaggcaggtggatcacttgaggtaaggcgtttgaggccagcctggccaacatggcaaaaacctgtctcttttaaagatacaaaaattagcctggcatggtggtgcgcacctgtagtcccaggtactcaggaggctgaggcagaagaatcacttgagcctgggaggcagaggttgcagtgagccaaaatcatgccattgtactccagcctgggtgacagaccgagactgtctcaaaaaaaaaaaaaaaagatttttacagctttgagtttaaaatttgtcatcagacaggtaaaactcactagtttaaaaggacagttggattaaattctgtctctctaaatggaacagattaaagttttcacaagcccttatggagtttcagagaaaacagggaagcaaattgcgtctcaaaggagagagaatgtacgcattttcaagaaggagtttacatgtgttaaaggaagattaaaagtggatgtcaaggtaatgcaaaatcataggaattcactagaaagttgtgcaaggaaatacatagatgggcctagaaaaaaattcagaaactgaggtaggaggcaggactcaactctggaggtggggcttggacaccagaccaaactgaagactagctcaaacaggtccagggaggaagcagctttccataagacacacccaccagtgtgccatgtcagtttaccatcgccatggcaacacccagccgttactgccccctttcatggcaacaaccggaggacccagtagttactcccctcatcttagaaagttctacataaaccaccccttaatttgcatataattaaaagtgggtataaagatgagagcagaaccacctctgagctgctactctgctact

SEQ ID NO: 445 - DNA, 40001 bp, Homo sapiens
ccatgtaaaatttctctctgggcattttaggtaggagtgttgtctatattcttaagtgtccgagtctactttggctacagagatgaattaggaaaaattagactctgctttgtatgtatgcagagttctccgtgcacgataaagtgtaaatgaaaagcagcaaatgctattagcaggagggcaagccaaaactgctaggccctttttaaatgtcctcaagtcatcctcaaacctacccatgtaattatcttctaagttcattctcaaaaatgagattctacatttcagggtttatttacagccagatgatcataatactcccctgctcaaaaagcttcggtgacccctattccttgaaattaaagtcacagattcctatctcatcattcaaggccacctgtgatctggtcaaaatctatttctagtagtattgcccactgtttcctttccaagcactcaactcagtctacctccagctgattagatttcctagaaataactactcctccttctaaaccccatgaacaaatgttttctgaaaaggtatttggaggaaagagactttattccagtggacaaaactgggtgttaggttttgaagggaaggcgagggttaaagaaagacatacgtaagagggtggcttaatagcaaatgcaggctttatgtccagcataaaacctacagaagtcaggaaccagcataatgccagagcccactgctgcttacaggctggggcaatttatgggccaaaggggtccgggcagtatggcttgctgcctggcaggatattgataagatgttcccgtgatgagatggttctggcccttgttccagtgggatttcgttgtggtgttcctcggatctttgtccagcatgatatgatagagatgtgtctttggttaggcctttgtctgccttgtggtcaggtggttaggcaggacgtttctcacacccgaacccctgtttcactttgactaaggtctgcaaaatagcagggagagcttatgacatggtgcagtttggactaacactgagagaccagagttcagtgtaaaatgaatgtgcgttcagagaacagagaggagtcgggctttatagcaaaatttgctgcccaggttccccatcaggttcatttgcatatgaacccagattcatttgcatttgctttcctctgatgcagctgagccctgattaaccgagcagatgagctctgattgattggtttccaagccctaaactgggagtctctgtcagactgtggctggctggtggtgggaggggcccagcagcagtttgtcctgggagcaacagcaggcgctggtttggcttgattgtgaaaagaggggtcctgtgatgctcttatatctttctgagaacacagagtatgtgatcgctcccacacccggctgtagccactgggtttctgttttaaatatgagtacctcagtgagtcatagggagtccatttggtctgtgggctgtgaacatactttaaacaatcccaatcctgttctctcttgacaaatcactttctttacccaaatacagatactggagtacgtgtctttcctccccttaaggacagtacctcttgggcttactttagttagccccacctaggagagagcctggcacatgttaggtcttaataaacactgagcaaatgaatgactgagttgtatgagacatttcatttaccctccccggctccatgcctgggaggaatgagctacctctgaagatgggtaacgtcttgagattttcacaaaagaatataaagctagcaagtcaaagacagtgtgatactgctttaattttagtttagttttttttttttttttttcctgaaacacagcacattaggagttgagatgatggtattgactgtccttgtggtttgtgtgcaatttttaaccaggattcatggctggggaaacaaaagcacttctttgcttgcataacttttttcccttcctttattacttcaaagaggcaagatgtggtttgcattcatttcactgctaatattgctctcaaagatcgctaaagatctcttctccccttacacattccactcatttataacccagatcctcagtgtggctaatggagggtccctcagccctgtaacttctgtgcatgaagcagtaggtagtgggtccagttatgttaaacattaggtaatatcagtatcttttaaccttactatgagaatcttaaagatggaagcattagcctctgcttatgattgctgcaggcaagaatctgcaccaaccctcccaagagtataaagatcatcaccgtcaccgtcaccattgtaaggtcacagctcttcacagttcacttatctttttcctagttattctccctcctaatcattgccaaagtcttgggagataggtgtgaatccttctaggacgcagctgaaaaagttaaatgtcttgtcctagagcacacagctcagcagcaccaagaatgaaatgttaaatctggtgtttttccctctctgctgtagtgaagctctgctagagatttaccgaagtccttgatattttaacctagctatcaacttcagcccagagaaggtcttccaaaagtagattccaaaagtatattcatccatcaaccataaccttaaatctgaagccaggaactaaaaagaaattctcaaggtaacacaattgtcatgaagtctcactcccagggccaattataatctggatttttgtcttcatccttccaggtgtctctgatcccactgtaagcaaaccctgagtcctagggcctttcttccacttatttcactctttctgtacacattttccagtacctccaccactcaccaccctccaaaaagaactgatccctaagcttgtgcagtgattaacgattttcatgtcttttctatttgcctgcagttatgctacaagatctcttggcaaaggactagccaggcatgcctaatatatacattcgtgtgatttaacaaactggtttctaccactttcggcctgaagtgacagtgttttttaacgttggttgcaggcaggggactgttgccccctgccaagcacttcagcttccttgcccggcctctccttggcttctgtctgtccccaccagcagctcttcatgggacccatcctgaccctccaagaaagcagaaaaggaggttcctgatgcaaaacctaaagagctttcatctgaggaaggtgaatcctttttaaactatgaggcctggagagacgttaaaatgagagcaatcacaccctactccccgctttgagctatgtattcatctcttaaaactgcttgctattgccacaagtagctatgaattaattttaatttaggattattatagtgtctcaccagaagcataaaccacatcctataacttaacaataaccaattgctcatcaattttgtttctgtaatccaaagagagttcctgatcaacaactttgtaccagcccactctctcggtcccagtcttttgtttttaaaaacctgcttggaacaaaggctctaggaagctcacagccaagagtacttgggtctgagtcttccaggcagctgtcctcactttggctcaagtaaactctttaaattatgctttgcgtctcagcctctgccttttgggtcaacactgaggggagtaaatgaatggcacctgctccttctctgtctgaagcttggacttctcctgagaggacttcctgctccaagataggagggagtctcactcagaagaggaaggagctcctgtctgctgaggacacggttccatccaatgaggtcagcagggctatcagcagcttccgttaattccgttggggcaggcgtgtggcaagcagcagttatttgagctgaggatgctgggatggattttcacatgagcagttggcccttagatcatgagaccagcctaagtgcccaaggaaatggaacagcagggagggggagggacatcacacccactatcaaaacttcttgttagtctctggcttccacatccttccccaaaacttcagcccaattcacagccgcatttttccatctctttgccattcctccatgggagagctttctgttggtacaggaatagctgagaagtgggaaagatcaagggtagtaagagctgcccccgataatctacagaaagctttgctggaatgaggttgtgcatctctgaacctgagctagatttgttgggtcagggaccatacttatttactggcccaagaattagaagaggaggtgtctaagaaatgcttgttgaatgaataaataaacagccgagtgagtgtttatatgagcctgaaaactgcctgcaccagcacaaaagtaaagccccaacaccctcaggtcacacctactggaaaaatatatgtcagccccagaaaaatgtgggcaacatgaggcaactccggagcaacacaggaaactgccctcctcttctggcccctcttccactgtgatgctcaaagtctgtgatgaccaagtctggtcatctaatcagcaggatataagagggtcattcttcactgcggccattccagtttcctggaaacttggctttctcctgaccgtttccccaggagcacggtggtgacaagcttgagctctgacatcagaaagtccccagtttgaaacctctagcttcttactcgctagctatgagactttgggcaaattaatctctaaacctcaatttctcaatctgtaaaatgttcaaggtcaagcaactcacttttccacattgtaattgatgaaactaaaattcagactcagatctgcctcactccacagtctgtgctttttccttcccactcatctttttctctttctattaaaaatttcataacacatttgagattctgtctcaactcatatcactgaaatcatctgtcacgtctgatgatcatatagaagccagactaagattcagccacaaatgttatgcctaaacatttcttattatttctttttaatgtttctcatgtatacaatcaaactcgcaccctagtattattggcaggctaatatatgcccatgagacatgtagcttaaatctctatgggataggataagtattctccctttgtttgtgatttgaaagctttccatggatgctaaagcgatttgttaaaataccttcacctgtaagtgtttttcctctcttaaaagcctaattcatctctgagtttgtttactaaaataatctaatttgctcattttctctagccattccaagctaaatcccaggaagtactaaagaagcaatgcacagacacagtatcatacaatttgagacacagtattataaaattgatgtgaacttctaggcacagtgtgctcacagtctgtctggaaataactttgtagcaagcatagttccagtctagctgcctggcagcctggcaggatattattattactgatactaatttactttttaatgtaagtctacccagaatatattaaagaagtttcaagaaatcaggatcatggattataacctgacgtagtgctaaggaaccatcagttccatgtaagcatttggttagcaagtctttttcaaaggccatgcttgagaaacagttttgctctcccaaacaatgtgttgtagttttttttagcatactactgtgcagataaataaatgagatattaatgccattgcaagttctggctttgtgtagagttttctagtgaagcctgtttaggatcctggatttgtccaagctgttctgattatcccatcatttttaacatggataatctacaatctttcatctattacataaattgaattctggcacaagttcaactgctcttcattgaaactgagaaaaattttaggatcactttgctggaatccaaagaagatgttaaatactaccaaaaaaaaaaaaaggctgaaaactggtttccaagaatctctggggcatccttaagaactccccttgcatgttcattagacggccctttacccaatgtatctctaatagtctgctgaaaatactcaaaggcaagtaattttcatgtaatcaactaaacaaaatgtttaacaaatatggcaaatattaatatttttaactgtttatgtaaagtgcaagagagttattgattaggagagtagctctgaagccgaacagcctaggtctaaatcccggttctttcatcaacaagctccattactgttgataagttatttgaattatcggtgtcttagtatctttccttatagaggtgatgattgctcctacctaatagcactgtagcaatcatatatgcagagcttatcacactaattgacattcaaaaatattagctcttaaaaaattattattagaaatttgagaaaaagaatcacactaaaaaaggataaaaggcattgaaaataattcccccaaaagaaaataaaaatttctcaaatcatataggacttattttgtaacattaagaagattccaattaattcaaattaaatggatgatgccttatcttcacaatgacattccaatagcttgttttcttattttaatgaaaatatgtaatgatggtgaagattcagtgagacaggcacttccatactagctgctggaattctacgttgacacaacatatttggtgagcaatatggcaatcagaagactaaaagaatgttgcatattttgtcttggtaattcctcttctggaaatctttcttaagtgaacaattcctaattcaaaagctacttactatatagttatacacaaagacatatgctacaaaattattaattactaggaaaacaaaatgaaataatctatatgttatataataaaagcataactaaataaatttcgtgtagtcacataaagatatgtttatgcagcagaaaattggaatttatgaaaagattggcataatatagagacaagttttcttagttatcatgaacagaaaaatatgatggcagtcatgaaaaatattcattaaaaattagaggaaaataaatatgtctatctatctagctagctagctaattttgagattctgttttataactgaagtttagactctgtgaccctcccctaaaagtctgttcatctcttttttagttaagactgttgactgttttccacaacaaccagtagacatcagtgaccattaaccacttttctcatgcattctattttccttatttccagaatacattcccttaagctaaatacaacttctccctctacatctgttttccatgagcatatctggatttactggtatatctatcacttccatgtccttttcaggattggtgaaccatgtcatccattcctgctccaggcagaagcttgttctcagtccttggttttgagcttgtgtatctgtctctctctttaatttttattttaggttcaggggcacaagtgcatgtaggttagatgggtaaactcatgtcacatgggtttgttgtacatattattttgtcttccaggcactaaacctactacccaatagttattcttcctggtcctctctatccttcgaccttctactctcaagtgggcctcaatgtctgttattccccttattgtctccgtgtgttctcattatttagctcccacttataaatgtgaacattcggtatttggctttcttttcctttgtaagtttgctaaggataatggcctccagctctatccatgtccctgcaaaggacatgatctagttcttttatgtgactgcagagtagtccatggtgcacatgtaccacatttttttttaaatccagtctgccgtggatggacatttaggttgattccatgtctttgctattgtgaatggtgctgcaatgaacatgtgtgtatgtatttctttatggtagaacaataaatcacaatgttaatggctgttggtagaattaattttacgtaatttctaatctttttctttatatttttcaaatattctacaatgagaatacattgcttctctaataatattaatgcaagcatataaataatttaagttccctggttaatctcacttattatctctaagctttgtgtctccttgtgaaggcaaatctcctgaataaatgcttacttagcacgcgcatccacttggaatccatcatctgaaatagttactgttcatggtgcattgactttaacttcaaacttgggcaacactggaaacaaagagaaatatacttcagcccccacaatcactggtgagcaaaatttattgcaatcatgtagcttaaggtgcttcccagcaccagctttccctgtatgtccatctggatagatcatgttctgttgccccagattccatgtggcaccagtctacatgatggtgtctcactagtcattaactcttcctttttcttttctctgtcctcagaatttcaagttttttcctttgtaatctcttagatctctcctggcagattgggctctagaaaatgtatatttcctaggggaaaaaaaacgacagaaattagaataacgatactgggggaggagtgaggaggaggaaaatgctgatgatgaagctgaccaggccaaggaagggagatgagaaaaaccagatcaagcttcacctactcctgcctacgtctaacaccaaaggtgttttgttccatgctttgaatcctttatctacacaggacaactacaaatagcaattggttaccctacccttgatagtaaattggtgtgtcagtgtctttcctgattttcttttcacgacaattgagtaacctccaaacactgtttctgaaatcagtgggaatgagaggaatcatacagtatggactgttttgtgactggcttccttgtttccacattatgtctgtgaaattcatccctcttgtggcagacaggaggagctcactgcctttcactgtcttgtaatcttccatggccggagcaccccacactgtatccattctattccttccactttttgatgatgatgaatgaacattcatcatctctgaatgtgtttgtatatgacttttggtgaacataaatgctcatttcagtttggtagatacctaagaaattgaattgctaggtcatggttttttcttacatgtagctttagcagatacagaaagtttcttatagttgtggttcaagttacacgcccaccaagtgcagacaaaagcactagtagctccacactcttgccaacacgtggtattgttagttcttttcattctagtgcatctggggaatgcagtgctatataacctgcattttctttcctttttttctttcttttttttttttttgttgttgttgttgttgagacgtggttttactctgttgctaaggctggagtacaatggtgtgatcatagctcgctgcagcctccacctcatgggctcaaggaattgtccctccttagcttctggagtagctgggaccacaggcatgcacaccatggtcagcttaatttgtattttcttgatagttaatgaagttgaacaggttttcatatacttattggctgtgtgaatggcctcttttgtgaaatacttatttgacccatttataaagatttttattgtcatttgttattaatctgtggggtttctttttcttttcttttttttttttttgagacggaatctcactctgtagcccaggctggagtgcagtggctcaatcttggctcgctgcaagctccgcctcccgggttcgcgccattctcctgcctaagcctcccgagtagctgggactacaggcacccgccaccacgcctggctaattttttgtatttttagtagacggggtttcaccgtgttagccaggatggtgtcgatctcctgacctcctgatctgcccacctcggcctcccaaagtgctgggattacaggcgtgagcacaagaaattcccacaagaaatctgtgggatttcttgatatattctagataagatttgctttgaaagacatatattgtaataatcttctgctctgtggcatgtcttttcactcacataaaggtattttttgatgaaccatatattttttattttaataaagttcaattaatctacttttactatattttatttttaacaaccttgtcaatatattatttattatttttgtttatttacttatttttatagttagtggttttttatgtgtgtcttgtataaaaaatatttgcctatccctttgttataaagataaacttatttaaaaaaaaaaaatctagaccttttttttcttcaatacaccatgcttaacacagattgactttttttacccttcatgttttggtctaggatccatctcagatttatttacatcaggactgaggtggagagtcacggtttctatttttctatatggatgtgtggctaacccagggccatttattgaaagaccaccctctccccacttaactgtgctgtctcccgtgtcatctatcaggtgttaccgcatttttcacttccgtgcactcttgtttgcgccattggtcctagaatatatttttgtgccagcacttcagcatcttagttattgtagctttaaaagaagtgttgctgtctggcagttcagtcctccagctttgttctgtttaagggctgcattggctgttcttgattctttgattttccatatatactgcagaatcatcttcaatgtataccaaaaaaaaaaaatgctgggattttgattggcattccactgaatctgtacatcaaattagagagatttggcatctggaaatattgagtcttccaatacatgaacatgatataatcctccattaattaggtatttctttaatttttttcttagcaatgttttgtgtttcatatttttcagtgtaaaggtcttgcctgccttagttttatgcctaggtattttttggttttggtaaatgctcctttcaaaagtgtattttccaattgtttactgccagtatatggaatgcaattgatttaggggggttatttattttaattgtgatatgatatatataatataaaattgaccatttaaaccatttttaattgtagagtacagtggcattaagaatactcacgttgttgtgcaacagttcaattgatttttaatatcagctttgttgagctatggtcgacatatgttaaaatttgctagctttaggtgtgcagctcagtgagttctgataaatgcatgcagccacgtggtcatcacagtgaagacatggaccatttccagcatccttcagagttcccgtgtgccctttaaggctcctccccagcagcctgcctcctggccttcagtatccatagacctgctttctcgcattgtcattttgccttttctagaatttcaggtaaaagaatcctacagtaggtatcttttgtgtctggctgctttcacttagtgtaaagctcttgagaggtatccgtgttagatgtgtatcggtaagttgccctgttttattactgaatatattccgctctatggatgtaccacagtttgtttatccatttatcagctgaaggccacttgggctgctctcggtttgtggggagcagagggaagctgctggaacattcttgtacagattgttgtgtggaaatctgcttttatttgtcctggataaacacttaaggggaaggatcgctgggtcttatgtttgactttataaggaactgctgaactgttttccacagcagctgtgccatcttgtatgtccgtcagcaccgtgtgagagttcccctgctctgcaggcttgccaacgcagatgtgtcttttgatttcacctgttctagtgtggataccgttgtggtttcaagttgcatttccctaatgaataatgatgttctgaatcttttcaggcactttttttttttttttttttttttttttgccattttgtatacttctctggtgaagtgcctggtcaagccttttacccatttaaaaaatcaaactgttttcttattgatttataagatagaagctaggcatagttgcatctgcctgtagtcttaactacttggaagcccaaagcaggatgatcacttgagcccacgtgtctgaggtcagcctgggcgacatggtgagaccctgtcactaaaaataaacagaaagtaaagatacatatatatctcactgtgctaggctgaatgatggcctcccaaagatgttcgcaacctaatctgtaaaaactgtgagtttcttaccttacctggcaaaagggactttgcagatgtgattcaactaaggatgttgagatggggagattctcctgggttacctggctgggtctgatgtaatcacaggagtcctcattagagggaagcagaaagaccaaagtcagagacggagatgtggccgtagaagcagaggtccatgtgctgcggggccatgagccaaggaacccacgccgcctctgggaactgggaaaggcaagggagcaacgtctccctggagctccagagtgagccagccctgatgacaccgtgacttcagccctcggagactgactgtggacatcggacctctgtcactgtaagatcctaagtttatgttcttttttgggaatatgcactctctcttcagtggaggacttgaagctggctcttctgattctaagtccatgttgattttttcctaccattgttcggggtagaagggagcaggtatctcaggtggtgggaacagtgcgagaaagcccccaggtcaacatgcacgctgccgcgcagggagcaggctcctctcagattaagcagcgtgtgctgggactgcgggaggtgaggtccattgggtggatccactaggctttggaagcagagagtttgggctggagatggtgagaaaccacatagtggttggagcattttggggtttgtcagaagggtcagggctgctggctggggtaggagcaggtgctggggagacagcactggcctgcccacctcactgggctctgacaggaggcatgccaggcgtgctgttcattattatttcagaacagtgctgcttaactccacggaccaagctgcttctgtgaatgaggggtagggaatcccagaggccaaggccgcctcatctctcagggaccttctggctcattagatggcctcgtccctcaatcttctccaaacgtgctggcttccctgaggatgctctgagctggtgccattaacctgggcagcacttctctccggtccacacgcacttcactctattatcctgcaccctgaaaaggcatggattttgttgaacggggccttgtgcatcagaagccaagtgcacctctgtctgggagctggaatgtatgcagtggtcatctttgctgcttctgccctggtgccacactctgaagagtgagaacatgggcagggtggtcgatggcttcacacctctgtctccccaccaggatctctggctgagactcagggtccgaggacccagggtgcctccagaccacagaccaatgaattttctgttctcttttcaacttcttcccagcctagggcagttcaaagccagcttctttcaggaagcctgccctgatagtgccacccaactacaaacacttattttctgtgctgcatattttcagtgctaagtgattgtgcattcaacctttcagtacacatggtctcctgtggttctctagtccttctggagaagcaagtgtgagacggatgcctcgtctggtgaggttacagactttctgaggatggggagcaatctttcttcatttgtatcatgtctcaccaaatagataaaccattggaggacaggtactgtttgacatgaaaataaggtttatggtgccctcctgatcattgttcagtaaactcttcagggaaaggagtggagagatcattagttcattggaaaaggtatttcttgcctagaggggtggattcctaaatttagggctaaatgtgtcatgcagctctaaatttctacaccatgagaaggtagtcccttttgcttcttttatgtacaatccatgcatttgttccacagacatctgatgtttactgaatgccctgtgcaacagagattgaggattcaaaggtgaacaacagatgatctttctctgcagggggctgtctctatgcacatcactcacaaatatccatctacggtccctcacaaatatccatctacagtcccaagctccttcccctaatccacgtcctgtgttaggtgttgggcaaactttccaggtgtcaagatgcagacaattagacctgcagcccccagaggagctgagataatgctactcctttcgaggaggggcacatgacatcacctgacctgttgaagcagtggacagagtggggtttgggggatcctaaccagagtagctagccctccccacctgcgtgtcttgtatctgtaggctctgcatccatagattcaaccatgtttggtaaaactattcaaaaaacattgcatatgtgctgaacatgtacaagcttttctttttatcataattccctaaacaactattgacatagtatttacattgaattaggtatcacaagtaatctagagcttattgaaagtgcatgcagggtgtgcataggttgtctgcaaatgccgcaccattttatatcaggggcttgagcacctgcgctgttggtatctttaagggaggatcctgaaaccaatccccaataattactaaggaacgacggtatttgggttttgacagaaagctgagaaacccagaatgttagaaataacctcctaacagtaggaagctgagttaaaatcaggaaaagccagcggttaaattcagtctttttacacacaagagcaagccacatgttctacagcaatggaggaaaaactcagtgattacccaatgaagtgaataaaagctgcagtgatagttacaacaacacgacaacaggtgacattgagaaggaagatctcatttagggtttgttggagggagccacagccactaaggatgcagcctcctttggaagcactgacctggcccctgcgcccatggacgtgggaatagtgtgggagctggcagagtctcagcaacctctcaatctagtttgtctccttagacaacatccatctcccccattctccatcagctccttttccagcttccccttcctgcccttgtttttgtaaggccgggagggaggtgtctgggcttacgacaatgtctcacattgccccaggagagggcagcagacattctcccatcccaggtgcctcctctgcactgtccaggattccagtgaattttcgagggttattgaaaattacctggttcatgggagccaggctctgtgctaggcactgggaatgcaaagccaactgagatatggggctctgctctgcaggagctggtggtctaaaagggtgaggcagccgtggaaacagatacagggccaaacagtgaggtcaaacgctggggcagaaggctcttcaggggactgtgggatccccggaaagtggggagaggaggggtctcagaaaacacccagcaggaagaggtgcttgagctgagtcttggaagccggcaggttttcctggttcctaggccaggcagggcacaccaggcagggcaccccaggcaggggagctgggctgagtgtgacaccacagggcgagctggggcttgaacacagggtgctgagggcaggaggggtctcagggaggggacgatcatggagggctgtcctgcatgcccatgctaaggagtctggaccagggcctggaaggatccgataagcccccaaagggtttcattaggagaacaaccagagcagacctgcactttaaaatgacagctccctgttctgcctgtggaggacagacgtggcaggatggagaagggcaggcctgagggccgctggcccagtcagctgggcttgaactaggtggagggagcgagggcagttgtctgaactaaggcaggagcagtgggaagggcagtgaggtgaacatgaggttgaaatgacaggttctggtctttggctagatggggccggatgagggcagaagtctcccaggtttctggcttcagtggctggtgtaagtgttggtggagctgaacacaagggtggaggagcgatctcgggagaaagattatgagtcattgacaaatatggggcgtctccccagaccccactatttcatttcccactgcaccctcttatctagatccttggtatttttcactggttttgagacagtgccttcctgttgggtcttgtaaggtccagtctctcttcttgttggaagagcctgtgtattctttcactgcatgtttatgaatagccttcccgggccaggcactgtgatgagttccttctcccatacagctcatggcctggtacagggggagaaggtgaaggaagagatagatggtgaggctgatggttgtagtccaatatgcagtgtggtctcataagtgaagaacaggctgcaaggagaacattccaggacaggcctgcgatctggacttcagtgttgaggtggtttcctaaagaaattgtctgggctcagctggatgtgcaagggctcctgagtgacaggctgtggagaggggcttctctggggctggaaggagccagtgcagtgcccgaccctgtggcatagaacgtgagaagtgggcagcctctgcttgagaggatgccgagggtggtcagcaaggataactaacggtggcagggcctgacggggtcagcttgcaccaagttgggtggagaacgagtagctccaggcctcccacagtggacagatcctcaggcctggaggggtgtccttctgaaggagcattcccagtctctgacgaatgaggcctgggtctctggctggagttggagtgggtctgtgtctggagggggcacttgggctctggaaagaggctacaaactctagactaggctgggcaaactatggccagctcctgttttatcagaatgcacctttatattctccttcatgtatgtattgtccatggttgctttagtgagttgagtggttgcaacagagatcacatggcctgcaaagcttcaaacatttcctaactggctttttatggaaaaggtttcccaagccctgctctaaactggcaggcaactttctcagagatagttcaggcctagtctccatgtgtggacaagatgagcccataccgtgaagctggatctcccaaaacgcacatctgtctcaggtcttataaagctgtgaatcattaagtgtgtgaacatacatgtggtcatgtgtgaatatgcatgtggtcacctgagcacacatatggtcgtatattaacatgcatgtggtcacatgtgaatgtgcatatggtggcatgtaagatgcacatggtcatgtgaacatgcatatggctgtgtgaatatacatatggtcctgtgaacatacatatagttgtgtgtgaacatgcacgtggttatgtgtgaacatgcatatggttgtgggaacatagatatggtcatgtgagaacatgcatgtggtttgtttgacgcatgtggtcatgtgatgtgagcttgaggtgcaccgtcaggctgggatgggccttcccagggtggactcagccccttgctgcaagagaccacttcctgaatcctggtcctaagcctgtgagcctttgctcggcaccaagaagcaactctgttgataccgactgagattcagatgcctgaacctgaccttctacacacgtggccctagtggatcattccagcctcagtttccatgtctccccaaatgcctgctaaatgtgtcagccaaacctgactacttcccattctgcacacataccttctccaccttggtggccgaatcctttggagcccacctctcacattcagctcccggttcttggttatttgggctcctgtctcgtgtgctctatcaggttctaggctttgcaggagtgagttctgtctccactcgtttctatgtgcctcgtaggactggctcttgggagggtcttcatggtgactgaggccatggatccttagccctgtagcttgaattcacttggcactcaaacactcatcctgaaatgatgctctgaaagtgatgcttccagtcagttaaggatccactgtattatggatctccagcacccaatgcctggcacataagaaatgaatgaaaagtagtgaatgatctcaagtatgtctacaaggcgagaggaaagtgatcctattcaccagacatgctagggaggcatttggcgctgttggctctgctgttgcacaataggcctgggactctgaaggctggcacttcctcatcctaaacctcaaattttaatgaattacctccaagtgggcaaaggtccatgggccagggttcttggtgtaaataacccacctcttttgggtgtggttaatggacagggactatacaaaactaaaaacaatgtttgaatgctgacttcctgtcagccatggtgatgaagcactctgtatacatgaccttattcaatgctcactacaaacccatgaagcagatttttagaaaaactttccatttggagcattttaaacaagaggatagtgtaatgagctttcacctccttatcagcagatttaaatatttgttaactcatggcccatcttgtttcctgtatactcccacccacttatccccctctcttgttgttttaaagcaaatcccggacattatgtaatttcatctgtgaatatcttagtatgtatctgtaaaagaaagggactaattttttgttgtttttgaaacagggtctctgttgcccaggctggagtgctgtggtgtgatcatggttcactacagcctcaacctcctgggctcaagaaatcctcccaccttagcctcctgaatagttgggattgcagatgcacatcaccaggcccagataatttttttatttctatttttgtagagatagggcctttctatgttgcctgggctagtctagaactcttgatctcaagtgatcttcctgccctggcctcccaatgtgctgggattataggcatgagacaccatacccagtgataagaacttattatttatttatttatttttgagacagagtcttgctctgtcatccatgctggaatgcagtggcggaatctcagttcactgcaacgtccgcctcctgggttcaagtgattctcctgcttcagctgcacgagtagctgggattacaggtatgtgccaccacatctggctaatttttttgtattttttttttttttagtagaaatggggttttgccatgttggctaggctggtcatgaactcctggcctcgaatgagcctcccgccttagcatcccaaagtgctgggattacaggcatgagccaccgtgcccagccaagaactcttttaaaaaaaaaacaaaattgcaataccattatcataccaaccatcgcacactactattctttaatactaccaactaccctactgtctccaaatttccagtaatttcatttttttgttagtttgtttgaatcaaaatccaaataaagtctctccttatgattgtttgatttgcctgttagtatttctggatctataggtttctcctttcatcaattgtttctcctttgcaatttatttattgaagaaacaagactgtttccctgtatttcagatcttgctaaatgtatcctcattatggcgtttctcatagtttggattttgctaattgtatccttgtggtgtttaacttggtcttcactttgttctctctatttactataaattagtggtacgatctaaaaacttggtcagaggcaggttggatttgtggggcagggtaaaaatactttgctaggttcttccatcaggaggtgtgtactgtccggcatatatatatatatatatatatatatatatatatatatatatatatatatatatattttttttttttttttttttttttttttttttttggtgatgttgccagccactgattgattatggattgaacaatggtggtattgtgatatcattcctgctcatttttgtgctgtcatacttctataaagagatactgctaccctgagaacagccttgtagaagaaaaaaataaaatgaaaaagtaaatataaaaagagatacttctctttataaattattgtgttactcagttgtacaatttatatagaaaaggccaggtagttgctttatttatttgtttagatagggtctctctcactctgtcacccacgttggtgtgcagtgacgcaatcacagctaaccacaccctcaaccttcctggctcaaggggtcctcccacctttgcctcccaagtagctgggaccacagacacacagcatcaggcatggctcattttaaaaatgttttttagagacgggggtctccctatgttgcccaggctggtctcgaactcctatgctcaagtgatctttctgtctctgctttccaaagtgctgagattacagtcctgagccaccctgcctggctcactcttatttttaataaagaatcattatgaatgcagagatttaaacatatttgatgtagtttagtccattgcaattattatacttattgatatacaaaatgttctatctttggtcagaaggagttccttcagattggctcttgaagcatattgatatcatcctaatgatctttgatagattccttgctatctagagtgacaatatgttccagtcttgtcttaagcatttctagcccagacctggaatcatcaatttctctaagaagccttggtttcctttagtgggtaagggtatttgaggaccacaatcttggtgctaagggtcgatgttacagttttaaaagttttttttttaattgacagctttaattgaggtagaatttacctactaaaattcaccccttttaagtgtacaattcagtgatttttaatatatttagtctatttacagaattgtgcaaccatcactaaaatctacttttgaaacattccatcatcccagaaagaaaagttgtgcctatcagagtcactcttcattctcatccccagtcctaggcaaccactaatctatatcaggcaattctggacatttcatataaattgaatcagtcagtgtgtgttattctgcatctggcttctttcacaaagcattgtgttgttgaggttaatcaatgtggtagcgtgcatcagaattttccttttattgccgaatagtattccgttatataccacacttttttttttttaaatctcttcaccggatgatgggcatttgtgttgtctctgccttttggttcttgtgaatggtgctgccatgaacattcacatacaagtcagtgtgtgggcatagactttcattttccctggacaggtacacagaagtgaagttgctgggtttaaggcaattcatctaacattttgagaaactgtcatactgttttcccaaaaaatagctgcactattttacattcccaccagcaatctatgtgggttttgatttttccacatcctctccagcacttgatattatttttctgattggttatagtccttctagcaggtgtgaagtgacttctcattgtgaattgaattgcattttcttagcaattaatgacattgagcagtttttaatgtgctttttggactttaatacatcttttttggatggttctttgcccattttaaataggattctctctctcttttttcttggagacagagtctctctctgtcactcaggatagaatgcaatggcacgatctcagctcactgcaacctccgcctcctgggttcaagcgattctcatgcctcagccacccaagtagctgggattacaggcatgcaccaccacacctggctaattttttgtatttttagtagagatggggtgtcgccatgttggccaggctggtctcgaactcctgtcctcaagtgatctgcccaccttggcctcccgaagtgctgggattacaggcatgagccaccacgcctggcctggattatgttttaatactgagttgtaagagttctggatatgtcacttactagagatatgatttataaatattttctcccattctgtgggttgggagaaacctttcttgtgtcttttgatgtgccagggttttaaatttggctgatgtccaatttgccattttttccttttctcacttgtggttttggtgttgtatctaaggcatcaattgcctaacacaagatcacaaagatttacttctatgttttcttctaagagttttatagttttagtccttgcatttaggtatatgactcattttaagttaatttttgtgtgtggtggtagttagggactcaatgtttttgcacatggatatcccgttgtcccaccaccatttgttgaaacaactattcctggctgggtgtagtggctcacacccgtaatcccagtatttcggaagctgaggtaggaggatcacttgagtccaggagtttgagaccagcctgggctacatagtgagatactcatctcttaaaaaccaaaaaataaaggaagaaaaagaaaagactatttctttccaaatgatttttcttggtacctttgtcaaatcaattgattgtaaatgtaagggtttatttctgggctatcaattttttaaattagttaattaattttttggaggcagtgtcttactatgttgcccagactggttttgaactcctgagctcaagtcatcctcccctctcagcctcccaagtagctgggactacaggtgtgtgccaccatgcccagctaatttttagttttatttttgtagacatagggtcttgttatgttgcccaggctgatctcaactcctggctccaagggattctccctcattggccccccaaagtattgggatatgaggtgttagccaccatccttggctttttatttacttattttttttctttactcacacgatctctctctctgttgcctgacctggagtgtggtagccaatcatagctcactgaaggctaaaattcctaggctcaggtgatcctaccatctcaacttcctgagtagctaggattacaggtgtgcaccgccatgcctggctaatgaaaagcaaaatttttaaattgattttggtacattgatacaaaaaaatgttttgtatgtagacacaggtctcactgtgttgcctaggctagtcttgagctccaggcctcaagggatccccttgtctcggtctcccaaagtgctgagattacaggtgagagtacttgcctgagctttcaattacattccatcgacctatacatctgtccttatgctggtaccatactcttgattactttgtaagttttgaagttaggatggtaagtcctcccaccttgttctttgtcaggattgttttgcttattccgtgtcctttgcatttccatgtgaattttaggattcatttgccaatttctgcagaaaaggcagctgggattttggcaggaattgggttgaacctgtagaccaattttgagagtgttgatatcttagtaacatttagttttcagatctatgaacaagtaacatctttcatttctttaggtcttctttaatttctttcaacaatgttttgaagttcttagtgtacaagttttcctgttgttaaatttatttctaagtattttattcttttggatgctattgtgaatggaataattttcttaatttcattcttggactgttcattgctagtgtatagaaatacaattgatttttctatgccaattttgtgaacttgctgaactagttctagggttttttttttaggggattccttaggattttctgtatacaagatcatgtcacttgtgagtaagacagttttacttcttttctagtctggattctgttgtatatggatcgcctaattgcctgggccaaaacctcattacaaaactgaatagacctgctgaacatggccatccttgtcttattcccaatcttagggggaaagcattcagccttgcaccattaaatgtgttaactgtaaggttttcacagatgctttgtattatgttgatgaagttccttcctgtttctagtttgttgagaattttttttttccatgcgtgggtagataattttactctcatttacagaaaaggaaatggttattcaagcagcctgcctccagaccaagccctggattatggtgctctctacagcactctcttccatttaatttttcctctgcgcctcctctaaattctctttgagctcactggggaatgttggtgttctccaggattctcagcactttgcttgggtgcttctctgctgaagtgggagaatggattcagccatcacctgcaagctgatgactccacattccctgtcttctgctctgagctccggtgaatcctcatgctcccaagacttttccacttggatacagtcaggaaatctcaaacccatcctgtcctagaatgccccgttatccctctccactcaagtggtcttctctgcctctattttcaacattgtatgcttctgccatttgtcctgttccagcctgaaacctgggcgtgatccagcacttttccctttccttgacccctcctctcaccttttctaatcagtggccaagtctgacatattttttctcctcacctccactgctactgatacaggaggtaaagaaattatttaggcagatagtgaggggaacagagtccttggcagagcttcccttctaacaaaaagcagcccaacaaattttttttctaacaaagagcagcctgaaaaattgagctgcaaacatagataagcaagctggaagcttgcacgggggaatgctggcagctgtgccaatagaaaagggctacctgggggccgggcatgtccaacatagagggcccatcttcccttttctgtcaccacgtgtgcagtaatagagaaatgggcaacatggcgcggctcaggcagagaacccacctgcataatacaagattagggagggggcgactagaatttctcaccctatgcaaacgacacacctggtctaagcagtttttcatgccctgtgcaaatggcatgcttggtctgactagtctttcatgtcctatgtaaatcagacaccacctcctcaccagctcatctataaaaccctctgcatttggccgtggactggcaatccatttctctgtgacccctctctgcagcagagagcttttcttctgcctgttgaacttccactcttaacctcactctttgtgagtccgcatccttgttctccatggctgtgagaccacaaacttcaggtgatactccagacaatgaggccgtttcattattgccttgctcctgcctccagtctcattcccctcaaattcaccctccactttaccaacagagcaatttctctgaattacagatcctctcatccttagccctttagtggttccctattcccatagcacagcaattaaggcctttcctcatctgttcatttcatacactaggaacttccactaaagattgaagtcactgaatgcactttctgatgccaattttaatagcctcatgctgctttcatcatttgatgttagaaacagtgttaaccagaaacaatgttacccacttgactctgctttcttctgcatgtcgtgttttctctgtgtcaatgcttcttgtgtactctgttgtctttttaaaatattaaacttatttcaatagagacaggggtctcactatgttgcccaggttggtctcgaactcctgggctcaagtgttcccctcagctcgacctcccaaagtggtgagcttacaggcacaagccaccactcctggccctgttgtctttttttgaaaagttctttctcctcccatgccattccctctattcctttacatcctgaaaagccctactcagtaggccctcttctttgaacctcctcctagctggtgcataattatgccctcctctgtattatttcagaacattgtgtatgcctataatatcacatatgttatcctatgttataagtatttgtcatgtttttctctagatttatactagacttatcttaaatactctcataattgccagcatatagaaaatgcctaaagaatatttgttgaatccacctgaattaggatttgtctataagcctctttgcttttaataaacaattttctaatttgtcagacagtttaaatgcattttgaagagaacatacttaaaaaaataacattttaaatgtgacaatgtaacatatgcttattttagactatacagaacatattgaaaagcccttcgaagaacagaaaaatgatttttaaatgtacaatctgggtactgttagtccaaactgcactgttttgtaagccccctgccgtttcacagaccttggcagagcaaaacattccatgggggttccaccgtgagaaatgtcctgccccaccacctgaccacaaggcacaggaatgtccttatcataccctgccgagcaaaggcccaactgaaggaacatctttgtcaagcagcaaaccacgccacccagaccctgcccgcccatacctataagtaccctagcctgtaagcggtggtgggctctggcgttaagctggtcccccacctcagcaggtcgctctggcaataaacttgtgttgctgtcgagctgccagctcttcctgtgtctttttttaaccttcgccttcccttcaaaaactaacagatatgttaccattttgatgtatttcctttcagttttatctgtgcattcatatgtgagtgtatgtacacatacatatgtgtatagttgtatgtatatatgtagtatacacataagtgtataatctggatatatccaactccgttatccatatcattggctatgtctacaacaatagtatagatactttttgtaacctgtctttttttgttgttaattattgtggatacatatcagttgtacctatttattgggtacatgtgatattttgatgcaagcatacaaaatgtaataatcaaaccagagtacttgggatgcccatcacctgaagcattgatcatttctttgtattaggaacattccaattccactctttcagttattttgaaatatacaataaattattaagtacaatcaccctattgtgctactgaacactaggtcataatccttctaactgtatttttatacccattatccatttccttgtcttttttaacttaatgtagtgtgagcatttccccatcatcaaatatcattttataaaattattttaaataactgcatttataaaatagccacattttataaaattattttaaataacctcactcgtgaatactggggtagctggggataaatttttaggctcattgttattgtccctcaaaacgtggaagttattattccattgtctcatctactgctgctgatgatttaggctcattgttattttccctcaaaacgtggaagttattattccattgtctcatctactgttgctgatgagatgtctgctgttggcttggcaatcttttctttgcagcaaatctttcttttttcttttaaccttttggtgtttcctcattttttaaattttttcttttatcccaatgtgtctaggggtttatctactatctaataaataaatatgtatttttaatcctgtaaaagacttgatgtgccttttcaacccaagggttatcttttttaattctgaaaaattctcagccattgtcacttcaatgattacctcttgcccaactactcaatttttttttaattccccttaagcacatattggagtaaaactctattttactttgctcatctttctacatatctgtgctgtaaattggtcactctgtcttccaattcactcattcactcttcagctgtgcctagtctgctgtgaaacctatctagagagttgtttaaatcaatctctgtttttctgttttggacccattaacaaaaatacagctccatgtttcttttatgtaaaatgctgtatttaccttaaagttcttcttttaacttaattcttttcgatagtttaacacacataagtttatgaaacaatacgtacacctcaatgacttgtcacaaaggagtatctatgtcatcatcatctaggttagaaaaacaaaaaaggacactgccagcactccagaatccaccattgcgatgctccctagtctctattccctcccaaggtgaggattaacctgacgtttattatataaaaatcacttggttgattttctttaaagtttttattttgaaatgattgtagattcacagagagtcacaaaagtagtagacagagtcccttggatgctttacccggctttccctaacagaacagctatcttacagaacagcaggacaccatcaaaaccagggcatgggcattgtctgactattgttagactacagaccttatgcagttttcacagtgtttgcatgcactcctttgtgtgtgtgtgttctatgcaaggtgatctcatgtgtagtatcctgtaaccacttgcaccaactgtccttgccaaagaactgtttcatcactgagaggaattcacttgtgctacctctttttagtcacatcctcgtaccttgtccctgtctcctggcaaccaccaatctgtcctccatctctatagttttgttagttggagtggaacaggaattaaaagaaattaaagaatgtgtaagcaaaaactcagttgtatgtaagaaaacccaattccccctgaggaagagaaagagctggagtcctttaaaaattaactgcctgtttttctgtggctagtgagccttatctctccctttcccaggcattatgaagaccctgtttctctagctgtgcagctccaaggtcactagacagataaactcaagttgtaaaatatgtttttccttgaaaagtaagaaataatgtaatgcaagtctcaattgaataactgtctttgtttctcgcttctgtaatatgcttccccctgcacaaatcttcccccacccatgaaatgcttaaaaggtaacttgactctttgttcggggctcagtcctttggatgttaatctgactgggccaatgcacctaaataataataataaatcctcctcaacccctcggtctctctgattcctaaattatcccacaacaggagaatgttttatacatggaagcttgtaagtgtaaaaccttttagaagattggcttttttcataagaggaagttttttctttcgtcaacaaaagccaaaagccaatcttcaacaaaagattggcttttttcaccaagtttcacgctctaacaaaacctccaagtttttgcctgtatcaataatttcttgctttttattcctgggtagtagtctcttatatggatatggtagaatttgttgagtctttcaccattgaaagatatttgggtggtttccagtttgaggctattttgaataaaacttttaagaacattgatgtacaggtttttgtgaacctgctttcattcttcaggttaaatcctgaagagtgaaattgctgagtcacataggacatgtacctttggttttataagaaactgccaaactcttttccagagtggctataccttgttcaagtgatgccagtgatgtgtgagttgtctggtttctaagcaatcttgccaggatttggtgtcatcattgagcttatcctttctaacagacatagcgatacttcattgttttaatttgcatttctctaatggttactgatgctgatcatattcacttgtgcttatttgctgttcatgttctttctttgacaaaatgtcttttcatgtcttttgcccacttttacaccggattgtttttttaaaaaaaatgtgttgaattttgaaggttcttcatagattctacatacaagtcctttgtcagctatatggtttgcaggtgttttcactcagcctgtagcatgtcttttcatcctcttaataagatccttcacagagcaaaagtcctacatattgaggaagttcattttgtcagtattttcttctacaaattgttatattggtgtcatgtctaacaacttagtcttgaatatttctcctatggtttcttctaaaagtttcatagtgttacattttttatttaaatctgtgctccgtttgaattaatgtttatataaaggtaggagctttaggttgaggttcaattttttgcttatgaaagttcaattgtttcagtagcatttgttgaaagattctcctttctctattgagttgtctttgcagctttgttagaaatcaattttccatgtcagtgtggatctattcctggatacagtctgtcccattgatctctgtgtctatccctttgctggaatcacactgtcttgattacttcagcattggagcagaactttaaaattgtgtagcatcgcttttctgacatcattcttttttctaccttttaatctttacatgtcttttaaaatcagattacctgatatacaacatatcctatggtgggatttcgatggagttgtattaaaagtatagatcaatttgggaagaattgaagtctttattaagtatttctacccatggatccatgtatttcttcattgatttaggtcttctgtgattttgtttacagcattttgtacattttcagcatacagatcttatatagactcaatcatttcattttttcagagatagtacaaatgcaattattttaaaatgttgattttctgttagttattgttagtatatacaaattaaatgagttttgtattttgaacttgtgctacttctggaatgtgtgtgtgtgtgtgtgtgtgtgtgtttgtgcacgtgtttatgtagtccttggaatataccataaccaagtgggttcttcctgggaatgcaagactgcttcaatacttgaagatcagtcaatgtaatctgccatagtaataatctaacaagaaaatcaacatgatcacatcaattgatatagaaaaaaaatttacagaattcaacatattttcctattacagattttctgcaaactaggaatagaagcaagcttcttaacctgatgtatcgcaccttcaaaaagcctacagcaaacatcttacttagtgatgaaaaactgattgccttccccataagattgagaaccaggcaaggatgtttactctcatcactcctatccaacatggtactggaagtcctagccaatacaataagggaagaaaatgacacaaaataaaggtagtaagattagaaagaaagaaattgtctctattcacaaacaaggtgatttcttttcctttttcttctttttttttttaagagacaggttccttctctgtcacccaggcttaagtgcgatcatggctcattgtatcctcaaactcctgggcacacacaaacagtcctcctgcctcagcctcccaagtagctaggactaccggtgcatgctgccaagcccagataattttttttattttttggagacacaggtagtctcattctggtttcagctctggaaggggcgaagaacaagtccccagagcccatcctgtccctcgtggatgacatactgagggctcaggaagacgctccctcacagcctgccccagtttccaggctgagccacctgagcagctgcttcggaaagcctcttgtgccatagccatgcttaggaaaaagcatatcttccattcaattcaccaagaaacaccaagaaataactggatacaaagaataaaaaatactctggtgtggcagggcaggagggtgaaaattgtgccccctccaaaggtaatgtctataaaaggataactaaggccagcgccaaagtccacctacagaaggcgggtctgtctcaaccccagctgtcagtcactgtgaacctttagaactggggctgaagcttcttccagttgcttgctcagatgtcagtgagaccgctccacaacagataaggggagctgtgtgtcagggaagtcccagccactaggacaagctgcactccaggcagctgtttctgttcttgtgcaaagaacagcgcaatccattcaagttcacaggggcgggtggcacttgaaaatgtcagggtcaacttgcagggcagaagttagcagggaagtcttcctgggggagtgggagagcccagcagagtttaggaggagggaggggcgacatcggggcaatcctctgagtctctctttcctcctcaggaactgtccaggaagaccctgcagtctctctgcaggctcatgggagctcccagaactgagacaacacacggatccaggcctgcttcgaagtcagtgggatgcggcccttgaaagtcgatgtattgggttcctagggctctcgtgaaaacatgccacacctggctggttttaaacaacaggagtttattctgtcagttgagaaggctacaagtgcaaaatcaaggtattgacgggatgagttccaactagaggctgtgaggcagatcaactccatggctctctcctggcttctgctggtttctggcaaccgttcacttcccatgcctggtagacacatcactctaacctctgcctccctttttcatgggcacattcgcgcctgtgtgtgtgtgtgtgtggatgtgtgtgttaaggacagcaatcattagactagatggggcccactctaatccactgtgagcttctcttactttggtaacatctgcaaagaccctatttccaaacaaggtcacattccatgttctgggactgtcttctgagagatgtctcccccaggatccttccaggtggaaggatgccctttgacctgcaaagccaggcagaaaaccaggatcagggcaggacaagaggatgctagcctgtgatggctcccactcaggtgggatgtgagaagtgcctgtggcctgggacacaccaacttgctcccgttacctcatctgagatggactgcacagtgtatgtccagggcccaacccggtacactgtgcctttgcaatgctgtctctgtgctttggaaattcactcagcccactgcgtggggtggtctgaggcgggccacaaccatttctcaaccatccctgagtacctgaccagtatccctcgggggtgacgacgaccgcctacatctggagcatgaggagcgtgtttacctggtgagtaaggatgcaagcataggacgtcctggccgatcctctgcacaagcaatgcctttgctccaacgggatgggcaacgttggattaggcctgaggcagatttgatctcggaagatacattcgagtctatgtgttttgtgcatttatttttgtttccttgaattaacatggagtccatttcaactttcacttagtctcctttctcttcccccacttctttctctctctctctttctttgtatgtggaagaattttaactctgtgttccataatgtctaaatactcaaatttagagttgacagccatacagcaaattattcaagttgctgtcaaaaaaaaaaaatccctgcgttttctaggattaaaactgtgaatagagtactggaagaaaaaaaagtcatagactcagatgcaaaatgacaacatttaatgggatgataaggaaataagacttgacaagaaaccatagcccactgcagactgttcacgatgtcagatggttcatgatttttttccaggtttgatacagaagaatcagtttgttacaagaaatgcttctccaactgggatttaaaacatcatttaaacaataaacacgtttgtatgtatatataaatagatatttagatataaaaacatgcatatataggcacatagacatgtacatacacacacatatgtacaaatatatatgcctaaatttttactgacctgtcaacttacaaaacaaaaatgagagatttataaaaggtacatatatagctgtgaattctttaaagctatttttaaagaaattaatataatcttaatgattatcagattactcatgcagtacacagctacacaagtctaatgaagtaccagacacttttctttcttcaactattgtcctatcttattcaggttttcattttcttactagatgtgttttcaatggtttatgacgtaataaaatttctttacctcttctagtaattgctttgtctcactcggaaactgaactactgtcgatgttgtaaaaagctagggcatattcttctgaaaaaataaagggaacatgtatttttattaaatagatgatataagcacattagatctaatccttccaataattttgaaatagagacaattactttcccattttatacatccagaaatatgctaataatatttaagacacttgatgaaatatattctattagtaaatgatagagacagaattcaaacactccacaaacttcacacagcattcaacaagaaataaatagtaccaaccttccagggaacagttgtatggtctctacaacatctttgtatatgttttagaaattaatctatcaaatttttaagttagttagcatttcagaatattccccactcctctctttaagtcaaagtccacagaagtagcttggaacagtcagtcttagcatgaacaacaatgacaataacaaaaagacctggaagcttagtgtggcttgtatttcaagttcaagtggagccctgtcaggttatattgcaaggattctggtgttgaaaaactctggtaactggaaaatgggttcagtcagaagacacatcatgggataaagaaaccagtatacaaagtaatgccatctattgtttactctgtgaagacggaggttgattttggaaatttagtagctcagggaatattagatataaataccacattcaataaccttagggcatggctgttgcttgcctacctttttcatagtaatcgtagaccatggctggggctggctgaatgttgaacacaaggttgctctgctcaacagaaaaagggaaactgtctgctcgaccaaaaccctatcatgacacaaattataattacattgtagcaggtctgagaaaagataatcactgagaaaattgtccgcagaagtttatgatctacataattaaatagatctagggtatgattaacttacacattggcaaaataatgagttgttaaccttaaatcatataaaatttcaagttcctttgcttacactgaggtgagaggaatttagctggaagtcttagaggaatgtaggcatttatgtgagtggtaacaatacacatagaaaggatgtccctaaagcgcatgccacagtttggcgtttcctcagtagaataaaaatagaactaccctatgatccagcaatcccatttctgggtatgcatccaaagaaaatgagatgaatattttgaagagacagctgcagtcccatgctaattctttcattaatcacaatagccaacataaggagtcaacctaagtgttcgaaacagatgaatggataatgaaactgaggcatatccacatacaaattattcggccttaaaaaaaaagaatttctgccatttgtaacaacactgaagaacttggaggacattatgtggaatgaaacaaaccagatacacacaaaaaacactgcaggatctcacctgtaagttaaatctaaagttgagttcatagatgcagagagtagaatggcagttatcagggatgggaaaatggggagatgctggtcaaaggatagaaagcttcagctgtgcaggatgaatacattctacaaatctcgggtacagcggtggcctacagttaacaatgctgtactgtatatgtaatattccctaagggagtagatcttaagtgctttgtcacaaaaaaagaagaggtaactgtgtgaagagagggatgtgttagtcagctaattcacatatagtcacgctagatgataacaatcagctcactatatatatcaaaacgtcacaccacataccttcagtacgcaattgtaatttcaaaaaattatggcaaacattgtaagagtttagtcaaattataaaataattacatatctactctgtgaccagactgtgtttgatagggagatgatgtttctaaaatggaaagctatctagtcacatagccagggcatatatgaaatagccttggaactagcaaggagaagatgatcagtgggataaaacactggtaatccttaacgtcccttattttttccttttacagatcctatcatacatatctataagaaattgaagcatccaattatccttggaaggaaaaaagaaaaactttaaagaaaaaaaaatatggctaaacttacattttccaagtagaaaagaacatggtcattcttgacttcagtcttcatcacttggcccttgttttcaagctttgaagaaattgttagggaaggatagagaatagattttagaacaaatgacagcgccactgcagaactcaatgtccactcttttctacgtcacgttctgttttatggaacattccttggtgccgtgatgttttcataaacacaggtagcaactaaagaaaaatatatgatgaaccatgggaaatactgactgctaattggtacaaattaagtaaaccagctctccagtgttagcgcaaaaatacaaaggtgaatgttgaagaagaactctatagttttgttttgctaaactatggctgaacaagtatttattttatctttatactctatgtagctgtctttgtgctgaaagattaggcttctattatttacctcttcaatggatgacatggttggagtaaatcctgatagcatttttacatctataaccaccatactggatttattgcgaattccagtgtatctgaaaattttaagaaaacactcgtttagatatcaattttaaaaagtgacttatctcataatgagagtgccaggtggataaatactaattggctagaaatctggaggacaggtaaaagctgaagagaaaacatcggaagaaagtcattttcaagcatctgtgaataggcacgaccagaatgataatgaaagagatgatacatagcaacagaaattggagcaaataatgaattatctggacatgaaatcttccccaaaccctgcttttaagcttacctgcagtctcaaagtttgaactgataaacagagcttctaaatcttttacatatacttaggttagtgttagagttgcataacacttagaggacatctttgcttaaaaggtggtatatgagcataattagagagtagatgtgtccccaggagaacttctagctcagtttcctgcttctggataagactatgggggtgtgaagttgagagttccatagttcatcagggcatggttgctcacacctgtaatcccagcacttctggaggccaaggtgggtggatcacttgagggtcagagttcaagaccagcctggccaatatggcaaaactctgactctactaaaaatagaaaaattagccaggtgtggtggtgcacgcctctaatcccagctactcaggaggctgagccataagaatcccttgaacccaggaggtggaagttgcagtgagctgagattgtgccactgtgccactgtactgcagcctgggtgacaaagtaagactctgtctcaaaaacaaacccaaaaaagaaaaagagttccccaattcactgagttcttagccctggagctcaagcgatttttatttagaaattctaaaaaatatctcccaaactaattttactcaatgttttccacatattaactaaggctaaaagcctttagcatctataaatcatgcttgaattcaagaggatcattttgtttttctattctgaaaagtaaaaatctaaaatgttactctttacagttacaaaagaaacatttgtgggcttgctactatatgaccatgcatgcttgtcttgagaaagaaatatagaatctctgtttttcaaaactaggagtacttccatacaacagaataaaaagtatcattgaaacatcagtgcagtgaaagctttcaaatcctgctcacatagactgcatgttttcttgcctcattttagctctgatttagctgaagatgtactaaattgtggtgtccggacagagggctaaaaagtgactgtgctgtagaattgtcaccaccaacatgagaactcatcatattaccatgatttatattttgttatttcactactgtttgaacttttaaaatattttaccatcttgttcacatgggagttactgtcaaaatatgacacttacttgagggtcactgtgaggtcaaaagcagtcgaagagtagttctttactatttccaaggaaagagaaaatccagatgccttcttaggtaggagaacattgtacttaagggtggcctagaaaggatagcaaattataagaaaacccatcctgtattaagaattatacagtctgactagagtcagtagtaatgtgattttacattttaaaataaccaagagtatacttcgatcattggtaacacaatggataaatgcttgaggtgagcataccccacttgccctgatgtgattcttacacgttgcatgcctgtatcatgcacccggtaaatatttacacctactatgtacccacaaaaattaaaacatttttaaaaagaaagagcctattgtttatttctattactaacgcagtttacatctttatcatcagggaatcaggttaaattctttagttttcagaataatgtaatttaatgaagatagaatactttctaatagcaatattcctcaagaaacttctcttagacagctgagtagcttttcaaaaagtaacttgcaattttggctattgattatgtaaatacacaaaacggtcaaataacacttcacgtagaactgaacagacagtctgactcttttactggcaaacactcatcaccctcttaggcagatttctgttacctggataaatgtacaaccgtgtccttccacatctactgtgtattgtccaggtgcctgtgttacttctgaacgttggaccagtaggcgattatgaccgttaacctggaaaatctcactggatccttcactgctaaaggtgacagtgttttgatccttagagaaaagcccctcttccccccctggctcttaggatccccatcgcagggcggggaggcacccaccgcgaggcggagactgagagccagtccctcccacccccggctcttaggacccccatagcagggtggggaggcacctcccgcgaggcggggactgagagccagcccctgttgcccccctggctcttaggacccccatcgcaagggagggaggcaccccaagcgaggcggggactgagagtctgtccctctttcccccgtggctcttgggacaaccatcgcaggggtgggaggcacgccgcgggagacggggactgacagccagcccctcttcctccctggttcttaggacccccatcgcaggggcggaggcacccgcagcgaggcggggactgagagagagctcctcttccccctcaggatgttaggacccccatcgcgggggggggaggcactcccgccaggcgggaactgagagccagcccctcttcaccccctggctcttaggacagccatcgcagtggggggaggcacccccagcgaggcagggactgacagccagcaactcttccgccccgggctcttgggacccccatcgcaggtgggggaggcacacctcgcgaggcggggactgagagccagccccacttccacccctggcttttaggacccccgtcacaggtgggggaggcacccccagcgaggcggggactgagagcctgcccctcttcccccctccaggctcttcggaccgccgtcgcagtgtggggaggcaccccctgtgaggcggggactgagagccagccgctctttccccctggctcttaagacccccattgcaggggggaacacaccccccgcgaggcggggactgagagccagcccctcttgccccccaggctcttgggacccccatcgcaggggggaggaggcaccccccgcgaggtggggactgagagccagcccctctcccccacg

SEQ ID NO: 446 - DNA, 50795 bp, Homo sapiens
gctggagtgcaatggcatgatctcagctcactgcaacctctgcctcctgtgttcaagtgactctcctgcctcagcttcccaagaagctgggactgcaggcgtgcaccaccatgcctagctaatttttgtatttttctttaatagagacaggatttcactatatgttggccagtctggtctggaactcctgacctcaggtgatctgcccgcctcagcctcccaaagtgctgggattataggcgtgagccaccgtggctggcctaggtttgccttttaaatggttaagtctggtacatcctctatttgaagcaagggaattaaaaatagagaaagaaggtggtggattgttcctgtaatcccagctatttgggaggctgaggcaggaggatcatttgagcccaggagtttgaggctgcaatgagctatgattgcattactgcactccaacctgagcaacagagtgagaccctgtctttaaaaaaaagaaaacaaaaaagaaagaaagaaaatttggaaaattgacagccaacaaaagaaaacgtgcttacatctccctctattagaaacagctataagtgaactcattaaaatccaaccaaactgaaataaaataaaagaggcaaagttattttcatttcctgagctgggaaatttaccttttccagcaagacagaagattgatgagaaagagattatacatctattcagaattatctggcacagtgctataagtatttgaagatgatggtgataggaagaataagaaaataaaatagctgttttattgtgatgtgaataaaaatattgccatcaaagcttactcaataatgctttgagtttagatacattataaaaagtcaaaaaaccaggaaaagcattttacggtataaatacctcatagaattaataaaggaagccctgtataatttaaaaacaaaatcaaaaggaatccctgaacttcagtttacagacaggctataacagattgcatgatgtgtacacgtctgtatgattgggtaggatagacttcgcacagaatctcctggccaaggggggctgagccctggtggggctcacttagccaggaggacggagggccgttttccaatttgttttcttagaggaaataactttttataatccaaccctgtcaaagggggcgcttttcctaattcattaaaagtcttgcactaagttggtagtataaatattaataaagaccaagaagagtccttggatagctgtagtagaacattggtctagaaatacgtaggcgcaattttaagtccttcctgcgtcactaaccatgaatgtggtcttagcgtctcttagtctcatttcctcatttgcaaaattagttggattacctcacaatgttgctgtgagcattaaatgtggtaatatatttaaaagtgctttgcaaactcataaagcaccattcagtcttcatttagtgaacatacattgagcacttactatgtgccaggtactttgttaagctttgcacatacagagctgcaagagacatagtcctttagtccttgcccttggaaagctctgtggggatgcagattataatgcattacaatctttaatgtgaaagatgctatggacttatggagcattgagaggcccaaggccctctgttttttgtttttttttttcaagacagtcttgctctgtcgcctgggctgtagtgcagtggcatgatcttggctcactgcaacctccgctcttcagaggttcaagcaattctcttacctcagcctcccgagtagctgggattataggcaccaaccaccatgcctggctaattttttgtgtgtttttagtagagacagggttttgccatgttggccaggctggtctcaaactcctgatctcaagagatccacctgcctcggcctcccaaagtgctgcaattacaggcataagccactgtgcctggccgagaggccctcttaatgtaagaccctcagacctccaatgctactcattagaaatttatacagttagatgacttcagatctatagtactatgtgtatctggataggaaaataaaagacaccatacagagctacctctgccacaaagttaccttcttgcaaatcagaaagagaaatctctgctaaacagacaagttgcaaaacatggctcttctgcaaagactagtcagaagaaggcatcccttttggtgggccagggcataggaggaccagattggagtcatctcttatatacaggggccactctatcgggcacaacctcagccagtaaacatggtggcttggcagtgtaaaatacctcaggatacagcatacacacatatatgtgcgtgcaatttagggggaggaattaattttgtgaacttggcctatgtaagcagactgataaactcctggaagggatgggagtttgcaaaaactaacaactacatgccaactttaccatgtgggcacaagaggattttgtagaggtgtatgagggcccaccaggaacacagaaacaattatggggagttagaacagatgaagtttaatgcaggaattggtcaccaaggtgatgggattgctgagaagtcaaataggagatactgagccaacctagatactggcaatggcaggaagctaatgtcactcttaggtgggggtgacaaagagaggagtcagttatgctggagtccagaggccaggaccactctatggaaaatgaggccacagtaggcctgggtgatgtgagctgacactgcagagagagccactgctggagatgctggtgaaggcagagaaggagggggagaaacccactggcctctcctttcctttacttcttcagtgtcactcaagtacttctcctggctgatcccagatcctccaaccagaaggaaccttggaaatgcagcttgcgtggctcagcactctgctacccaaagcaggccggggaagggagtggaaagacatctgagggctccaggttggtacagagagtgggaagaaaatatgagactgaactgagtaaccacaaaatgacacaaagttcttttttataaagctgtatagaaagaagcaacataggcccatcgtggtggttcatgcctgtaatcccggcactttgggaggccgaggtgggtggattacttgaagtcaagactttgagactagcctggccaacatggcgaaaccccgtctctactaaaaatacaaaagttagctgggcatggtggcatgtgcctgtcatcccagctacttgggaggctgaggcatgagaatcacttgaacccaaaaggcagaggttgcagtgagccgacatcgtgccactatactccagcctggtgacagagagatactttgtctaaaaaaaaaaaaaaaaaaagacaacatagaggaagaaaactttgatatacaatgcaatctctcggaaactgcccattacccctgttgtgagaccctctggcctttagttttcttggatactgaaatgaaacccagttactgcagttgtgaatctggatacctagtgccaatatcagtcatccactgatcctgctgtttgcaatcacaatgtctttagcgtacccactttgctctctctcatgcaagtatcctgtaagacagtgccatccagtagagttttctgtgatgatggaaatgttctatgtctgtgttgtccaatagggaagccaccagccacatgtggtcactaaacacttgaaatgtgtctagtgtaactgaggaactgtattttaaattttatttaattttaattatttataatttaaacttaaatctccattatgtggctaggggctaccatattggatagattttctctaaggtattgggactgagtgtttggataatctcactggtttattctacaagggagaacagtctttactttactttccaggtaatcccagcaattaaactaactaactcagatcatcagaataggttgaaatttcactgcatcctcaggcttcgttgataattctatcatgtccttaatgcttcatgcaaccagggagattccaagcctctcttcctgatgaagtcaggggagacagagagacttgtggaaaggtccctttgccaatatgcatctggggagagcacggaaggcagcactccaattgctagccacagagtggcatggaggcatctggaaggttctttttgtttctgttttttggcctctgagagaggcacagaaaaggctaaaagggggaattataacacctcagaggctgccaccaaagaaaatggcccagaccaaaaccaaaacaataataacagtaacgaaaccaggatgacacacatcccaaaggatatgagaaagacagagtatgacagtggacctgaagccttgcttgcattacaaaattatggttcctcctagggccacctggagtacatttgactcctttggatgacaagatcagcgcaaaaaaccctggatgcactgagcttacgtccaaacagagaaaatacaaaaatgactaaaattactccccagaaaacctgagttgcagacaaaacaataatagttattattgtacatagataatgtaggcatggtcaagtgtattcacagcagttttgtttatagtggtgaaaaaaaaaagagagagagagagacggagagattagaacaataatacaaacaacaacagaataaaatcctgtcaatagtagagtggataatttgcagaattactgagaaagtagcactataccatagtgaaaatatgttcattagtgtggaagaatttccaagatattgaatggaggaagcaagtcccaaaataatatttgaaaacattatataaggtagtggacaaagctgagtaatacttgatttagggatacatatgtaagtggtagcaactataaaaaaaaaagtagaggccaggcacgatggctcacacctataatctcagcactttgggagggtgagatggggggatcagttgagctcagaagttggagaccagtctgggcaacatggtgaaaccctgtctctaccaaaaatacaaaaaaattagccaggcatggtggcacatgcctgtagtcccagctactcaggaggctgaggtgggaggatcgctcaagcccagaaggtagagactgcagtgtgccgagattgcaccactgcactccagcctgggtgacagagtcagatcctgtccttaaaccaggctgggtgctgtggctcatgcctgtaatcccagcactttgggaggccaaggtgggcagatcacctgaggtcaggagctcgagaccagcctggccaacatggtaaaaccccgtctttactgaaaatacaaaaattagcctggaatggtggtgcacgcctgtaatcccagctacttggaaggctgaggcaggagaatcgcttgaacccgggaagcaaaggttgcaatgagctgagcttgcaccactgcactccagcctgggtgacagagcaagactttgtctaaaacaaaacaaaaaaccccaaaaaacaaaaccaaacaaacaactccctacccctgcaaacaaataaataaacaaaaaacccccccaaacccccaaaaaagtagagaagcaaggcaaagccaggatagtggttacctctgggaggcgaggtgaaatggaatcaggagacgctcactcggggctcgcatggcaataggaatgctctttttcttaacctgtgtcatggggagaaagtttttattttcttccacttattattaaagtgacctataatgctgagcaaatagcatatgtacaatatgataccctttctgtaaagtttaagatcaagtagaaccatatactctttatgaagtcatattaaaagcatacaaaataccccaagttcagggtaggggttgattcaggggagagaaaagaacaaaggatcatgcagagttcacaggggcttcaactgaggcagttattttcattttttatttctttagcctactggggcttgttatattttaatatgcctgagatatttcaacagaattataaaaagctgacgccagtgcggcttcacgggagaatctgcaggtaatgcagacctggaactgcagatggactgcagaggagagcaaatgaggaaagaggaacgctggctgacctgtaggtacatgacagatgccagagacaggaagaagtccacagaaaacctgcgttcagagcaaggagatcgatagggaagtgttaggcctgctggctgggaataataatggcagcagatggctgagagaaagcagaggggctcagtagctcattcattcactcattcattcattgggcatattttaatggactgtttccacgtggaaggctttgtttcactcatctcctattttgtgtgtcttcttgagcaagtggagaccacactgaagggattgaaaaatttcaaacataatcagtgtatgataggaaagggattattaagagaccactttgcatcttgccttttttgtttgtttgcttgcttgtttttgagggacagcctaggacaggagttaaggatatgggctcttcaaacagactgccagggtttgaattccaaccaattttagctgtgagctgagctcttgagccagttgctttacttctctatgccttaattccatagtctgtgcaaatatgaatgacagtatctaccttaggggtggagttgtgaggattgagtgaattaatgtacacagagagctcagaacacgtgccatataaggtttcctattattattagttctagcatccctaagtttacttaagtttgaaggacaaattaattaacaccttagaaacgacgtcagaaatggtcatggcaattggttactcaagaggacatgagtgtggagaaatgcgatggggttggaataggaaaggaagataatgagatatgtccaggtagagaaatagactggagataaaaattcaggatcagtagcagatctcagtggttgaccttagaaacagatgttaaactcactggatacatttcattatgaataaaagctttccctactactattcaagcgagaaattttatcttggcttcatagctcccatatactttccttgtaggatagcgtaagtttggagttctagcttgcttcctgtattccatttctgaagtgacttgaatggacagcactcaacatcaaggagggagaagataatgtcatctataaaagttattagtagctcacatgggaccaaataacataatttggaaaagggatgcaagcttgttttaaagaaggaaaagcaaattccagcctgatttccttctgattcatcacaaaaaactttatgggcatttaaccctctagttctctgctctattcactgataatgaggcccagaaagtatgtattaacattttgttactttatattttttccaggtttatttcagtaagtagagatctgaaaatagtatttttgaggtacttctatacagcatttatttcttatatctgggatttttttctttctttctttttttttttttttttttgagacggagtctcgttctgtcacccaggctggagtgcagtggcatgatctcggctcactgcaagctccgcctcccaggttcatgccattgtcctgcctcagcctcccgagtagctgggactgcaggcgcctgccaccatgcccggctaattttttgtattttttagtagagagggggtttcaccgtgttagccaggatggtctcgatctcctgaccttgtgatccgcctgccttggccttccaaagtgctgggattacaggtgtgagccaccgtgcccggccatatctgggatattttaatatcattgaaatgtatgtaaattctagatgcatatgttactatgctgagggtcattcaaagcagtgtaagttgatgtcgtcctcaggaggccttgccaattacagtctgtgtcagagacttgtgctcatttttctttttctttttccttttttttttttttttttttttttgagacaaggtcttgctcttttacccagcctggagtgcagtggcactatcatagctcactgcagcctcaaactcctgggctcaagttatccttgcatctcagcatctccagtagctgggactacatgcatgcaccaccttgcccagctaattttttaaaaattttcttccctagagatggagtcttcctatgttgacaaggctggttttgaactcctgacctcaagcaaccctcccacctcagcctcccaaagggcagggactacaggtaggagccaccgtggctggcccaggtgcttgttatttttgcacttctttagcaataccagcaactttctgtagccctaaaagccaagggttgaaaactaaatttctggagaaaaataaaccttggataattttgcagactgcctaagctttccgttttatttattcaattattattgaatgcctaagtcgggtgggtcatattgattctgaagacactgaatctaatggtagatttttgggggaacacttcattaagcttctaatttagttggtttcttgtgtcactatgttcattgttattgactttctctttctgcctattgatttcttggactctatgtgctttttccaatagtgtcaatctgaagtggttttcttctaataagaaatgccaggtcactgtctggggagccatagacaatttgatggtgattgtgcttggaaggtgttttaggcaaggaattggcctaaacagggccacctcatcttattttgcttggctcacttatcacttgttttagtcttgaaaccaagaaatctcaatatccatctcagtgtgtggtctctgatttggaagaaatgacttgacaagatttttagaaacagtaagagctcctctggatcatgtacttactcaacatcatggaaaaatgggacaaaattctttccgaaattgcagctaattgataagaataatgaagagggatgtattgagagagagcatttcactgcttggtgataatttagcttttaaaactacgttaagaaagaaatcactaaccaaagcaatagcagcaacttttctaccagaacagacatttctaattaattccttggccattaaaccctacaggccaatccagatgagcaataaaaaaacagtgagagaagagtgctggagaaagttttccttttttgactgtcagcattaacagtcatattttttcactgttctaagtagcaaattgtgagttgcaaaaatggctaggggaaaattttaaagtctgaaatattcattacctacttactaaagtagaaattccatctgtgtgccataaaattaagtgattctaaggaaagtaatagcttttaatattccttcagtaggtcctttgtgacagtttctgagtttggctaaaaagaagcaacacggctctgattttctttccagaagatgatgattttggaatgggagcattaatttcccttttgaattgtgtacacagctactttcccaaaaatactgaaactgaacatatcttgtccctgttttccttctgatttcaggacatataatgatttgccttccgtaactgcagatgggtgggggccctcccctttcccttagcacccttcttaaattctttgctgggattaacattaagcctaatttgaataggaattcactctcctgtgtcgggtggccagcaaaaccgcaggttctgctgcttttcacattaaatggtgtcaaaaattactcgagttgaggatgagtgtctttcactgcgtagatggaaaacatctaggactggactggatgcatcccggcccaaggcaacacctctaaatgtgcgtgcacaaaaacaatgcctgactttcatgagttcttcacaacttataagatatattgacgtaataacttgacatacactatgatcttaatgtttatgctcccccatccctaattcatatgatgaactcaaatccccagagtgatggtattaggaggtggggccttagggagctaattaggtcatgggggcagagccctcatgaatgggattagttcttttataaaagaggccaaggggagactcctagcttcttccaccgtgtgaggacacagcctctagccatgctagatctttgatgctgaatctgccagtgcctaaatattggatgtctcagcctctagaattatgatatataaatttctgttgtttataatctacccactttattatacttactaaaaaaatagtccaaatacaataaatatatagtccaaaaacaataaatgttttcttagcttgaatggaccaagaaaacataattgttattattgtatcctgaaacaattgaggtaggcatggcagagattactgtctcctctgtacaggataaggaaactgaggtatgaaaacaaaactaaaagaattttccaagttcactcatccagtaagtggtggaaacagaactaaaactcaagcttctgaatcctttatttttgagacagagtctcactccgttgcccaggctggagtgcagtggcgcgatctcagctcactgcaatgtccgcctcccaggttcaagcaattctcctgcctcagcctttcaagtagctgggcatgaatcacaatgcccggctaatttttttgtatttttagtagagatggagtttcaccatgttgtccaggctggtctcgaattcctgacctcagatgattcacctaccttggcctcccaaagtggtgggattacaggcgagagccaccgtgcctggccctgaatcctttctaggttttcttcctcccaattaaaccacatttgttctatgccacattgggtcatgctaacatggggctttttttaattattattttttttacatttaaaaaaaaatagagatgggggtctcattatgttggctaggttggtcttgaacttctggcctcaagcaatcctcttgccttggcctcccaatgtgctaggattataggtgtgagccaccgcgcccagcgctataatggagtttttagatatccacaaagatgcagctacagcaaaaatcaaaatgacgacaacagatttgggaatgagaatgagggctcaaggtgcaattctactgctttacgggaccttgaaacttttaagtcaagtgattttgtttttccaagggaagcatcctcctccccacaaaaccccccaaaatgttacactccagagtttcacaagcctttctctcagttgtgggatagaaaatctgactactttgtcccaaatgaatgaaataaattttttcctatgtttaaaattttttgactcaataaattggttattattatatcttcactgtatgaaaaaagaaacaaaagcttaggacttccacatgtaccttttctttttttttgagactgagtctcactctgtcacccaggctagcgtgcagtggctcaatcttggctcactgcagcctcagcctcctaggttcaagcgattctcctgcctcagcctcctgagcaactaggattacaggtgcatgccaccatgcctggctaatttttatatttttagtagagatggggtttcaccatgttggccaggctgttctcaaacttctgacctcaagtgatccacctgcctcagcctcccaaagtgcttgaattacaggtgtgagccaccgcacctggctaccacatgtactgtttttaaacttttctgattaaaacacactgtactgatatattattagggcaatacaaaaattctaaagaatgagataaaaaatataaataacatttctcatattttcttcttttatgtctccagtggatcagttgatttactggagtatgtgcaacccacattggaaattgctgttctaaaataggaagaaaatattaatagcagactatatttatcaagaacatataaaacttgtcacctgtttttgtgactcaatttcactagttcaaatcaaacacggatttccaagtacacatgttaagaattagagccttagacctgcttcattctgaagggagaattgttacaatgaagtaacttgaaaagattaaatatatcaatattaaccaataatttggagaataattctcattctccaataatttggaggtactttaacaagaagcatatagaaaaagtccctatgcatgaggctgtatgccaataactgaggctgactataagattgaatgtttatgttcccttaaaattcatatgttgaaacctacctctcaatctgatgacattaggaggtggagcctttgggaggtgagtaggtcatgaaggcagagccctcaaaaatgggactagtgctttataaaagagaacctggagacctcccttgctccttctgccacctgagtaagaagatggccatctaggccaggcacggtggctcacgcctgtaatcccaacattttgggaggccaaggcaggtggatcacctgaggccaggagttcaagaccagcctggccaacatggtgaaaacccatctctactaaaaatacaaaaattagccaggcgtgggggcacgcacttataatcccagctactcaggaggctgaggcaggaggatcacttgaacccggggggcagaggttgcagtgagccaagatcgtgccattgcactccagcctgggtgacagagtgagactccatctcaaaaaaaaaaaaaaaaaaagaagcagatggccatctatgaacaaggaagtggactctcacaagacagtgaatctgccaacagcttgagcctgaactttctagcctcctgaactgtgaggaataaatttctgttgtttataagccaacaagtttatggtattttgttatagtagtccgaatggattaagacagaaattggtaccaagaagtgggagtgttgctataacaaatatctgtaatgtggaagtgtctttgaaactgagtaatgggtagaagctggaaaacttttgaggtgcatgctagaaaaagcctacattgccataaatagtcctttgaaagcaatgttgatgagggctcagaaagaaaagagaacagtagagaaaggatcaatcttcttagagaacacctaaataatcttgaacagaatgttggtagaaatatgaagagtaaaagctgttctgatgaggtctcagacagaaaagaagaacttgttattgaaaactggaagaaggtggtctctattataaagtcttaaggaacttggctgaattgtgttcctgtcccagtgttttgtgtaaagtagaacttgcaagaaatgaaattggatatttggctgtgaatttctaagtgaagtgttgaaggagtggactggtttctcctgactgcttataataaaatgagaaaaaagaagttatttaaagatgggatggttcatcaaaagggaggcagaacttaaagatttggaaaattctcagcctatccatattggaatgagaaacctggtttaagagagaaaactaagggggtggccaaatgactgtttgataaggagatttgtcaaccatctcaaaagaagctaccagctattctccaagagaatggagaacccctggaggcaattcagaaaccatcagagttgtcccttctattgcaggcccatagtacaagggttgggggcagggagggatagaatggtttccaagaagaggcttgctgatgcctggtgcccgcaggagtttggcacacaggccttgcctcacatcaaggactccattccctacactccagctctgttctcctcagcaaccctaggtagcgttccggtggatcccagggtggcatgagctatgttcagcacagctgtcaggctatggttgtccccacctagatttcaaaggacgaggcctcctggtagagtcatggactagggaccccagccctggaaagctgcagggtcaaggcagagaactgccatgggtacagagctgcctgaagccttgggccaacccctgcccaacaagtctgcaggggccagactgctgcctcaatgggtctgatagatgggatccatgccccagtgggcctggagggcagagcatcaggtcaaagtttcttctcaagctctgttactcctttcttatttactgtttttcccttttggaatgggaatgtttatcctatgcctatcacaccactgtattttgaaagcacgtaactctttcgggttcacaggttcacagtggacaggatgaattgcctcagggtggattgcaccttgactcttacccatatctgatttagatgatatttagaggagactttggattttagattttagaattaaagatggaacgagttaagacttttggtgctgttgggatgcagtgagtgtatgttatatgtgagaaaaacatgaattttgcgggggtaagtatgaaatgctgtagattgaatgtttaggtgacaccaatgttcatgagttaaaatctaacccccaatatgatagtattaggagaggagggctttgagaggtgattagatcctgaagacagaaccctcatgaatcatatttgtgcccttataaaagaaactgttaaaagctcccatgccccctctgccatatgaggacactgtgaaaagatggtggtccatgaaccaggaagtcagccctcaccagaatctgctggcaacttgatcctggacgtcctcaactccagaactgtgagaaataaatttcgtggtttttttttttttttttttttttttttttttgaggcaaagtcatgctctgtctcccaggctggaatgcagtggcacaacttcagctcactgctacctctgcctcctgggttcaagcaattcttgtgcctcagcctcccaagaagctgggattacagcagtgtgccaccacgcccagctgatttttgtatttttagtagagatgggattttaccatgttggccaggttggtttcagactcctggccttaagcaatctgcttgccttggcctcccaaagtgctgggattacagctgtgaaccaccctgcctggcctttgttgtttataagccatctaatttagggtacgttattatggtagcccaagtggactaagacaaggatctaaagccttctctcatgtactgttttaatgacttccataactcaacatcagagaaagtatccagagaacatgagaaaattaaagttttgtggagaatgaaagtgagcacatgaataatttctcaccccacgcaaagggtatttgcaacctcactgttttatttgttctttaccacagctttgtgattttggcacattttttcccatttcttttggtgagaaaaatgaagctcagagagattaagtgacctgtgcaagattgcctagccagtaagggtggattctacgctgctcatggtaaatctggactcttctctgtgacagtctgccaaacacctggttatgcatccttccttgtcattcctgaagtgaaaaatgaaggcaagaaatgctcctgaagtgaagaatcaggtattttttccctccaaaggactaaacctagtagtgtggctaagaatccttaggaaacttggcaaaagaccaacagaggcaaagcaaattagtggaagatgcaggaagaaaagtatggaggactcagtaaaaaccttgcatgaagataagaaatataaattatattttgtcaaaaccaacagttttttcaaatatagaagaaagggcaagagtggaatttggatttatatccaaattccatctctctagggcctgtgctgttaaccatttgctatactgagactcagaggagaaaaagagcctcggcagtgggggatcctttgaccagataggacatggtggattttcatttttggctctgtggaaattctgttgtttcaatgcccatacaatcaacaaatgacaagcgaattgatgacttagctatctaaaagcacctcatggacatttctgcttccttgtgcactgtgtatggaagtgcacatcatcttgttcgctggtgatttgtgttttctgggttctgatgttctagcacactcagataggaaaggccaagagaactaaaatgatgggcgccctctccagtttcggaaggagatagattagaatggaggggcaggaaagaagtgggaatcgggttgtctgaggaggtggagagagttcccagtaattactgggctacaggtgtaggggtagctctctgtatcccagtaactactcagaacaggtaaggggtagcccctcaattgttcttaaccaggcgtgggtcatcctcatcaagcacttggaaatgaatggaggattttttttgttgccaattacttgggtgtgctatgatatttaatgcccagggtcagagaagctaaacgtcctgccatgcctaagtcaggcttacataaagtagaatgatctttcctcaaatgctgataccacccctattgaaatttactgtgagctagtcctactgacctcaaagacattctggtgtcagcagttgaagaatgagggaaaagcataaagaaggtttgaaaagattctgggaagaaactagatgtatctttaatatgttttattcatatggttagagtgtgtgtgtataagagatagatctatttgaccgggtgcagtgtctcatgcctgtaatcccagcactttgggaggccaaggcgggtggatcatgatgtcaggagatcaaggccatcctggccaacatggtgaaacactgtctctactaaaaattaaaaaaaaaattagctgggcgtggtggcatgtgcccataatcccagctactctggaggctgaggcaggagaattgcttgaacctgggaggcagaggttgccgtaagccgagatcacaccattgcactccagtctggcgatagagcaagactctgtctcaaaaaaagaaaaaaaaaaaaaaaaaaaaaaaagagatagatctttttgaagggtcttgtgttatgttaagaaaattattaaattatctcatacatgtttacatttatgtgatctgctaatgtgatttaaaattcggttattatgttgatatggtttggatttgtggccccacttaaatctcatgttgaattgtaatctccattgttggaggagtggcctggtgggaagtgaccggatcttggggttggcttttaatggtttagcaccatcctcctagtgctgtcttgtgatagagttctcacaagatctggttgtttgaaagtgtgtagcaactcctcctctgctctctctctcctgccgatcatgtgaaggtgtatctactttccctttgccttctgccatgatgataagttccctgagacttccccagaaacagaagcctgtacagcccatagaaccatgggcagattaaacctcttttctttataaaattacccagtctcaggtatgtctatagcagtgtgagaatggactcatacagatgaattgttcttttaatgcattgtcaaaattcatttgatgtcatttttaaatgtttgcatctttattcataagtgaaatttgcctatagttttctttttttgaattatctttattatgctatgttaatagcacaataatgcataacataaataaaatgaattgcctggttgagaatggagaaaataaattaggaattatttgtactttaaaacttaaatataattcagctgttgtattttctgggcttagtatcttttaaaaaatggcagacctttacttagctttccagtgttttctgtgatgactgatctggtcagattttctatctcttacttggcaaaacatagtagtttttattttggtagaaaactaaccatgtcctctaaattttcaaatttatcactgtccctaaaaaacagaggctgaagcaagacaagtggtaaggttttattgaaaggtgatattctgggatagagagacacggaacagggaaacaagagaaagaaggatggaaagcaaatggaaactggcatgttaccaagctggccaccgcctcatgaactgtgaagaatatgatgtccactcagacaggacaataccagacaggctgtacatacagaaaagacatgttggaatagtccactggagggggaaagagagatggattgctccattaccttccttccgtctcatttctctcctattggtcaatgtttgcctcatggcgagttcagtccatgcacttttaggtggtatcacctggcttctttgggcagctgctgcggaggccacgtcccaccctgtggaatgccaattctttggagtctgcattggagtttagaagggcaggaggaatcggaacctacacgggtccgactgaattgcgccaagaggtgccagagcttctgcagcttctggcatgatgagaaggcattaggaaggccatgtttccagagcctagcattcacctcaggacagaatgagatagccagagatgtcagtagatgcggtggtggtggcagcaggggcagttgtgtgcctgagagacaggtgaagctttgggaatctgaggtgactataacatgtctctgaaataatttccatagatatgcatgtatattctttttttttttttttttttttgagacggagttttgctctcgttgcccaggctggagtgcaatggcgcgatctcagctcactgcaacctccacctgccaggttcaagtgagtctcctgtctcagcctcccgagtagctgggattacaggcatgcaccaccacgcctagctgattttgaatttttagtagagaccgggtttcaccatgttgtccaggctgatcttgaactcccaaactcaggtaatccacccgccttggcctcccaaagtgctagaattacaggcatgagccactgcacccggcctaaagtgcttttcaaaagaactggtacttcccttagtctttaaatatttctcagggccctggtaaagacctggagacctggacctttttaggagacaaatctggggacagataagttagttgcatatgataattttagtttattattgggagacaaagttggggacagataagttagttgcatatgataattttagtttattactctcatctctctagatcttttttttttttttccttctcattgcatgatctgggaactcagcctcatttagcataggtgacgactgactccagatttgagttaagcaaccaagaaaacagctgaaagccatgtgggttacctagaactcgtatattggatccagaatttttggcatttgtttccatgtttataagtttagaaaatctaaaattatgttccgttccctctaatctgtcattcccagaatccctttttacatttattctccaggtttctggtgatataaattagtcaattcttgtaatttattgttgttgtatatttcatggtttgactttgtaacttatcttaaagggcatgttggattacgtctttagtcatgagtatagaagcaaggaggagagaggcttggggggaattggcaccccttgagaagcaactaccttaggagaggtatttaaaaatcaaggctcctatattgtcaggagcagacttaacttaatggacaaggaaattatttcatctggcaagagaggcttagtagttttaagggttttggatgccattggactccattccaactcttagggccccactctttctcaattagctacttaacagagggctgtgaaagcaacctactttgcaattgggcaaattctgtctgagtttcagtagtcttggccaaacaactgcaagatataggggactcttttttagggtagtcatagaaaccctttaatcgtgattgtgccttgagctgataactttaatattgagcttggaattttctttatttaagctttcctgtgtggaagcaggagtcattcagtcttgccaacagaaggttacctcattccaggttactgcaggtgatcacgtaaggaacactttcgtcccatgtaagatgaactaccagtcctgtaatgataataggatcgtcactgctttcaaatccaactgaggaaaaaaaattagtccaagattcttacttctttgcgtgtctgttgacagcaaaatgtttggccttagttattctgtggtttactgttcttagtttgaatccctcttgctagttgtaacagaaagggctttattaaagggtgttaggtagctcacagaatttctgcaacgactagatcatcaggctttgacattacaaatgcaaacatatttcaagttctaccaattatatttaaaggaaatccagcctgtccctctttcagggccctaataccatttccttttaccctgacaataatttccagtgaagacagttttgcagatacatgttatccagtcgtttccttaatccctttggcttatgttactattataaaggttaggcaaagataataaaactaaaaggcaaatgccacactcacctttaattggcaaggaaacattgcataaaatgttttataaacactatcctgtaacaacaggatagtagccaggaatttacatatttgttcttgcttttccctaaaaagattggcaattgattctgatttacctttgtgtaaacttcagcttttgatagttagcagactttttttgcgctgagcttgaagagttggtggttttacttttaatttttaaggaaaataaccaccctagtgccttttgattctctggaaacccaagtcctgttttattaaagccaattcttcagtaaaagaacattggcaaaggactattttctgtacttctttcaaaatgaccttggggtcccatgcataaagtttttggaatttaaaaaaaaaccctggtaattgatgattttaggttaagtgaccagattcccggcaatcagatcttttaggcaaagaaactctattttttatctccaaaacactctttaatagaacaggaaacaaacatgaaaggaaggcctaaaggaaggttggctgtttattctggttatagtgttcagataattgttccattatttgcctcccttttttgctaatgctgatgccccaagaacaattattttgttctcttagaagtagaccgtggttttagaagatttacgcagtgagggagaggtaaactcatacaaaatctttacctaatatgttgtgagtttactatcccatgaggttccatctccatctaagaagcgtttcaagagacttatctttttgtattttttttgagacagagtttcactcttgttgcccaggctggagtgcaatggcgtgatcttggctcattgcaacctctgcctcccaggttccagcgattctcttgcctcagcctactgagatgctgggattataggctagtgccaccacgcctggctaattttcgtatttttagtagagacggggtttcaccatgttggtcaggctggtcttgaactcctgacctcaagtgatccaaccgcctcgaccttccaaagtgttgggatgatgggcgtgagccacagcgcccagcctgtattagtcccattttaggcattactgcttgaatgttttgcataaaaagtgagtcagtgattcatcagtttttcaggttattctattgtcgcttcattttgtaagtttctgggttctatccgtaatgcttcatgtctcaattgatttgttagaagaggaaattggtttcttgaattggtttgaaaacctttaggataaaaactcaagttaaaaatttttatcaaggacataaatatgtacaaagcactgtgttagacttttggaaacagaaaagaatttatgatttagtaatcttgatagaagcaaatgaaataataaacagttgcctaggtgaagctaatcctttgctttgaagattttcaggctaaatcaactcattaagggctggtcttatgattattaaaaacatataattacccatgaggtatgataggagaggtattctgaatatattcacacatgtgtgctccatgtccccagttccccaagctcaaggccttgtaatttggtctaaaattttacagttagggatttcattcctttgagatctagtagctttttagactttatgagcgctctattaaagttcaagactttttttttttctctttccaatttttattttaggttcagagggtaaatgtgcaggtttgttacatgggcaaattgcataacataagggtttggtgtgcagattattttattatccaggtaacaagcatggtacctgatagatagtttttcaatcttcaccctcctcccagtctccaccctcaagtaggcccaggtgtcttttgttcccttctttgtgtctatgtgtactcaatgtttagctcccacttatgagtgagaacatgtggtgttttctgttcctgtgttagtttgcttaggataatggcctccagctgcatccacattgctacaaagggcattatctcattgttttttatggctgcatagaattccacagtgtatatgaaccacattttctttatacagtttactgttgatgggcatttaggttgattccatgcctttgctattgtgaatagtgctgcaacgaacatacacatgcttgtgtctttatggtagaacaatttatattcctttggctacatacccagcaatgggattgctggatcaaatggtagtgctgttttaagttctttgagaactctccaaactgaattccgcaatggctgaactaattcacattcctgtgagctgtgtataagcattcccttttctctgccaccttgctggcatctgatattttttgcctttttagtaatagccattctgactggtatgagatggtaactcattgtgattttgatttgcattgatctgacgatcagtgatgttgaccattttttcatctgcttgttgaccacatgtaagtcatcttttgaaaagtgtctcttcatgtcctttacccatttgttaatgttttttttttcttcttaatttgtttaagttccttataggtgctgggtattagacctttgttggatgcataatttgcaaatattttctccctttctgtaggttgtttactctgttgataatttcttttgctgtgcagaagctctttaattaggtaccatttgtcaatttttgtttttgttgcaactgcgtttggggtcttcattatgaaatcttttccagggctgatgtccagtatggtatctcctaggttttctataattttaggctttacatttaagtctttaaccatcttggattgatttttgtatatggtgaaaggaaggggtttagcttcaaccatctgcacatggttagcctattatcccagcacaatttattgactagagattcctttccgcatcgcttgtttttggcagctttgtcaaagatcatatggttgaaggtatgcagtattatttctgagttctgtaacctgttccattggtctatgtgtctgcttttgtaccattaccatgctgctttggttactgtagctttgcagtgtagtttgaagttgggtagtatgatgcctccggcttggttatttttacttagtattgtttttgctattcaggctcttttttggttccacatgaattttagaataggtttttctaattttgtaaaaaattagaatttttctaattctgtaaaagtttgataggaatagcactgaatctgtaaattgctttgggcagtatggccattttaaccatattgattctttctatccacgagcatggaaactatttccatttgtttgtgttgtctctgatttctttgagcagagttttgtaattgttgttgtagggatccttcacctccctggctagctctattcctaggtattttatttttgttgtgggtattgtgaattggattgcgttcttgatttggctttcagcttggatattgttgatatgtagaaatgctactgatttttgtacatcatttttgtattctgaaattttgctgaagttgtttatcagatctaggagcttttgggcatagagcgtgggattttctaggtatagaatgatatcatctccagagagagagagtttgacttcctctcttcctatttggatgccttttatttctttctcttgcctgattgctctggctaggatttccagtaccacgtgaacaggagtggtgagagtgagcatccttgtgctgttctggttctcaagggaatgcttcgagtgtttgcctatttagtatgatattggctgtgggtttgtcatagatggttcttattattttgaggtatgttccttcagtgcctagtggtggattagcagtaggtgggggatacaggtgagtgtgtgccagcaaagtggtggggggaggccaggggtgggtgtgcactgtggtaggtgaggttagtctgtgaaggagctatggtggggccaatgggaagtgctcccttctggcatctgacgctgccctgcaagtgggtactgctgggcagagaacctgaaaaaggcgggcagactgtgggctactcaaatcagatggggcccatcccatggacaagatagccatgttctgtccagctccatcagtgaacaaaagtcaaaccacctggaggagcttggcaagccttggcggatgggtgtccctagccagtgctccacctcagctgttccatgccaaaccttctggtctcatcacaagctagagttctgtccctgccacctctccaaacagctctgtcagctcaaatgtccacgagggtcgtgggctctcctgcaactacgaggttcttggtgagagtgggccactcctcgcctgtttaactcaaaccatgcaaaggagtcgctgggggtcaggaatgagttctggtgctctgtagtccggtgcagggttcccagcttccttccccttcagcccagagtttatgtcttccttcggtacactctcaatgcctttcttatttgatctgctgggagtgtactggtctgcttgatggtcttgtcttgtggtgggagatgctctcctggcagtgactagttgaccatcttggctttttcctgaatcaaagttcaagactttgactacatctatgtgagtttctaggagggaataccttaaagagtttgctcacacctaagggaggagagtggacagctagctgagagcagcactgaggattgagaggctctctgggatggaaaggaacctgttttctaccttggaactcttagtcttcccttcctgaatgtgtcttacctgaactttgaatttctttaaattttactgcagaacatattgtttgcgtttcacatttgtttccatgttgccatataattgctccctagctctgttgaaaacatatttttgttttggacgtgcacgcatgcacttgtctcaaaccaaacaactaacgcaggagtggagatagagatgatctcttggacttcggtgtctagtgcagtagtagttagaggtcagagttcagaataaatgacttttgtgtcctgtctgggaatagaatttgacaacgtagtgagtaatttaggaagtggcaaagttgtgtttctgtctctaagtccagtattcactttcatacccaagaagctgtctgttttgttttgttcacaggaaggaaataaaaggatcagggcccagaatataagctttacctattccataactcatcttagcttttctgtatgtgtgtaatacaaattaaacctttattttcttctggatatcctaatctctgatttttcttggagctctggagagatagcatcctaattgcctaaaacttgtttctctcagaatctctgttttttcttcaaccagtaggattgggcagcattgtgtcagaaaagctggacattcttgtccagctgagtctttggaggaaatgctgttttttattgattgacaccactggagaggaaccccttggaaatgacagatttgggatgtaagggttacatttgcttttgttatgatgtctgacttttatgatccttaagactgaactgttgcccagccgaaatagctcagttgggagagcgttagactgaagactgaactgtgaaataattttttatttgaaatcagctcattttttaaatacttgtagctcttaaagcgataatttaataccacattaattatgttgcagcagtaattgtgtaggaatgctaggctgttatgattggtatttctatgattggtatttatatattctttccatgagggtatttattatcaggttcattcatagcagtgatttagagtaccccacatcaagtgtttttctttgcatctttgccttctcccattctctccttctccactgtccttttcactacccttgttgggtctttaagctgaggctggggtcatactggttaacgtctttgtgcaaatggatctctgaccacatttcacagtgaaatcagagagttttgtaggtttgtttaatctatagttgcttttggttcctgctatgaaaatgaacatttaaaaaattggtcaactgtctaggtgtggtggctcacacctgtaatcccaggactttgggaggccaaggtgggtggatcacctgtggtcaggagttccagaccagtctggccaagatggcgaaaacccgtctctactaaaaatataaaaattagctgggcttggtggcacgtaatcccagctactcgggaggctgaggcaggagaatcgcttgaaccccagaggtggaggttgcagtgagccgagatagcgccattgcactccagcctgggtgacaagagcgaaactccgtctcaaaaaaaaaaacataaataaaataaaataaataaataaaaaataaaaaaataaaataaaataattcgtcgattatatgatgtaaataaaagatttccatctagctaagggttcagtcagccttaaaaaaaaataccttacttgcaaaaccagtttccattcaagaaccaggaagcaccagagagctttgattcacatgttaattttgcattagaagattaatcttcacactctgattttattgaggcccagatgaatcccatctccatgactatggcttgaattccaggaatataggcatgccttttttgttttcctgctttttcacggatatatttgaaaatcactgtggtctaaatgtttaattctggaagaaccaaagtgataaagagctggaattgctttatactctaccatctgttttgccatttgtcttctgtaaggagagcattacatcgggcctccccacctagttctctttgaggctctgatttagcacataccagaaagaaatgaaccatatgcaggtctttccggccagtgagattttgttgccatttaaaaaaataacggtcttctattgagcaataagttatatcagagggcaattcactggtctttattcccaatttgtgtacaaactctgtagtaaaacatttgtgagtataccatgtggtgaaatgaagttacctattgcatagatagcaggctgtatttggataggacttccttgtgtttgcttatttggtttaccctcaaattggttaatgtttcaagagtattttagaagtgaaacaagggaaaacctagaaaaatatgatttctaagcctcttacttcataggggtacacagcagcctgtgggtttagctctatgcatgtgaacacaaaaagaagacagctgctagataccataaaatagttaagttctccatctggtttgcaatatgggtgaagatttgctgcaaatctgggttgactgccatgccccagttagtttacaaatacactggtccttttagttatagaacatgaagagtggtcctaagtgcccaagtattaaactcttatacaagcattcagcaaaaatggggtaaagatgaaagcaataccactttatttaaaatgtgctctacttaatttctaaaagtctggcaaagaatagaaaaatcttaggtctagtttaagttggggatgacagtgaaatgaaaaggaacacatatatttgtgttacaattgaagctggcataatacataagatttagcactttgaatataatgttttttcattgagaacattatttttcttaacaaaacaaccaatatttttgtaatttataattaatatatgacaatccctgtaattctggtatcagaagatctggtaaaatctaatatgttccgtgtgttgtaagatttttactttctgaatataaataaagtcatagtatcattgaatgcttttattcattcaaaatcagttattgaagcaatctctgggtagctgaggtaatgctggcagtctaaattcaaatgtcttcacgaattctccagaaaaacaatagcgatttatgagaaaaaagaaatccacgcgaatcctatgcttgcagtattattcaaagactgaaggcactacaaatttcagattacttgagtgtacaaaaatgaacacctatttcccgtagagttttctctgaagctctgttgaaagacttgtggactgttgtgggtggggtaaggggtctaaaacattgcacagaagatagaagaggaaatgagataaaatcacttccagaaatagaaggtccaccctaaattttttttttaaaaactgaaaaaaattctaaaaaccaacagccatgaagcaaaaaatatattctaaactgaaataaataatcccaaacatgcacttcaagatattaaaaggcatcttgaaacagaaattcaaaaactaagaataagaatgagcaaaaattgttctgtggtgagcaggtgcatgaaatcatactcccaaaggttgagggagctgagaggctgaagaaaagaggttaacaaattcagtttctcaacaagaaatattttatagggactcgccaacagaagcaatgtcctgggcaatcgggaggtggtggatccctgcactcaccctccagaaagtactctttatagaacaagcaatttacggtaaaatgcgtgcagctggttacatcttcagacttttttttgccacaatatgtggctactatgtggattatatcagcagctttatgacgagtaatctacgctccaggcattgatgaccttgctgcagaacaccttggtaggtgggggttaaacgtctgtcatcatggcagtgtcccttcaagatggcaccactggcccggcgccgtgggtcacgcctgtaatcccagcactttgaaaggcagaggcgggcggattacttgaggtcaagagttcgagaccagtctgcccaacatggcgaaaccccgtttctacaaaaaatgaaaaaattagcagggcgtggtggtgcatgcctgaaatcccagctactcaggatgctgaggcaggagaatcgcttgaacccaggaggcggaggttgcagtgacctgagatcatgccactgcactccagcctgggcaacagagcgagaccctgtttcaaaaaaaaaaaaagaaaaaaaagaaaaagaaaggtggcatcatggcatcactcctaccatgcaagaggctgttcttctacaaaaagagaaataaaattacagttgtttgaatctaggaaagaaaaagaagaaacccaaatatcagacaggaaagactaaattcttagatataacaaggtacctaagagaaaatatatttgaatgaaaattcagcaaaaggaaaagtagaaaaacaactaagagagtgaaaatgaaataataaaagaaataaaaagggttagggtaaaatgattggaatggaagataagcaaaaaaaaaaaagttgctctaggcataactggaattccagaagaacaacaaaataatggaatagtataaaataattaaaaccataattctagaaaaccttctggaaataaaaaaaggactgacttcatatatatatgtacatatgtatacacaaatatatgtgtgtgtgtgtgtatatatacatatgtgtgtatatatatatgtgtgtatatatatatatgtgtatatatatatatatatgtgtgtatatatatatattttttgagacagggtctcgctatgttgcccaggctggtctcaaactcctgagctcaagagatcctcctgccttggcctcccaaagtgctgggattactggcatgagccaccactcccagcctgactttatattgaaagaatttagtaggtacttgggaataatgacctggaacaacaaactctgaggcatgtcctagtaaaattatttatttcaagatagagacaaaaattcttcatggcttttaggcagaaaggtcaaagaacaagataattatactggcatcagatttctcacaagcaacagagaaaacaaggcaactgaacagccttttcaagaaaatcaaggaaataaagtgtgaaccaaaactttatatccaattaagctcttgtttagctgtcaaggctatagaaaagcaattttaaacatgacagaaatgaaggaacactctcctaaggagctatttttgaagagtccactagaggatgattttcatccaaccaaaaatatgactggaaaaactttgacaaaaggactaatggtaagaaattaatatctttcatgaatcatttagagaataagttgagacatcatgccgctttagccctaaatacttcagggtgtatatactaataacaaaaattttgtctttcataacctcagtacaattgccaaaattaggattgtaacatggattgaagtactgtgtacatgtatgagagagagactgatccagactcccgggtcacaaatccctattagcactcgtgactttctttcgtctgcaaccactctgtagtcctttttttggtctttcacgaccttcatgtttttgaagaatatagactagttattgcatagaatgcccctcaatgtgagtttgcctgatgttgggctaattcatgatatttcttcacgattagatttgggttatgcttttgttcttttcttttttttttcttttgagacaaagtctcgttctgccgcccaggctggagtgcagtggtgcgatttcggctcactgcaacctccgcctcctgggttcaagcgattctcctgcctcagcttcctgagtagccaggactacaagtgcgcgccactatgcctggctaatttttgtatttttagtagacacagggttcaggtgatccacccacctcagcctcctaaagtgctgggattacaggcgtgagccactgcgtccgacctaaaatttcttttagtgttttaaaaatctatattttgttctagtattcggtcttttattgttttatgcatatgttaatgctcttgccccctgttttttttttttttttcatttttattttaaatgaggtggggttcttgctaggttgcctcaaacctggcctcaagctatctttcaagtagcttcccaagtagcttccctactcaagctagcttcccaagtagctgaaactgcaggtgtgggtcaccatgcctggctttttttttttttttttgatttggagtctcgctttgttgcccgggctggagtgctgtggcgcgatctcggctcactgcaagctccgcctcccgggttcacgccattctcctgcctcagcctcccgagtagctgggactacaggcgcccaccaacacgcctgactaattttttgtatttttttagtagagagggggtgtcactgtgttagcccccatcctggtctcgatctcctgaccttgtgatccgcccacctcggcctcccaaagtgctggggttacaggcgttagccactgcgcccggccatgcctggctatttttattaattttttttttttaatgagatggggtctgtgtcccctgttttaaaaatttacttttgccttggtctgccagtttttttttaaacttttcctttggtgcagctggtttgccattttttaatggtttctttgactctcacctattgcttatataccaatcaatgaacttttttctatttttaccctttctctctattctccttcaattttaattaaattagtaatttatttctatgtcatcaaaacatacaagatgtatatattatgttcctgagcttatctccttctattttttcccttaaatctaccttcaatgtattaattttttaccctcagtccttttgcacaaatttttccagtcatatttggttggatgaaaatcatcctccagtggactttttatggctcattagcagagtgttccttcattgaggggatttgtattgagtttgttaaaatccttactttggtgattatgctgtggttatgaaagacaaaatctttttaattaggaaatataccctgaagtttttaggggcaaagaacatgatgtctcaacttattctcagataattcatgaaacacacacacacacacacacacacacacagaagtaaataatagtaattgtggaatctgctgaaaggtacatagaatttcttggaacttttttgtaaatttgaaatgacatcaaaattatataaacaataagtgtggcgcaggtccaagtagacaggcagtggactcatggtgcgtacgtaagccctgtggcatgtgctgtctcagggtgacgggcagaggacaccacacccttcgacaacctggggcaaacaacacagtggaggaggaagtacagtccttacttgcttcacaacaagttgaggtaggagaatctcaccagcaaagtgccccttggtgctacattagcgagtctgcagaggtggtcacggcacaggccttggagcataagctgtgctgggtcaacagctggtaggaaacatgaagagccaggtcagggctttctttgctgtataattcagaattcctgatgtgttttccttgttgtttggttctcttcttataataaagagaacgtatgtaccagactaaaataaattttatatggaatttaaaaatcacatacatgttattatctaatatatttaatagtttctataactgctgaatgagttgattattgctgctcttgccacaggagggaaaaatgggaaaaatgctcttgccacaggagggaaaaatgagatgatggatatgttaatttatttcactatagtaaccattttactatatatgtatctcataacaagttatagaccttaaatatacacaataaaatttatttaagaaacccaaaaccctacatcacattgtacacctgaaaaattatcatattataattatatagttatatattataattatagttatatttactttatataaataatatacattttatataaaatttattaaattaattttaatacatttaatttaattttactgactctctcatccacctaagccctggcaaccattgatctttttactgtcttcatgattttgccttttccagaatgtcatgtatagcagttggaatcacaaagtatgtagccttctcagattggcttcttttacttagtaatatgcatttaagtttcctccatgtcttttcatagtttggtaactatgaaaagttttttattgctgagtaatattccattgtctggttgtactgcagtttatttacccattattttactgaggacatcttggttgcttctaagttttggcaattatgaataaggttactataaacatgcatgtgcaggcttttgtgtagatgtaagtttccaacttacttgggcaaataccaaggagcacaattgctggatcatatggcaagagtgtgattagttttgtaagaaactgctaaactgttccaaagtggccgtaacattttacattcccatcagcaatggatgagaattcctgctgctccacatcctcaccagcatttggtgttgtcagtgttttagattttggccattctaattggtgtgtagtggcacctcattgtttcaactcacattttcctagtaacatatgatgttgagcatctttccatgtgattacttgccatcttatatcttctttggcaatgtgtctgttcaaaagtcttttgccaatttttaattgagttgtttgttttctgattgttgagttttaagagttctttgcatattttagataatagtgctttatcagataagtattttgcaaatattttctcccagtctgaggtttgtattctctcttaaggatttatgctttttatcaaatcaaaatgcaaacagaggccaggcgcagtggctcacacttgtaatcccagcactttgggaggctgaagctggaggattgcttgaagtcagcaggagttcaagaccagcctgggcaacatagtgggaccccatctctacaaaaaaatttaaaaaaaaattagccacgcatggtggtgcgtgcctgtggtcccagatacttgggaagctgaggtgagtggattgcttgaacttgggatgtggaggttgcagtgagctgtgatcgtgccattgcactccagcctgggtgacagagtgagaccctgactgtataaaaaaaaatgcaaagagagaaactatcaaatacacaaatcagaatgtctataggtaaaagcaatccaattccttaaagagaaacatcagcattcttgcttttcacagcacaaaggcgtttatcccaaggtcttcaataaaggggattttatgtaatgtaatgaagaatacttaccacaggcttctctttcctatgcaccaaaccatgtaatgacctcgcctttgttttgaaggaacctcagagcattgactactgtgtgttaaggttataaagcaggaagatattcctagaaatagaatttatataagaaatctaagttggcctttgcaactcttctttttttgctctctctccctctgctctttgtcttaacctcgccttcctctttttaatttcctctctcccccacttctttctttttcttcttccattctctatatttaactattgagaggaaaagaaaaaggaaatagaactccttgttgaaaagctgtctcaaaagtctctggaattgtgttctctcacttcgcttcccaagcgaaggccttaggctaaagttaatggcgtggacttctattcacaatcattgcatgaaatgtgctgtcttcccaaaaaaccttatggtaaatataactcccatgtttgcagatgaatttctgtatgatctattaatatagatcaataacataacatgaatatagcatctcaacatctttttctgcattccttgtctttgcccgtgccagccatatcggtgggcatctgctctggatggcacctgaagggcatctcccttcctaagggaagggagagtgtggctctgccctggagatgtggtgggggttggactgtaggtgttacttagggctatgggagtttgaaacatacatggccatagatacgtgggggtaatgagagatgattaggagtaagggagaaagtgtctgggcacaagagaaatggtaattgcatttatcaggttcagaaaaagtccttaaaaagttagctgccccatgggatttgtatcagaaatcgccttgccaatgatttgctgtagggaaacaaagctgatgtctccattgtactgcattactacctctaatgatatactgtgtgccttttaggaaaacaaataaaattcaggccataggttcactttaatcttgttctctggctgctggagcttttatggaaactgtagttagggcattttatatgaactccagagagaatgtctgaaagcacatctcaataacgatgtatcaccactagttctggtgtagaacatctagataacaccttcatacttacccctgtttccaaacatgagggaagtttgggaacagcatattgtctctctgctctgcccattggagtagacaaccaggtaactgttagcacagaagcctcctttctcccttcgtcctgcaaacttggtgagtcctggggagtgtagtgaagaaataaatatccctggatattggtttaagccaggaggtgtagtgttgttttcttttgataactaacagaattgcatggccccttctgttagttatcaaaagaaaaactaacatgcaggggtcgtgctgtaacgtgtagcaattttggctacatattcggggactcataaatgactgtcagcatccaaagccttggcaccaggtcttggaggtggcacgtgggccaacaaatgacatcctagcaatcgagttatcctccatcttatgtttatagtcatttatgcagtattttgatgtatctgacagtaatgaaactcctggcctttagtgttctgtaataattcaccatattgttgaatctgtaggcagaaaacagactcggaaacatttactagtgcttattatgcagcaaacatctaacaatgtctgtcactgcctaagccacttcctccacctctggccttctatcttccctgcaaccctcagcctctgcctgcagcacagtcagtacccagtgagacaccacttatataatgagatggtagagatgggagagaagtgaacttagttacttaactatgcgcaaccagagagaatttgcctcatatggaatcgatagaaccagaaagaaaacgtaaaattttatgtcatactcaggatatggaaattgcttggttgtattgaacattctcttgaaataatccttgcttctccaatacagctgcctttagtgggtattaattttgcccacaatgacaaaatgagtataaatatcatatggcaagcagtgtcgtgtggacctttcaaaataggagttaatcggttaactatcagcaggactccacttttaggaagggcccaactttccctagttggtaacgccttaagcagagaagaggtgcatgtggtcttgaaaaaaatgtgcacatcatctgttctcttccttcagtcacttcggaatgtgctgaccttgctttcgtctgttgagtcttaatgaagtatctgcgggggtttttagggccagacaagaaaatgctctgaaggcagatgaaagggaagtctgtgcagggagctccagcataagccagagaaaaatatctgtatctgaaggcaatcttctttattgcttctgagcaggctctgagtgggaggggaaatatctgctgcctttcaaatggaaagggccatcgtgtcaaactcttgttggcatgagctgtcctataacacctctgtccctccccagccatgagtaaagatagaaacaacacaaactagagctctccattgctacctgcctcttctaaaataccttcaatttgggggaagttttgtgttttatctagaaatcaactattgtgaatatgtatttggaaatacttggtttctatcaaatatgaaataaaaaaaatgtaatattagctagaaaggtaatgaaaggtacaagttaaaccttacaagaaaacacaatgcattttttaaaaattccattttagcccaggcacggtggctcacgcctgtaatcgcagcactttgggaggctgaggcgggaggatcatctgagatcaggagttcgagagcagcctggctaacacagtgaaaccctgtctctaccgaaaatacaaaaattaggcaggcatgctggcacacgcctgtagtcccagctactcaagaagctgaggcaaggcaggagaatcgcttgaacccaggagcgggaggttgcagtgagccaagatcctgccactgcactccagcctgggtgacagagtgagactccatctcaaaaaaaaaaaaaaaattccattttaattttagattcagggggtacatgtgcaggtttgttacatggacaacaatgtgtgtgatgctgagcctggggcttctatcgatcccattactcagttagtgaactaaacacccaaccagaagtttttcagcccttgcccctccctcccttcttccttttggagtcctcagtgtctattgttaccatctgatatggtttggctgtgttccaacccaaatagcaacttgaattgtgtctcccagaattcccacgtgttgtgggaaggacccagggggaggtaattgaatcatgggggctggtctttcccgtgctattcttgtgatagtgaatacgtctcatgagatctaatgggtttttcaggggtttccacttttgcttcttcctcatttttctcttgccactgccttgtaagaagtgcctctctcctcctgccatggttctgaggcctccccagccacgtggaactgtaagtccaattaaacctctttttcctcccagttttgggtacgtctttatcagcagcatgaaaatggactaatataccatccttatgtccatgtgtacccaaaatttagcacccacttataagtgagaacacacagtatttagttttctgtttctgcattaatcacttaggataattgcctccagctgcattcatgttcctgcaaaggacatgattttattctttttttttttttttggctgtatagtattctattggtgtatatatgccacagtttctttgtctggtctaccatgaatgggcacctagcttgattccgtgtgtttactattgtgaatagtgctgcagtgaatgtatgagtgcatgtgtctttttggcagaatggtttattttactggtatatatccagtaatgtgattgctgggtcaaatggtagttctatttttagctctttgaaaaatctccaaactgcttttcataatggctgaattattttatgttcccaccaacagcatataaacattcccttttctccacagatttatgaacatctttttttttatttttttaataatagtcatttgaatggtgtgagattatatttcattgcggttttgagttgcatttctccaatgactagtgaggtcgagagcctttatcatatatttgttggctgcttgtatgtcatcttttgtgaagagtctgttcatgtcctttacccactttctaatggggttaattttttttcttgttgatttgtttatgtttcttatagattcaggatattagtcctttgtcaggtgcatagtttgcaagtattttctcccattctgtaaacctactggtgctagttagtgagtctacctagaagaataaggccttgcccttagggagcctaagcccagtgaggcagtcacactacccagtgcagtataaaaagtactggaatggagtcacatacgacatgccattgggaggcagatgaggcaggtgctaaatgtatctggagaagcttggaaaagtgtcccttagggagatgcctttcttaaataggtgtagaacagaggaaaggacattgtaatcagaagaatggatgcatgcaaagacaatgatgcttgcacagatgacctgtgctggaacagtggaaggctaaaggggctagagctttgtggtggagatggcatgaggtgagtctaggatctcctggggatgggtaaaaatgggaggttgggagcatggagataggatgagggttacaggggcattcctcagtctgaagggggttcagtctgaaggggggcagtgctggggcacaggaggcaaatggtgcctataaatagcttggatgttgaataagtaaaataggttagatgtcagcacaataaaaatttattgttgtcttctatcaccctgtataatttattcagtgggataagaaccccttgctttgggatgaagacccaggcaggcccatgacttttctgcttgctcgtagtaagttgaccgttctgcttcagtgcagctgcatcagaccaatctgtttcaacttttatgtacagttgtgagttgtttttcagttgccatgccccctgctcccagttgaaggtcatataatctgagcatgcccagagaaaccagcgtgtaaccactagtagaacctgagcgctcagaccgaggagtggggactgtattaagaagtggacatcgtctggcaggagccctggtgccaccccatggcaggatccagtcccttatgcctactgccatcacctcaccgtaagatccaatcagatcacacctcattgccctctgtctataaaacttgccccagccctcagctcagggagacagatttgagcatttcctcttgtctccttgctagtcaacacacaataaatctttctctttgcaaaagcctggtgctttgatgtttgactttccattactgtaggcaaatgaactcagtttggttctgcgacattaatttgcatacactcagtcccaatttagtatttaaaaatgtccagtttattctgggtgtggtggctcatgcctataatcccagcactttgggaggcagaggtgggaggattgctttagacccagagttcaagaccagcttggacaacgtagtgagacccctgtctttgcaaaaaataaaaaaattatctgggcatggttgcatgtgcctgtggtctcagctgaggtgggaggatcacctgagctgaggagttcgaggctgcagtgagcagaaatcatgccactgcactccaacttgggcgatagagtgaaaccctgtttcagaaaacaaacaaatgaacaaacaaaaaacaaataaaaatgtcgagtttaatatattaattaacacttaaatcttcattcaaagataagaccactccccctccaccttccagcaggggttcttaagagttccttccccaaccttagatggtctggagcatgtgcgagggagccaggagtctctgaaggggaggcctaggcgagttcttctgtggctctccattcttctcttccactctctagatgccattttgaccccaggagatggtgagtgctttctgtgcctggatggcgtcaccctctccaggcttgacagatgtttaaagctgtctttcttccttgtgacacttttgtgagcccagcgagtgcccatgcatttcacgtggtagcctgtagatgaggatgatgcctcccctctggcttgctgatgcccctctgctgctggtcctcacagcacagcattccttacagacttaccctgttggaagcaccttgtcctcctaggtggtccccttggttgggaattaaaatggctccaagtccaccttctctggcccttggtccccagggatccccaggagacctgtacacatcttcaccttggcaaactccgggcatgtaggcccctcctattcgggtgcaacagcctctgtcctgctgctaccggctgcgttatttcccgagacacaagttggacacacatctccggtggctcacaagacatttcctaccctctgagtggtcccttggaagccccacattgagcttgaggtgaagatggaagtacctcacagggtgaacagggttccaaataagtctcattacagattttctatttctccacctcaatccttctatattccagaggcaaagacttctaagggtggagaagagaagggcagggccaagagtttgggaaccagtttttggacctgcatttgtaaattttggctatggtcacatggcacctctctttgaagttttacaattgttatttcttgggatatctatgaaaatgttaatgttaatgtcctattaagtgtgtaacaatctggctgtgtgcagtataaaaagctggcttggaatatgttggggaaagggaggaatggcatgggtagttaacataataaaatcattgagaattcataatgtgttaggtgctgttctaagcatgttgtaaagaataacgatctaaatggtcataactctgtgagttgataggaatattccctcccctgcttttttatagattaggagagaggtacagaggagatagttagcttgcccaagatggcagagctgaatagcatagctgggattccagtctgggcagtctgaccctacagaatggactaaattgctatgtatcattggctgccagaaattatgctaagtgctttacatagattctctcactgacgtgcttttaataactctatgaggtatatgttactatagtctgtattttatatgaagaaacaatctcagggaggttaattaatttgctgaaggtcatctaatcaatgagtggtggggctggaatactaatccaggtggaattgattcccgaggtttgctggtcgctgctgcaatactggtttcctcacagagaatgaagatgtgcgacttttccaggaaaatgcaaaggtgcagactctgcatccagaccccctgaggttcaagtcatgacccctcacttcccagctggggggcattggtgtctggctccagaatgtcctcttaattgctctgctatgtagagctcctactccgtgcctcagtcaacttcacctgtaaactgaccataataattgtatgacagtgtagggtcattatgaagataaaatgagttaatatgggtaaaatgcttagaagaatgtttagtgcataataaatgctctataaatgttaactgttattgttacactaattcaagatggaatcagaacattttgctgggtgcagtgcctcaaacatgtaatcccagaactttgggaggaccacttgagcacaggaatttgagacaagcctgggcaacatagtgagacactctctacaaaacaaacaaacaaacaaaaaaattagccagaggtggtggcatgtgcctgtagtcctagctacttggaaggatgaagccagagaagagcttgagcctgggagatccaggctgtagtgagcagtgattatgccgctgcactccagcctgcacaacagagtaagatcctatcaaaaaaaaaaaaaaaaagagaaaattttactgttaccgtgtgtctgttcctagactattagtacatagaaagtacaaatttaggttgtggaaattatgctttgttcctcaatgttcccagggactaagaacttccatacagaagcaaattggctctctgtcaaggtggtaataattattaggtttcttttactgtttgcttatcctgtcacctgaatacacccataagcaattacataggaatcaagaactgcagtttttcttgtaaagagcaaatttgaatagtcagatatcttgctctgatcaaaagcttggctgagaaaaaatgatgtttatgaacaggatagagtcttcccctaatttattccttccttccttccttccttccttccttccttccttccttccttccttccttccttccttcctccttccctccctctctctctttctctctttctttttttctctctttctctctttcctctctctctctctctctctctgcctttctttctttttttttttttgacagaatcttgctctgttacccaggctggagtgcaatggcgagatctcggctcactgcaacctccgcctccttggttcgagtgattccctacctcagcctcctgagtacaggtacctgccactacgcccagctaattttttgtattttttactagagacagggtttcaccatattggtcaggctggtcttgaactcctgacctcaggctgccttggcctcccaaagtgttgagattgcaggcatgagccactgcacccggccccctaatttcatcatatggatccaatctgttcttttgacttagatggattcatttactcaggggcagactattgagtgcacaattctagatactggggatacatccaggaacaaacaaaacagacaaaaccacctgccatcagggagcgtatgttgcagtgggtgagagagacaatgaacaaatatgtgaaatatatagtaagtcagaaggaaataaaggaatagtgaaagataggaaaagaggggaaatgctagggggtttgcaattttgaatagagtagtgttggcccaaaaggaagaagctgaggcccaaatgataatttaaatagtctactagacccaaagtgaggacagttgcccagaaggctcagagccacataaccttggacatgagcttcctttggcctttgttacaagtaagtttctaaaggcaaaaaggggacagggagcgtatcagcggacaactgatacaaagttttttgtcagatattttcactggtttacagaaataatattgatttgtgattggctatccatggttaagctatagggtgggttataagtgtctggtgtggcattattaggctaatttacatctactgtggcaacaacaagcagtttcaagagatgaatacacagctcaaagtggggagtagagtgtgattgctgtctgattttaatgtctttctgggcttgagagagagatatatataaatataatattataataatataatcatattatagtatatataatatgttatatatttttatagtatatataatatatatttatataatatattattataatgatatacaatatattatataaatatatattataatgacatatatattatatgtgatatatataatatatatcacatatataatatataaatataatatatattatataatatataatgtataatataatatattattatataatatataataatataataatatacaatataatattattatatataataatatataatataatattataatatataataatatataatataatattatattatatataacaatatataatatattattgtattatatataacaatatatattattgtattatatataacaatatatattattatattatatataattatatatacataatatataatataatatattatatataatatagaatataataatatataatatataatataattatatataatatataattatataatatacaataatatattatagtatattatatataatatataatataatattatatagtatatacaataatatataatattattatattataataataatatagctgttgctgggggagggatgctatccttgcacagggcaaatggttgatgatgatgccattcatttatattgcactttgcagtttaggaaggtctttacaaatctacatggcagggccgtgtcttattcatcactgcttccccagtgcctagcagacatcctgtgctccctgagtgttgaacattcattttctcatttcttctcctacaacaaacctataggacagtcaggcaagaaatctttatttccatttaatatttatttcatttaggatcattaggagtgaaatcacagagccgcctgctaagtggtgaagctactggacttttaagtcctgtgggtctttcccttctatcttggaaggtattaagaagcccagtcctttcctacagaatgattggcagataattaactttttggtggtgccgtttatttgagaggtaaacgaaaccagtagtgcctcatgcctagaatttgaaggccaaattaaattttctcctatcgtgtgtggctagagaaaataagaaatcctgttaaagtataaactcaggcatgaaactgttgctctgaatcttgttatcatttaacattgaacaaagcgaaccagaacaagacatgcaaaggccttttacatgctgcttaaagttacacacccaggaaatcatatgcacatgtctatgtgcacatacattgaattgcaagttcagtggctttaaatcttctttccatatgcagaatttttataagcagcaaatgctacagatgtgactttggggtttaatgaaaaaatttgtatggataacatatgtttcctttatagaaaacaatctcagcctgttgaaattgcctgagttttcaagtgatcgtggaataatttgatttgactcttaagtcttagtttccttcccattttttttggtgtgtcatggttcctgggagagtcttatttttaattctggagtcctgttctaaataagaaaaaggaatacttctttatttgtagttgattctatgtaaatatgtctttgacaaatgtgaaaatgttttaggtgctgggaggtacatggtatatgtaaaattgtaacttcatgttctttgcttcaactttgggggacagatttaattagcagcctaactgagtttctttagcctaattgagtttctctgctcttggaagagcatgcgttagggaaattatcttagaataagttagaagcgagcctgcaattttcttgatcttgaatgccctttgggagaaatggtatgagttagtattaagttactctatttgaagattcatcatctttcaaacacacaccttaaagaggccatacatttctcatagaacttactacagggtctgattttatattttagtctcatcttggatatgccctaaactctgcaatatgtctcctgtagcttttctaaaggatcagcagtttgagatttctaaggaaaccaaattaattttggcagaaatagttaaagccatggtgagaatggggttcaagacactctaccccaaaatatggtaccttgcgatattgaatattttaaactgagggtcttggagaaaatggcagaagtaggaaggtcactctgatctcctcccattctgctcttacctttctcccatggagcaggttataaaacccaggaaggattttctgatgttcctctgaagcaggtcataagcccctcatgggagaggtatcttctctatacctggagaaaaggagcattcttatttccaaaggcacagggtcacaagagaggaatctgcatgaacaggccttgtttacttatgctatggagcaaatgggctcactgcctgatgcatacagaagtgaagaactatggcaccagtttttgagaaaagaaggcctttattgtaagaccagtcagcaaaggaggcaggagggggctcaaatctgcctctctaatttgaggtctggggcaagttttaaagaatcagagggcaagggaaaggattgaagagtgttggctgagcggggtctgattggaggccttcacatttcaccatttacagtaagatatgttacggcagattttagccctggatcttcggggccaacagacctcttgcttctgaaagagctatgtgtttaggttctggtcatgttctagaacttcttggttctgaggggagggaatcattggttccgggtgtgttagaggtaaaagctttttctattgcacatgcccgtgctacagaatttgtagtttttggctctgttatacccaaaaggtaacttgacaatttgttatcaacagaataggcccagtttgggctggtttcatggttacacttacaccctttaccctatcacattattctaccatgactctccatttttcttcaaaaacctactataaaaagcactcagatttaactgtttctttgggtcttcgtttcctcatgaagggtctcatgacacataaaacttatattaaaagcatttgtatgcttttctcttgttagtctttcttttgttagagggtccccagccatgaatgtagaagggtaggtaggggagaaaaagtgatattctttcttcccccattgcaaggttcatggctgacaccaccacaacaaaagatggactaacaagataaaagcatggcacatttaaaaaatactagttttacatgacctgggagtcttcagaaatgaagacccagagacccagggaaaactgtgtttttgtgcttaggttcaatgagcagtggacacttgtgtagaagaatgactggataaaaaagggggtatgatttaatgttaataaactagggggagttgagcagaacatgtttgttcagattcttcttgtcctctctgggtaacattccatccctgtaggtatagggcaggacacctgtcacatgtgggacttcaaaagatggggggatagaggaggtcagagatacctttctgcttatgcacttttctcagtttccttcatcttaaaacactcagtatgccaaggtgacataatttgggatagcatttcctgcatcctatcaggtagaagaaaaaaaatatttttccttcagtgacagtttttggtaaataatagcaagaaaaccttttctgaagttatagttaaaaatatgagcatcacctgaaagtcatttggacagatgcatttaagttgacaagtctttttggtttatactttaattattatttgctacttttattgcgttatggtcaccaactgtggcctggattattttttgaattttccatttatgaagttttctttttcacttactatatagttgacttttgtaaatgctacctgatggcttaaaaagtggcatattatctgcttttggttaatgtatctttgtatgtttgtgtggaatactgtgtgtctaattctaggcagcacaaatatatgttggtagaataacacctggtttttggcaatataatatttctctttctgtaaaaatgtgtgacacttttgcttggtataaaattcttgcttggtataaaaacatattcgttagataaaagatattcgacaatctcactgagagacacgaaggctacttgggttatggggaggtatgtcatcccctttgcaaattatgagtatttttggatcatctgtagctgggggcaggactctttcaaaggagaggcgatgtgggctatagtgaggagacactgtttctcaaattccatgtgaatctctggccttcaggggcatttgatacgtgaacgtggctaaaggatctcaagatgagaaacttgcttcattgttaaagttatgggctcagctgtcagggtcatactctgcacagagcaggaggaaagttcctaggcattcctgcctgccaacagggccagccgctggtgctgcacaatggatccttagaagatgaacctggaagagaaggcaagtagacttttcagcaggagtctgctgggagaaaggagtgccattctctctggtgtaaaagaatcttcatggttgggtgcggtggctcacgcttgtaatcccagcactttgggaggccgagacgggtggaacacaaggtcaggagtttgagaccagcctggccaatatggtgaaaccctgtctcaactaaaaatacaaaaattagccaggcgtggtggcgggcacctgtagtcccagctactcgggagtctgaggcaggagaatcgcttggacttgggaggcagaggttgcagtgagctgagatcatgccactgcactccagcctgggtgacagagcgagactctgtctcaaaaaaaaagaaaaagaaaaagaaaaaaaaagattcttcatttgggactgtcactaatatggaagaacggggatatttaccccgttgacattgagaatgtatgtacatttaggtaatttttgacctactataaatgtttgttagttttgctttctagtaagatatcttttttgatatatatattggctactgtgataaaaaatttagggaaataatgtcatactattgtggttgtccagtggtaaaattgtcctgaaatttcttagaagggttcctcaggcaaatgagatatgaagccaccttaaaataaaatcacctgggccactcttatcttgattttttttttttagcattaatattttcctactgtttgaagtccaccattttcttaagacttttaaagtgtgaaatggcacacctgcatccaaaggattcgaccagtggggcacctgctgcatttaaaatctagggctctcaaataaatccagctttacttaagcctgaccaaataagtattgaaaatcttaatgaaaaggagcttgatgttattggcttattttccactttattgagtttctgtcacagttgcctgaacaatgttcgatgacttaatttaatttattttctttctgggggacaggcaggaaagaaattcacacagaaagaggaagaccttaaaggtaaacagatgtatgtagaaaattagaatgtggactggcaaatctaagataattgtactgaaatactgattagacattacaaaaggggctgagttctctgataagcttacttgaaattataaatactttaacaaataagttgaagaaaaagtgatctactagaaaagaacaccagccaggaaccaggagacttggtttgtgttttaaaaagcccataaattcatgggctccagaatttaagccttaaagggactacttcctagctctgtgactttgggcaggttgccttctttttctgcaaaatggggatgggaattgtaacctacctgatagatatttttcaagaacaaaatgagtaagtacatgcgaaatgcatagaacagtgcctggcaaatagttaagtgctcaataaatgttgaaaattataatttccaagtaatttaattttttttagagctcagctttctcatttgtttaagaataattcttcctgcccttcttgtatgggcaataagaaggttttaccctcatttgtttaagaatagttttttcctgcccttcttgtatgggtaataagaatagtttttcctgcccttcttgtacgggaataagaaagatcacttgcctgaaagaattttctctccaggaggagagataaaacattaaagtcaagcgctcaaagcatcagacgtcactaaaagacatccgaggtcactttggtctgggaggataatgaaagtcttcctaaccttagtgccagcactggttgctgaacttgagtatataaagtaatgacatttagaaaacaattttggaaacgaaacacagatgtccaactttattttgccaaataatggggttaaaaacctctctctaggctgggcatagtgtctcatgcctgtaattccagcactttgggaggccgaggtggtaggatcatgaggtcaagagatcgagaccatcctggccaacatggtg

SEQ ID NO: 447 - DNA, 40001 bp, Homo sapiens
aactttttgaggccgggcatggtggctcaagcctataatcccagcactttgggaggcaggaggatggcttgaggccagaagttggaaataagcctgggcaacagagtcagaccccatctctacaaaaaagcagacaacaacaacaaaaacaaaaaccttttgaacacctattatgggttaagcatactgattctctcaggtaggactctgagtatgcagtatagaaaactagctcaaattggattaaggcaaatgggaatttattggctcgtggaatggaggaccagtttcaggagaggcctaactcagggctcaacaatgtgaaggggaaatggatttttctgtttcttggctgactgctcttctctgtgtgctggtttctttctcaggctccgagcagttggtcgaagtagcagctctcgactcagcctctgaggctcaagttcaatgagagggagcgagagagaaatcgttctagggagctgcagcaagacctaggatccaacgagtggaccatcttagatggccccatttctgaggtgcccatttctgaaccagtcccagtggccaggggtataagcatgttctgattggcttaggcttggacacatgttccacctctagagctgagttggctttatctggagtacagggactgaaagtggggaacagaagtctccccagagcaaaataggagtactctaagatgtggttgcaaatcagcacaccccacctatctctgtttgactactatttatgcgttctcagcagacataaatgtgttaagagtagtagatcggccgggtgcagtggctcacgcctgtaatcccagcactttgggaggccgaggcaggtggatcacctgaggtcaggagttcaagaccagcctgaccaatgtggtgaaaccctgtctctactaaaaatacaaaaattagccgggcaatgtggcatggacttgtaatcccagctactctggaggctgaggcaagagaattgcttgaaaccgggaggcagaggttgcagtgagcccagatcatgccattgcactccagcccagacgacagagcaaccctccgtctcaaaaaaaaaaaaggtagatcacaaccttctttgactaatactctatccacacccactcccctatttaaccagtgtgtcccctctaagaatctttatcctcatggttcacatggtgtattagtctgttctcacgctgctaataaagacatacccgagaccgggtaatttataaaagaagtttaattgactcacagttctacatgactagggaggcctcacaatcatggcagaaggtgaatgaagagcaaagtcaagtcttacacggcagcaggcaagagagtatgcccaggggaactcccctttataaaaccatcagatcttgtgagacttactcaccaccacaagaacagtatgggggaaaccacccccatggttcaagtatcttcacctggctccacccttgacacgtggggcttattacaactcgaggtgagatctgggtgggacacaccatatcacgtggccacaccatatcacatggctttggaacccttcagggtactgggtgcatggatatgtgtaatgttttattgcttctcttttgaggtgccacaaaatacccttctctgcttggagacgcaggctccaggaaaaggaaggagaccaacagatgagaagtgacttcttttcttccacttctaggaaaatacataattagaaccttccaagatgtaaggaaaaagggccagatttagatttccaaatgtggagtgacaagtattttacaaaatgagggagttggattagataactcactaaaggccctcctagttatcgaaggattctattattcacatcctttcttttagaacagcagtgtttgttttggtttcaataaggggagagggcatgggctcctgaagtggcagggaggaggggaagagatggagcagcgcaggcaggggcaagcggggactgtgagacaaataacacccatttcccagttttagttgtcaggcggctgctcttcactccccacttggattttgagcattttcacaaatcttcagaattagttcaaatcatcaactcgtacttggtagctttattcccttggctcttgaaagggaaagtaaatcaaagcttgtctgcccagaacctggcaggagcatttaataaagatgttcagcttggcgcagtggctcatgcctgtaatcccagcactttgggaggccgaggcgggcggatcacttgaggtcaggagtttcagaccagcctgaccaacatggtgaaaccccatctctactaaaactacaaaaattagccgggcatggtggcgggcacgtgtaatcccagctactcaggaggctgaggcaagagaattgcatgaacctgggaggtggaggttgcagtgagcccagatcatgccactgcactccagcctgggtgacaagagggagactgtctcaaaaaaaaaaaaaaaaaaaaaaaaagatggtcatggtcatcccagggtgggggcaggcttgaggactctgcggtggtctctcaggatctactccagatccaggctggcttccagaaatactgcaagtggtaagaatgccaagatttcccagctctgttgcagaatgaattagtggccctcaagtgaagtcactgcagaacaaaaggctataaaaagagagaaaagaatgagggggagatgttataggtgcaaactggcatggaaagccctgcaacgcaagcaagcaagatgtttgaattctcccaagagaggcagacaaagcaacacaggaaaacatttagacatccatgaaggcagagagaatcctgaagcggaagtctgtcagtgagcagcatttcagtgctgagccaaagacagggaattggccaaagcaccaggaaagagagctgcaggccctcagtagctggtcaaccaatatgggttgaaacgaagtctggtttcagcatttgtgctgatgttgcctcattttacgttttttagtttttgttttgagacagagttttgctcttgtggcccaggctggagtgcaatggtgcaatctcagctcactgcaacctccacactgccccgccgccaggttcaagtgattctcctgcctcagcctccctagtagctgggattatagacacgcaccaccatgcccggctaattttgtatttttagtagagacggggttttaccacgttggccaggctggtcttgaactcctgacctcaggtgatccagccgcctcggcctcccaaagtgctaggattacaggtatgagccaccgcgcctggcccattttacattttatttctcattgatcacttgcaggtcagagagtcacacaagctacagtcccaagcacctatgttctaaacggtgcagcttggcaagggagtcacaaataaacatgcccctttccccagtttcctcttccaaatagtcctgaccctctatgtaaggacccagaagtgcctcaagtcgtgttaaagcctacatttcactcttttatctgaaatacaatttgagaaataggaaatgcatgatttgtaacctgacaaagttgaattttacctgagccttgtgggcctggtgaacagtgaaggttaagaaatcccccacccagatcacaaggtcgggagatcaagaccatcctggctaacacagtgaaaacccgtctctactaacaatacaaaaaaaaattagccgggcgtggtggcgggaacctgtagtcccagctactcgggaggctgaggcaggagaatggcgtgaacccgggaggcggagcttgcagcgagccgagatcgcgccactgcactccagcctgggtgacagagcgagactccatctcaaaaaaaaaaaaaagaaaaatcccctacccgggctgggcatggtggctcacgcctgtaatcccagcactttgggaggccgaggtgagaggatcacctgaggtcaggagttcgagaccagccatgaccaacatggtgaaaccctgtctctactaaaaatacaaaaaaaattagccgttgtggtggcaggcacctgtagtcccagctactcaggatactgagacagaagaatcgttggaacccagaaggcggaggttgcagtgagccgagatcaggccactgcactctagcctggcaacagagcaagactcagtctcaaaaaaaaaaaaaaaaaaagaaaaagaaagaaagaaagaaagaaagaaagaaagaaagaaagaaagaaaatcccccacccttcatgttctgcaaaagggcttactgcaaagaccaccccccaacccttccacatgtcacttcagtaagactcacagatgctcttcttctttacctatgttaagaccagacacagaccctcaaaatttcctttctttgcctcacagatgattagctgaactgcttgtcctcactgaagaactagagcaaaatacatgttacccaaactttggttaggcttctctccttcctcagagcctcagaactttgtttacccttggcctgagccccttcagagaacagggtggcttcagggccaaacattccaatttgctcgatttgttactctttcatctgcttcccacatctggttcatcctagccttgtttcctcctaccatagagaaaccctttgcaacctttgagatgtttacagaccttccagtcccagcattcccctccctccattgcaggagtacccccgcaatgccctggcaataattccttcgaatgaaggtctctcttttaccacatccagaattttttttatttgacaaaccagaaatggaagacaacccatcagctcgtcttctgagctccttctagcgccaggaattccatagaaaccgcatattgtttgattcctcagcccccggatgggttgccagagtgcagtgggacttgccaagagaatgtgacctctgacaaacaatgatatgggtagagagcctaagttaaatgcttatcatgtgctaggtactattttatgtgttttatgtttgttatcacatttaattttcccaatttccataagaggaaagtattatttttagccctgtcttataagacaggaaacagaggctctcagttaaattagtcaaggtcacacagccagtgagtgacagagctgggacgcaaatgcaggtcagtctgaggccatggttgggcttgtaatcaccatgctatgggctttcctaagaggcggcttcttggaaatgctcctttcggtgtctggtatctctggatagaagcgtgtgaaaaagaaactgtcagctgggaattagccaagcacaacagccagagtatggtgtccacctgccgaacactgagggaaaccaaaatatttctccccaaaatattgaggattgttagttgaagacactaaaccgcaggggaccgctgtgcctcagcctctgtgtgcctgatggcggggcataaatccttccttattggagacagcacttgctttttggcccagagaaggcaccagcaggcaccagcggaaactgggaacagattttactctcttcccacatgtattagtcaggattctcttagagggacagaactaataggaaagagatagatagatagatagatagatagatagatagatagatagatagatagatagatgcatacatacatacatacatacgtagatagatacatagatacatggatagatagagataaagggaagtttattaagtattaagttacacagtcacaaactcccacaataggctgtctgcaagctgaggagcaaggagagccagtccaagtcccaaaaatgaagaacttggagtctgatgttcaaaggcaggaagcatccagcacggaagaaagatgtaggctgggaggccaggcctgtcacacctcttcatggtttctgcctgctttatattcattggcagctgattagattgtgcccactagattaagggtggatctgccttccccagcccagactcaaatgttaatctcttttggcaacacctacacggacacacccaggatcaatactttgtatccttcaatccaagcaagttgacactcagtattaaccatcacaccatatttttccgcctttgaaaagactggaactgctctctctttcatcttgtcactatgtaggatttatggctctttgttaaactatgatttaagcaaagcccctaagccactgccttgagagagaaatacttttgaactgaggcctctcccgtgtgatgggtactgcatgcattaataaatttctgctttttttttttttttgttaatctaacttttgttttcaggagagtatctcaactaaaaacctaaaaaagaaaaggaaaaaatatgttttctcccccacaatgtgcacctgccaaacagaccatttcacagcaaagcaatgcgtaacacaatggagtgaaacaaagaagagaccagtgtgtaatcatgcccatgccctcagcacagacagaaacaagtgcacgtactgtgtaaactacagaagcgaccaaacacctccctttcctggctactataagcagctgaggcttctttatcaatgaggttttgagtggggcttggttcctgccactttctaaataaaaatcattaagatactcaatcaccaaattgcccacactatctgactgcacccagtccagagcaggcctcgctcggctcagcccttccccaagtcatctaacataaactcaaatcctactataagcccctcctaatggcctcttacctagaccacacttccctagggtgtgtaaacccaaatcataaagctgactctcgctgcagatgaactaagggactggtgagcttcaacacaagcttggccccatctgcgcacctgaacgcaatgctttcccatgcgtctccccgtggatacatcccgtaatggagggtgctctgacttcagctggttcgggaaaggccactcctgggattgcttcctcttttctgcccagcatttcttcttcttctttttttttttttttttgagacggagcctcactctgtcgcccacactggagtgcagtggcgccatctcagctcactgcaacctctgcctcccgggttcaagattctcctacctcagcctcccgagtagctgggactacaggcatgtgccaccacgcccggctagttttttgtatttagtagacatggggtttcaccatgttggtcaggctggtctcaaactcctgacctcaggtgatccacctgcctcggcctcccaaactgctgagattataggtgtgagccaccacacccagccttctttcttctttactctcccaactcctccactgcaactcccattctacagagaaggcattatctcctttgggctaatgttttaccatactgaaaagacctctctaagttagtcctcttcacctcagtttcccagctgggaaagctcaagcccaggcattgtaggtccctgtggctttacgtacacctgaaagtggcagggacgggtcagcagagaccctgatcctaccattaggttctgaatgggaaaaggaactacagaagcatctccaccaaagctcttcttgccaaagtttacttctgtattgtttaggccttggaggtaaaggataaaattgtccagacagctaattattttcttcaggtggctgaggtaggaggatagcttgagtccaggaagtcgaggctgccatgagctatgattgcaccactgccctccagcctgggagacaaagcaagactctttctctaaaaaaagaggtaaaaaaaaaaaaaggaacgagattgtgtcctttgcagggacatggatggagttggaagctgttatcctcagcaaactaacacaggaacagaaaaccaaacaccgtatattctcgattataagcgagagctgtacgatgagaacacatggacacatgggggaaacaacacactggggcctgtcgggggatgggaggagggagcgcatcagggagaatagctaatggatgctgggcttcatacctaggtgatgggatgatctgtgcaggaaagcaacatggcacacatttacctatgtaacaaacctgcacatcctgcacatgtaccccagaactttaaagtcgaaaaaaaagaggccgggcgtggctgttcagacctgtaatcctagcactttgggaggccaaggagggcagatcacttgaggtcaggagtttgagaccagcctggccagcatggtgaaaccccatctctattaaaaacacgaaaattagccaggcatggtggcaggcgcctgtaatcccagctactcaggaggctgaggtaggagaattgcttgaacctgggaggtggaggctgcagtgagccaagatcgtgccactgcactccagcctgggcaacagagcaaaattccatctcaaaacaaaatcaaaaacacataccatcacaccggagattagggcttcaacagagaaattttgaaggaacacaattcagtccatagcaagtagtacagtggtttttaaaaatttttatttttaattcaaatgtaataattgtacatatttatagggtacaatgtgatgttttgatacatgtatatattgcgtaatgacaaaatcagggtaactagtacactcaccacctcaaagattaatttttttttgtggtgggaacatacaaaatcctctcctctagctattttgagatatacaataccttattgttggctacagccaccctactgtgcaatgggatgcgagaatttattcttccttgttaattttaactttaaaagtttatttttggccgggcacggtggctcacgcctgtaatcccagcactttgggaggccaaggcaggtggatcacctgagatcaggagttcgagaacagcctggccaacatggtgaaactccgtctctattaaaaatacaaaaaaattagtcaggcatggtggcaggcacctgtaatcccagctacttgggaggctgaggcatgagaattgcttgaacctgggcggcagagtttggcagtgagccgagatcacgccactgcactgcagccttcacgacagagcgagactctgtctcaataaaaagaaaacaaaaagtttatttttgttgtaacattcttttattatttctagaggcatgtaacaatgtgctatgtaacaattcaagactgtggcccagatgaaataatgatagcagcacatatctggaacttctttggtcacatgaatgcataataaatatatgaagtggaaactcaattctacgtagtatgactacagcagactaaagacaataatcaggccgggtgtggtggctcacacctgtaatcccagcacttcagcactttaggaggccaagaccagcagattgcttgagctcaggagttccagaccagcctgggcaacatggcaaaaccccatctctacaaaaaatacaaaaattagctaggcatgctgatgtgcgcctataatgccagttactttggaggctgaagtgggagggaggtggagaccatagggagcagagatcacgccactacactccagcttgggtgacagagtgagaccatgtctcaaaaaaaaaaaaaatgcaatgaccaccaaaaactactctctgcagtaacatggcaatgaaaatagatgccattgttatgtactttaacttctactatgattatttgacatgagattcctttcctttgctttcctttttttttctttttccttttcctttcctttcttttcctttctttttttggagacagggtgggtctcactctgttgcccaggctggagtgcaatggtgcaatcttagctcactgcaacctctgccttcctggctcaaatgatcctcttgtgcctcccgagtagctgggactacaggtgcccactaccatgttcagtgattttttttttcctgcagtttttgtagacagggtttcataatgttccccatgctggagatttctttctttctttttttgaaaaacaaaaaacaaaaaaacaaagtcttgctgtcgcctaggctggagtgcaacggcacaatcttggctcacttcaacctctgcctcccaggttcaagcgattctcctgcctcagcctcccgagtagctgggattacaggcttcgtgccaccccgcctggctgatttttgtatttttagtagagatggggcttcaccatgttggccaggctggtctcaaactcctaacctcaggtgatccacccacctcggcctcccaaagtgctgggattacaggcatgagccaccatgcccagccttttaaatttattttaaaaataaacgtatttcttacagttctggaggtttgaaagtccacagctgttgggctgcatctggtgagggccttcttaccgcagcataacatgacagagagcatgacagggcaagaggccattttcttgtctgagagtttgatttagtctagaatctgaccccatcttgacataaacaccactggctcagataaatattaagtgcaacagtttacctaatttagttatttatttgtattcttttatttttattttatttattgagaggggttttgtcatgttgcccatgctggtcttgaactcctggactcaagcgatcctctcactttggcctcccaaagtgctgcgatcataggcttgaactaccgcgtccagctagtttatctaatttaaagacatcaaaatctaaagtcagattcttacttagatttggtgtttcagatttcaaagagatgagatgtcaccagataaaaactactaggtggtaaccaggcgtggtggctcacgccgtaatcccagcactttgggaggctgaggcgggcggatcacgaggtcaggagttcaagaccagcctggccaacatggtgaaaccccgtctgtactaaaaatacaaaaaaaatagctgggcatggtggcaggcacctgtaatcccagctactcgggaggctgaggcaggagaatcatttgaacccagtaggtagagattgtagtcagacgagatctcaccattgcaccccagcctgggcgacagggtgagactctatctcaaaaaaaaaaaaaacaaaaaacgaccaggtggctcacgcctgtaatcccagcacttcgagaggccaaggtggaccgattgcttgagctcagaagttcaagatcagcctgggctacatagtgaaaccctgtctctaaaacaaacaaacaaacaaacaaacaaaaaacaaacaaacaaagcttagctgggcgtgatggcgcatgcctttagccccagctactcaagaggctgaggagggaggatcacttgagcctgggaggcagaggctgcagtgagctatgatcgtgccactgtaccccagcctgggtgagagagtccctatctcaaaaaaataaaaccaaaaaactactggggccacgtcagaactgaaagagttctgcaggcccttcagagaaaggagaagtgagagtcaattaacctcaagattacatttaaaagcattttcctctttagtatagaggtgtgttaaaaaaaaaaaaagcatttatacgaggtatgtgaggtatgttagtgaaacagcaaaaacctaattatatcctaaataactggcacgctctaggttacaaatagcaatttgtaaaagacccattgaatgaacacattaaacagcaggttgcttattccttctcaaaccgcactaaaaaattcctctctcgcatgtgtaggtcccagagccagacagttatgagatgatggtgccccctggtggccaatgtggggagccacccggccaggcgtgcttcctggctttgtgccagccatgcctttattctttggttggttggttggttggttggttagttggttggttggttggctggttgagacagagtcttgctctgtcgcccaggctggagtgcagtggcgatttcggctcactgcaacctccgtctccgaggttcaagcaattctcctgcctcagcctccggagtaggtaggactacaggcgcccaccatcaagcccggctaatttttgtatttttggtagagacgaggtttcaccatattggccaggctggtcttgaactccagacttcaagtgatccacccgcctctgcctcccaaagtgctgggattacaggcatgggccaccgtgcccggccagaccatgcctttacttttgcacatatgcacagtatttctgaaaatcaagtgaaaaagttggatttatatactctatgtgagtttacatgttatggggatttccatttccagagaattaaaatggataatcaaatgtttaatttcatttcacaattttcaaatatttctttccttccctccctccttcctctctttcttttttctttctctttctttctttctttcttctcttccttttttttttttcttagacagagtctcactctgtcgccccagctggagctcagtggtgcaatctcggctcactgcaacctctgcctctcaggttcaagtgattctcctgcctcagcctcctgaatagctgggactacaggcctgtgccaccatgcccagctaatttttgtatttttagtagagacagggtttcactatgttggccaggctggtcttgaacttctgacctcaggtgatccacccatctcagcctcccagagtgctaggattacaggcgtgagccactgtgccggggcagcaggcctttcttgactgcagattttctaatacatgaaaacagccaccaattgcaaaaatatattaattttcgacaggtacaaaaggcactttgtgaatatcagtatgcagttgggtacacttatccggaattaaacctgtctctcctggagctacatgccacaggcatctcacacaggggccgctgttctggaacactcctgtgagccaataaaggatcaacagcttctcttcaggccaggcgcagtggctcacacctgtaatcccagcactttgggaggccgaagggggcggatcacctgaggttaggaattagagaccaacctggccaacatggtgaaaccctgtctctactaaaaatacaaaaattagccaggtgtggtggcgggcgcctgtaatcccagctactcaggaagctgaggcaggagaatcacttgaacctgggaggcggaggttgcagtgagctgagatcgcaccactgcactccagcctaggaaacaggagtgagactccatcttaaaaaaaaaaaaaaaaaaaaaaagcttcttttcaagaaaaagccatccagtgaatgggtaccactcacaaaatgaagttactgtttttttttttgtttttcgttttttgagacggagtctctctctgtcgccgaggctggagtgcagcggcgcaatcttagctcactgcaagctccgcctcccgggttcacgccattctcctgcctcagtctcccgagtagctgggactacaggcgcctgccaccacacccggctaattttttttttttttttttttgtatttttagtagagacggggtttcaccatgttagccaggatggtctcgatctgctgacctcgtgatctgcccgtctcggcctcccaaagtgctgggattacaggcgtgagccaccacgcccggccttaatattaagcttgttttgctatagagttgaaactaatttgtttgcagattgggcacaaactctctccccctgcaaaaccaaattgttcggtaagccatgagttacctctttcatcgacctcaggcttattttggcatattcaataggctgatttaagcctttggagccacttctataagtagtctgtaagaaataacacaccttagctgggcgcggtggctcatgcctgtaatcccagcactttgagaggctgaggcaggcggatcatgaggccaggcgtttgagaccagccttaccaacatgaggaaaccccgtctctactaaaaatacaaaaattagccgggcgtgatggcacgtgcctgtaatcccagctactcggaatgctgaggcaggagaatcccttgaacccgggaggtggaatttgaagtgagccgagattacgcgccactgcaccccagtctgggggacagagacagactccgtctccaaaaaaaaaaaaccacacacacaaaaaagaaatgagtatcttccttctccaatgcaccaaagggataccagtcactattccttttctttctacactgaagctaagaaatgcctttttcagttaatccacaaacaaatgattaacatccctactttttttttttttttgagatggagtttcgctcttgttgcccaggctggagtacagtggcgtgatctcggctcactgcaacctctgcctccccggttcaagtgattctcctgcctcagcctcctgagtagctgggattacaggcatgtgccaccacgcctgggtaattttgtatttttagtagagacggggtttctccatgttggtccggcttgtctcaaactcccgacctcaggtgatccacctgccttggcctcccaataacatccctactttaggctacaccatatataatgagtttagttggttaatggctacccaaattcaagtagtaagcaaagtacctttatgccttgagaggcatgaaaacagcagcctccaggctgaaatatataacatggatggctgccacccaaccaacgcaatcaaaccctccccttaactgatcagatgtggataggacagcaaaatacatctctaagattgggtgcccattcctctccttggggatggttatgagcatgtgagtctcacagttgaccatatccaccttacagttggactggacaatacacttgagactgtccttatctcccaggtgtccttacacatctagattccctccccaccaattgggaaacagtgacagcccgtcatagacagaaaaagtgggcttcttggtgattttattctatggctgtcttctctcctcaagcagtggctatagatgttgaattacaagtagaagccctggcaaaacacacagctgcagcttttatttatttatttttgagagggagtctcgctctgtcacccaggttgaaaagcagtggtgccatctcggctcactgcaaactccacctcccaggttagccttagcctcctgagtcgctggaacaacaagcgtgcgccaccacacctagccaatttttgtttttttagtagagacaggttttcaccacgttggccaggctggtctctaactcctgaactcaagtgatccacctgcctcaacctcccaaagtgctgggattataggtgtgagccaccaggctcagcccactgtagctttcaataatactcatcagggccagcagcggtggctcacgcctgtaatcccagcactttgggaggccgaggtgggcggatcacgaggtcaggagatcaagaccatcctggctaacatggtgaaaccccgtctctactaaaaatacaaaaaattagccaggcatggtggcgggcgcctgtagtcccagctactcgggaggctgaggcaggagaatggtgtgaacctgggaggcagagcttgcagtgggctgagaccacaccactgcactccagcctggggaacagagcgagactccgtctcaaaaaaaaaaaaatacttaccaggctatcacccttctgacagaagagacttaccaaataagacaaatggctctacaaaactgtatggctttagacattttaactgcagcccaagggggaatttttgccctgatcaaaactgaatgttgtatttatattcctgagtattcccataatgtatcccaggctatgagttccttggaaactcacattacagcattaattctctgtctcaaggccccataatggcctggtttgttagctatccagtacttggaaagcatttcttttcagcatgcttggtattgtaatactcgttattataaattgctgtgctttttacttctgttgcacttgtgtaggtttgcaagataaaatagctcagcaacttctttgcccatctatttactcatttcatattttacctttataggaactattgggacattgctcaagcaaggaaccacctggctccctgaggaggctcactgcatgctttcgtgaaaggaccctgtcccagcaatcgatgtccactatcagcaggaagaagttacagaagaatgaccttcaccctcctctcctcttaaaattaagggctctcttagctgggcatagtggcgcatgcttgtaatcccagatacttgggaggatgaggcacgagaatcacttgagcccgggaagcagaggctgcagtgagccaagatcgcaccaccacactctagcctgggtggcagagcgagaccctgtctcaaaaaaacaaaacaaaacaaaaagattaagggttccctcaaaattagtgggggtaatgttagggaaccaggagcctaggagggccagagtagcaccattttaagttcagctccatcttgagaaatagtaaagcccattctctgctggtcacgacccacattcatgggctgtttacagtggaagaaacagcctaaagatacctacaaggacacactcctactacagccaagagtccagatgtccaatacccataacaatctctgttttcaagataataatagttttgctttgatgtatccacacactagaatgtcaaggccagttttctttaaatcagtagtcatacattctgtcatgctgtctgctcacccacacgtggacacagcttagcttagcctttatatagacaagatctctagagaagaaaaacaaaaaacaaagtcgaggcgttcctcctcttgctttctgaggatgccctactctaacagtgtagtttctaataacgttgcttctttcactgcactctgtgactcgttttgaagtccctcctgctcgagatccaagaacgttctcttggggtctggatagagatcccttttccggtaacacgatcattgaaggtatagaggtcccggactgctgggaatattttatatttccttttgaagactctccatcctgcccttatttcttaaagctgagttaattccattgcacataatttatttctccctcctgtatacatatcttccttttgtcctcttctgtcgcttttaataccgtgtggaggtgcaaaaccccttctagtaatggctggggaaaaaaagtcatgtaagtcccagggtgaaataagactttctaaaaaaaatacttgagtctcaacctctaaaacctttcaagtaccccgatatttcttttcatcttgtcacaaatttttatattcctcttcatcctgttaaaatctcccctgtttttcttaaattaccacctttcaaggtaaataaaacgctgctggttctctttttatcagtgtgccatttaattttcggttattacaatagaatggtcttaaatttgtctttaaactgaaaacatgcaactctcaagtgataacacggcttagagaaccttttgtttgagagcctggaaactaagtgtctccattacaatgtttccgactcccaaaataaccaagagatgaggtatccttgtgccacctttataaaactcttggttgttacgtctcatgcagagacacaatatttgttgatagtttaaataataattattattaatattaatagaacattttctatgttccaggccttgctttaagaagtttataggcattgactcatttaatcctcaccacaacctatgaagtaggtacttcttgttctctcatttttcaattttattttgttttgtacttttagtagagatggggtgtcgccatgttgcccaggctggtctcaaactcttgagctcaagcaatacacccacctcggcctcccaaagtgctgggattacaggtgtgagccaccgtgcccggccttgttctctcatcttatagacaaattcaccgaagcacagagaggttacggcacttaatcaagctcacagagctagtaagtggtggaacagattgactttagagccactctgttctgccctttaacagaattcattctgtgacatatggattattttgagtctcattaggcatattttgaaactactcagattcatattaaaactccatgaaggtaggaccgaagtcttattcatttttgtttctcccacaaatttttttttttttttctgagatggagtctcactctgttgcccaggctggagtgcagtggcgtgatctcagctcactgcaacctctgcctcccgggttcaagcaattctcctgcctcagcctcctgagtagctgggactacaggcacacaccaccacacagggctaatttttgtttttcgtttttgtttgtttgagacggactcttgttctgtcacccaggctggagtgcagtggtgcgatctcagctcactgtaaactctgcctcctgggttcaagcgattctcctgcctcagcctcccatgtagctgggattacaggggcatgccaccacgcccagctaatttttgtatttttagtagagacagggtttcaccattttggccagcctggtcttgaactgctgacctcaagtgatccatccacctcggcctcccaaagtgctgggattataagcgtgagccaccgcacctggacaatttttatattttttctagtagagacggagtttcatcatgttggccaggctggtttcgaactcctgacctcaagtgatccgcctgcgtcggcctcccaaagtgctgagattacaggcatgagacaccgcacctggccccctagcaggttcttgatagttgctgacaatggagctagctggggattctttcctccgatggtcattatgcattatagacaaggttcctgtgttctcattatgcccccaaggaacatgcttcagcaaacgtgaaaaatgccagagccatacatttttttttttttttttttgagacagggtctccctctgtcacccagcctggagtgcagtggcatgatcacagctcactgcacattcatctgcccaagcccaagtgagcctcacacctcagcccccaagtaggtgggattacaggtgcactccaccacacccggctaatttttgtatttttttgtagagttggggtttcgctatgttgcccaggctagcctcaaactcctgggctcaagcaatcctcccgcctcggcttcccaaactgctgagattataggcgtgcaccaccatgcccagcccagagccatacatgttggtttaaccaaaagagctgaagggtggcttggagcactggcataaatgatgtccctttagctgtcagggctgaccgggagggaaacaaccctgcaacccgtaatggtccttggcttgatcaaagagcaccttgtacttgaggtaccctctttgtcctggtcccatccattcaccagcagccttcacacatctgtcctaaaaccttagattttacctatctgttgctgcacatacagcggtgccaggggacactgtcgaccacgcccggttaattttttgtatttttagtagagatggggtttcatcatgttggccaggctgttctcaaactcctgaccccaggtgatccacctccttcagcctcccaaagtgttcggattacaggcgtgagacaccacgcccgggctcaaatgttcatctctttcagaaataccctcagaggaacacccagaggaatgtttgactaactgtctgaacacattgcaacccagtcaagctgacacatagaattaaccctcacagaaccaataaggaagtggaagaaagtgcttcttttgctacaggatgaggtgggagcaggaattgtgagaggccccctggccaccatctccagtgtattgggttcagctcatttcctccccagcactgctactaatgttcaaggcattatttgttgaagccaggtgccgtctaagcaggctgtcgagggagagcaattttttttttgagacaggatctctttctgttgcccaggctggagtgcagtgacatgatcttggctcaccgcagcctcgacctcccaagtagctggaaccacaagtgatcctcaggtaatcaggtgattctttcacctcagcctcttgagtagctgggaccacaagtgtgtgccaccacacctggctaattttctttctttttaatagagatagggtcaccctatgtggcccaggctggtctcaaactcctgggctcaagtgatcctcttgccttaggatcccgaagtgctggactacaggcgtgagccactgtggctggccttttttttttttttttttttttttaaggagagcaattttggtaactagagactgctgggaaagagaatgtgggcgatcagagagtgcaagggacatagaaggaagtctttagaacttggatgggagtccaagttctgccacttccaggcctttgtgcattcagccagttacttaagctgtttggcctcagtgtccatatattgcattaacaccgggaataacaatttttaccttacaagattgttaagggaattaaatgagatcatgtgaataaagagcctgccatagagttgcactcaataaacactattttacttccccctgaattccctacctgtacttttggcacatgaaaaaataattaggtagaaataggctggagtccagcaggggaagacaaactaatctttcctggactacatttttacatggataaaaatttttgccactgcaactctaagcagcactcagtatctttgagatattagtgatgtttttctctgatgttcttttagctcctggggtcactgtgggctaagagaggtggagacaggctttgtgcaacgctgccttgtccccctgctcagaggcagatgtgacttaataggaagaatcctagaggccttcagatgctgtagagaagattcatgtttgatgagagagagcctggatgacatgaaagttgttgtttttttccagagaaaaggaaagagacataacattccccctacccgcccaagcatcagcttcctcttctgaactggttgctgtggagattaaaaactttgtacacagcacattgcacacaggcgatacgcggttgttagaatctcattaccattgacaatggctaattatagatgtgaacatctaaatgtgtctgaaggggacagagaagtttggtaaggataacttacaatctttccatcttttgttttgttttgttttgttttgttgtgttttagagagggtcttgcaatgtcgcccaggctggagtgcagtggcatgatcttggctcactgcagcctccacctcccgggttcaaataattttcaaatctctgcctccaaagtagctgggattacaggcacatgacaccacgcccagctcatttttgtatttttagtagagatggggtttcaccatgttggccaggctggtcttgacctcctgatgtcacgtggtctgcccaccctgtcctcccaaagtgctgggattacaggcgtgagccacttcgcccagcctttttttgtttcgttttgtttcttagagacagcatcttgctctgtccttcaagctaaagtgcagtggcttgaacatggctactgcagcatcaacctcctgggctcaggtgatcctcctgcctcagcctcctgagtagctgggatgacaggtgtgcaccaccatgctcagctagttcttacaatttttgtagagaccaggtttcattatgttgcccaggctggaattttcgtattttttgtcacaaagcctcgctatgttgcccaggctggtttcaaactcctggcttcaaacagtcctcacaccttagcctccctaaggatcttgtgctgagattacaggcatgatcctccatctttttatattgtgtaattataatgcagagtagtttgagcttggtgatgagaaagctttcttttcgccttcctgccactcattgtttgtatactttattttcaaaggccattaacatgtcgacagccactgagctgctgtttttgttttattgttcccttgaccacacaccaaccaaccatgactcccaattaatattcttaatggaatccaagcctctaagcctcacagtccaggccctccaccagcctgcctcaccctatcctcatttcatctcccgcaacctggctccggtgagtgctcttcgtagtcagactgggctgtttattttctgcaatgaacttgtaaatccctgcctttggctcgtgcttgaaatagcttcctctttctcattaccgagtctacgtcctgtgtttaagtgcagctctggaaccagacgacatgtgtgtcatcccaactctactgccagctatttatgagccctcaggcaagttactgaaccttcctgtgacttcacttctttacctctaaaacagaggtcataatagtatacctacatcctatgcttattttgaagcttaaagaggtaatttaggggctgggcgcgtgtaatcccagcactttgtgggactgaggcgggtggatcacctgaggtcaggagttcgagatcagcctggccaacatggcaaaaccccgtctctactaaaaatacaaaaattagccaggtgtggtggcaggtgcctgtaatcccagctactcgggaagctgggacaggagaatcacgtgaacccgggaggcgaaggttgcagtgagccaagatcacgccactgcactccagccttggtgacagagggagactccatctcaaaacaaaaccaaagaaaacaaacaaacaaaaaaaaaacaagtgttgataagaatgtggagaaattggaaccttcataaattgctggtgagaatgtaaaattgtgcagtcactttggaagacagtctggcaattcctaaataatttgagcatagagttactatatcacccagcacttccattcctaggtatatacccaagtgaattgaaagcatatgtctccacataaatgtgtacattaatgtttatagtggcattattcataatagccagaaagtggaaaccaccttaatgtttatcacagatgaatggagaaacacaatatagtactgaatattcacataatggaatattatttagccacaaaaggaatgtagtacaattgtccttcagtatccacaggggattcgtttcaggacccctgaggatatcaaaatccatggatgcttgagttccttatataaaatgatgtagtatttgcataattactttaaatcatctgtagattataatgttgaatatgatgtaaatagtttttttttttttttttttgagatggagtctcgctcttttgcccaggctggagtgcaatggcaccatctcagttgactgcaacctccgcctcccaggttcaagcgattctcctgcctcagcctcctgagtagccgggattataggcatggaccaccatgcccagctaatttttatatttttagtagagatgggtttcttttttttttttttttttttttttgagacggagtctcgctgtctcccaggctggagttcagtggcgcaatctcggctcactgcaagctctgcctcccgggttctagccattctcctgcctcagcctcccaggtagctggggctacaggggcccaccaccacgcctggctaagtttttgtatttttagtagagacagggtttcaccatgttagccaggatggtctcgatctcctgaccttgtgatctgcccaccttggcctcccaaagtgctgggattacaggcgtgagccaccgcgcccagccctgtgacggggtttcaccatgttggtcaggctggtcctgaactcctgaccttgtgatccgcctgcctcagcctcccaaagtgctgggattacaggcatgagccaccacgcccgaccaatagttgtattttttttggagacggagtctcgctttgtcacctaggctggagtgcagtggcgtgcaattggctcatgccaacctctgcctcagcctcccaagtagctgggattacaggcgcccaccaccatgccgggctaatgttttgtattttagtagagacggggtttcaccgtgttgcccaggctggagatagttgttatatttttaggaaataatgacaagaaaaaaaagtctatacatgctgttcagtacagatacaaatttttttccccaattttttcaatctgcggttggttgaatctacggatgtgaaacctacagatacagaggtctgactgtacttattcattctacaacatgaatgaagaaaacattatgctcaatgaaagagtcagtcacaaaggactgcatatgattccactcacaggcatccctccttttactgtgcttggctttattgtgcctcacagatattgtgaattttacaaattgaacgtttgtggtacccctgtgtcgggctagtctattggtgccatttttttttcaaacagagtgtgcttacttcgtgtttctgtgtcacattttggtaatcctcacagtatttaaatttttttcattaatattaaaagtaatggccaaaacaacaattacttttgcaccaacctaatatgattatctgttctggtgatctgtgatcatagatctttgatgtttctattgtaattgttttggagcacccatgaaagatggtgaacttaatggataaatgtgtgtgttcttttccttttcttttttttttttgagacagaatctctctccgtagcgaagtacaatggcatgatctcagcttactgcaacctccacctcccaagttcaagcaattctcctgcctcagccccctgagtagctgggattacaggcacgtaccaccacacccagctaatttatgtatttttagtagaggtggggttttgccatattggccaggttggtctcgaactcctggcctcaagtgatccacctgcctcccaaagtgctgggattacaggcatgagccactgcactcagccctgctgtcagaggcctttgtaccagagcaactccatctcgaataggggctggttaacctgaggctgaaacctgctgggctacatttccagtaagttaaggtattcttagtcacagaatgagataggaggtcgctgtaaagactttgctgatcaaacaggttgcagtaaggaagccaaccaaaacccaccaaaaccaagatggcaacgagagtgatctccagtcgtcctcactgctacactcccaccagtgccatgacagtttacaaatgctgtggcaacatcaggaagttaccctatatagtctcaaaggggaggcataaataatccacccgttgtttagcatatatcatcaagaaataaccataaaaaatgggcaacaagcaacccttggggctgctctgtctttggagtagccattcttttatttctttactttcttaaacttgctttcactttatggacttgccctgatttctttcttgcgtgagatccaagaaccctctcttgggatctgaatcgtgatccctttccagtaacactaagagggttttgagtggaagattgaaatgacctgacctttttttttttttttaaagaatcactctggcttttctgttgagaagagaccaaaggaagcaaggagggataaggaggttagttcaaagacctttgcaatgaaagagttaaggacgtgccacccccaaatatgccagtttggcatactgattatttcaagctgaaggtacttgagagactgtcattgcaggaagagctagctcactgtttcacagtggacagggtctatgcaaacctgcggccaaggaagctgagaggtggaagaaagaggctgacacatccagtttcttaggaagaaacgtttactagggacttagaacagaagccatgtctgtatctcaggaagcagtgagacaagatggtggatccccgcaccattacccctcaaacccagggcttatataccccaggagaggagtgattcagaagggacgtggagaacaacttaagtatgataacatcaaggccacttgacctaagggcaggatttacagtcagtacgtgctcttacacaaggaacaatagataaactggaagtcttacaagacttcctggaactggcgttaatcagaaaccagcatggattagcatccaggatggagttgctttgccctccccactgacgtgtccattcctacctttaggaagccataaaaattcctttgagaaagatgccttccctttttttttttttcttttttgagacggagtcttgctctgtcgtccaggctggagtgcagtggcgcaatctcggctcactgcaacctccacctcccgggttgcagtgaggcaacccgggttcaagcaattctctagcctcagcctcccgaatagcagggattacaggtgcgtgccaccacgcatggctaatttttgtatttttagtagagacggggttttaccacgttggccaggctggtctggaactcctgacctcaggtgtgatctagccgcctccgcctcccaaagtgctgagattacagacatgggccaccgcgcccggccgatgccttcctttagtagaaagagaaaataacccttatctccagagactgggaattgatgctacaatggacctatacagataaacttactaaacgaacacttacctttcactagctttgcacttcactgatacaggagtttagaagaaatcacttaggcagatagtaggagtatgggaatcctcagtaaggcttttctttttcatgaaaagcagccccaaatcattttctaacaaagagcattctgtaaagccgagctgcagacacagacaagcaagctgggagcttgcacgagtgaacgcagggaggaacttcggagtacacatgttcaaattggaggctccatcttcccttccctttgtcagccacgtgtactgtaaggagcagacaagatggtgttgatcaactagaaagtctatttccataataagattagggtggggtaaccaggcttcccctgcgcacagtgtaaacgtcatacctgatcaaaccaatctatgagccctatgtaaatcagacaccgtctcctcagacctgactataaacttcggcgcatccactgccggctggtcctttccactcgcagatccatttctctatagagaaagctgtttctctttcccttctcttctgcctattaaacctctgctcctacactccttgtgtgtgtcagtgtcctaaattttcctggcgcctgacgacaaaccccgggtttataccgcagacagtggtatggtcccttcatcaccatatatctcctagtgattcccccgcaatttactgcccctagtccaaatccctttgtcttatcatttcttcataaatttatcatttctttgtccaaaaggtataaaagctttctgttctggccattttcttcaggtcgtcgcccctttcatcttgtgagagtcttcatgtgcaagtaaaaattagtaacacttgtatgcttttctgttaatctggtttatgtccatttaattcttagacttagctttagacgatcccaagggagtagaggagaatttatcctcccatcagcaataatccaggctagagatgatggtgatttatattagaggaaagcaatgcaggtggtgaaaagtggtcagattctgcatagacagtgttttggatttgctagtgggttagttgtggagtgtgcacgtgtgtgtgagagaaagattgagagagaatgtgttatagattataccaaatctttcttaagctttaagcctgaactatttatgaccaatgataagtatttccatcatatcttacaactaaagaaatgtgccaggccggtcgcggtggctcatgcctgtaatcccagcactttgggaggccgaggccggcggattgcctgagctcaggagttcggaaccagcctgggcaacacggtgaaatctcgtctgtactaaaatacaaaaaatcagccggccttggcggcatgcgcctgtagtcccagctactcaggagcctgaggcaggagaatcgcttgaacccaggaggcagaggttgcagtgagctgagatcgtgccactgcactccagcctgggctatgcagcgagactccgtctcaaaaaaaaaaaaaaaaaaggtaccagtgtgtagtaacattgtgggtgagaatctttgctctttatacataactgtttaagtttcagttttgtttttgcttttactgttttagctgaagcacacttggccgatgttaagctaaattatcagtagatggcaccacagtcttagttagctgaagatttctgggttttgcagggagtgaggattctagtgtcagttgtcggatgtttaggtgtgactcagtgacctatgcttaaaagtttgcccggttactaactgagggagcaacaagtacaaactgcagatagggaattgaaaaaaggaaacacacaaatttacacagacacggtgcccatagatttgttgcaagggcagtttggtagagagaagctagaaggaagctgaagctccagaaaacccaaaactacaaacttccttcaaaagtctagggagaggccgggtgcggtggctcaggcctgtaatcccagcactttgggaggccgaagtgggtggatcacttgaggccagaagtttgagaccagcctggccaacatggcgaaacctgtctctactgaaaatacaaaaaattagctgggtgtggtggcgggtgcctgtaatcccagctattggggaggctgaggtgggagaatcacttgaacctgggaggcagaggttgcagtgagctgagatagcgctactgcactccatcctgggtgacagagtgaaactctgtctcaaaaaaaataaagaagacaaataatagcaagtgttggctaggatgtggagcaattggagatctcatacaatgatggtggaaatgtaaaatgacacaactattttgttttattttatttctgagacagagcctcaccctgtcgtccaggctggagtgtggttgcacgatctcagctcactgcaacctccacctcccgggttcaagtgattcttctgtctcagcctcctgagtaactgggattacaggcacacgccaccatgtccgactaatttttgtatttttagtagagacacggtttcaccatgttggccaggctgttcttgaactcctgacctcaggtgatcctcccaccttggcctcccaaagtgctgggattacaggcatgagccatggtgcccagcaggcacaaccattttagaaaaagtttgcagttaatcatacacctaccatatgatctagccattgcactcctaggtatttatgcaaaggaaagaaagcctaagtctgtacaaagacttgtacacaaatgttcaaaacagctttatttgtaatagtaaaagaaagaaagaactcaaatgttcatcaacatgtaaatggataaacatgggagcttatctatatgtacaatgaaacactacttagcaatataaaggaatgaattattgatgcaggaaacatggatgaataaaaataattactaatgaaagaaataagacaaaaaccgtataaactctatacaattgcatgcatatgaaaatctagaaaaagcaaagtaatctgtagcgacagaaagccaagaatggttgtggtagaagggagaaggactggacgggtgccgtggctcatgcctgtaaacccagcacttcgggaggctgaggtgggcagatcacttgaggtcaggaattagagaccagcctggctaacatggtgaaacgctgtctctactaaaaatataaaaattagccaggtgtggtggttcacgcctgtaatcccaggtactcgggaggctgaggcatgagaattgcttgaacccgggaggagaaggttgcagtgagccaagatcgcgccactgcactccagcctgggcgacagagtgagactctgtctcatgaaacaaacaaacaaacaaaaaaacagaacaaaaagataaaaaaaaaaaagtaggggaagaactggagggaggaattacacaggagcactgaatatattcactatcttgattttggtgatggtttcatgagtatatactgtaaaggaacataaaaactctcaaaacccccaaactcattatgccaaagggaaaattaagcctgcttacttcacaaccttgtgtcaaagcgctatacattagccagatccctacaaaaggaaaaggtctcaggcatttccagataactgccctcacaaatcgcgcctaagaaaattctttcctggctcctaaacctttcaaggtgtataataaatcctcccataaacaaggacatgtcaactgtcactttaagtctgtgacttaagtctaactccttgtccaggaacctaaagtctggtaaatttcacaccgactgtgtcaattataagccttatcttcccaagtgcaaaaacaaagatgacatccattattcttctacctatcctgagaagtctgaataatgaattcttcctttactccctattttcgaatgtttgccttatctcatgtatagcatagatgtactgggcactaattaaaatctcacaagaatgtcatcatttgcttcacgcctatctcccttttcctgcatgtcttttctcttaaagcaatgtgtaaataccgagtctcctgaagcctttcccaaggagcacgggccacagactcatgtttctgtgactcagggttttcctgggcacacctttaagctctggctcaataaacctggattgattgagattcttgcctcagtctctcatttgggttgacaatacatatgtcaggacattagactgtactctgtaaacatgcaaagttgccaatgtgaagtcaaatatacctcaataaagctgttaaaagtaaattttttaaatgagatactgatatgtaatgtttgttattttactcatgtatttatttgccttttctttcatttaacagagtttattgagtgtctgtgccagaggctaaaagaggtatgacatggtctgctttcaagtctaggcagtgacggttctgcttgatatgcttgttgtacatgcccataggaagctaagaaaataggaagattagcgtgtaggctggcatgttggggaaggcttttcagaggaccttaacgttgaactgagttctgaaggacgagtaggtggtttggacagtgaggagcggttagcagtggcagctttctgtcttcaacaaggcctagggatgagagaacaaggcgctgtgggaggaaaacaaattgcagcagagaggggagaagaggagtgttttgaaaagaggcaggataggttaagtcgggactgatcagcatgggccaggaaagctgtggtcaggaatccggctgtaccattgaaggtctggggagctagagcaggttttaagcaagggagaacacagatagcctgctgatgaacagcacaggccaatcgagtggagcaagagaaaccatcttgcccttagattggctagcattacggttaaacgagtgtatttaattagtctccaagtcctgctaatagctcatccttaatcattttcaaatgttccaattctttccatccctatcgcagttaccttagttctgtctccattattgtttgcttggattaccataatatcctccaatggcggtttccttgtcttcagtcttgccccgcctttaactctttgctacctgcagcataaaacatttttctaaaattcaagtttgatcctctcacctttaactgaaaacctgatctgctgctcatcaacactatctctgtgtttctaataatgatcatcactgtaatagcatacttagcaagcatttactacatgccaggaactgggctaaacaagatgtgcttttatcttattaaatcttcctaaaacattattactatcatcactattttacagatgaagaaactgattattaagaaggtttagcaatgtgtccaagatcatacagttaataagtgtaattgaataacttgttgaaaaaccaaaaaacccttaaagacaaagttgtgtagggaatagaattttttacttgcacctgcaagagggaccgattattagagaactggctttgtaaacaaaaatgtagggcaggtatttaaagtaaaaaaatcacaaggatagacaacagctcaaattgttatcagttcacaagtctgcttggatgtatgtgggtcaattttgttaaaatctagacggtcctttctattaagacattacaatgcatcaacaccaaacaacagaaaagaaaatccatatatccctgtttttcatgctttgtctgggactaaaggaagggcaggccttttctagactatggaatctaagtttcagaaaaaaatcatttaagctgcaatataaagaataatcttggccggtcgcagtggctcacacctgtaatcccaacactttgggaggccgaggtgggcggatcacgaggtcaaaagttgggcaccagcctgaccaacatggtgaaaccccgtctctactaaaaacacaaaaattagctgggtgtggtggtgtgcgcctataatcccagctactggggaagctgaggcaggagaatggcttgaacccaggaggcagaggttacaatgagccgagatcatgccactgcactccagcctgggcgacagagcaagacttcatctcaaaaaaaaaaaaaaaaaaaaaagaatagttttaaggaaggcagaattagagatagacaagttataggaacccaggcaagccattataatgccaaactaaggcaatggcaggagggatagaaagaactggaccagttttaaatccattatgggacaggaaaggcatgttgcagtcccttcagccaagttgcaagttttgaatgagttatccaaacattattaaatgcatcttcagtgatgactaccaagcttttttccaggaaccaaccctcttttgtaaaaatgttaggttagcctgttcgttctggtttcttgggcagtgactgggatgttcaaactattaattgggatagaacaccgaagctggttaaaaacaatatttcttatagaaattgatcttgaacatggatcaaggttcactgctagcaggagaatcggagagtgtgtggtaatgaaaagttatagttgagaaaacaagcgtttacatcagcaactaattaagaaaaaagcagctcataagtggatgaatgcagttcataaacacattatatcagttattacacaggaaatctaaggcagaatactgtgaaatgcaaggtgtatagcttatcaacaagaatgtagcaaatacaccattcaactaagaaagaaatgataaggctgcatctggggctgttgactggaagcacaaagtttcctttccttgtagtagttcctaaagattccagtttacatggaaagacagaaagctgtcacacccatggcaggagcgcagaacccaagcgacaaattctaattttgaacaggcaggtgccagtgcatttctcaaactgcaaactaaaatgcagaaacacgattttcctgtttcttagttttggaccgttttcccccctctagcacgccagagcaggttttaattgttgtcaggtcagatggtgagttaactttgagtgttgagttgaggggccagtgggatgtgggtccagttgaaaggtggatatatgtagatccagactcgagtgatataggctgcaaataaattgctagtgaatttatgaattattagaaaagaaaggacattcattatgatttaatcgcagttgaatgtaggcagcacagagggcttatactgtgtctttttttttttttttttttaaatatacggtgtctattttgctcaccactctatgcccggtgcctggaagtgcgactggcacatagtaggtgttgcatagtttcagaatgaactttttaggaatcaaaattctacaaacattgcacacagatttaacgttcccttattttccaggtgaggtcagggcgccctttggtttcgcgcttctgtccctttaagaaagtggaggagaaagaaagcgctgctgggaaaaagggcggggccgcgaggggccgccgtccgtcccgccccctgccgggccgcggcgctctgctagagcgtggctcagttttggtagcgggaccccggaaatgtaaagcatgagcgggaacagtcgccagggcgagtgacaggcgagccctatgctttacttccgagggcggtgtcagcaaagctaggtaaggagacagggaggacggtgcctgcccctttaagatcgactccaccccgcctctggaggaaaatgacgccgccgtctacccgttgtggaacgtaactcttttcatcccatcagctctccttctcattaagagaaataccaagtggtcaccacagtcacatacttcataacccatgcctcatcggtgctgggacgggagagggaagcgccgatctaaatgacatggggtccaaatcccaaataatctctatttgctctgcgttacctttaaacttaggctgcgttgtgtgattcaagtgacagcctagtactgcttaacaattagtctagtgggataccaggccctgagagacccctacgatcccaggacactgatgtggggtaactaacacccactggaagtctacgctgagttcacaggctatgtatgacctgacatgcattttgacctgccctgtgttttgatatttgaatgagttgctgatgtttacaagccgaagctggccgggcgtggtggctcgcgcctgtaatcccagcactttgggaggtcgaggcaggaggatcgcttcaggtcaggagttccagaccagtctggccaacatggcgaaacctcgtctctactaaaaaaaaaaaaaaaaaaaaaaatacaaaaattagccgggcgtggtggcacgcccctgtaatcccaggactcgggaggctgaggtaggagaatcgcttgaacctgggagtcggaggttgcagtgagccgagatcacgccactgcactccagcctgggcaacagagactctgtctcaaaaaaaaaaaaaaaaaaaaaaaaaaaggtggaagctaatgtgtcaatatctagatttttttgatgattttgagaaatcggaggatctggcagcatgtcctgcctagcctttttgaactgtttgaaaacagtctccagcttgccacagcccctctgttattttacagccagcctgcatcactcatttatgatgtccagccccttgtggggatttggatttttgacccctaaatactttagtggatttaagaccatttaaaacatttatgcagaagagatccgaggtccccaaacaactgggtgtataagttgtgtttaagttgttcctcattctcatttattctaatccgggtgtttttctatatatatatatttttaaacaaatcttagtgatcaattgcacaggtgtttttctgttggagcaaatcttttcagtttaggcttggtaaaatcgaaccatcagatacttttacagaaagagatttaggagttgatgttcttttattacaattaaatgcatacagtatttttaaaggaaaaaacctgaatcttgattgcattgttttatgatacaacaatctttaatgaaatagagtagtcaatataatttgtattaatatatctctgcccacagacaattataaattcattaacccccagaactcttggctagacttcataaaggcaaaaactgtgtttgccctgttaactgctttatcccaccactagaatataagcttcctgaagacagaagacttctgttattttgttcacagttaccaagcatgcctactttgttaaatttatgaaagaactttaaaggtacagttggcccacaatataacaatatagcaatataaaattacaacaataaaaataacacaaaaatagtgtaacaactacttatatagcatttacgttgtattaagtattatgagtcatccagagatgatttaaagtaaagtataccacagcatatgcctagtttatatacaaatatgatgccattttatataagggacttgagtatcctctgattgtggtatcctggaagcaggggataccggaaccaatcacttgaggatactgaaggatgactgtatggctgatttcctgtaagaggcattttcttgaggattctttcaaaatcaaatgcttgtatatttgttgtgttaaattactaaaaggattctcttgtgaaaagtatcatttaaaaagattggattttcccaattgatgcaccaaagctttcatctgaaatgaacttgcacatgtgaatcatcagatacagtaatatacactgtaatattttatttcttttttttttttatgagacggagttttgctcttgttgcccaggctggaatgcaatggtgcgatctcggcacactgcaacctccgcctcccgggttcaagcaattctcaagtagtgagattacaggtacccgccaccacgcctggctaattttttgtatttttagtagagacagggtttcaccatgatggccacactggtcttgaacacctgacctcgtgatccacccgccttggcctcccaaagtgcagggattacaggcgtgagccaccgcgcccggccaatattttcttattatgtaataggatctagaaatgttgctcttcctcagaattctcagtattacttttcttttttttttcagagtcagaggttccggttgagatcaagttgggagacacacccttgttcattctccttgagaagcagctattatcaacagaacattgacagaacctgtgtttggggaaaggactgatggctttgagtctaggttggaaagcacacaggaaccactgtggtctcctcttgcaggctctgcgaagcagtggtcttctcttgtttccctgtggccagtgtccctggagaggagctggaagctttttggaccctgagataaaggctttcctggaggagaacactgaagtcaccagcagtggtagcctcacccctgaaatccagttgcggcttttgacccccagatgcaaattctggtgggagagagctgacctgtggccccacagtgatccttactgggcaatctactggccaggaggccaagccctgtctaggtactaccctaatgaaacctttaaggcgctacagatctttgctgttttcagttccctccaacctctacaaaaaaccagagcaatgctaggcgtggtggctcatgcctgtagtctcagtactttgggaggctgaggctgtaagctgtgatcctgccactgcactctcgcctggcctgtctcaaaaacaaaacagaaaccggcaaaactcagtcttgttgttttcttttttctttctttcttttttttttttttttttggtagagacaggatcttgctatgttgtccaggctggtcttaaacatctggcctcctcaacctccccaagtgctggtattacagacatgagcctctgagcctagcctcaggttagccatattttttgttgccttgttgcgtaatttcccattctaacccaagcttatcaagctattttcccaagtaactgtctccccaagagaaatcctagagtcagctgtcaagaccctggatagctataagtgatccagaaatctcacctgttaggaggttcatagttcatagcgcatgaccattgcagagttcctagatggaagctaaacacccagtcctttcgctctcctttaattcagtgaatgtcgctccataaacctcacattccttccagagttgcttattttcccataaaacaggagctgtgagtgagtgggctgttcaaagtttccctcttctgttgggtgcagtgcctgtaatcccagtgctttaggaagccagtgcaggaggacagcttgaagtcaagagtttgagaccagcgtaggcaacatagtgatacccctatctctacaaaaaaaaattttttttttttttgagacagagtctcactctgtcacccaggctggagtgcagtggtgtgatctcggctcactgcaagccccgcctcccgggttcacgccattctcctgcctcaccctcctgagtagctgggactacaggctcatgccaccatgcccggctaatttttgtatttttagtagagatggggtttcaccatgttgatcaggctggtctcgaacttctgacctcgtgatccgccctcctcggcctcccaaagtgctgggattacaggcgtgagccaccgcgcctggcttaattttgtatttttagtagagacagggtttcaccatgttgaccaggctggtctcgaacccctgacctcaagtgatccgccagcctcggcctcccaaagtgctgggattacaggcatgagccatcgtgcctggcagtagcagctatttagacagggcatgtatgcctctactttgccatagtgttaactggttgatgtcaagtcccaggttcttagtgccatcaacaaagaattggacatgacacatacaagtagcaaggcagcaaacagtttgttaagcagaatgcaatcagcaacggatcaggctgacctgcgagtggtatcagccccagtttgttatagttcatggccttttatatgttttttcctcacttgcttaaccttactttgtttttcgtaagtgaattgctcatcctggcctttccctcattgtgcctaaaccgcactttatttctcataagctaattgtgcatccttgcttaaccttattttatcttttctgacaaaattgctcatctttacttttagttcttgtaaccaaattgctactgcaacccctttccacttattttccttatcttgcatgttctaactcattgcttactcccgtatctcttactgcttactgtcttatttcatatgtcctgtttctgctatcttgtatgctttgcttttggtattgcttcagctagcctatgtccaacgggtccccttcacccctgacttcctctgccattctcctgcctcagtagtacccactgttccttattactccaatccgaagatcaagagtcagctgaaatttgttatttcagcgtttctccatccctcttcgcttgtttggtaactatttagctccagtccaaattccttggttgaattggactttgagttttaccagagaggtcattatactacatttcaagcagcaggaaaatcactctatgatggagtcaagaggagacagtgactcttggattgagtttactaattttagtctttgttttagcagtattttgtcagtcttaattcgtggtgctcggtagtttctggaacatactaagtattcaatactttgtcagccgaaatgagagactgaggcatgagtctcaaccagtcaaggtttgttaagcccaagaaaaatgcaagtcacagaaaagtttgtggcctgtgctcttctaagaggtttttaggaggcacagtatttatacatttctttttctttctttttttttttttttttgagatggagttttgctcttgttgcccaggctggagtgcaatggcacaatcttggcagactgcagccttcccctcccgggttcaaacgattctctgcctcagcctcccgagtagctgggattacaggcatgtaccaccacgcctggctaattttgtatttttagtagagacggggtttcaccctgttggccaggctggtctcgaactcctgacctcaggtgatccacccaccttgcctcctaaagtgctgggattacaggcgtgagccaccacacctggccatttatacatttcttttctttctttctttttttttttttttgagacagagtcttactctgtcacccaggctggagtgcaatggcttgatctctactcactgcagcctctgcctcctgggt

SEQ ID NO: 448 - DNA, 199877 bp, Homo sapiens
ccagtaatgggattgctgggtcaaatggtatttctggttctagatccttgaggaattgccacactgtcttccacaatgattgaactaatttacactcccatcaagtgtgtaaaagcatccctatttctccacatcctctccagcatctgttttttcctgactttttaatgatcgctattctgactggagtgagatggtatctcattgtagtttcgatttgcatttctctaatgaccagtgatgatgagcttttttcatgtttgtcggctgcataaatgtcttattttgagaagtgtctgttcacatccttcgcccactttttgatggggtcattttttttttctcgtaaatttgtttaattcctttgtagattttggttattagccatttgtcagacgaataggttgcaaaaattttttcccattctgtaggttgcctgctcactctgatgatggcttctgttgctgtacagaagctcttcagtttaattagatcccatttgtcaattttggcttttgttgccgttgcttttggtgtttttgtcatgaattctttgcctatgcctatgtcctgaatggtattgcctaggttttcttgtagagtttttacggttttaggtcttatgttcatgtatttaatccatcttgagttaatttgtgtataaggtgtaaggaagggattcagtttctgctttctgcatatggctagccagttttcccaatgccatttgttaaatagggagtccttttcccattgcttgtcaggcaagcaatgggaacaaaaacaagcaatgttttatgttttgatgtcaccttttacactattaaaataatatatatctttaacaaattatttcagttttagctgtttttaatagttttgcgttttaacctttatactaaagatataatgggttaacccactgccatttgttttagagtgtttgcatttaaaattgtccttacttttaccagtgaatttttcattttcatatgttttcatgttatgaattaccatcttcttcctttgacttgatgaatgtcctttagcatttcttcttaggcagatctagtggtgacaaactctctcagcttttgttcatttgagaaagtctttattaccccttcattttttaaagatagcattgctgaatatagtgttgatagttgatattattttcttgcatgattttaaatatattatcccactcctttttggcatatggcactccttttttctgctggaaaatccactcatattcttatagcagtttctttgtatgtaacaattcacttttatgtttctgctttgagctttctcagtcttcaacttttgacagtttgattttaatgtgtcttagtgttaatctgtttagatttatcttactttacaccgtttgagctttctgcatctagatttctatttccttccctaggcttagaaacttttctgctactatttcattaaatatattttctgtcttttctcctgatacacctataatgcaaatgttgctatgcttgatggtgtcccgtaagtttcttaaactatcctgacttcttttctttgtttttgtttttactcttcagatttgttcaatttatagtaacttgtcttcaagttcactaattcttccttctttttgattaatcttctattgaactcctcagttgaatattttagttcagttatagtattctttaactctttgacttctgttttgtactttttacactttctatctatttattgaaattctatctcttttttgaaatagaaatgaattaggtggttacttcagcaacatgtaatgggaagctcctgacccaccatccacctagagaaagaaccaataaacatctattcatgagtcagttgtctttgagagaaagagagagaccattgttctgctgacctcagaaggcatctttatgactactatattgaatcctctgttgggtatgtcatatatcatcacttaacttgtgttggttttaggagatctaaaccatctctccaagtcttgtcagattgacctcatgtagggaaggatcttaccaatatgtctgatgagagatttttaaggtgcctttcaaatctttgtgttttatcagactactatctatgttttcagtggccccctgaagcatagtgtgtgcctcatcctttcagcacttcgacactagtaaggtaggagtgagactctctagacatagttggaataggtgatgtgttggatgtgtgtcccagtttcttttagcctcataatgaagctaagtatagatatttatctcccactgtttcttcactaagctagggagatgatctgtggaaaatgcttattcatattcaggctataccctctgatcctgggaagatagttgctggaagcaagtccattgtaaatctatctcttttttctatgttttagggacactccaaaatgcaaagcaccatcaactaccagtggtaggacattaaggagataatcccttgggtgggtgttattgaaattgtgccagttgatgcatggtcaaactctttccaggacaaatgggtacacctggatttatcactggaggcagctgaaggaaagatttgtgaagtgccaaactctgactctggctgccaaaaaagctattgtttgcttttcccattacctttcctgtgtacatttgttagaagccaggacataaagtagccaataaaagtgtgtgccataggttcttctgcagagaaaagggaagctgtgtttctgccccttttccacactgctccaagggcacgtagcttctggaagtgtttgcatgcttgcttaatatcatatccttgttctgtgacctagggagacatgcatatgtttagtcccttctgctccaagaactaatatatttagcctggagttcttcatgaggtagctgtaaaagttggggcactcaatgtgtgtcatgaatcccttccagatagaaacagggagctgcatttttaaagcccttcctctgcaccactcctggggaataaaagtaaaactgtaaaactgtaaaacttctacttcattctttggtccagaaagactcgcatatggtttgtcctctctgctcccagagcaaggaagtttaggaggcaatcactcaggtagaagctgtagaggttggaaaactgaatgtgtgtacaaacttctgagagaagaaattaataaatttagagttgttgctaggatgagctggggaagaatgctggagaagtatcagtctacttctcaggcttccagagggctaatacttttgttccccattaacttcagaatgctagttagtttcgagcccagctgccaagtagccattggaaaaatgtgtcccttttggaaagaatcatggggctacatttttaaaatcttttctctgtactgctcctggaggatgaagcctctgaaagtgtttgcacatttatagaaaattaccttttatttttttttctgtggtctgcagggacacatgtatgccagtatcctttgcttccagagctaggtttaaatgcagtcccttgtggggaagatataaaagttgaagcattaatgtatatacacgtttcttccaagagtgattaatagacctggagttatcactggagcaagccaaaggagaggctcaagaagtgtcagtttgattctcagtctgatggtaggttcatgtttgtctgcttttttaacaccctgatgtaagttagttagaagtcaggcagccaagtagccagtgaagagcatgtcccttccatttagaaagaggggactgtgaatttttaaatttttatttgtttagagaaaaggtctcactctgttttccaggctagagtgcagtgacacaatcatagctcactgcaacctcaatttcctgggttcaagcaattgtcctgcttcagtctctcaagtagctgggactacaggcatgtgccaccacacatgggttacttttttggaagaggcagcatcttatgttgctcaggctgatctcaaacccctggccttaagccttagcctcccaaagtactgggatgacagacatgagccactgtgcccagcagggactgtgacttttcaagcccagttttttgttgttgttgttctgttactgggtaatgaagtctctgaaagtgcttgcacacccatggaaaaccaccattatttttcttgtgttctgtaaagactcatatgtgtctaatctcctctgtttccagaactggatattggcagcaaaggagaatggaaacaggtgggaaatcttagaatttgggtggcatatatgagatccaaactttcttctccacagggagaaattggatgttggagattgctttcctgattttatggtgcagttcatagggcaaggtcagtgcctgagtgttcctcagatttttctgctcatacattgtggatattttctcagttgctagtgtgtagcagtctctcaactggtctctctctttctctcaaagaaaactgactcatgaatagatgtttatttggtctttctctaggtggattttgggtcaggagcttcccattacatgttgctgaagtaaccacctaattcatttctatttcatttttacgtttggacaacaaaatttagcaaaaacttgcagtttgttaataaagtagaaagtttttttctctaatataaccatgctggcagaataaaaccaggggtagaggatgtttaaaagagtaacaagaaagacttgcttcttctagtacatacgctccttaaagtttactagagtaagtcaaacaagccataaaaaacattactcttattttctcctcagaatttctagacctgcagtaaacaatgtatttcattttctaagggataacctagagattaaaaaaaaatcatatgtagatttgaaggaaatgttttaaacaaaaacagcccacctggatacttaactatgtttaatatgtcagacatgattatcaaagtcagttctataaatggatccattccttacttgatttctagaggcttggtttccactaagttggaatcacctttgtttccgctgagattaactagtgaatatctaactaggtgaatatttttgtgattgtattttacacatggtttagctgaggcaattaatcaccactagacaggccctactagagctgctcaaaaagctccaaactaggaaactaaaggttgatatttaccatcataaaaacacataaaactaatcctcacaggtctcataaaacaatcatacaaaggagaaagataaataaatcaaatggtaacatgacagaaatccaccaaaccaaaagataaacagagggaaaacaatcaaaaaattacaaaaaaaactagataacaactaatattatgacagaaatgaaacttcacataccgatattaacttcaaaaggtaaatggattaaatgctctactttaagatattgattacctgaatggattaaaaacatcaactgactatatgctgcttaacagaaactcacttttctggtagacaattatagatggaaggataaaaaagaaagatatattccacacaaacgaaaaccaaaagcaaaaagtagctatacttaaatcggatgaagctgacttcaaataaaaacaggaaaaaaaagacaaagaagctcataacataacaataagggaatcaatttaacaatgggatataacaacattaagtatatatgtatacaacaacagagcacccagattcctaaaactagacctaataaaaaaccaacagtaatacaataataatagaggatgtcaacagctgactcacagcactagacagatcattaaaacagaaaattaacaaagaaatcttgggcttaagttgacttctatatcaaatggacataactagatatttacagagcattctgtccaacaactacagaatatacattctcttcatcagtaaatggaacattctcaaagatagagcatatattaggccataaaacaagtctcaaaatcatatgaagtatgttctcagactgcattgtaatgaaactagaaatcaatccgaaagacttttgaagctacacaaatacatgaaaattaaacaacatcctcctgaatgatctttgagacagtgatgaaattaagatgaaaattgaaaaagttctgaactaagtaaaaatggaaacacaacatgcccaaacttctgagatatagcagatacattcctaagcaggaaatttatagcattaaatgcctacatcaaaaaatttgaaaagatcacaagaaaccaacgttgcacctcgagaaactagaataatgaggacaatccgaacacaaagttataaaaaagaaaatagggaataatgaagatcagaggagaactaaatgaaattgagaccaaaaacagtattaagaatcaacaaagcgtaaagttagtttttaaaagcataaacaaaattgataagccactagatagactattcaagaacaggagagaggccaacaaagtagcccaggacaatgtcataagtcataccaatcatttgtcctgagctaatttgatttgcattactaaagtatggcattgaagaaatgcagaaaatattttatgacgtcattgggaaagcttagcttaccaataaataattaattgaccaaattttaaaatatagaagtgatagaaaatcacccttttcaaattttaccagaaaagcagttaatctggaagcatatagtaatgtttgtttttgctattgctcaatgttgtttacgaagagatgaaacactgtttttatttcaatagtataaaagttcttaatatgtttaaatatacttttgagatagatctgaagaatcttaaggagttagcatgcctaattcatctataaatttcctaactttatacatgtaccaacttaggcaaataaggtattttgaaacttctgtgttaatatactggataatgatctgaagacaaatacaggatctttctcagaatatctcataaatgagccaaaacagatccaacctcttcaaagcaatagatgaaaagaagaaggaaaaaaaaacttttatcgtattcagcagcaatacaatagcaaaacgactacacagaatttattaattggaaaaatctagtcaacataagatagtatcacagaatacaaagtataataacaattgtcaataaaggaaattgaatctttttttttttttttttgagacggagtcttgctcttgtcacccatgctggagtgcagtggcaccatcacggctcactgcaacctctgcctctctgattcaagcgtttctcctgcctcagcctcccgaatagctgggattacagtcgtgtgccaccatgcccagctaattttcgtatttttagtagagatgggggtttcaccatgttggccaggctggtctgaaagaatcttttgagcactgtgtgagatttctaatccttccatgcaaattagcgacaggaaacaatgacttgcaacaatcacaatgaatgtggagcaaaataagatctaaaagctgaagcagttgaagtaagaatagtaaatatggcatataaaaaactacagtaaaatttgatttgggttcctaaagtagacaactcagccagcatatgaaacataacatttagagatgtatttctggaaaattcaatcgaaacactagaggaactgaatctgcaaatcaaataccatctcatattccaggaaaaaatgaggaaaattaggctaaacttttaagaagaaaataattgccttaaatattattaaaatgaggagtttctgggtgttaactgtcattcacaaatccagcctaaatttagtacaatatttgaaaatttccctaatgcaaaatatagaaaaattgttcaaattaatatatacattaatgtgtgtatatatatgcatgtttgtgttaatctatcatattggtttttgagaataaaaagttacattgataaagtccttgcttttaaaaagcttacaatctagttaagtttgtaagatataggcgtgtgtgtgtgtgtgtgtgtgtgtgcaattttatttcaagatggattaaaattgacatttttatatgtcagtacatttgatggtaccccacaggtctgaattctttttttctgtttgtcagacaggataatttctattgacctgtcttcacattcactgattctttcttctgcctgcttgtatcttgttttgaactcttctaataatttatttttaatttcaacttttgttatggattaaggggtacatgtgcaggtttgttacatggttaaatcgtatgacactgaggcttggggtctcaatgatctcatcacccaatcagcaagaataatactcaacaggtggccctacagcctacaccctctccctctccctctgcccctgtctagtgatccccagtgtccattgttcccatatttacattcatgtgtagtcaatgtttagctcccacttataaatgagaacatgcagtattttgttttctgttattggcttaggataatggcttccaacaataattcactacaaaagcagaatcaaaaccaaaatttatatgaccatgacaacagatgcagaaaaagcctttgatgaaattcaacatccctttatgataaaaatcttcaatagactaggcactgaaagaatacacctcaaagtaataagactcttctatgacaaaccaaaagccaacatactgaatgggcaaaagctggaaccattccttttgggaactggaacaagcaagaatgcccattctcaccactcctattcaacacggtgctagaagtcctagccagagcaatcagggaagagaaagaaataaaaggcatccaaatgagaaaataagttaaactatctctttttgctgatgatatgattctatatacagaaaaccttaaagactctgacaaaaggcttttggaactgatgaaagaattcaataaagttttaggatccaaaatcaatgtataataatcagtagcctttttatacaccaataactttctagctaagaatcaaatcaaaaacacaattgcattaacaatagccacaaagaaaacgaaatacctaggaatattttctacatgaccaagtgggatggtacagtcctagaaagtcctagaaaaaaagagcattttgcatctgaaggattttgaatccaatttctatatggtttaactaatagttgatgacctatttagagacttttatatacaatttatactacagcatggaccccaagaatatgcagtcaatcctcattatttgtggattctgtatttgctaatttagcagtaaaaaaaagtgtttataacttcaaagtcaatactcccagctcttttacaatcatttgcagacaatatgtacaaaggcacaaaatttgagtctccaacatgtatgttccgacctaaggtcaaacaaggcaatgatctgccttctactttcagctcttatagacaagtattcttttcaatcaacttagtaccacatttttcagattttgttgttttctgttgattattttgccatttaaaatggcctcaaacagtgctgcactgctttctagtgttcctaagtacaagaaggctgtgaagtgccttaaagaaaaaaacacatctgtcagataaccattgttcaggcaagcattatagaactattgaccatgagttccaggtttatgaacccacatatgctaaagccagaaaaaaggaaaaggaagttcattgacctgtatgggaggccaacctggaaaatgttagaatagcatctatagcatattttgaggctatggaagagatgcaaaggcagctaaatttgtgacttcatgagacaacagctaataaaaatgtatgctatttaggaattgcagattttaaaaaccatgagatactaatgcacacctattagaatgtctacattctgaaacactcacaacatcagatgctggtgagaacttggagcaacaggaatgttcatttatttctaataagaatacaaaatgctacaactaatttggaagatagtttggcagtattttacaaagctaaacataattttaccacatcatatggtcaagaaatcacactcatttgtatttgtccaactgaattgagaacttaacatttatataaaacctggacatgaatcctaatagcaacattttttttataatcatcagtgctttgaagcaactaagatctccttggctacatgaattaacaaactgtgatgcattatacaatgaaatactattcagtgataaaaaatgatctcttaagccatgaaagggcatgaaagaaatttataataaatacctgtttttaagtaaaggaagctgatctgggagggccatatactatatgatatcaaccatatgatattttggaaaaggaaaaattatggacatagtaaattgatcagtggttgccagaggtttggggaggaaagatgaataagtagtttagagcactggggatttttagggcagtgaaactatttcttatgatactttaatggtagctacatgtcattctatgtttgtcaaaactcttaaaatgtacaacattaaaaagtgaatcctaatgtaaactttggatatatgggaactctctgtacttggtactcattttcctgtaaacctaaaactggttaaaaattaaggaacattaattttttaaaaaagaaaaagcatagtggacagcattgttgtgatgctgaaagtctaagaaatttatgattattttacccacggtcaggaaatgttaaacctttctcagccagtactggctacctcctacattacaaaaggcaatatggcataaaatgtgttaaatttgcaatgaagcagtttctacagattagaaggctggggaagagttgttaaaatagctactaaggtattctagggttaggtgaaagaccaggttttcaatgctgatgagactggcttgttttcaaggatgttggcaaaagagtctatgtagtacaaatggcatttcagttgaccaaacatgaccagaggctcacagtatagaaaccaaaccctttaccttcacttggagcaatggttcagttcaggccaattcagtgttcatggcaactttatgtaatgttaactatcacaaataaagaaatcaattagagttgcactatatatgtgtctaattttaacattagatcattgtatacactttttagctctttgaatgtatttaaaatagattgattaaaattatttttgagtatgtccattgtttgggcttccctagagagagtttctattacttgctttttctctgtgtcttggttatactttcatgtttatttgcatgtcatttttgttgttgttgttgaactctgaacatttcaaataatacaataattttcaaaacagtgacatagattatgaaatgctttgtttagatttattcctagaaaaattatcccttgcagtattttttgtatttgttctttgtatgtattgattgatatcacatgacagaaacattttatgtgatagaattaaactaattgtccaccaaacatgaaaataaatgaatcaatcaatggttagcataaaggagctgcaattagtgtaattggctttgctctacattgtgtcgagattcaatcatcctccaaattattgtgaagttagataaatgttaaataaaaagcgccctcctaattttctctaaagcaaagaatacagaatattaaatggattaaagatacatttacatgtctatgttaacttataaattagctattatgcaatttcctttgagaaaagtgagtcgtgaattatatttatttgctgaatttttcatcactaaaggtgggaataaaagccaaaatgatatatttgtcagcagagatgccaaagtacaggttaaggaactcaattgctttttttaaacctctgtaagaaatgttgaagtgattctatttttaaggggggaaggtcctttattaaaaaatccttttccttctctatatattttttagacatgtgtccatcctgtttccatggattgaggatctgtgtaattatatagggtatacaaggttcctgactacgttacatatgtttcaaataattaaaaatgtatagctaccaaaacttagaaaatatatcactttaccatggagaatatttttttcaatttagaacattctaggctttgttttactggttttaaaatatagcacaaatgattaaatctcttttgaatcagttgatgcaatgaagaaagcattaatctagcagtaggagacttcagtgacttatgaaatattgagaagaatagaagtcactttccattgatcctaatgtacagatcatttgaaaaagaaggaagtgattgaagaactattcttggaactctaaggagcagaaaagaatatttagaaaataaagttagagagtagctaacagcaatttggagaaaatatttaatccttaggatgcaataaaggatgtatttaagaggaaaagtggcatatgtatgatgacaaaatttgtttggtaaggcttcttttaggaaacagtttttgtattcacatatctaataacaagtagtttaggttcaatatactccattttcctttgttttctagttgctgtcaaacttattttggtagagggtattccttcattcacttttcaggtatttatctaaattctttgggatcttttataagtgctagatacagaaagacaaatgagacaatgttcatgacttcaagtagtatctagtccaattgataaattataaagtaaattgaaccatatggagttgctattttgcaagtagggaaatgtttgcatattggcaacatcacatgacttaacatggcattgcagtaaaagttataatggaagaatatgtgaggtacagtgagaacaaaaatgcatatatttcagattgaaaaaaacaggctggctttcaggaggtgacacaaactacaccttataaagcaggtgttcatagataaaggagagaggacggtttgttaaatagcacaggcggctataccatttggcgtatctctgactgtctttcaaattttcaagcccaagtaatttattttcccataacaatcatgcagccctattcttacagtgaccaattccaatgatattgaaatagcatgttagattgattttattttaatttttggtttttaggttttttttttaaatttttttattcgagaacgtttcactctgttactcaggctggagtgccgtggtgcaatcacgggtcattgcaaccttcgcctcccaggctaaagtgatcctcccacctcagcctcctgagaagcttcaggcaatccattcaccttggcctcccaaagtgatgggattacaggtgtgagccactgtgcccggctagattgatttaaaaagtctaaaactaaatctctataagccttatactttatcttcaacttaatctgtgtgacaatacattggaaagtaaactaaacaaggttttatttggaattgatagcattgattaaaaagaagtatggtcttgtttgtgactctttctgatagaatatcttgaactactgtttatcacaggacttgtaatgagaacagttataatgaatgactcagaagaatgggcgaagaccctggcatgcatgatgcatagtagacatttatttcttgaacccatgttgttgccttgtatctctgtttattttatgagaatacagttcatcacctatttaggtaatatgtgctcattatttttcatcttagtcaaaataattttttaaaagtagtatcttttaatcttttcttatagaataaattctatatagagatgaggattaataacaaaatatattacaaaaatctgtgcaaaagggaaaattttgcatgtcaccaaatgacaaagttcaaatttaaaaagctgcttgtcaaaaccaattaactaaacaaataataaactaaattataatagcagtaaaagtaaactgtaaaccactaactgtgcttgaggactaaaacacatttgacttttatttctagctaaggtattttacatatacgtatagttcaaaaatgttttataccatgaatttttaactacatgccatttgaattgtgtcaattttcttgttttctttcatcaattttaatttttaacctatgattactttttccatagcttttctttttgataatgtgtatcaaatttgtgttctcttagatttttattttgtaaatatttgcattctcgaacaattgaagcaaggcaaattgacgccataaacttctttacaaatcatttgtttgtatgtttaatttgataagaatgtaaatcaaaacgtaatgtatggactatgactaaatgaagatatatggatctacattttaaagcaccccattagttatttgatttcctttctgatcactttctcttatcatatgtgtgtgtgtgtgtgtgtatatatatatgtacatatatatgtatgtatatatatgtacgtatatatgtgtgtatatatatgtacatatgtgtgtgtgtgtgtgtgtgtgtgtatatatatataggtcttatgttagcaaattctgtttttcttttagttctttttggaattattctgtatttccctatattgtgcaatcattattagcagaaacaaattatttttttaattaagtaagcaaaacttctatatcagaatatattttccttgaaaatgtttcagatgtttggaattttgtattctttcttagagaaacaactcacataagatatttattactattttcttttcagttattttaaaatcactttactgagttatgactgatacacaaaaggctgtacatatgtattcaatgtatgacttggaaagaagtatacacaggtgaaactctcagcataatcaataccataaacatatccatcactttcaagttttctcccatcatctttatttaattttttgtatgtgataagaacacatcatggaagatcttcccacttacctcatctttaagtgtacaacagagtattgttaactgtagtcattatgctgtagaatagatccataggacttattcatcttgtataactgtatgtttgtaccctttgaccaatgcctccttatttctccctgcctccaaatcctgacaatcactattctagtctctatttatataaatttgactatttcatattcgtcatacaagtgagatcatatagcatttgataattgtgtgtatgtcttatgttacttagcataatgttctctaggttcatccatgtttccacaaatgatggatttccttctttttaaaggctgaattatattccattacatgtatataccacattttctttacccgtcgatgaacatttaggttgctttcagctcttggctattgtgaataatgctgcaattcacatgtgagttcagatatattttgaagatcctgatttcaattcctttggatatatatccagagataggaatgttggatcatataatagttttattgttaattttgaggaaaattttatattgttttacccatacttcctatatcaatttacatcctatcaacagcatacagggttctcttttctccatatgctcaccaacacttattaggttttatctttttgttaataatcattctaacaggaataaggtggtatgttacctggtttaaacttgaattaccctagtaattcatgattttgatatttttttcatttacctttcagccatttgtatatcttcctttgagataagtctatttgggtcttttccctattttataattatttgtttttctcctattgagtggtagttttaaaaaaatatttacaatattgaaattttgtcagttttatgcctgcaaatattttctcccagtctataggctgcctgtttattttattggttgtttcttttgctgtgcaaaagagtttgatgtaatcccacttgtctgtttttgcttttgttgcctgtgcttccggtgttatatccaagaaatcattgctaaggccaatgtgaagtaacattttctctttttcttctaggagttttatgttgtctgtcattaattcattttgagttgatttttgtatgtgttatgaggtaaggatccaatctctcattgtgcattcttggcattcttgtcacagatcagttggccatgtatatgttggtttatttgtgttctttattctagtccattagtctgtatccctctttttatgcaaatatcatgctgtttagagtactgtggcttcataatatgttttaaaatgaaaaagtatggtgcctccagctttgttcttcttgttcaaaattacttagggtatttcaggccttttgcggtttcatataaattttagggatgatttttatatttatgtaagaaaatgccattggaattttgatagagaatgcattgaaccagtaaattgctttgggtagtagggacatttttataaaactaacctgtaagctgttcaggttaagttttgtgaatgcatctgcttttatcttcaatacagtaatacattatttgagttgtcttagaggtgactgggtattagctccttaactctttgttactttggctaatttgttgggctgcttattcatttgtgggtttatttttgcaggtgtatttgttgtaaaataaaattcattattcaacactaaaataagtatgtatttacagagctgtgccatataagaaatgacaatttcactcttgcaagagcattcaaattactccacagactaaaaaacagggctgcacagcttctatttttacatttactttgcatatttttttccatttttctactgaccctagtgacaggtggcttaatgtgccccatttacctcacaaataatagcatgagctgtaccccatgtggctggaaggacatttctcaaaagaagacacagaaatgactgacaggtatatcaaaaaattctcaaaatcactaattatcagggaaaatgcaaatcaaaaccacgatgaggtatcacctcacacttattatcaaaaagactaaagataacagtgttggtaggatgtggtgcactgttggtagaaatgtaaattggtacagatgttttggataaaatgcgatgggaagcagcattatgaaatacttttctcaccacctcctaaaacaaattaggtgtctccattttcttttgtcctattcattttcttttgtctccctgtgtactgttcttgacagggaggtttcagtaatgtcatatataaaaaggtttgggaaaagggaaaaagcctattttcaatcatctttcagatttaaccaaatgtgaaagtgaaaattctctgcatatgtgtcacattgctagaaaagactatagttgaaactggaaatggagtataaatctcccaagcccaacctggccattctcatgaaatatttattaataatacttggtaaaaatgacaaattcaggccaaacaaatgaaaccaacactgtgaaatcaggaagtaatatatactaataataaaagactaagaattgcattctagttaggtttaagaaagtctgtctttacttgaatgaagtacttgaacacttgtcagggattcaatcatttatatttgtattacaccagatatcttggctgtttctaggtatacagaagaaatgtattattgttacagaagaagtgtatttttgcttccaggtatatagaagaactgtattattattgtattattgttagaaaaaatatataatgtaagaatgaattcacgtgttttataaccagactgctgtaaccaggcatatatttgtgagatggttgatcagaagtattgtcaatggaaatataacagaacaatgctactttataaacaaaatgtcaaaacctatgtccttggctttattagcccaatgatctgaacaaatgtaataaataacaagtacaaattctattgtggaaaatttgtggactaataaattttaattctatgtctattttcaggagaagttaggtaactgtgaaggtagtgaaaatcatagtttaaagaatcgttagttaacacagaaacaaaaaaaatgctgcatattctaacttataagtgggagctaaacagtgagtacatattgacacaaataagggaacaacacacactaggcttacctgagggtagagagtggaaaaaggataaggattttaaaagggtacctatcaggtactatgcttactatctgggtgacaaaatgtctgtacaccaaactcccatgacacatgcaatttacccatgtaacaaacctgcatgtgtacactctaaacctgaatctaaatcaatttcatattgcatgtactgtatattccataatcattgttgcagatggtaatattggaataaactctatgactgcataccagtgctacatctgcaaaaagatgcagttatgtaagcatccaacaatttatgaaataactttgaaaatatatttatgcaaatttgaattttattaatgttgcttctgtgggatactaatagatgcaaaaatttacaaaggctactgagtgtagatggacagataatagataagtataatatattttgctcttaatagaaactcattgttttttgatctgttacctataaaacacatggtcagacatgggacctaaaatatccatgtaaaacaaaacgtaacataactttcttaaaaacatctcaatccaaaggtgggttgatgctatacttccattaaaaacatgtaactgccatcagagaatactataaacacctctttgcaaataaactagaaaatctagaagaaatggatacattcctcgacacatacactctcccaagactaaaccaggaagaagttgaatctctgaatagaccaataacaggctctgaaattgaggcaataattaatagcttaccaaccaaaaaaactccaggaccagatggattcacagccgaattctaccagaggtacaaggagcagctggtactattccttctgaaactattccattcagcagaaaaacaggggatcctccctaactcattttatgaggccagcatcatcctgataccaaagcctggcagagacacaaccaaaaaagagaattttagaccaatatccctgatgaacatccatgcaaaaatcctcaataaaatactggcaaactgaatccagcagcatatcaaaaagtttatccaccatgatcaagtggacttcatccctgggatgcaaggctgcttcaacatacgcaaatcaatgaatgtaatccagcatataaacagaaccaatgacaaaaaccacatgattatctcaatagatgcagaaaaggcctttgacaaaattcaacaacccttcatgctaaaaactctcaataaattagttattgatgggatgaatctcaaaataataagagctatctatgacaaacccacagccaatatcatactgaaggggcaaaaactggaagcattccctttgaaaactggcacaagacagggatgccctctctcaccactccaattcaacatagtgttggaagttctggccagggcagtcaggcaggagaaggaagtaaagagcattcaattaggaaaagaggaagtcaaattgtccctgtttgcagatgacatgattgtatatctagaaaaccccatcatctcagcccaaaatctccttaagctgataggcaacttcagcaaagtctcaggatacaaaatcaatgtgcagaaatcacaagcattcttatacaccaataacagacaaacagagagccaaaccatgagtgaactcccattcacaattgcttcaaagagaataaaatacctaggaatccaacttacaagggacatgaaggacctcttcaaggagaactacaaaccactgctcagtgaaataaaagaggatacaaacaaatggaagaatattccatgctcatgggtagaaagaatcaatatcatgaaaatggccatactgcccaaggtaatttatagattcaatgccatccccatcaaactaccaatgcctttctgcacagaattggaaaaactactttaaagttcatatggaaccaaaaaagagcccacattgccaagtcaatcctaagccaaaagaacaaagctggaggcatcacactccctgacttcaaactatactacaaggctacagtaaccaaaatagcatggtctggtaccaaaacagagatctagaccaatggaacagaacagagccctcagaaataacgccgcatatctataactatctgatctttgaaaaacctgagaaaaacaagaaatggggaaaggattccctatttaataaatggtgctgggaaaactgggtagccatatgtagaaagctgaaactggatcccttccttacaccttatacaaaaattaattcgagatggattaaagacttaaatattagactaaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaatctacagaatgagagaaaatttttgcaatctactcgtctgacaaagggctaatatccagaatctacaatgaactcaaacaaatttacaagaaataaacaaccccatcaaaaagtgggcaaaggatatgaacagacacttctcaaaacaagacatttatgcagccaaaaaacacatgaaaaaatgctcatcatcactggccatcagagaaatgcaaatcaaaaccacaatgagataccatctcacaccagttagaatggcgatcattaaaaagttaggaaacaacaggtgcaggagaggaggtggagaaatgggaacacttacactgttggtgggactgtcaactagttcaaccattgtggaagtcagtgtggtgattcctcagggatctagaactagaattaccatttcacccagccatcccattactgggtatatacccagaggattataaaccgtgctgctataaagacacacgcacatgtatgtttattgaggcactattcacaatagcaaagacttggaaccaacccaactgtccaacaatgatagactggattaagaaaatgtggcacatatacaccatggaatactatgcagccacaaaaatgatgagttcatgtccttcgttgggacatggatgaagctggaaaccatcattctcagcaaactatcacaaggtcaaaaaaccaaacattgcatgttctcactcataggtgggaattgaacaaccggaacacatggacacaggaaggggaacatcacacaccggggcctgttgtgggtaggggaagcggtgagggatagcattaggagatacacctaatactaaatgacgagttaatgggtgcagcacaccaacgtggcacatgtatatatatgtaacaaacctgcaagttgtgcacatgtaccctaatacttaaagtattataaaaaagagaaaaaaaacatatttagaggaagtacacatgtaataatataaatttgtgactatatgattaaaatataaaatccaacaggtaagttatatattttttcaaaagtattaagttttaaattttttcttattagtatttcacaatatagtttgcatcttaatataagtaaataaagatgaagaacagaatatttaatgaacacaaagtcttggaaattatcagagattaaaaagttcacttaaactgcatgaaatattgatattaacaaggaaaaacagcattaatattaaatttttcaatggcgaaactactagaaaaaaaagaggtgacttttgcaacatgaatatcatgcaaagtctacctatatccccaaactatcaccttttcccatagtagatagaatattttcttaataacaaacaactaacaaacaaaaacaatttgctaaagtgtacgatggttttttccatgttataaattacataaactagacatatttagagttacgatgtatagttgaaatttactagatgtaataaaatatgctgtgctataacatttatgaactaaaatcttgtttcaaaaacatagttaatcccatgaatatatcacaatatattttagcacaaattttccagaaacgtgtgtgtgtgtgtgtgtgtgtgtatgtgttttaattgtaaatgtatatttaacatctcttatattggtacattgttgaatgcagtttccaaaattatatttctcaattactttaaggtctgcaatattagcaggtaaaattttctaatcataagaaaataaaattggaaagccaataacaaaaactatcgttaaagatcctatatttctagtaatgaaacattgatttaaagaagaattcataaaataaatctaagtaacaaagcaatgcatgttaaaatttgtggggcatagcaaaagcaaaacttagaagtttatagctctaaattgtatttggacacaattttaatttattggaacacaaattaatattcaatagagtcaacaaaatatgaataaatataatatgactagatgtctataataataaagccaggaaataatggataatattgaaactttaaaataattgaaaagttagacaatgttttgatgagaatgagaaagtcaatgtaagacagaaaaggcaaaaatgaacaaaattaaaaaggaatatatttacaagcacaaaatattttgtaaaataatttgaataccttgatgaaccatacattttggaaaaaaaaattaaagcactaaaatcagtatgagggaatgtaaattgatgacagaaaaaacaataatttagaaaaccattgattgattaaatagctcaaaaaaactgagatctagaataatttcaagtgaattttaccaagttactcaattttgtgcatttttatacataattaggaaacagaagaataatcccaaacaaatttaatagaagctatagcttgttactaaacttagtaagaataatgcataaaggaaatacaaatatagtgccctgtaagtaagagtaactcaatcttctgaacatgagactataacataaaataaatgacacttaatcaaataaaaataaattatgtttcatggtgactaatcctttgtttggagccgaattttttcgacaatactataaggtaatttatagtattttctccctagggtattaaatttgtagacacttatctcttatggcacaacaaatgtaatcaagatttttaagacttcaagaatggatgttttatttcaacgatgccaataatttaactcaaatagaagtaaaatatatgaattttctaatttatgcttgagataggtttcttttggcatttagctattgtaagttgtttggatatgtgtatccattatacttttaaatcagttgactcagagtgcttctgtttccactataaaatttgataaataaactttgtagcagaaaaggaaatatatttgctctttgagggtaaacctattctcaataatataacttcaaaaggtgctaatttttatgaggtatgggtgtaaagcttcaggctagaaaaaactctaatgacttgtgattggcaccattaataacttctgtgtgttcttattcagagtatcatgaagctgctttgtactgcatgttttctttcctttccagaaccttacttggaagaaatcagttgagttccaaaagcccagtactgataagaacaatttccctacagcatttgttggctggagattcaatactacattttcaagtagaatttcaagtcttatatgaaaaagcccaataataaatctaattccaaattttacagatagattgatagatatacatagatcgttttaatatattttaaagtgcgttttacaaagtcatgaaatatttttagtgagaaaaacatctactactgatataccaaggtgtgtattgatataattaatttgaatacgtgtactttgaattcagatacagaaaacacgcacaaagctaaaaagctgaaaaagtgactgagtcaagatttgaattaattctgaactccaagattaagctcttaatcactacatctgcttctatgccaaaccatattagaaactgttctaattcatgttattaactgaatgtttgtgtacctccacaatttgtatgttgaaacccgaatcccaatgtgatggtaggtgcctttgggtggtgattaggtcataagagtagaatgcttgtgagtgggattagtgctcttatgaaagaaaccccagagagttctctcatccactttctaccatatgcagatgcaagaaaaaggagaaagtctgcaaactggaaaggggccatgagtagaacttgaccatgctggcaccctgatctcagactttcagcttccagaactgcgagaaatacatttatgttctttaaaagcctccgtccatgatagcttcttatagcagcccaaatataataagacatcaaaacagtggggaaaaattctgctgtcacaatagtagccaagttcttcattttcagagttagaagacatgctatttgttagtaggtttttaccaatcatggtgcctatcctcatgaaaggcagtcattttagttttcatagaatattttcaattagtttaaaatttatatgctttccaaatactgtgaagttccattaaattacctttgtatccagtttttattctaaatttttttaccattttatttatcttttaatcattattttaggttcattacaaaacaaggacaatgttcgtgatagcataaatcaattaagttaccaacatgactgtgcttttatatttatattctttttatccttcatcctcccctctaccattctcaacctctggtaaccaccattttattctctatctttatgagatccacttttttagctctgacatataagcgagaacatatgatatttgtctctggcttatttcacttaacgtaatagcctctagttccatccatgttgctccaaatggcagtattttattgtttatggttaaataatatgctattattgtctaggcacttaagttgattccacatgttggctattgtgaataatgctgcaataaacacagaagtgcaggtattcctcattgatctcctttcctttggatatatacccagtagatgaattgctgaatcatattgtagttatattgttagctctttaggaacattcatactgttctttatagtggttgcagtaatttgcagttccaccaatagtgtacaagggttcctctttctccgcatgctcactggtgtgttaatccctgtctttttgatacaaaacattttaacttgggtgagatcatatctcattgtggtttcgatttgcatttctcttatgattagtgatattgagcttttttcatgtacctgtttaccatttgtaagtattcttttgagaaatgtctgtttagagttttgcccaatttttaattggattattattattattagttttgctgctaagttgtttgaacaccttgtgtattctggttatttgttagataggtagtttgcaaatattttctccctttctatgggttgtcccttcactttgttgattgtttgctttactgcacagaagctttttagcttgatatataatcaaatttgtctatttttgcttttgttgcctgggcttttgaagtcttaccaaaaaaaaaaaaaattgcctaggctaatatcctaaagcatttttccattttcttcttctggtagtttcatagtttcaggtcctagatttaagtctcttttttttttttttttttttttttttgagatggagtctcgctctgctgcccaggctgaaatgcagtggtgcaatttcggctcactgcaacctccgcctcccgagttaaagccattctcctgcctcagactccccagtagctgggattacaggcatgggccaccacacccaactaatttttgtacttttagtagagacgaggtttcaccatgttggccaggctcgtcttgaactcctgacctcaggcgatccgtctgccttggcctcccaacgtgctgagattataggcttgagccaccaggcccggctgatttaagtctttaattcattttgatttgatttttatttatgataagagataggaatctagtttcattattttgcatatagttatccagttttcctagcattatttagtgaaaagactgcatgttcttgatgcctttgtcaaaaattagttggctgaaaatgcataaatttatatctggattctcttttctgttccattgttttttatgtctgttgtttatgctggtaccataccgttgtggttaccaaagattcatagtaaattttgaagttcggtagtgtgatgcctccagctttgttctatttgctcaggatgctttggctattgtggaccttttgtggtttcacgtaaattttaagatttttattttccatttcagtgaaaaatgtcattggcattttgataagcattacattgaatctaaatttctttgagtagggttgtcattttaacgatactaactcttccagtccatgagcctggagtatctttccctgttttgtgtcctcttccctttcttctgtcagttttacagttttccttgtacagatctttttctttagttagattgatttctaagtattttatactttttgtagctattgtaaatgaggtagctttcttgatttctttttcacagtgtttgctgttaatgtatataagtgctactaatttttgtttgctgattgtgtatcttacaacttcaccgaattcatttatcagctcttaacagttttttgctgtggcctttagatttttttacgtgtaagatcatgtcatctgtgaacaagacaaatataacttcctcctttccaatttgaatgccttttatttttttttcattggcccaattgctctggccaagacttcaaatattatgttggacaacagtggtgaaagtgggcatcgttttcctgtaccaatccttacaggaaaggccttcattttttccttgttcagtaccatgtgagctgtgggtttgtcttatatgtcctttattattttgactaatgttccttctagactcgttttgatgtggacttttatcataaaaggatattgaattttatctaatgctttttcatcatttactgaaataattatttgactttcattcttaattctgttaatctgatgcatcacatttattgataggcatatgttgaactatccttgcatacttggtataaatcccatttgatcatggtgaatgattatttagtgtgttgttgaactcagtttgctagtattttgttgagaatttttgcatctatgttcatcagtgctattgactcgtagttttctttttttgttgtgtccttgtttggcattggcaacagagtaatactggcctcatagcatgcattagatgtatttcctcctcttcaaattttttgaaatacatgttccataacttaaggcattcaggttctcattttaaattcaagaataagacaaatattccatgctccatataacattccacaggttattacactggaataagggaggactattttaccactttgttacatatacctattgatggggtaaagaagataaagcttatatgcattcattctgaattatcaccttaatgaagtcagtagtttcaggtttctatggaaatttgttatcaagaagcatacaatttcacagttaaaaagggtcttaatactatgccaatgctcttaccttgtaaatgaacaaattaaaattcaaattagttatatgattcatcaaaattaaaaaaaaaactatttagtaagggagtccttactaagtgttggcaaagctcatccagttttctttccactacaggggactgcctccgatgaagaatagtagttgtgtagtattacttagtttccttctgtcttcttttatcaaaatgatagtattcaataaccaagtatctgaattttttgtacactatattttgccaattttctcaatgcctcttagctggaaattaaaggccatctgcccactatatttctaaatagagttttcttcaatttgtatgtccctatatacaaaaaagaagttcacatttttttctgtgtctgaacaatgttgacctgatttcagaataaataattccacaaaatctaatgatagaacacagaatactacatacaaaaatgaagattaaagtttaaaaactataatttcaaactattgatcagtggtaatttgggcacctctaggttacttcacgggcatgtggaaaacaagcaaaccctttagagtgaatagaaatgattaataataacataatttaattcaattatttttcacaggtttactaagccaatattttctcttttaatcccctatggttggtctatacttctaatctgtcccttttgtttgatttgctcatttagaaattggtattacctctagttaagacagaattagaagagcaacatttaaatgaacaattcactaaaaaaaaatcaatatctatctttccaaaggcatgaaatactctcttagtgataaaatagtatggaaaatacattgtatatctgtttattactttttagttctcaaaggcaaatttacttttacctgccactttgaaataaattaattttatcaatgaattcaaaaatattaatatatttaatttaaatgtcttcagatttttgcatgaaaggtatatattatatagttatatatattatttatatattaatagaaagtcctaattttatatgcatgtgtgtgtgtgtgtttaaatttttagaaataatgaaatattttccctggtctttacatttaaactgagagaccaagaaaaaaaagcaagtaaattccagctagaaagtgaccaatggagatacagtctatccaaccttctcagtgttcggattcattacaaaaattatctgcattattgcattttctgcatgttaccactttctcttaattttctgaaaattattcatctaatatttagaaagtgatatggagtattttaattttcttgtggctataaaaaaagtcacttctgcaataaacatatgtgtgcatgtatctttaaagcagcatgatttataatcctttgggtatatacccggtaatgggatggctgggtcaaatggtatttctagttctagagccttggggaatcacaaccaactcaaaggtccatcaatgatagactggattaagaaaatgtggcacatatacaccatggaatactatgcagccataagaaaggatgagttcatgtcctttgtagggacatggatgaagctggaaaccatcattctcagcaagctatcgcaaggacaaaaaaaccaaacaccgcatgttctcactcataggtgggcattgaacaatgagaacacttggacataggaaggggaacatcacacaccggagcctgtcatggggtgggggtcagggcgagggatagcattaggagatatacctaatgtaaatgatgagttaatgggtgcagcacaccaacatggcacatgtatccatatgtaacaaacctgcaggttgtgcacatgtaccctagaacttaaagtattattaaaaaaaagaaaaaaaagtcacttctattgttattgaatgtattattatggtagttcaacagggttaagtattgtatattttctttgtaactgtagtgaaataaaaagtccactgctaaagccacatagaatttaagggaatacaaatctgtgttaacagtgaaggcatttattttgaagtaaaaaataaaaacggaaaggctttgggtttcatctaacttggtggagtgtgcttttttattaaatacaaagtaatttaggtttaatataagtatgagatagaggccgagctgctagttttattttaaatccacattggaggcttaagtggagattttattgctcccagttcttccttattttgctcccttttctgatgttgtcttttctcggggacatctgtggaggagagttttcaacaggaatggggaagcagacatatccctctcaaatggaccccaaagaagcaaagtctttgaacttcagaatatgtttcatgatcataaatccactacactccaagataagtccttcttgctcatgatagatttctatatttatttaagcaaggcacatgtaacaggaagccaagctccattagaattcctcaattgatgaatcctttgaatattttaactgctttataaaggagtagactattttaaataaaataataaaaggatatcttgaaaataaatgctttcctgtttaatatgctaaatatttgttactattgctagcttactttcttccttctgcttccctggccctttaaaacaaaacaaaacaaaaaacacacacatgcactttttaataattgctaggttactgggagtaacagtatagtgaaaaaaattggttcacaataacttggacaatttgatttaaaactcatgatctcatgttcagctcaaataaataacattcacaatgatgtgctgaataagccagtcataaaagttgctttttttctgtgtttgatcaattcagtctatcaccatacatagtacatacaccacaaaacaagaataattcataagatataagaaaggatagatttcaatatttctctcttgaaggatatcatagttaaatttgcattttttattgtgaaatatttcattattctctgatcctcagaatgatcacctgggaagcacaggcgcaactgttccatcatttctgacttgattcctctgtatgtcagagttcccaaaacactttcatttgtgttagataaatttgaataattatttatctatatttaattatcaatgtaaactataagctaagaaaaataaaatacataataaggacagtttaatttttatcacaaagtattataaaaagagaagcagaaggacacaaaaaggaataattaaaaaaaaaactgccctaaaaggcatttggcaaattgctgcttcttatgaagctctctgagtatttcacaaaagaggatgttaaagcgagaaaattaaagtcttctctatggcagaccacctgtgaatataggccttagtgtgaaaaagatagatttttttttaatttattttattagtttgttctcaccctgctaataatgacatacctgagactgggtaatcttaaaggaaagaggtttaattgactcacagttcagcatagctagggaggcctcaggaaacttacaatcatagtgaaaggggaagcaaacatgtccttcttcacatggcagtagcaaggagaaatgctgagtaaaagggagaaaaaccccttataaaactatcagatctcatgagaattcactcactatcatgaaaagagcataaggataaccacccccatggtttaattacctcccaccaggtctgtcccaggacatgtgaggattatggaaactacaattcaagatgagatttaggtggggacacaatcaaaccatatcattccacccctggcctctcccaaatctcttgtcttcagaattcaaaacacaatcactccttcaaacagccacccaaaaacttaactcattgcaacattaacttgaaagtccaagcccaaaatctcatctgagaaaaggaaagtcccttctgcctatgtccctgtaaaattaaaagcaagttagttacttcctagatacaatggggataggggaattaagaaagtagacccatttaaaatgggagatattggccaaaacaaaggggtcacaggccccatgcaagtctgaaatccaataggcagtcattaaaccttaaagttccaaaatgatctcctttgattgcatgtgtcacatccaggtcacactgatgcaagaggtgggctgttatggccttggacaactctgctgtggctttgcagggtacagtccccgtcctggctgctttcacaggctggcattgagtgacttttccaggagcatggtgcaagttgttggtggatctatgattctggagtctggaggatggtggtcctcttcttacagctccactatgcagtgccccagcaggcactgtttatgcgggctccaatctcacatttcccttctgcactgccccagcagaggttctccatgagggtcctgcctctgcagcagacttttgcctggacatccaggtgtttccatacatcctctgaaatctaggcagagtttctgaaacctcagttcttgccttctgctcacccacaggcccaacaccacattaaaagtttccaaggcttggggcttccaccctctgaagcaatggcctaagctgtatcttcgcccttttcagtcatgctggagtggctgggatacagagcaccaagttacaaagccacacacagcaggggtggccttgacttagcccacaaaaccattttttcctcctaggcctctgagcctatgatgggaggcactgccatgaaggtctctgacgtgtcctggagacattttccacattgtcttggtgattaacattcagctcctcatcatttatgcaaacttttgcagtcagattgaatttcttcctaggaaatgaggttttctttttatggctttgtcagattgcaaattttccaaacgcttattctctgcttcctctcaaacattttgccacttcaaaatttattctgccagataccctaaatcatctctctcaagatcaaagttccatggatctctggggcaggggaaaaatgctgccagtctctttgcatagcaagagtgacctttatttcagttcccaataactttcccatctctatcagaaatcaaagaagcctgaccttcattgtctatatcactatcagcattttggtcaatactattcaacaagtctctaggacgttccaaactttcccacattttcttgtcttcttctgagccttccaaaagtatccaacctctgcctgttacctgttccaatcacttccacatatccaggtatctttagagcaatgctcccttctctgtggtactaagctactatattaatccattatcatgctgctaataaagacatactcgatactgggtaatttatataggaaagtggtttaattgaatcacagtttagcatggctagggaggcctcaggaaacagacaattatggtggaaggggaagcaaacatgttcttcttcaaatggcagcagcaaagagaggtgctgagcaaaagagagaaaagcctctcataaaacaattagatctccttagtcctcactcactatcatgagaacagcaggaaactagctgcccctatgatctaattacctcccaccaggtccctttaatgacacataaagattatgggaactacaattcaagatgagatttgggtgaggatacagccaaaccataaaatttattttaaatagccaattataaaacaactagaaaactttcagtattaatgacaagaaatgcttaaactttttgccagatatatatgtatattatttatattttttatttatatatatgtaatatatattatttatacgtattatttatataaaaacaggagctagacatataaaataaagggtttaagtgtctctcactctcccctctccccaattcttttcctggatataaattattatatatatatatatatatatatgtgtgtgtgtgtgtgtgtgtgtgtttgtgtgtgtgtctgtgtgtgtatttactacagaaacttcaagtggctacctttgtgtctcctttactgtttatttggcttgttaatgttaatgcaggcaatgcaaactccattcctgaaataagtcacttgtttgtgagttattgtcctttttatatattgatgaagccaatatgtaatattttattaatattttggcatctatttttataaagggcattgacatgtatttttattgttgtagttgctgtttttctagctatattaaagttgagtaatgaggtgatgttggttatttaaaattagttgtaatatttacctcatctattctataaaattatgtaacacagacatttttttcttaatgatctgtttgttgtttggttctttgggccagagtcttgctctgtcacccagactggagtgcagtggtgtgatctctgctcactgcaaactctccctcctggattcaagtgattctcctgcctcagcctcctggacagctgggactacaggcatgagccaccatgcccggctaatttcttgtatttttagtaaagatgggatttcaccatgttggccatgatggactcaaactcctgacctcaggtgatctgcccacctctgcctcccaaagtgctgagattacaggcatgagtcaccacacctggccttccttaattatttgatagagttcacctcatgaaaacatctaaacttttcctgagaaagctttgagataaaacatcaatgttttaaataaccataaggtaaaataaattttatattttaaataaccataaggtaaagtaaattttatatatataaaatataaatatatattatatataaatattatatttataatatttatatataacatataatatataaatattatataaaaatatatatttacatatttatatataattataattatatttatatataataaatatatttatatttatatttatatataatgaatatatttatatttatatataatgaatatatttatatttatatttatatataatgaatatatttatatttatatataatgaatatatttatatttatatataatgaatatatttatatttatatataataaatatatttatatttatatataataaatatatttatatttatatataataaatatatttatatttatatttatatataataaatatatttattttatatttatatataataaatacatttatatataaatatatataatatatttatatataaatatttatatataataaatatatttttatataaatgtttatatataaatattatatataatatatattttatatatattttatattttataatatatattttatatatattttatattttatatatatatatatattttaccttatgatctgtattttacaagttgttgtaaatagttgcccatattttaccttggtctgtattttacaagaacattgcctatttaataaattgacaaatttattgacattaaatttttcataatatttgttatccttctaatgtcagaaaaatcaattgtgctgctcactttttcatttctagtattggcaaattgtgtctcctttaatatttctttcatgatttttgataggtggtttaaaatattattaatgcttaaatcaaacaaattttggtctcatttcttatttctattgtttttatttttatttcattcatttccatcacaataatttttataacattctttttttattatgttgagtaaagttcactcatatttctaggtgaaaacttaagttttttattttaatacttgagaaggagtatgtactttcaagtattgtttagagcattctataactatctgttagctcaattagtcaattaatattaccaagatttccatgaaaaaagtaaagaatgtctacatatttaaatatacagtcagactccaaagaaccaagtttgctctgttgaaattttaacgcagcaatgaaagaaatcgttttccttataaactggaaattaatttatgaattaaagaaaaagcagtgaatctattgagacatataacaattttaattccttgaacataatgggctttcaatgaatacatattgataaaacaattatttacattatatgtgtacttgtgaattgatgaaatacattatgttttaaatgtgtgttacctggtacatttaagtaatgagcatttatctttaatgcacaatattactatttttaaggaaaagggtactacaactgagaactaatattgtcaagctgtttaagaattggtggatgtattttataatgaagagctataacaagtgtcaaattactcagtttcaccaattacaatattttgtattcacttataaacatttctgcatagataaattttatgaaatgtagtttccatgaattactttcttaaaccttttactgtttagaaaaaaaaaaaaatgtagctcaccgccgccattcatttaattttacataaggaagctctttgaggctgaagcaaatcagactgagtttcaatgtaaaaataaaatataaagactgttcttggagttagttctaaacagagttagcatcagaatcatcctaatcatcagaattatctatttcaggaaaaccgcattcatcgtatgaatcttcaaccaataactgttcaagagcgatgttaacatcatgcataggaatgctacgttttctaggatttgacattttcagcaattgaggattactatattttataaattgaaataacactactaaaaacagaattctaaaaattgaatgatgtattttatttccaaattcaatatctaaaggaataaaaaaataataaaagtgaaatatttcatggcaaatttatcacacggtaaatgctgcagccacaaatgtcaccagtgagtattctcagggcaaatgggcaaagggttagttttcagttctattgtgaatcattatttgggcagtctaaataaatgtctgcctttaaaacaataagtaaatcaaagacaaagttttaaaatacaaaaatttggctatagagaggaaacagtagcttcaaatgtgttaaaatcatttactaataaatataaaacaataaaattatgcatttgttataatgttatctcatggaatgacagtaaaatagtaaaattttatacaattcagtggcatcatgatagattagtttggcctcttctaaaattttatataattgagatgatacagtaaattcatttttgtttctagcttattttgttctatttgattttgatatttatttatcttatgtgaattggtaatttattccctttttttcacagactagcatgtcattatgaatatatttcaatttgtttgtttttgtttatggtcgttaaggtttattccagcatgggttattgtgaataaagctactacaacatttgttttgcaaacctctttttgagcatctatttttgtttcttgggggagtatacattcctaagattgaaattgctggtataaattaggtgaatttatgtattaaacatctttctacttactttgggtttaattttctgtttgttatctagcttcttaatgcatgatcctaatcattattttgtaccttttttctctttaatataaacattttaaagctatgaatattcctctagtaactgctttgtttgtatctcacaaaatatggtatcttctgcttttattaacatttaacttgaaaattgtcttattcatgtacaattacatatgatttccaccttgactgacgtgttatttaaaagtatgttgcttaattacaaaactgggcagctggttgggcagacactgagctagctgtgggaggtttgtttgtttgtttgtttgattttttgtttgttttttgccccagtggcacttggaaccccagcatgacagaaccattcactcctctggaaagggggctgaagccagggagccaagtggtcttgctcagtgggtcccactctcatggagcccagcaagttaagttctactgattgaaattcttgttgtcagtacagcagtctgaagttgacctgggatgctcaggcttggtgggggaaaagcatctgccattactgaggcttaagtaggtggttttcccctcacagtgtaaacaaagccaccagaaagctcagactgggtggaatccacctcagtgtggcaaagccaatgtatccagactgcctctctagataccccttcactgggcaggccatgtctgaaagaaaggcagcagccccagtcagaggcttatagacaaaactcccatcttcctaggacagagcacttaggggaaggggcagctatgggtgcagttttggcagtcttaaatgttcctgcctgccggctctgaagagagcagaggatctcccagcacagcactcaaactcttctaagaaacagactacctcctcaagtgggtccctgacacccatgcctcctgactgggagacacctcccagcaggggtcaagagatgcctcacacaggagagctctggctggcatctggtgggtgcccctctgggatgaagcttccagaggaaggagcaggcagtagtctttgctgttctgcagcctctgctgatgatacccaggcaaacagggtctgaagtggacctccagcaaactccagcagacatgcagaagaggggcctgactattaggaggaaaactaacaaacagaaaacaataatatcaacatcaacaaaaaggatgcctgtgcaaaaacaccatccaaaggacatcagcatcaaagatgaacagtaggtaaatccacaaagatgaggaaaaaccagcacaaaaatcctgaaaattccaaaaatcagagtgcctcttctcctccaaaggatcacaactcctcacctgcaagggcacaaaactgggtggagaatgagtttgatgaattgacagaagtaggcttcaggaggtgggcaacaataaactctgaggtaaaggagcatgttttaacccaatttaaataagctaagaaccttgataaaaggatagaggagctgctgactacaaccaccagtttagagaggaacataaatgacccgatagagctgaaaaacacagcatgagaacttcatgaagcatacacaaataacaacagccaaatcaatcaagtggaagataggatatcggagattgaagatcaacttcatgaaataaacagtgaagacaagattaaagaaaaaagaataaaaaggaatgaacaaagcctccaagaaatatgggactatgtgaaacgacaaaacctactattgattggtgtacttgaaaatgatggggagaatggaaccaagtaagaaaacacacttcaggatattatccaggagaacttccccaacctagtaagacaggccaagattcaaattcaggaaatacaaagaacaccacaaagatactcttcgagaagagcaaccccaagacacataatcgtcacattcaccaagcttgaaagcaaggaaaaaattctaagggcagccagagagaaaggtcagattacctacaaagagaaacccatcaaactaacagtagatctctctgcagaaaccctacaagtcagaagagagtgagggccaaaattcaacagtcttaaaggaaataattttcaacccaaaatttcataccctgccaaactaagcttaataggtgaaggagaaataaaatcctttacagacaagcaagtgctgaggaattttgtcaccaccaggcctgccttacaagagctcctgaaagaagcactatatatggagaggaaaaaacagtaccagctactgcaaaaacataccaaaatataaagaccaatgacactatgaagaaactgcatcaagtaatatgcaaaataaccagctaacatcgtgatgacaggatgaaatacacacataacaatattaaccttaaaagcaaatgagctcaacgcctccaattaaaagacacagactggcaaaaaaggataaagagccaagacccattggtgtgctgtattcaggaaacccatctcaagtgcaaatacataggctcaaaataaagggatgcaggaatatttacgaagcaaatggaaagcaaaataaaataaataaataaataaataaataaataaatatatcaggggttgcaattgtagcctctgataaaacagactttaaaccaacaaagatcaaaaaagacaaagaagggcgttacataatggaaaagggatcaatgcaacaagaagagctgactaacctaaatttatatgcacccaatacagaagcacccagattcataaagcaagttcttatggtcctacaaagagacttagcctcccacacaataagagtgggaatttttaacaccccactgtcaatattagacagatcaatgaaacagaaaattaacaaggatattcaggactccaactcagctctggaccaaacagacctaatagacatctatggaactctccaacccaaatcaacagaatatacattcttctcagcaccacatagcacttactcaaaaattgaccacataattggaaataaaacgctccttagcaaatgcaaaagaatggaaatcataagaaacagtctctcataccacagtgaaatcaaattagaactcaggattaagaaactcactcaaaaccacacaactacatggaacctgaacaacctgctcctgaatgactactgggtaaataatgaaattcaggcagcaataagtaagttctttgaaactaatgagaacaaaggcgtaaggtaccagaatctctgggacatagctaaagttgtgtttagggaaaaatttatagcactaaatgcccacatcagaaatggggaaagatctaaaattgacaccttaacatcacaattaaaagaactagagaagcaagagcaaacaaattcaaactagcagaagacacgaaataacttagagcataactgaaggagatagagatgtgaaaaacccttaaaaaatcagtgaacctaggaggtgaaattttaaaagattaacaaaatagaccactagccagactaataaataagaaaagagtgaagaatcaaatagacacaataaaaaatgataaggggggatatcaccactgatcccacagaaatacaaactaccatcagaaaatactaaaaacacctctacacaaataaactagaaaatgtagaagaacttgattaaattcctggacacataaaccctcccaagactaaaccaggaagaagtcaaatccctgaatagaccaataacaagttatgaagttgaggcagtaattaatagcctaccaacccaaaaaagcccaggaccaggcggattcacaggcaaattctaccacaggtacaaagaagagtgggtaccattccttttgaaattattccaaacgatagaaaaagagggactcctccctaactcattttataaggccagcatcatcctgataccaaaacctggcagagacaacacaaaaaataaaaagaaaatttcaggccaatatccctgatggacattgatgcaattatcctctttaaaatactggcaaaccaaatccagcagcacatcaaaaaacttatccatcaagatcaagtcagcttcatccctgggatgccaggctgcttcaatatacacaaatcaataaatgtaattcatcacataaacagagccaattacaaaaaccctgtgattatctcaatagatgcagaaaacacctgtgataaaattcaacacaccttcacgacaaaaacactcaataaactaggtattgatgggacatatctcaaaaataataagagctatttatgacaaacccacagccaatatcatactgaatgggcaaaagctagaaacattccctttgacaaccggcaaaagacaaggatgccctttctcacaactcctattcaacgtagtattggaagatttggccaaggcaatcaggcaagagaaataaataaagagtattcaaataggaagagaagaagtcaaattgcctctgtttgcagataacttgattgtatatttagaaaaccccattgtctcagttcaaaaacactttaagctgataagcaacttcagcaaagcctcaggatacaaaaccagtatgcaaaaattacaaacattcttataaaccaataatagacaaacagccaaatcatgagtgaactcccattcacaattgctacaaagagaatacaatattcaggaatccaaattacaagggacatgaaggacctcttcaaggagaactacaaacaactgctcaaggaaatgagaggacacaaacaaatggaaaaaagtttccatgcccttggataggaagactcaatattgtgaaaattctcatactgcccaaagtaatttaaagattcaatgcaattcccatcatgctgccttgattttcttcatagaattagaaaaaaactactttaaatttcatatggaactaaaaaagagcccatatagccaagacaattctaagcaaaaagaataaacctgggggcatcacactaactgacttcaaactatactacaagtctacagtaaccaaaacagcatggtactggtaccaaaacagatatatagaccaacagaacagaacagaacagaggcctcagaaataatgtcacacatctaaaactatctgatctttgacaaccctgacaaaaacaagcaatggggaaaggattccctgtttaaaaaatggtgttggaaaaagtggctagccatatgcagaaaactgaaactggaccccttccttacactttatacaaaaattaactcgaaatggataatcacttaaatataaggcccaaaatcataaaaaccctagaagaaaacctaggccataccattcagggcataggcataggcaaagacttcatgactaaaacacaaaaagcaatggcaacaaaaggcaaaattgacaaatgggatctaattaaattaaaagccttctgcacagcaggagaagctatcatcagagttaacaggtaatctacagaatgggagaaaaattttgcaatctatccatctgacaaagggctaatatccagaatctacaatgaacttaaacaaatttacaaggaaaaaaaaacaatgtcatcaaaaagtgggcaaaggatataaacagacacttttcaaagaagacatttatgtggccaacaaacatgaaaaaaagctcatcatcactggtcattagagaaatgtaaattaaaatcataataagataccatctcacaccagttagaatggtgatcattaaaatgtcaagaaacaacaaatgctggagaagatgtggagaaataggaacacttttacactgttggtgggcatttaagttagttcaaccattgtggaagacagtgtgatgattcctcaaggatctagaactagaattaccatttgatccagcaatcccattactgggtatatacccaaaggattgtaaatcattctcctataaagacacatgcacacatatgtttattgcagcactactcacaatagcaaagacatggaaccaactctaatggccatcaatgatagagtggatatagaaaatgtggcgcatatacaccgtggaatattatgcagccataaaaaagaatgagttaatgttctttgcagggacatggatgaagctggaaaccatcatactcagtaaaataacataggaacagaaaaccaaacactacatatttttactcataagtaagagttgaacaatgagaacacatggacacagggaggggaacatcacacactggggcctgtcagggagtggggggaaaggtgagggatagcattaggaaaagtacctaatgcatgtggggttttaaactttttttgatgggttgatgggtgtagcaaaccaccatggcaaatgtacacataagtaacaaacctgtatgttctgcacatgtatcccagcatttaaaatataaaaatgttaaaagtatgttgcttatttacaaatatctagggatataattgttttatttttatttgtttttaatccaattcattgtcagagagcatactcactataattttaatcacttaaaagtaatttagacttgctttgtagccatatcttgggtaatgttccatgtgactttaaaaaaacacgtttttctcagtttttctatggtcgtatactctattctctctctcttcccccaatcctccaacaatcccttgtttgactctgtgaccctatgattctctattagctgagaaaaagcaacctttctggctcactatcatgggtttcagtattgaaagcatgttgctgtttggaaataagtagcaatataccttgcaagtggtaaaaccttgatgtaagaaggcaaaggcaaatcttcactatgaactcataagtgtttatttggtagtggaagaagagttaagtactcactcaggagaacattatgtgtattcccagattttttaatgttggccagtagccttgttgtttggtcatgcaaattggccatagaaaatggacaatagataatatccatccatatgaggcactcttatggaaatatctattggagttgagaagtattgaagaggatcatctcaaacaccatctctccaagaaaggcttatttagttcactagactatctacctaagttaatgaaatgagtagtgtattggttcttagatcacagatctaagatagcacatatttcccttacaccctataaaacaactaatgtgacaaattactgtgtccaatataaacaaatatataatctcttgtcaatgatcatgggtaaaattacccaaagcaagtaggtcacattggacctctacctgtagccagagaaagcttaaagtgagtattaagtgggaacaaaatcttttctacttgagactgcacttattctgtagcagatctaatctgaggcataaatttcaaagtttgaagcgatatattttctattaaattgaactacttacatgtctgttttctgatcatctacaaaatggtctaggaaacataatattacacaagcatatcatattctttattactctcagaacagtggtctaacaaaattcaaatgaggaagtgaaacatatacaggaggtggtgagaaaggtcttaagagttggcttagttggtgtgtttgactgactgtaaggtgacttgtgaatgatctctgaatgctggtgtttacaccctttgtttcaacccattttcttcaaagtatatcagacccatgacttgtttctaattaacaaaatatgacaaatatgacaaaggtaatgatacttcacttctgtgaatatattatgttatataagactctgtcttacaatcagactctttctagagaccctcttccctagctggcttgatgaaataaacagttatgttgggaaaacccacatggcaagagagtatgaacagcctctacagactgcagacaacttctaggaagtgagggtgatttttggctgacatccaggaaaaaaaaaaaacaaagcaaaaaatggaagctctaagtcctatacccacaaggaactgaattccatcaaaacctggattaactttgaagccaattcttttccagtccagtcttcagatcaaaatgcagccaaccagtacttatgctgctactttgtgagctcctaaacacaggggccagctaagttggtcctggactttagaaactataagttgtcaagtgtgtgttgatttacaagtattgtcgaggatgtggagaaagggaatcctggtacaacgttggtgagaagtaaagcattacagccattagggaaaattgtatggagtttcctcaaaaaattaaaaaagaactaccatatgatccagcaatccaactactggttatatacttaaaggaaaatgaaatcagcatgtataagagaaacctgtactctcacgtttattgtggtactattcacaattgccgagatatggagtcaatctaagtgttcattagggataatggataaagaaaatgtagcatatatacataatggaatactattcagccataaatgtgaatgaataccttcatttgtaacaacatggattaacctggagaaccttatttaactgcatgaaataagccaggcacagaaagaccaatatggcatgatctcactcatatatggaatcaaaaaaagttcatcccatagaaggtgacagtagaatcttggttactagaggatgggaaaggatgaggaaaagaggagttggtcaatggtacaatattacagtttggaggaataagttctggtgttgtattgcatggtagggtgactaaagttaataataatgtattgtatatttcaaaatagctagaagaggaattttaatattcttaccatacagaaatgataaataaggtaatggatatgctaactactctgatttgatcattacacattttagtccataaatttgtacaattattttatgtgtatcaaaaataaagcaaaagtaagtatgtggcaattcattacacagcaatagataactaatgcaataacttaaaaacaaatgtcctaaatctgggccgggtgtggtggctcacgcctataattacagcactttgggaggccaagaagcacagatcacttgaggtcaggagttcaataccagcctggccaacattgtgaaacccagtctctactaaaaatataaacatttgccaggtctagtggtgcacacctgtaatcctagctactcggaaagctggggcaggagaatatcttgaagttgggaggcagagattgtaatgagcagagatcacaccactgcactccagcctgggcgacagagtgagtgagattctatcttaaaaaaaaaaaaaaaaaaaagatgggactctttaggtacatcgtccacataaacatcagttagcgtgagattatatcctcactaagaaaggactattgtgtcttaacgtaatgtattgaatatctgtgaaggtcacaggttccagctactaggaaattgaaccaaataagtaaatttattttaaaaaaaactacagaaagcctaaatcacaacaaagtcacctgacagtatgttcttaattgttctttaatagcctgaatttcatgaatacaaagagatttatctcccctgtggctcaattgttccaccatacctaaaagcaggtgtttgtaacaactggcactgtaatatttagatatagttatatctacaaaccaaataaaacccagaatttattgaatagtgacctgtagtcaccaatccattaattgagaatgtttggtatgctgcaagaggttgtttctgttgggatagaataccgaatgatactgtaacttgaactgttgtatactgagacctttttcaatctctccattatagctaaaaagtataacaaaggtttgaagttcatttttgtaattaaatgaaaaccaatcttatgcaagtgaagataagaattattttaataagctgagttgaaaactccaaatcatataattaaaatgggaacccattggccatgaaaacaagtgactttggccatagacattcaaataaatgccttcatcaacatgtataaaaaattttaagtaacgtaaattatgaagtaatttaactaggaaaaaatgactcataaaaaattgtacatgctttatacaggaaactcctatgcttatgcatatggttcaaattttcatcctcatcttatgttaggcatattcttttatacaagattttgcagaaaatgctgtaatatgaataatgactagctacctgatatatgtggcaagaagatgttgacaaagtaagagaatggactgaagagaaagcagtttagatatcttgcctttgatccatttatctcctaattccccagggtcaacccctggggaaaaaaaatgcagatgacttggtctagccaccttgaaaacatgctaataactgacatttcttataacatgttgactgaatgcacagactcatattttctaaaaccggtgttcttatttataagatgcaaaaattgatctgctgttacattttcatttcagatattgaattcttcaagtctagaattttagttaatttctttgtatccattccatatctttgtagagattcccaatctttcatttattatgccttttttaagtacataaaatttttatcacaagtgtttaactacacttatctttaaatccccaaacatctgtgtcatctgaatttgttactatagcttttttttccattacttgagagtcatattcacctccttctttgcatgtctagtaattttaattctatcctgaacaaggcagatgctgcaagcttattttctgcccacatttagattgtattaagtttagttctggctagcagacaggtcttcttgatcctataaaaccttggtttcagaaattgttatgaaggatacagcatattttttactcaatgactagagtaaccctgctcctaaaacatctttcttggatcatgatggcatgtctgtctgtttaatgaggcatctccaatttgtctagtcatatctcctaacacatattcggtaaggcctccagaatatgcattcatctccctgatcccctatcccctagtattagctattctctgactcgttttcagggtcttgcccagtgcatgcacaagttagtatttgggcaaagcctcaaagggaaacctatgtagtcctctggattttcttatctgtgcaattccttcaccactagttttctgtcctataaattgcagctgattcagcaaactccagcatccaaaccatataccttccagttagatctctactttgtttgactaagctctcctgccatatatatatatttcctgagggtgcatttgtgtttctctggcaattctctgtgccataatttgggtagtgatcgtcacagaaagccaagttgaatgcagaggtcacctctttttttcctttctctcaagcaccatagccctgtgctgcccaattcattataaacagttgctttgtatatgcttattgtcttttcttcttagttggtttctgaagtccctggtctgttttaaatgtctcctttttttttaatctctctcttttgcttctttagtagcaacttgaaaattatacatattttcctaccttgatcaaaattttgaattttatcatcataacttcacaaactagtttttaagaaatattattcctgattacttccatttaaaataaaatatttaaaatgacttcagttgtttttctttttctttttttaaaattttttgtttttaattttgtgggtacatagtaggtgacatttttcttttcatcaatgattttgttttagaaacaaaattattgttaatatggttttatattttggaattatattcagaaattatttttgagatttgttttgtctcaaatttttaacaaggtttagatattatgttcttatttttatcttaataatcaagtatttctgtatatgacatatttctattgctgtattctctgttaaatgaggtaaagtatagtaattcctggcctaaattaggcagttaataaacattatctgctgttgctgctatcatcatcatcatcattaaatagcacacatatcaccaaaaacaccaaaaatttaagcttcaaatcgacaatttctgaattacaaagatgacagatctgactcatttggaagagatcattttctctctccttccatctctctctcatgaaaaacatttttttatgattagttggctacacaaagaagcaataatagacgttaaaacaagttatggttgttttcaataatattttgattctaaatcctagaaatttctgtgagatcatttgagttacagcctactttaaaacatttaggaagcatcagtgtcactataaaatgactatctaattcagtcacagagataattcatagcatttataaatcattgtaattaaatttgagaaaaaaaacaggtctttgattcaaagaaaaatactgcctcaaataggaggtaatcttatatactggtagtgactttgaccatacaccaagaactttagatgtaaatcactataaataatttttcctgacccaattctctcaaaaagagttggaattatgagttggaaatgatttataaccagattccaatctgatttaatgttaatacatattcctaattaatgggaataatgatagggttcaataatccaacaacggaatatcatactcgagctattcccatactcattccatgtgttatttcaagttcttccaaagaaacttgggtaaagaacaaatgatattatttggatttgttatcagcaacatggcaaagactaagacaaaacatgttgatatttgtctgtcttttcatcgttattttatatagattttattaactgtcagagatgatttgctaagctcccttgcgatatacagtatgtaaggatcctgaggaagaatttgtgtctctaatgacagaagtgaatcccttatattaaataagtataggaactccataaaaaggtctggagaaaattgaaactgtttagaagtctgagtcagtggtagaatatatgtgcagacttagttatgaatgcatttgcatttttaagggagtttaaatcaattccctttatatatacctgtcacagtttgggtttaaggtttctaaaatatggtgtgaaaagtgcaggccatgtagcccgtgtaacataggggttgttcccatcttagtgatgatataatgaatcatcttcataataaatcattacaatagctttctccagtggaatttaggctcacatacttccatttagcacttgattctatagtcaggctatagatttatgggtagagaagccacttatgagactgagattgtagttttccatctgacctgagaatagacataacataaacaaatatgaacactaagaaaaagtaggttattaaatttgaaagtttatttccaaaacctttccctgatttggaaactaaagtttacatagacaacttccatgcctcagcatcttcatatgctggactacagggctgattgtgaatatcttcaaatttgcctccaacttaaatgttctataattttatgaaaaatttaattacacagaattgaaatccttcttaccagatctaagtttttctaaagtgtttacttccctagaatatattattaacaatgattcttaaacccattttctgagggatcttaaaaaccaggatgaatacctgtcaatactgaatttttcaaatggaactgccatgttccagctatgttacatgtaaaaactccacctcacatatctaagatacattcccttatatcacttacctacctatgtgaagaatattttttcaggtggtgtattagttttctctagcctccataacaaattgccaaaaattaaagggtttaaatgatgcaaatattattttttacaattctggaggtcaagagcctgatatgagtctcactgagttaaaaggaagctgtcagaattcctttctggaggctcttggggaggattcgtttcctagctcgttcatattattggcagaattcaattccttggtattctagacctgaggtccccatgtcctttcaggatgtcagcctgaagacattctcacatctattgtccaccagattctctggttcctgcccccttctccatcttcaaagctagcaatgtctactgatgtccctctgaagcttcaaatctcacctgcttctcattttgtcacatccctctgtctgtctctctgactctagatgggagagctttgttaattttaagggctcatgaattagaatgggcccacattgataatccaggaaaatattcccatcagaaggtctaaatgcttaagcacatctgcaagtcccttttgctagatagcatgacatattcagaggttccgcatacttagagtaaggacctcttttgaggaccattattctatctacaagtagtctttccaggctctttcaattctaaagtctatgattgtacaatatggctttcttaataatatttcaacttcctgaaaatgcccattctatattgcccaatattttgaagttcctttcaacaatattcgaagataatttttcctcttgctctaaaatccatttgcactagactttcccatgccccatttgtcacctaatgtattaaacatatttttagttatatcttcacttaaatataccaattaatgtgtttgccacgtctcatacacaataaatactgtagctgggtagtgaccagttctgtcagctgtgatgtaagtttgtctacattcaattacaaatacaattgcttattggttgtgataacttgctaaagtggcttagtgtctctaaaccataatttccttgatctccaaaataaggatatctatcatataggattactttgggttaataactaataaacataagtcagttgatagacttaactgagtaaacaaggtgtttaagaaacttaaagaaaatactgataccttataagtgcaaagttattcttaattgattagcatatattagcaatagacttaaaattatgtagaatttttatattccattgggtaaaatatatttttatcatttgtgaccttgagaggtcatgcttcatacataaccacatataaaaccaatgaaaaataaatctcagttctcttgacttctgtagtgatagttttctatcatgaatcatcctttctctttgaaataaacatatgtccttgtagtttgtgaaaattttaatgcctacgattataataaatctaaatttttagtaagtttgattctattaatttacacttaccaaattggggatatgaatattactcacattaattttgtgtattttacttcacattgtttcagaagaaatttaagacagttcataacacgaaaagcatttcaatataagattaattaaaaattgtgataaagtaaaaagataataggagtaaaaaacttgaagaactaagaaaaagaacaaaattatgcatcataatctaagttttccatagctacagtgaaacaatatatccattaccttacactattttccatatacatgaaaaaaatatacttattacacctagtaaagggtaaccccgtaatggcagagattgctgtctattttactattggttgtctcttgcactttgaacagttcctggaacataatatgtgctcaatatatatgtgtagtatgaacatttagaaataaatttattgtctgcaaactgtctataaggaagagcaaaaaatctcgagctgatgagtatggctcaagtcaaattgtgagaagtttttaatatctgtaaaagtaggtcaactgccatcttttaagcaattctccatgaagcttgtttaacttaattcaatttctgaagaagattgtgttgtaatcagcttaaggttggtttttgtggtcagatacatataaagcagttactctttagctgtctttcactcccacactggttttactgaattttatttccagatggtttcagtgtaaaggagaggaaaactatattggctattaacatttaagatagcatctattacacatgataatattattagcagttgaattatattcctttactttaataattggctcctgactttaagaattttgtaacctgaaattagtttttatataaaaaaatttattttttattttgtatttttgttatttcttattcttttttttttctttttttaaatttattattattatactttaagttttaggttacatgtgcacaatgtgcaggttagttacatgtgtatacatgtgccatgctggtgtgctgcacccactaactcatcatctagcattaggtatatctcctaatgctatccctcccgcctcccacgacagtccccagagtgtgatgttccccttcctgtgtccatgtgttctcattgttcaaatcccacctatgagtgagaatatacggtgtttggatttttgttcttgcgatactttactgagaatgatgatttccaatttcatccatgtcgctacaaaggacgtgaactcatcattttttatggctgcatagtattccatggtgtatatgtgccacattttcttaatccagtctatctttgttggacatttgctttggttccaagtctttgctattgtgaataatgccgcaataaacatatgtgtgcatgtgtctttatagatgcatgatttatagtcctttgggtatatacccagtaatgggatggctgggtcaaatggtatttccagttctagatgcctgagaaatcgccacactgacttccacaatggctgaactagtttactgtcccaccaacggtataaaagtgttcctatttctccacatcctctccagtacctgttgtttcctgactttttaatgattgccattctaactggtgtgagatggtgtctcattgtggttttgatttgcatttctctgatggccagtgatggtgagcattttttcgtgtgttttttggctgcataaatgtcttcttttgagacgtgtctgttcatgtcctttacccacttttgatggggttgtttttttctcgtaaatgtgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaaaggtaatgcctaggttttcttctagggtttttatggttttaggtctaatgtttaagtctttaatccatcttgaattgatttttgtataaggtgtaaggaagggatccattttcagctttctacatatggctagccagttttcccagcaccatttattaaatagggaatcctttccccattacttgtttttctcaggtttgtcaaagatcagatagttgtagatatgtggcgttatttctgaggtctctgttctgttccattgatctatatctctgttttggtaccagtaccatgctgttttggttactgtagccttgtagtataatttgaagtcaggtagtgtgatgcctccagctttgttcttttggcttaggattgatttggtgatgtgggttcttttttggtttccatatgaactttaaagtagttttttccaattctgtgaagaaagtcattggtagcttgatggggatggcatttaatctgtaaattaccttggacagtatggccattttcacgatatggattcttcctacccatgagcatggaatgttcttccacttgtttgtatcctcttttatttccttgagcagtggtttgtagttctccttgaagaggtccttcacatcccttgtcagttggattcctaggtattttattctctttgaagcaattgtgaatgggagttcactcatgatttggctctctgtttgtctgtttttggtgtataggaatgcttgtgatttttgtacattgattttgtatcctgagactttgctgaagtttcttatcagcttaaggagattttgggctgagacagtggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgcccgttttcaaagggaatgcttccagtttttgcccattcagtatgatattggctgtgggtttctcatagatagctcttattattttgagatacatcccatcaatacctaatttattgagactttttagcatgaagcgttgttgaattttgtcaaaggccttttctgcatctattgagataatcatgtggtttttgtcattggttctgtttatatggtggattacatttattgatttgcatatactgaaccagacttgcatcccagggatgaagcccacttgatcatggtggataagctttttgatgtgctgttggattcagtttgccagtattttattgaggatttttgtatcaatgttcatcaaggatattggtctaaaattctcttttttggttgtgtctctgcccggctttggtatcaggatgatgctggcttcataaaatgagttagggaggattccctctttttctattgattggaatagtttcagaaggaatggtaccagttcctccttgtacctctggaacaattcggctgtgaatccatctggtcctggactctttttggatggtaagctactgattattgccacaatttcagctcctgttattggtctattcagagattcaacttcttcctggtttagttttgggagagtgtatgtgtcgaggaatgtatccatttcttctagattttctagtttatttgtgtagaggtgtttgcagtattctctgatggtagtttgtatttctgtgggatcagtggtgatatcccctttattgttttttattgcatctacttgattcttctctcttttttttctttattagtcttgctagcagtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattcgggtatgttgtctctttgttctcgttggtttcaaagaacatctttatttctgccttcatttctttatgtacccagtagtcgttcaggagcaggttgctcagtttccatgtagttgagcggttttgagtgagattcttaatcctgagttctagtttgattgcactgtggtctgaaagacagtttgttataatttttgttcttttacatttgctgaggagtgctttacttccaactatgtggtcaattttggaataggtgtggtgttgcactgaaaaaaaaatgtatattctgttgattaggggtggagagttctgtagatgtctattaggtctgcttggtgcagagctgagttcaatcctgggtatccttgttgactttctgtctcgttgatctgtctaatgttgacagtggggtgttaaagtctctcattattaatgtgtgggagtctaagtctctttgtaggtcactcaggacttgctttatgaatctgggtgctcctgtattgggtgcatatatatttagaatagttagctcttcttgttgaattgatcccttcgccattatgtaatggccttctttgtctcttttgatctttgttggtttaaagtctgttttatcagagactaggattgcaacccctgcctttttttgttttccatttgcttggtagatcttcctccttcctttattttgagcctatgtgtgtctctgcacatgagatgggtttcctgaatacagcacactgatgggtcttgactctttatccaatttgccagtctgtgtcttttaattggagcatttagtccatttacattttaagttaatattgttatgtgtgaatttgatcctgtcatgatgttagctggttattttgcttgttagttcctgcagtttcttcctagtctcgatggtctttacattttggcatgattttgcagcggctggtatcggttgttcctttccatgtttagtgcttccttcaggagctcttttagggcaggcctggtggtgacaaaatctctcagcatttgcttgtttgtaaagtattttatttctccttcacttatgaagcctagtttggctggatatgaaattctgggttgaaaattcttttctttaagaatgttgaatattggtccccactctcttctggcttgtagagtttctgccgagagatccactgttagtctgatgggcttccctttgtgagtaacccgacctttctctctggctgcccttaacattttttccttcatttcaactttagtgaatctgacaattatgtgtcttggagttgctcttctcgaggagtatctttgtggcgttctctgtatttctgaatctgaatgttggcctgccttgctagattggggaagttctcctggatgatatcctgcagagtgttttccaacttggttccattctccccgtcactttcaggtacaccaatcagacgtagattcggtcttttcacatagtcccatatttttggaggctttgctcctttctttttattcttttttctctaaacttcccttctcgcttcatttcattcatttcatcatccatcgctgataccctttcttccagttgatcacatcggctcctgaggcttctgcattcttcacgtagttctcaagccttggttttcagctccatcagctcctttaagcacttctctgtattggttattcgagttatacattcttctaaacttttttcaaagttttcaacttctttgactttggtttgaatttcctcccatagctcggagcaatttgattgtctgaagccttcttctctcagctcgtcaaagtcattctccgtccagctttgttccattgctggtgaggaactgcattcctttggaggaggagaggcaccctgctttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgctggtctgttggagtacccggccctgtgaggtgtcagtctgcccctgctggggggttcctcccagttaggctgcttgggggtcaggggtcagggacccacttgaggaggcagtctgcccgttctcagatctccagctgcatgctgggagaaccactgctctcttcaaagctcagatggaaatgcagaaatcacccgtcttctgcatcgctcatgctgggagctgtagaccagagctgttcctattcggccatcttggctcctcccctccaaaaattttaaaattagtttaaaagaggaggcactgtttccatgcttaacttttaaaaaataaattatcagtgacaacttaattattattaagttaacttggccttgaaatatgatgatgcaaggttttggtttctacaagtcctaaaagtccagacttgcaaatatttgggaataaaaatagatgcggttaggaacataaacatggtgagaaaggtcgaacattagcctacaacatatcattttttcttaaagtattaacgtttctttctattttactagccaaattaaatacaaagagagggtaggtttgtcatataagaactcccatagaaaatgaaaagcatcttctatgctgctgcgaaggaaactgtgcttcattaaggttctcagataggtacccagatgagttgccctccgtgaatttgttactgagaaaagaaataaaaagaatattaaaccaaaagcaaaaataaaatattttcctttagtctcctagtagcaaactgccacatccattcataaacaaatgcctttcttgtgcataaactagacagaaaattcaatagcattctaaactacattataagtcatactgatttgaatactgcaatttaatactttctgagaaaaaagtgcctaaaatctagatgaggtctgaagcaaggacgtatttggagtctccaggtagacagtggttaagaaataaacaaactttactacctctgtttttcttttcagaaaagcaagaagcccccaaggagtacagtgggagtaattctgtctgtggcagtttagaatcatccagaagcctaacgttttacaataaaagatgactccctcgcctttattgataaatggctataattttccactggacaccctgaatcggctaccctgtcagaacagggaaaaaaaagctctctaactctgaactagaggtgtaattctgaaatgtgagactttagtgtgcaacaataacgtattttctatgaacctttgacatgaaagagttttagagaaatataaagctggcaggtatgtacaaatagcaagcacttggataaactcagcaattttatcataaaggacaaaataataatgagttaaggaaacaatctgaaacacaatggcaggaaatgtagtaaaaaatgaacttcaaagaaagctatcatgtgacacacaatccattgaagctactagaatgcctagtgtttcctcaactttagaataaggaatatggtgacaaggcttattcagccacacgcttcacacagacaaaaattacacactctatcttttaaagaacatctgtcacactatagacaaagtaactatttgataaatatgtatgagtaaaaatgcttatcttactttttaggtaaatcacgtgttactggacctgttggttattgtccctctctatgccatgatgctcctcaaatagttcagttacttctctgtattttcaggaataacctgttgatttattcattgtcttttctcctgataagtttatatctaatctatttttaaactactataatagtgtgaatattagtaattgcattgcttttaagattcaagtcattgatattttaaaatttctattttattttattttattttattttattttattttatttttttgagacagagtctcactctgtggcccaggctggagtgcagtgatgcaatcttggctaactgcaacctctgcctcctgggttcaagcgattctcctgcctcagccttctgagtagctaaaattacatgtgtgcactaaaactcccagctaatttttgtatttttagtagagacagggttttgccatgttagccagcttgtcttgaactcctgatctcaatcgatccacctgccttggcctccacagtaatgggattacaggtgtgagccgctgcacctggccttgatgttttaaaatttcaatagttaaaaatgtgttctaataagtgtaatcactttggaatttggatgttactacttcactgtcatgcatcaatattgtcagctaataagcattcattgaagtatcattttgtgcattcagtgagaagaagaaagtgatattaatttaatttaaaatatatttccaagacagtgttgatattgaataaataataatgaactgaaatgaataaacgggaaaacatctgagtctgcggataaattggatatttaatagtgccatcatatacacagtatcaatacttctatgtttctgcccaatgaatccttttgacttagatcccaatgaaaatataacctttttatcctaaatagaagcaggataataccaagccagtggacaaaacatgatcctctaataaaatagacagacgtttaagcctatatagacagagtttatatgggatacacagagcttcagcctgtggcagctactttgtttatatttaaaaaaagcaaactggtcatagaagatgaaggaataccaatgaaatcacagtggtatttggttaggttgtgtgcttatttggaaaagcttggtgagggaagaggtataaatggaaatgatgtgcccattggatcattcttaagatactctttgaggctcacataccacatgatcacacaaaggtgacgaagtaattcttagagtaattaatacaaggggcaatcaaaattttaacattttagaggaagcagtagtgcttaacaaggtaacaatagaatgtgtgtaagtttaactttggacaaaggaactgagataaattaaaaatgagaactctgaaaagaaggaaacataaaagtataaaatattaaaatagaagaatctcaatcaaacatacaataattatcttagccatttataatatcaaataacttggagacagttacctatttggactccaggtaaggtaatttatttcaccaatcattcaatgagagaaagtagaatttgtaacaatatttcaatacctaatattaaaaacagatgcataggtctttatatttaaagtaaattttaagtagccaaatgaaaatctattcaacaaattacattcattgcaaaagtttgaagggtaattctcactaaaaataccttgtctaagagacatgaaggacctcttcagggagaactataaaccactgctcaaggaaataagagagggcacaaaaaaaaaaaaaaagaaaaacattccatcctcctggataggaagaatcagtatcgtgaaaatggccatactgcccaaagtaatatatagattcaatgcaattcccatcaaactaccactgaaattcttcacagaattaaaaaaaaaaactactttaaaatttatatggaagtaaaaaagagcccatacagccaagacaatcctaagcaaaaagaacaaagctggagacatcacactacctgacttcaaactatactaaaaggctacaataaccaaaagggtatggtactggtaccaaaacagacttatagaccaatggaacagaacagagatctcagaaataacaccacacatctacaaccatctgatcctcgacaaacctgaaaaaaacaagtaatgggaaaaaatatttcctatttaataaattgtactgagaaaactggctagccatatgcagaaaactgaaaatgaactcctgccttacaccttatgcaaaaattatctcaagatggattaaagaaataaatatatatataaataaaaaaaaaacctaagaagaaaaccagggcaataccatttagaacataagcatgagctaagattttatgatgaaaacgccaaaagcaattgcaacaaaagctaaaattgacaaatagggtctaattaaactgaagagcttctgcacagcaaaacaacaacaacaacaaaaagtcattagagaaaacaggcagccttcagaatgggagaaaatttttgcaatctacccatctgacaaaggtctaatatccagaatctacaaggaacttaaatgaatttccacaaaaaaaaaaacccaacaacgccaccaaaaatgggcaaaattctccttgaagaggtctttcacatcccttgtaagttgtattctaaggtattttattctcttcatagcaattgtgaatgggagttcactcatgatttggctctctgtttttctattattggtgtacaggaatacttgtgatttttacacactaattttgtatcctgacactttgctgaagttgcttatcagcttaaggagattttaggctgagatgatggggttttctaaatatacaatcatgtcatctgcaaacagagacaatttgacttcctctcttcctatttgaatactgtttatttatttctcttgtctgattgccttggccagaacttccaatactatgtcgaataggagtggtgagagagggcatctttgtcttgcgccagttttgaaaggcaattcttggagcttttgcccattcagtatgatattgactatgagtttgtcataaatagctcttactattttgagatacattgcatcaatacctagtttattgagagtttttagcatgaatcggtgttgaattttatcgaaggcctttcctgcatatattggaataatcatgtcatttttgtcattggttctgtttatgtgatggaatacattgattgatgtgcatatgttgaaccagctttgcatcagaaggatgaagctgacttgagtgtggtgaataagcttttggatgtgctgctggatttggtttgccagtattttattgaggctttttgcatcgatgttcatcagggatattggcctgaaattttctcattctactataaagacatatgcacacgtatgtttattgtagcactattcacaatagcaaagacttggaaccaacccagacgctcatcaatgatagactggataaagaaaatgtggcacatatacaacacagaatactatgaagccataaaaaagtatgagttcatttcctttgcaaggacatggatgaagctggaaaccatcattctcagcaaactaacacaggaacagaaaaccaaacaccacatgttctcactcataagtgggagttgaacaatgagaacacatggacacagggaggggaacatcacacactggtgcctgttgtgggattggggggctagggaaggggtagcattaggagaaacagctaagtgtggatgatgggtttatgggtgcagcaaaccaccacggcactggtatacctatttaacaaacctgcatgttctgcacatgcatcccagaacttaaagtataatttttaaaaaagtgggcataatatatggacacttctaaaaaaatcatacagctaacaaacatggaaaaaagatcaacatcactgatcactagagaaacgcaaatcaataccacaatgagataccatctcatgccaggcagaacggcaattattaaaaagtcaacaaatgagagatgctggcaaggctgtggagaaatagaaaagcttttacactgttggagggaatgtaatttagttcaaccattgtggataaaagtgtggtgattcctcaaggacctagaaccagaaataccattcgacccagcaatcccatttctgggtgtatacccaaaggaatataaatcattctactatagagacatatgcacatatatatttattgcagcaccattcacaatagcaaagacatggaaccgacccaaatggccatcagtgatagactgggtaaagaacatgtgccatatatacaccatggaatgctaggcagctataaaaagaaatgagatcacgtccttttcagaaacatggatgaagctgaaaaccatcatcctcagcatactaacgcaggaacagaaaaccaaataccacatgttctcacttataagtgggagttcaacagtgagaatacatggacacagggaggggaccaacacacaccggggcctgtgggggttgaggagggaagggagagcatcaggacaaatagttaatgcatgtggggcttaaaacctaggtgacgaattgattgattcagcaaactactatggcacatgcatacctatgtaataaacctgcatgctttgcacatgtatgctggtactcaaagtaaaataaaaattaaaaaaaaccttatctattcccttagctgttatctaattatatgtttttttaaacaaatctattcaagttaatttccaattttttaatcagattatctttatttttctgagttgtaggtattccaatatattttaaatattagccccttaccagatatatagtttgcaaatattttatcttgctgtataggttgcctttttatatttttggttgattgcttcctttgctgtgcagaagctttttagtttgacgtagtcccacttgtatatttttattttggttgcttgtgctttttgttttatacccgataaacctgctaagaccaatgccatgaacttttcctctatgttttcttctagaaaattttttgcttcaggtcgtttgtttaagtctttaatctactttaggttcatttttgagtatggtttaagggacaaatttcattttttctcatgtggtttatctatgttgctagatataacaggatttatttatttatttattttttaatttattcttatttttttaacctccagaatacatgtgcagaacatgcaggttttttacataggtatatgcatgttatggtggtttgctgcacctatcaacctgtcatctaggttttaagccccacattccccacatgcattagctatttgtcctgatgctctcccttccctactccccccacccaggacccagtgtgtgttgatcccctccctgcgtccatgtgttctcactgttgaactcccacttataagtgagaacatgcagtatttggttttctgttcctgtgttagtttgctgaggatgatggctcccagttttatccatggtgtgcgaaggacatgatctcattcctttttatggctgcctagtattccatgatgtatatgtatcacatgttctttatccagtctatcattgatgagcatttgggttggttccatgtctttgctattgtaaatagtgctgcaataaatagacatgtgcatgtatctttatagtagaatgctttatattcctttgcgcatatccacagtaatgagattgccaattgtcaaattgccattgtcaaatggtatttctggttctaggtccttgaggaatcaccacactgtcttccgtgatggttgaagtaatttacattccctccaacagtataaaagcttttctgtttctccacagccttgccagcatctgttgtttcttgactttttaataattgccattctgactggcgtgagatggtatcacattgtggttttgatttgcatttctctagccatcaatgatgttgagcattttttcatatgtttgttatccacatggatgtcttttttttaagaagtgtctgttcatgtattttgcccaatttttggtggggttgtttgttttttcttgtaaatttgtttaagttccttgtagattctggatgttagaccttcatcagatgggtagatttcaaaaattttctcccattctgtagtttgcctgttttctctgatgatagtttctttgctgtgctgaagctctttagtttaagacgaaagagggcatcctcatcttgtgttggttttcacagggaatggttccaccttttgcacatgcagtatggtattggctgtcataaatatctcttactattttgagatgtttcgtcaatacctagtttactgagagtttttaccatgaagggatgttgaattttatcaaagaccttttctacatctattgagatagtcatgtgttttttatcattggttctgtttatgagatgaattacgattagcaatttgcatatgttgaaccagccttgcctcccatggagaaagctgatttgattgtggtgaataagctttttgatgtgctgctggatttggtttgccagtattttatagaggattttcacattgatgttgatcagggatattagcttgaggttattgttttttgttgtgtctttgccaggtttaggtaccaggatgatgttggcctcataaaatgaattagggaagagtccatccttttcgattgtttgaaatagtttctgaaggaatggtactagctcctctttgtacctctggtagaattggctgtgaatccatctggtcctgggctttttttgttggtaggctatttatcatttcctaaatttcagaacttgttatttgtctattcagggattcaactttttttctggtctagtcttcaactttttttctgggctataaggatgtatgtttgcaggaatttatccatttcttctagatttttctagtttatttgtgtagagttgtttatagtattctctgatggtagttggtatttctgtgtggtcagtggtgatatcccctttatcagtttttgtgtctatttgattcttctctcttttcttctttactattctagctagcagtctattttatatttttttcaaaaaactagctcctggattcattattttttgaaaagttttttgtgtctctatctccttcagttcacttctgatcttaattatttcttctcttctgctagcttttggatttgtttgttcttgcttctttagttttttaaattgtaatgtcagggtgttaatttgagatctttctagctttctgatgtggacatttaatgttataaatttctctcgtaatactgctttagctgcatccccagagatcctggtgcattgtctgtttcatttgtttcaaataatttctcgatttctgccttgatttcattatttacccaggactcattcaagagcaggttgttcaattttcatgtagttttgtggtttttagtgagtttcttaatcctgagttctaatttaattgcactgtggtctgagagactgtttgttgtaatttcagttcttttgcatttgctgaggagtgtttcacttccaattatgtggtcaatgttagagtaggtgccatgtggcactgaacaaatgtatattctgttgtttgaaggtggagagttctgtagatatcttttaggtccacttgatccagagctgagttcaagttttggatatccttgtaaattttctgtcttgttgatttgtctaatattgacagtggggtgttaaagtctcccacctttaattgcgtgggagtataactctctgtgtaggtctctaagaacttgttctatagatctgagtgctcctggattgtatgcatatatatttatgatagttagctcttcttgttgcattgatccctttaccattatgtaatgtgattctttgtcttttttatctttgttggtttaaagtttgttttgtcagagagtaggattgcaacccctgcttttttctgctttccatttccttggtaaatattcttttttttttaataggtaaaagaaaaagtaatgattttataggtaaaataaaagattataatctacttaaatatttccatctgagaaaagataatcctaggaagagagatgttaggcatttgctgaatcagtaaaaattgttaaaatctaataaaataattgtattttaatgtactttcgagcatatcaaattataatctagaaataatggaaataagtgcctttgggattttaatttttatgtacaagtgaaggccacagaagtgactcttcctttattattttttttatatccaccacatcaaggcacctctttttctttttccttttttttaaaaatttattattattatactttaagttttagggtacatgtgcacaatgtgcaggttagttacatatgtatacatgtgccatgctggtgtgctgcacccattaactcgtcatttagcattaggtatatctcctaaagctatccctcccccctccccccaccccacaacaggctccagagtgtgatgttccccttcctgtgtccatgtgttctcattgttcaattcccacctatgagtgagaatatgcggtgtttggttttttgttcttgcgatagtttactgacaatgatgatttccaatttcatccatgtccctacaaaggacatgaactcatcattttttatggctgcatagtattccatggtgtatatgtgccacattttcttaatccagtctatcattgttggccatttgggttggttccaagtctttgctattgtgaatagtggtgcaataaacatacgtgtgcatgtgtctttatagcagcatgatttatagtcctttgggcatatacctagtaatgggatggctgggtcaaatggtatttctagttctagatccctgaggaatcgccatactgacttccacaatggttgaactggtttacagtcccaccaacagtgtaaaaatgttcctgttgctccacatcctctccagcacctgttgtttcctgactttttaatgattgccattctaactggtgtgagatggtatctcattgtgattttgatttgcatttctctgatagccagtgatggtgagcattttttcttgtgttttttggctgcataaatgtcttcttttgagaagtgtctgttcatatcctttgcccactttttgatggggttgtttgtttttttcttgtaattgtttgagttcattgtagattctggatattagccctttgtcagatgagtaggttgcaaaaattttctcccattttttaggttgcctgttcactctgatggtagtttcttttgctgtgcagaagctctttaatttaatgagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatctatcttgaatgaatttttgtataaggtgtaaggaagggatccattttcagctttctacttatggctagccagttttcccagtaccatttattaaatagggaatcctttccccattacttgtttttctcagatttgtcaaagatcagatagttgtagatatgtggcgttatttctgaggtctctgttctgttccattgatctatatctctgttttggtaccagtaccatcctgttttggttactgtagccttgtagtatagtttgaagtaaggtagcgtgatgcctccagctttgttcttttgccttaggattgacttcgtgatgtgggctcttttttggttccatacgaactttaaggtagttttttccaactctgtgaagaaagtcattggttttgacaaaattcaacaacccttcatgctaaaaactctcaataaattaggtattgatggaacgtatctcaaaataataagagctatgtatgacaaacccacagccagtatcatactgaatgggcaaaaactggaagcattccctttgaaaactggcacaagacagggataccctctctcaccactcctattcaacatattattggaagttctggccagggcaattaggcaggagaaggaaataaagggtattcgattaggaaaagaggaagtcaaattgtccctgtttgcagatgacatgattgtatatctagaaaaccccattgtctcagcccaaaatctccttaatctgataagcaacttcagcaaagtctcaggatacaaaacaacgtacaaaaatcacaagcattcttatacaccaacaacagacaaacagagagccaaatcatgagtgaactcccattcacaattgcttcaaagagaataaaatacctaggaatccaacttacaagggacgtgaaggacctcttcaaggagaactacaaaccactactcaatgaattaatagaggatacaaatgaatggaagaacattccctactcatgcacaggaagaatccatatcgtgaaaatggccatactgcccaaggtaatttatagattcaatgccatccccatcaagctaccatttccttggtaaatattcttccatgtctttactttgagcctgtgtgtgtctttgtgcgtgggatggatctcttgaatacagtataccaataggtcttgactctatccactttgccagtctgtgtcttttaattggggcatttagcccatttacgtttatggttaatattgttatgtgtgaatctgatcctgtcatcttgaggctagcttgttattttgcacacttgttcatgccgttttttccatagtgtcatttgcctttatattttcatgtgtttttcagtggctggtactgtttattcctctccatatttagtgcttccttcaggagctctacaaggtagacctgtttatgatgaattccttcagcatttgcttttttgaaaaggattttatttctccttcatttatgaagcttagtttggctggatatgaaattctgggttgaaaatttcttctttaagagtgttaaatattggccctcactctcttctggcttgtagggtttctgctgagagatgtgctgttagtctgatgagcttctttttgtaggtgacctggtctttctctctggctgcccttaacattttttttccttcattttaaccttagtgaatctgatgattatgtgtcttggaattgatattctcgtggagtatcttagtggtgttttctgtatttttttaatttgaatattggcctgccttgctaggttaggtaagttcttctggataatatcatgaaatgtgtttctcaacttggttctattctctccatttccttcaggtactacaatgagtcatagcataggttcagtctttttacagagttccatattgctcagaggttttgtttgttccttttcattcttcttcctctagtcttttctgcctgacttatttcagaaagatgatcttcaaactctaatatccattcttctgcttgattgattcagctattgatagttatacatgcttcactaagttttcatgctgtgtttttcagctccaccaggtcatttgcgttcctctctaaactggttgttctacttagcagcacctctaaccttttatcaaagttcttaggttctttgttctgggttagaacatgttcctttacctcagcaaagttttttattacccaccttgtgaagcctacttctgtcaatttgtctgtctcatcctctgtcctgttttgcgcccttgctggagaggtgttatcatcatttggaggagaagaggcactctggccttttgtgttttcaacatttttttattattgattctttcttgtgtttatgagtttgtctagtttcaatctttgaggctgatgactctttgatgaggtttttgtggggactttttttttgatgctgctgttgttgctttctgtttgtttgtttttatttcagtagtcagatccctcttctgtagggctgctgcagtttgctgggggttcacttcaggccctattcatctggttcactcccgtgcctgtagatgtctcttgaggaggctggagaacagcaaagatgggtgcctgcttcttcctctatgatctctgacctcgaggggcattgacctgatgtcagtagtgacactactgcataggatgtctgacaacccctgttggggggatctcacacagttgggtggcatgggaagcaggacccattcaataaagcactttggctgttcattggtggagggggtgtgctgtgctgtggggaaaatccactcttttgggctccccagattcctcagagctagcaggaggaaagactaagtctgctggtccatggagactatggccttccttctcccaaggggctcaggcccagggaaatctgagttctgtccctgagctcctggctggagttggggttccttcagggaggccctgcagttccaatgttggctctcatcccttcccctgggaactcggcaggcttaggccaattctacccaagcgaaaatctgtgcggctctgtggttaggactcaaggccccagtggtgtgggctcatgagtgggagcttccaatccatgggttgcacagttccatgaaaaaagcatggttttccaggctgagtagcatgctcactcactgcctctcttggctgggggtgggggctcccctgccctgtgtagctctcaggtaagccacagcactacactgttcttccttcctctccgtggttcacactagctgcctagtcatcctaatgacagaacctggatactttggttaccagtgcaggatttgcacactgttttggaatttttcgatgggaacctctgatcactgctgcttctattcagccatcttcaccccattcccaggccttctttattttttaaggctatgagatattccatcatatgtatataccatattttctttttccattgatcatcagtagaaatttaagttgttttcatatcttattattgtgaataattctgcaatgaacataggagagaagatatttctttgagatcctgacttcaattattttggatatacacccagaagtagcattgctggatcctaagttacttctattcttaattttttgaggaagctccactgtattccacagtggttgaactaatttacactcccaccaagagtgtaaaagcattcctatttctccacctcctctccagcatctgttgtttcctgactttttaaagatcgccattctcactggtgtcagatggttatctcattgtggttttgatttgcatttctctaatgaccagtgatgatgagatttttttcatatgtttgttggctgcataaatgtcttcttttgagaagtgtctgttcatatcctttgcccaatttttaatggggatgtttgtttttttcttgtaaatttgtttaagttctttgtagattctggatattagccctttgtcagatggatagattgcaaaaattttctcccattctgtaggttgcctgttcactctgatggtagtttcttttgctgtacagaagctctttagtttaattagatcccatttgtcaattttggcttttgttgccattacttttggtgttttagacatgaagtccttgcccatgcctgtgtcctgaatggtaatacctaggttaatggattaatggaataggacagatgtctttataagaagaagaagagacctgagctagcatgctgaaacccccactatgtggtgccctgtacaatctcaggactctgcaaagcccctaccatgaaaaaggctcttaccagatgcagccctttgaccttggacttctaaagcttcacaactatataataaatatatttattttctttataaattatccagccactattattctaagtgaagtaactcagtaatggaaaacaaaacatcgtatgttctcactcatatgtgggaactaagctatgaggacacaaaggcataataatgatacattggactttattgcctaggttttcttctagggtttttataaacaaatgaaaatattatgtaccaagaagaagagaatattttgaaattgtacattttctattgcctaagatttatgcagacactatttgcagtatttttttacaaaatgaatgactttattttaatgagaaaattatattacttcctaaaaatgaaatacaatgcttggggcttagtctttatagctggtgtaaaaataaaatgttcctgaaaaataatttaagttataaagaattatgcaaatttaaataattcagagctgttacatccaaattatgggaagacagatgaataatagaaaattcttgtggaagtgcataaacctaaatcccctccctgcacttcctatattctactggagccataggaactgtggtaagccactgggaaaaactggaagaaactcatgatagtgccacaattgggaccttttaaataataaacattggtgtgggagcaactatgtgtaagagatgttggggtgcagaaggaagtaacaaaccattcttaagatggatgaagacttagaatgaaactatgtgagtaaatcactgatcttgcaattagaaatggggcttggagaaattatccagataattttggatattatttagacattataataattatttacttactatatgttaatgtccatgaattggactgggctgccactactatattattcatgtaattctacactattcctgttaatactggcagtattggaaagtgtagtagtttgtgctgagaagccttcctttcttcttatttctgaatataatgttgttccctataaaccacaaccccaaggtcagactttctcgagctgaattttataaaactggagaacaatgagaacttgagaactcatcatctactactacttgtcaatacaaaactacccatgagatttcaacaggcatacccatctgagatctgagatgccacatgagacttcaataggtaaagaacaatacaatccatttacaaagtggggcaagaaacttttgcttatgtcaagaaacacagactctacagcctgatatacaggttttatttcattctatacaattaattaacctatgagctttggaaaattacttaatatgttagtattttattttttaacatgtaaaatataaattgcaatatatacttgatggatcatactttgaaaattcaatgaaatagtttatgtattaagcccttagagaaataagtacataaaaaatatatgtgttagctatggtgatatcctagcaagacatttgaattataatttttttaagccaaggcctctaaatggaaatgataaaatacattcaggaaaggggagtaggatatcatcagacttatcataagcaatattgaatatatattaaaaataagattagactattgaaaaaagattggaaatataaataagatacattatttaatcatttgagtaacatggcagaataaggggctcttgactacccctcctgctgcaatcacatcaataaacacctacaaatggatcagtactctctagagaaagccaaaatccagttgaaatttttttagtcacccagcctcctacacactggatgactaaaaaaatatccacataagaaggatagaaaaggtggagatacacctatgcactaacgtcaccctgagcacagagctttatactccactcagaaagaaaactccactttgagacttcttcctgaggggtaaggggcttatatttcactgatagtgtacaagttttacagtcctttccagaaagtttggctctttaattattgtgcataaaaaaaaaactttctggcttttttttatgaggatcataaaaaaaagtgaagacaggctaagaaacttatgggacaccatcaaatggaataatgtacacattatcagagtaccagaagcagatagaaagagaaagaaacagaaaatatattcaaagaaataatagaagaaaacttcccaaatttggagaaagaattagaaatgcatatccagaaagctgaacatacacctaataggatgaatctaaagagatctacaccaagacacattattatcaaattgtcaaaaatttaagacaaaaaaaggaatattaaaaacttcaaggggagggaaacacgttacaaacaagggaaccataaatctatctgcagattttgcaacagaaacttaacaggccagaggtagtggcataatatattcaaaaagatgaaaaaaaaaaactgtaaatctagaatactatacccggcaatcacatcctccaacagtgaaagacagataaaaactttcccagacaaaaaaaaagttgagagaacttataaccatacttatcttacaagagtgctggaagagtcttcaaagtgaagaaaaatatcactaaagagcaacaggaaaatgtacaaaaatgtaaaactcactggtaaaagaagtatatagtaaaactcaaaacacttgtaatggtgtgtgaaaattatatcttcagcatacaattaaaaataaaactattaaaaacaactatagctacaataatttgctaagggccagaaactatagaaaataaataaatatgtcatcaaaaacaaattgttgtgtggggagtaaaagtgcagtttttgcaagtgattaaagttaagtagttatcaacttaaatcactattattagtataagatgttatatgtaactctcatggtaatcatagagcaaaaacccttagaaggtacgtaaaagatagaaagaaaaaaatcaaagcataccagtacagaaaatcatcaaaccgcaaaggaaaacaggaagagagaaagaaaggaacaaaggatctataaattaaccagaaaacaattaacaaaatgatcatagtaggtctttacctatcaatacttactttaaatgtaaacagattaaattattcaatcagaaaactttgaatgactaaatgaataaaaaagaaagactcaaccctatgatgtctacaagagatgcactttacctctaaggacacacatagactaaaataatgggatggaaaaatatattctatgtgtatcattcagggttctccggagggacagaactaacagaatatatgtacatatgaaagggagtttattagtgagaactggctcacataatcacaaggtgaagtcccaggatagacgttctgcaagctggagaagaaagaagccagtagtggctcagcctgagtccaaaagcctcaaaagcagcgaagctgacagcgcagccttcagtctgtggctgaaggctcaagagcccccagaaaaccactggtgcaagtccaagagtccaaaggctaagtaacctgatataatgtccaagggtaggaggaatgtagggaaacatacagccattccaccttctactgtctgttttgtgctagccacactggcagctgattggatagtacccaccacatcgatggtgggtcttcctctactagtccactgactcaattatcagtctcctctggcaacaccctcacagacacacccagtgacaatgctttaccagctatctaggcatcctgcaatccaatcaagttgacacttaatattaatcatcacactgtacaagttgaaaccaaagagaatgggggtagctatacttatataaggcaaataaactttatttcaaaaactgtgaaaagagacaaaacgtcattatttaataataaagagattaatcaagtagttttaaaaaatagcaagcatgtatgaacctaacataggagaatccaaatatataaagcaaacattaatagatctaaaggagagctagactgcaatacattatagttgggaacttcaacactccattttcaacactgaaaagatcacctagatagaaagctcacaagaaaacattaaatttcatctgcacgttacaccaaatgaatctaacaggcatttaaagagcaatccacccaataatgatagaattgcttggacaatgcaattattctcaagggcatgcacagcattctccaggatagataatacgttagactacaagacaagtcttaaaatatttaagcagtttaaaattatatcaagtgtcttttctgattgtgaggccatgaaactagaaatcaataatagaaggaattttgaaaagctcacaaatatacggaaattaaacaggtataactaatggatcaaagcaaaaattatgaggagaattttaaaaatattctgaccacaaacaatgataaaacaataatataccaaaacttatgaaatgcggcaaaagcgattctgaggttatatcagtgaatatttagattaaacaataagaaagatctcatataaacaacctaatgttatacctcacagaattaacaaataaaataacataggcctacatttagcagaaaaaagaaaattacaatgatagggttataaataaacaaaatagagattagaaaagcagtaaatctataacatggtttttaaaaaaacagaagcaaaatcaacaacatttgttggactaacaaagtaaaaaagagacaaggtgcaataaaaacaagaaacaaaagaggggacattacaactgataccacaaaaatacaaaggatcataaaagaatattataagcgactgtacagtaacaaattgggtaatagaaaagaaattcataaattcctagaaacatgcaactcaccaagattaaatcagtaataaacagaaaatccgaacagacctatgaacagtaatgagatcgaatcagtagtagaaagtctctgatcaaagaaaagcccaagatctgataacttcactgctgaattctgccaaacatttaaataactaatacccattcttctcaaacccttctaaaataataaagaggaggaaatacttccactctttttatgaagccagacttatcttgagatcaaagccagacaaggacactacaagagaataaaactacatgccaatattcctaaagaatatagatttaaaaatcctcagtaaaatgctggttaactgatttcaacagcacattaaaaagatcattcgccacaatcaagtggtatttatcccagggatgtgaagatagttcaacacacataaatctataaatgggattcactatattaatatgaagggtgaaagtcatgtgattatatagatgcaaaaaagtatttgaagaaattcaacaatccttcatgataaaaaaacctttcaatgaactagatatagaaaaggtacatacatagactggatttcaacacaataaaggccatataagacaagcctgaagctaacatcatactgaacagtgaaaagtggaaaacttttcctgtaagattagaaacaagaaaaggatgcccactttccccactttaattcaacatagtactagaagtgctaaccagaacaattaggcaagaaaaataaattaaaaataattatacaggaaaggaagaagtaatattttctttgctgagtgataacatgatcttatacacagaaaagctggaagactccccaaaatactgctataaatgatttttaaaatcagtaaagtttcaggtgactaaatcaacttacaaaagtcagtagaatttttatacagtaagaatatactattcagaaaagaaattaataaaacaacctcattttcatagcttcaaacatatttaatattatagtaaaattagccaagaaagtgaaagatctgtccagtgaaaactataaaatattcataaaagaaataaaagaagacacgaataaatgacagacatgccatatttcatggaccaaaataatattgttaaaatgtccatactacaaacagatctatagattcaattcaatatctgtcagtatgctaatgtcactttttacagatagaggaaacaattctaaaatttgtgtggaactagaagccaatccaaatagccaaagcaatcttgagcaaaaagaacaaagctggaggcatcataattcctgattacaaaatgtattatgaagctatagacatcaaactctcatggtacttgcataagagtagatacatcaaccaaagaaaaaagataaaaccctcagaaataaaccctagtatttatggttaattgatttttgacaaatgtgtcaacacatgatgacgaaagtttattcagtacataatgttaagaaaattggatatccatatcagaagaatgaaattgaacccttatctcacaccatacacaaaaatcaactcaaaataagtaaaaaccttcaatgtgagacttgaaactgtaagctactaggagaaacataggagaaaagttccatgtcattgatctgggcaattattttttggatgggactctaaaagcactagcaacagaagcaaaaataaagtgggattacatcaaacttaaaagcttctgcatagctaaggaagcaatcaataaaacaaaaagacaacctatgaaacaggagaaaatatttgcaaaccccttacattagaacccatatatctgaagagggtctaatatcaaaaatatataaataactcaaacaactcaatagcaagaaaacaaataacctgattgaaaaatgggccaaagatctgaaaagacattactcaaaagaaaagatataaatggctagcagatatatgaaaaaaagttcatctgtaattttcagaaaatgcaaattaaaaccacaacatgagagcacttcacacttgttagaatggccattatcaaaacaaaacaaacaaacaaacaaaacagggaaaacaaatgttagcaagaatgtggagaaaaggaaacctatgtgtgtttttggtctgataaattagtaaagccatttggtgcagctgctatggaaaacagtatgagggatcctcagaaaactaaaaatagaattaccatatgacccagcaattccacttctggctatatatccaaagaaatttaaatcagtatatcccagcaatatctgcactcccatgtttatttcagcattattctcattagccacttccattatggaagccacctaattatctgtcaaaagataaatagctaaagaaattgtggtagatatactactctgacttaatagagaaggaaataggaaattcagacatttacaacatggatggaactgtagaaagttatgcttcatgaaataagcccaggcacagaaaaataaatagtatataatctcacctatatgtgaaatctaaaaaagtttatctcatagaaacagagagtcaaaaagtagtaaccagaggctagggggatggggcagtatggggtaagaggagatgttgatcaaagggtacaatattttagttagattgaaggaatattttttactgatccattgcattgcatggtgaccacagttaataataatataaatttcaaaattgctgaaataatagattttcaacatcttgactcccaaagggctaagtcattgaggagatagatgaaacatcatactgtaccccataaatatacataattattatttgtcaattaaaaataattttaagagtacattatttaactgacatcattcaaagagggtaaaatacatatttagacatacatatttacagaaaaaagcatacgtgtaatatttctgagaataatttcaataaaatgttttaaaaaatcattttgaaaaaggagattctagaaatggtaaaaaataaagtctataaacaatatgaaagaaatagcagtatattgtaaaaaatgttcatattaaaatgctgatgaaatgtaaactttaacatatgttatagaaatagatttcaatgtattttcctagatgcatacaataaacacacaagacaaggcaataatagcaaaaacagaaacaaaatatcttgatgaggttgaagttggaagttaagatccattgggaaggcaggtaatcacgttttaactttgattcatcagtaaacgattaagattttaattgataaagactagcaccatcaactaacagttaccaggtgcaacttctctaattcaccatgtggtttatgccacggccactctaaacttgacccagccctaagggattagggagcccattaataggaaactttcttttgagattcaccaatggcttttttgagacattctcagaactcagaatcaatgaaaacttgagaaagcagtatcaaaacatttatggaatgtcagcatcaggtaatggcacttttaagagctagacctagagcaactcaactgcagggcccccaaaagtcaaaatctgagaagaaataatctaattgctaaacgtgcctatgatgtacagccctagatctaatacacatcaccaaatcaatcagaaattcctggaataaagcccctggcagaactaatgagaggattatgttatggtatctattatacatataattgtaactcatgcatagcaagttttattaatgggagaataattttttattattactatttatgtttttaagaaggttttagataaaatatgctaacataagatatggaattatttctgaatttatcttaaagagatgagttgctaaggctgtgactatactcttacaaatgggaattttcaggggaaggatagatgtagaagcataataagctggctgaatattgaatgaggttatggctactaccatgcacatcctcctctgatgatcataaattgaactttacagatttcctgagaaatgaacagaagcagcaagcagaagtcaagtaatggtcttggtgaaaaatagatttctaactttgtaattgtcacccctatatcctacccaatggagaatgtctgaatcaacctcctttaggcacaaacataagaaaaaacatgagtaagataaaaacacatgcacacgtatgtttattgcggcattattcacgataacaaagacttgaaaccaacccaaatgtccaacactgatagactggattaagaaaatatggcacatatacaccatagaatactatgcagccataaaaaatgatgagttcatgtccttttgagggacatggatgaaattggaaatcatcattgtcagtaaactatcgcaagaacaaaaaaccaaacaccgcatattctcactcataggtgggaattgaagaatgagatcacatggacacaggaaggggaatatcacactctggggactgttgtggggtggggggaggggggagggatagcattgggagatatatctaatgctagatgaccagttagtgggtgcagcgcaccagcatggcacatgtatacatatgtaactaacctgcacaatgtgcacatgtaccctaaaacttaaagtataataataataattaaaaaaaagaaaaaacatgagggtctaacagttcatgtcatttactttgtttccttatttgtccagtgtcacaatacatatgcatttttattattgctaatttttttattatactttgacttttaggctacatgtgcacaatgttgaagttagttgcatatgtatacatgtgccatgttggtgtgctgcacccattaactcatcatttaacattaggtagatgtcctaatgctatccctcacccctctccccacgccacagcaggccatggtgtgtaatgttccccttctggtgtccatgtgttctcattgttcaattcccacctatgagtgagaacatgcagtgtttggtttttcgtccttgcgatagtttgctgagaatgatggtatccagcttcatccatgtccctacaaaggacatgaactcagcattttttatggcagcatagtattccatagtgtatatgtgccacattttcttaatccagtctatcattgttgcacatttgggttggttccaagtctttgctattgtgaatagtgccacaataaacatacgtgtgcatgtgtatttatagtagcatgatttatagtcatttgggtatatacccagtaatgggatggctgggtcaaatggtatttctagttctagatccctgaggaatcgccacactgacttccccaatggttgaactagtttacagtcccaccaacagtgtaaaagtgttcctatttccccatatcctctccagcaccggttgtttcctgactttttaatgatcaccattctaacaggtgtgagatggtatctcattgtggttttgatttgcatttctttgatggccagtgatgatgagcattttttcatgtgtccattggctgcataaatgtcttcttttgagaagtgtctgttcatatccttcgcccactttttgatggggttgtttgtttttttcttgtaaatgtgattgagttcattgtggattctggatattagccctttgtcagatgagtaggttgcaaaaattttctcccattctgtaggttgcctgttcactctgatagtagtttcctttgctgtgcagaagttctttagtttaatgagatcccatttgtcaattttggcttttgttgccattgcttttggtgttttagacaagaagtccttgcccatgcctatgtcctgaaaggtaatgcctaggttttcttctagggtttttatggttttaggtctaacatgtaagtctttaatccatcttgaattaattttcatataatgtgtaaggaagggacccagtttcagctttctacatatggctagccagttttcccagcaccatttattaaataaggaatcatttccccattttttgtttttgtcaggtttgtcaaaggtcagatggttgtagatatgcggcattatttctgagggctctgttctgttcctttggtctagatctctgttttggtaccagtaccatgctgttttggttactgtagccttgtagtatagtttgaagtcaggtagtgtgatgcctccagctttgttcttttggcttaggattgacttggcaatgcaggctcttttttggttccatatgaacttgaaattagttttttccaattctgtgcagaaagtcattggtagcttgatggggatggcattgaatctacaaattactttgggcagaatggccattttcacgatattgattcttcctacccatgagcatggaatgttcttccatttcttccatttgtttgtatcctcttttatttcattgaacagtggtttgtagttctccttgaagaggtccttcacatcccttgtcagttggattcctaggtattttattctctttgaagcaattgtgaatgggagttcactcatgatttggctgtttgtctgctactggtgtatgagaatgcttgtgatttttgcacattgattttgtatcctgagatttgctgaagttgcctatcagcttaaggacgtttggggctgagatgatgggattttctagatatacagtcatgtcatctgcaaacagggacaatttgacttcctcttttcctaattgaatactctttatttccttctcctgcctgattgctgtggccaaaacttccaacactatgttgaataggagtggtgagagagggcatctctgtcttgtgccagttttcaaagggaatgcttccagtttttgcccattcagtatgatactggctgtgggtttgtcagagatagcttttattattttgacatacgtcccatcaatacctaatttattgagagtttttagcatgaagcgttgttgaattttgtcaaaggccttttctgcatctattgagataatcatgtggtttttgtcattggttctttgtatatgctggattatgtttattgatttgcatatgttgagccagccttgcatcccagggatgaagcccagttgatcatggtggataagctttttgatgtgctgctggattcggtttgccagtattttattgcagatttttgcattgatgttcatcagggatattggtctacaattttctttttttgttgtgtctctgtcaggctttggtatcaggatgatgctggcctcataaaatgagttagggaggattccttgtttttctgttgattggaatagtttcagaaggaatggtaccagtttctccttgtacctctggtagaattcggctgtgaatccatctggtcctagactttttttggttggtaagctattaattattgtctcaatttcagagcctgttattggtctattcagagattcaacttcttcctggtttagtcttgggagggtgcctgtgttaaggaatgtatccatttcttctagattttccagtttatttgcgtagagttgtttattgtattctctgatggtagtttgtatttctgtgggatcggtggtgatatcccctttatcattttttatggcgtctattcgattcttctctcttttcttctttattagtcttgctagtggtctatcaattttgttgatcttttcaaaaaagcagctcctggattcattgattttttaaacggttttttgtgtctctatttcctttagttctgctctgatcttaggtatttcttgccttctgctagcttttcaatgtgtttgcacttgcttctctagttcttttaattgtgatgttagggtgtcaattttggatctttcctgctttctcttgtgggcatttagtgctataaattgccctctacacactgctttgaatgtgtcccagagattctgatatgttgtgtctttgttctcattggtttcaaagaacatctttatttctgccttcatttcgttatgtacccagtagtcattcaggagcagattgttcagtttccatgtagttgagcagttttgagtgagtttcttaatcctcagttctagtttgattgcactgtgatctgagagacagtttgttataatttctgttcttttacatttgctaaggagagctttacttccaactatgtggtcaattttggaattagtgtggtgtggtgctgagaagaatgtacattctgttgatttgggctggagtgttctgtagatatctattatgtccacctggtgcagagctgagttgaattcctggatatccttgtaactttccatctcgatgatctatctaacattgacagtggggtgttaaagtctccctttattattgtgtgcgagtctaagtctctttgtagatctctaaggacttgctttatgaatctggttgctcctgtgttgggtgcatatatgtttaggatagttagctcttcttgttgaattgatccctttaccattatgtaatggccttctttgtctcttttgatctttgttggtttaaagtctgttttatcagagactaggattgcaacccctgccttttttgttttccatttgtttggtagatcttcttccatccctttagtttgagcctatgtgtgtctctgcatgtgagatgggtttcctgaatacagcacactgatgggtcttgagtctttatccaatttgccagtctttgtcttttaattggaacatttagcccatttacatttaaggttaatattgttatgtgtgaatttgatcctttcattatgatgttagctggttattttgctcgttagttaatgcagtttcttcctggcctggatggtctttacaatttggcatggttttgcagtggctggaaccggttgttcctttccatggttagtgcttccttcaggagctcttttagggcaggcctggtggtgacaaaatctctcagcatttgcttgtctgtagaggattttatttctccttcacttatgaagcttagtttggctggatatattgctaattttttaaagccagcgtgtttgaagtttctgttccagttaatgggcatagatgcattgaaaacaactaagacagaataaactttcattcctttacttggcttagaagtcaggtgcaatggttaatagaaaagtttcttgcaaaactgggcaatgggtaaagtttgatgttattacactttttaaaaaacctgaatcttcccttcctatctcctgttatctccagggagctgatcaactcattttatccacagtgaaaattctccctgtactgttctcagaggggattacctcaaaattgcacaattgttacaaccactgatccaatgccctgaggacccagatttcagttacctgctccaggaaattatcagatgaaccatactgagaccatggctaataccattgttacgtaaattctgtttctgataactattacaatgaatgagtatggagttagttttctaccaagtaaatagagcatgctcattatttaaattgaaagaacaaacaatgtacaaaagagattattttgttgaagaaggcaaaaaaacccagctgctctattaacattttgggctattcccgctttggattttttgttgtcttttttgctgtccttgagactatgctttcattttctcctcttggtttgtttttcaaatgtatcattctgtatataatatatagtttggatactttccacatgaaaagtggttaagggaaattattttcatagtataacttctggaatacattgctgtttaaaacttgatttttattaattatatatttccttcaatatttcaaacatctttaatatggtagagagcatagtgaatataaagtttgtgttcatttaatgtaatttgtattgaaaaatacaagagaacataatatgtatgtgtgtgtagtcaaaggataattatgaaatgaaatggtaggtaagcacaatcacatcacatgatcaccctgcctgattacatctctctcactgtctctagggttaaccagtgtatttacgtttgttatgaactttgccttgatttttaatagtttttctaaataataaaaaatagtttggtttttgcccattttaaacattatataaatataaaattatgttttcttttgtgactttttaccttgttttttcttgatatatccatttgtgagatttacctagtttaattcacataactatatttggtaatttttatatacaaattagtatcctgttatataaatatgccactatgtatgcatctacttgcattattctcagtaacaacacttcaaggtcaatggaaaggtcagagtttccatggatgtcaagtagtaagcagcaccaagggggtaacacactcccctgctatacatttcattgattttccttcaatatgctaatgactaagtataagcaactgtgaaaaaaaaattagatagcatagattacttggtacaagtgttgaatgattgaattttcctctctctctcgtgctccccctccccctccccttccccctctttctccttctccttctccttcttcttcttcttcttctctttctcacctctgtttctgcctgaattactgctcagccctggtcactgcaccaaatgaccactgcttgtggatgtaaacaaaagaggtcatcttatcaatgtttggcagtccacagccaactccacactttttgactcagggagtaggtgtttggtgttaattagtagggttaatttatatgccatttgaaagtgtactagatacttcaagtggacctatcattttattagtttatgttgcatcaaccatattctgattgattatgctcaatgtgttatacatcccttgcataactattacatgagtggtttgcataacatactagctatgaaacttttcaaaaatatatttcagaaacttctggtaccttccaaaacatgtgtattacaattttctataaccttgaagcaactatttttaaaataacaaattgctttccagcaagtaaaaatgcctctgagaaagccaattttaatctcagtgaacatatttatactcatatattaaattgtaggatgaggcatacttggtaagcttcatttgacacgtaatagaccattccagtcgttgatcattgtttcaattcaggtcttctgagaagcaaacaccagcaggggattaaaagtacaagagatttcctaggggcaaccctgttaagaatccactgaagagattgaaagtagggggaagtcttcatgctacattgcaggtctgacaacagtttaaggaagaattgggcaagaagaatccagattactgcacagttttaagagagttttgatcagaatagtggggagtccccaagtcaaaatttctcagtaaaggagctccatgtcctacagaaatgagccagcattgataccttgccatgctcagtcattggctaacaacagcctggggaatatgtggtctggttgtgaacattatggtgatttcataagagtggccactgggctgttaactatgctccctgcagccagttctcttgttgaagattgagcagcacatttcaattgctgccaccacttatccccacaaatgtgcttttcattaggaagtatctcaggaaagggaggctcaagggaatcaagtatccattccttcttacaatggggcaaggtagcactgagagacacccagtgaacagtgagatttcaccaataatcctttttgttttccctgtataaaagcaggcataacttctcctgctgaactgggtcacttactcttgcttagatgataacactgtttcttgcctgttggtccctagaccaaaaatatatctgaaggacattggcaatagctacaccatgtacatcaatggcaatgtttctgtgttccctttgaggagatctgagtttcagggtcaaataacacagtttcccagttgatcattgagaatcttgttaagtgaggccagcactcttcttgctaattggtacttggattctttctactgatatatggcataatatacacatcttgagtttaatgtatctactatattctgaaagcatctcatcctttcagaatattgcctctaaggaggtgctttacctgtgcctctactaaggtgtttagcactttactaggctagcagcttccagatggtgtgttatataatacaatcggtagatcatatgattaagggtctattcctgtatcttcttctctgtgtagtggggcccctggtgaaatgttgtattatgtggtgccatgaagtaaacattttaagaagctcttacagacactgacttaggctctttcggcaggaaaggcaaaatcatgcccaagagaagtatctaaactactgaactttataggacaggaagagtttaaaattgttgtctagttaacaattgaccagttgcttcttgaggaatgatgttatgttttgggcttactgttggtttctgtacctggcagttgactattcagagataatattagctatatgatctcagtaaatgggagtcagtgttacggagcccacaaataccttccgtatctgccactgtggctacttcatacatgtgccattatgcctgatcttatataaccaatgaagaaaagctaatgctaactgaccaagtcattttgtagacctgaagtttgagtgtgttttcagatgcatactttctggtgagcattaacatataaatacaatatcttcataatttatgcctactccaaatgtctgttcacatgcctgtactcttccttgtctctgatcctccagtcgttttccttcccagtctcctgccattaaccactttccagaatctatacctattgttacctctgaccacttcttccatacagagtagattactaggtacaccacttgccgctttatccactaagaaacttctccatcttaattatcttataatgccacccataaatgtaacagtaatgtagctgcctttatttttttgtcttgtatgtaagctgactcaacaacaaagcaggacaggtatggtggctcacacctgtaatctcagcactttgggaggctgaggtgggtggatcgcctgaggtcaggagtttgagaccggcctggccaacgtggtgaaacgacgtttctactaaaaatacaaaaaattagctgggcatggtggcatgtgactgtaatcccagctacttgggatgctgaggcaggagaatcacttgaacctggaaggcagaggttgcagtgagccgagattgtgccaccacactccagcctgggcaacaagaacaaaactcagtctccaaaaaaataaaaataaaaataataaaataaaattaaattaaatacaataacaaagcaatctcagaattatcctcttttttctgctggtcatatgttactccacatacaaaggtacaaacagaagaaagtaaaaccatggtgggtgccatgggtttctgggctaccaataacctatgtctgtagctcactcataacttctggtttggtttgtcctcaaacctatatttatagactgtttctaagcccttccaagtaagtaggtcccaacttggtagatctaacagaatcatgctaaaaagaaaaagatctgaatacaggccatttggtttcctctggttaagataattcttaatggcttagggtaagcatatcattatttactgcagatgaaatgatgttgtccccaaacaccaaataattaaagtgtaattcctctacagcagagaatgtggttcgtgctatggacttgccattgaatcctttcatcttttgtcaattctgacacgataaggtctacgaatagtatgtaccaagtggtgggactggttgcgtggcagcctcaatttgttgtagagttttcctagcctaggttctttttacatatagccacttttgccatctgatatattcctaggtgtggactctgatgtttccagaatccaaagaagtctacaggactgatatggtttggctgtgtccccacccaaatctcaaattgtagctcccataatttccacatgtcatgggaggcaccaggtgggaggtaactgaatcatgagagcaggtctttcctgtgctcttctcatgacagtgaataagcctcacatgatctgatgattttataaaggggagttcccctggacatgctctctcttgcctgctgccatgcaagacataactttgctcctcctttgccttccaccgtgattgtgaggcctcctcagccatgtggaactgtgaatcaattaaacctctttcttttaaaaattacccagtctcaggtatgtctttattagcagcatgagaacagactaatacaaggatactgcttattgcttctttgtgaatgatattataatatgagatgaagtgatatgtcttttagtttggtggggaatatcctggaatgcttttcagcactgaatagacaaccattttctgaattggtaggtactcaaaacttcatagggttaatctctcacctgctgaaatacattcatcttactaaagcttccagtacattaaccgtctcttggttgcctaatctagttagtcagatgtgcttaatgtagtaggtcaatgttatggtttgtatttcacaccacccagcactgacataccatgaaccaaacatctgttgtgatatagcttaacctggaaggaagtcagggattcttgcacagagaaaataacatcttctgcaacaggcaaagactcacagtcattgacagagtagaacaaacttttcatgtagatcagaaggacagaagatgcagcatgggtggaaaccggttttatttgagagataaatgaagattgccctgacccaaataacaatcctacacttcttttacagtacctttaacttctaccaacagagattgtttatattgtaaacaatgtctaagaacctcctgttaaattacaaatatctctaaaagagaaaatgtactattccattgtcaacttctaataaaatagattaagcaattgcttctcaaaagatttgtcagggttttaagaggagcagccatgcatttggggatagtaatgagaaagaaacaaatttatttcaactctcttctttaaattttactatgtgatttctcattacccaaaacaaaataaagtagttatccttggcatggaatataaaatcatccctaatctaggccttgctaacctgggcattctttttatcacctgttttccatttatatatcattttagccacatcaaatttttattatttccattgtctcaagacatcctctgtcagttaactaaactctactcattattcaatacgtaagtgagggcttacttctgtgaagtctttcatgcttgtcttccctcaaacttttcctcaggcttgattaggtgagtttcctatgagctcccataatatactacaaatttatctctttatatttgtcttgttaatgttcagattatatatatatttctcccaataaaatgaaaggtagaggcattgccaagtgaccttgatatattgagccataaagacagtggcagcacataataggtgctcaacaaacaagtagatagatgattaaattaccacagatccaggggacctctcatgatgaacagacatcaaacagacaccacaatgagtgttctttggactacataagaaatggtaaacctaaaatattgctttcatcagattttttactgagagtcacccttataaaacaaaattatttactctgatgcatatactgtatactccccaagtgcatgaagttagctctggaggtgtcttataagttacttttataaatcaccagagaaaagattgtgaaataataactaagtgtttggggaatttgcaataagccctaatgcatacagagagtaaactaagtggtatgcatcattaaaaaataaaaatattttcttcttcatattttaaaccctttaactgcatttaaatatttaaagcttagactcttcagaggaaatgaaagcaccgtggatgtctctggagggatgcttccatccagtgctcctgagctaatgtcaatatttacatgttttaaaagtcatctgtaaatggcaggaattcttcatcctgaaatagtttggttctggttcagcctaacaagctacagatgtttataacagaatccacatcctgcaaacccttttaacttataatgcaatttatcttgcctcaaagtcacttacgtaaaacttgactaccattttccacatattttgctttttaaaaaataattgagataatgactgttaaatgcctactttattggagacagtatactggagctaactatgcattgtctccaatctttgcccctagttaagtatgctatttgtatacttaacttagataagggaactaatgtttagaaaggataagtgactaattcaaggagtagctgcaaatattttaggatatagggttgtagaaagaaacttttcaggacatccaattgtttaaacctatactaaaagttaactgagtatttgcaagcataattattaaaaacaaagtaaaaaaggcctaaaaatgaacatacacaatcccagtagaaaagagtatgaggtaagaatgcatagaggggacaaatgaaattcatataaaaatattacattgtataaattataaatttctccatagtttatgcatttattccagaatatgtggaaatatttattatactgactctaatacatgtataacatatgtgtaaatatgcatacaaaatacaaaagaatcaaaattacattcaagattataaggacagaagaaaaatgtccaggttaatagaaacctcataacatgttcctacttatttagattagttttatttaattatgttttaaattatataaatgtcaggttactagttggtgaagattgttagaaacaatttgcaaatcagatataaagcagagagggaagaaggcacagaagaaaaagttaagaaagagaaggttgagaagacagataaggagactgattattaatcaactttgcagattttaaattaaatatgtaaaaatattttcaaccatatatggataaattagactatggtgcagaggcttatttaaattactttaatttcaataatatcaacaaattttatttgacctcttcatcataaaatgcaagttgcatcatgccattccaaaggaagaaaaggaaatgcacttattatctttcattctaaatgaagaaaacagaaatgcatttatgaccgcaaataagtttctcaggcagataaaacaagtggtatgttctaccttgccccatcttattttattgtctctcattgatcattgaaagacttgaggttttgatcacttatctcaaatcagattattattttctgaaatataattactgtaatttattatttattgccatcttgttgtgtaattcagagcatgatagaatgctattggagcagtatctcctaggttaatctactctacaatactcacacttaaaaatttaaaaagaaataaaaatactgtaaaagaaaatgtttatgtacatgtgtaacagaaacaaaactcactatcaatttaatgacacattttactaataaggttgaggaaaaattaaatatttcaatgtgttttaaataaaatgttacctctttaaagaagtactatataaaatttaaatgtgaagaatgttattggtgttttatttttaaataaattacaaacatatttattaattggtctatgcctttaggggactcatttagaagctaggtatcatcaaataattgaatctgcaacaggattgggaaaaaatagatcaaaattaagaagataactcagtaatttcctggccaagaattagaaagcttcacatatttataagaaatcagaatacctatttacaggggaaaggaatgtagttaagtaaatttgacaccagtgtaatatttttctccactttgtctttaaagtatatctatataaattagagtgtacttggactgaataactttttgagtttcttccagttaggtgattgctagacatgacagtatttcttttcactcaccatagtaccagaataatattgacttaaaaatctagtcattcatggatatacacctgagtctgaagggtcaatggtttataaaagagcctgtgtctgtcctggcatggttctgaacatttggcaggatttattcaaaaaggttcgagaggcatttctggcagaaacatacagcgatgcttactttcactgttcttggctctagctggtgctatttagccatcattttatgaaaacgtgaacacaaagctcagtcatgccttttagagtggagaaaaagagctaagctaaaaataggccatcatttcattgagctgcagtcacgcagtcttacctggtgtgcatttgttgctaactggccaactcccccaaagtagatagtggagttttcttggcctatcctttcatgtgcagatatgattcagactatgaagttttatttaattctaagtgctatagagcaaaaatttgccttgtaacaagatagtgaatcttgatcaactctagctgtggaatagtttaccgatatctaagaataaagagagaaaaatgtgtttcctccttaaaaatataatatccaacattgttgaatttgtctttttataactaatttagttctaacacatcgaatagaaaaggttctttacaagagcatggcctagggcctaggtgctcaattagtatttttcaattaaatttgactttgatttcatagtaaaaaaaaatgttgataaattttaaagactataatcatactttttgcaactaaacaaataaataataatccatcctgtttctaatagttaacatacttttggaaatgaggtttggtagatctacaaaaatatttcatattattttatctttaatatgtttcaatgcttgcaccaattattaaagttagaacaacaaatatacaaataaaatatttaaaagtgattatattgcaaatacagtattttaaaatctattttaatacaaaatattacaaaatgatttacaactttttcattaacacagtgacagataaaaattcaacattcttttatctccaattctgcaattctatcatattatagtggccaataatgaacattacagatatattctctcagatatttttctttgttcaaaaacgtacttaaaaaatatttttaatatgttatttttctttgctttttttgttttaaacagtcatatgtcttttattttactttttttttcgtgttgtcaaatgtgattttttgtttgtttgtctttgtttttttaaatttcagtagcttttggagtacaagtggtttttggttacatggaagaattgtatagtggtgaagtctgagatttcagcgcacccatcatctaagtagcatacattgtacccaatatgtacttttttctttttatctctcaccactcttccccaacttgttccccttctatctgagtctccaatgtccattacaccataccgtttgcctttgtgtatctttaacttagttcccacttataagtgagaacatatgatattagtttttctattccattacttcattcttttttataactgagtagtatttcatagtgtatacatactacattttctttatccactcatcagttgataggcacttaggttggttctgtatctttgcaattgtgaattgtgctgcaataaacatatgtgtgcagatgtctttttgatatggcttttttcctttgggtagatacccattagtgtgattcctatatcaaatagtagatctacttctagttctttgagaaatctccatactgctttccacaaaggttgtagtaatttatattcctaccagcagtgtataaatatttccttttcaccccatccacacaaacgtctattgttttttgactttttaataatggccattttggctgaagtaaggtgacatctcattgtggttttaatttgcatttatctgatgatttgtttgttggccaattgtatatcttattttgaaaagtgtctattcatatcatttgcccactatttggtgggattatgttttcttgctgatgtcacctgagtaatatgccttttgcacaatgtgtatttttttattcctcccctcatctcccactctcctcctttctgagtctccaatgttcgttataccatttagggtctattatagattgtgggttccttatagattctgaatattagtcctttgttggattcatagtttgtaaatattttctcccattctgtgggttttctgttcactttgatgattgtttcttttgctgtgcagaagcttttagtttaattaggtctcatttatttatttttgtttttgttgcatttgtttttggggtattagtcaaaatgctttgcctcagcaatattgagaagagtttttcctaggttttcttctataatttttatgttttcgggtcttagatttaattctttaatccatcttgagttgatttttgtacctgatgagaaatagggatccaagttcattcttctatatgtggctatccagttttcgaagcatcatataccgaatagggtgttatttcctcagtttatgtttctgtatgttttgtcgaagatcaattggttgtaagcatttgactttattactgggttctgtattccattccattggtctatgtatctacttttataacagtaccatgctcttttggttaccatacccttgtagtataatttgaagtcagataatgtaatgcctccagatttttgtctttttgcttagaatttctttagccacttgggtgcttttttggttccatgtgcattttagaattggtttttctcaatctgtgaagaatgatgttggcactttgatagggattgcattgaatctgtagattgctttgagcaatatgtatcactctatactatataattaagagaggtagaattttattcatattgtaaaccttgttcctttccaagttgtcctggatttaattatttatattactacaagatatttcaaccataaaaatggaattttgttcgctagaaactttctggattgtatcaaatctgcaactttctggagtctattaaatttctgctgaaagagtatgaaaatgtatattctaaataagtaggaaaacttatttcttattatgactgcctcatgtttttgataattcatgatactgtcatattttttttccagatctttagagtgaaaatgttatcccattgatatatttttattattattattattattattattattatactttaagttttagggtacatgtgcacaatgtgcaggttagttacatatgtatacatgtgccatgctgctgtgctgcacccattaactcgtcatttagcgttaggtatatctcctaatgctatccctcccccctcccaccacctccaacagtccccagagtgtgatgttccccttcctgtgtcaatgtgtcctcattgttcaattcccacctatgagtgagaacatgcggtgtttggttttttgttcttgcaatagtttactgagaatgatgatttccaatttcatccatgtccctacaaaggacatgaactcataatttttatggctgcatagtattccatggtgtataggtgccacattttcttaatccggtctatcattgttggacatttggcttggttccaagtctttgctactgtgaatagtggtgcaataaacatacgtgtgcatgtgtctttctagcagcatgatttatagttcttttggtatatactcagtaatgggatggctgggtcaaatggtgtttctagttctagatccctgaggaatcgccacactgacttccacaatggttgaactagtttacagtcccaccaacagtgtaaaagtggtcttatttctccacatcctctccagcacctgttgattcctgactttttaatgattgccattctaacaggtgtgagatggtatctcattgtggttttgatttgcatttctctgatggccagtgatgatgaacatttttcacgtgttttttggctgcataaatgtcttcttttgagaagtgtctgttcatgtcctttgctcactttttgatggggttgtttgtttttttcttgtaaacttgtttgagttcattgtagattctcgatattagccctttgtcagatgagtagattgcaaaaattttctcccattttttaggttgcctgttcactctgatggtagtttctttgctgtgcagaagctctttagtttaatgaaatcccatttgtcaattgtggtttttgttgccattgcttttggtgttttagacatgaagtccttgcccatgcctatgtactgaatggtaatgcctaggttttcttctagggtttttatggttttaggtctaatgtttaagtctttaatccatcttgaattaatttttgtataaggtgtaaggaagggatccagtttcagctttctacatatggctagccagttttcccagcaccatttattaaataaggaatcctttccccattgcttgtttttctcaggtttgtcaaagatcagatagttgtagctatgcggtgttatttctgagggctctgttctgttccattgatctatatctctgttttggtaccagtaccatgctgttttggtgactgtagccttgtagtatagtttgaagtcaggtagcgtgataccaccagctttgttcttttggcttaggattgacttggcaatgtgggctcttttttggttccatatgaactttaaagtagttttttccaattctgtgcagaaagtcattggtagcttgatggggatggcattgaatctataaattatcttgggcagtatggccattttcatgatattgattcctcctacccatgagcatggaatgttcttccatttgtttgtattctcttttatttcattgagcagtggtttgtaattctccttgaagaggtccttcacgtcccttgtaagttggattcctaggtattttattctctttgaagcaattgtgaatgggagttcactcatgatttggctctctgtgtgtctgttattggtgtataagaatgcttgtgatttttgtacattgattttgtgtcctgagactttgctgaagttgcttatcagcttaaggagattttgggctgagacaatggggttttctagatatacaatcatgtcatttgcaaacagggacaatttgacttcctcttttcctaatcgaataccctttatttccttctcctgcctaattgccctggccagaacttccaacactatgttgaataggagtggtgagagagggcatccctgtcttgtgcccgttttcaaagggaatgcttccagtttttgcccattcagtatgatattggctgtgggtttgtcatagatagctcttattattttgagatacgtcccatcaatacctaatttattgagactttttagcatgaagggttgttgaattttgtcaaaaggctttttctgcatctgttgagataatcgtgtggtttttgtctttcgttctgtttatatgctggattacgtttattgatttgcgtatgttgaaccagacttgcatcccagagatgaagcccacttgatcatggtggataagctttttgatgtgctgctggattcggtttgccaggagtttattgaggatttttgcatcaatgttcatcaaggatattggtctaaaattctctttttttgttgtgtctctgccaggctttggtatcaggatgatgctggcctcctaaaatgagttagggaggattccctctttttctattgattggaatagtttcagaaggaatggtaccagttcctccttgtacctctggaacaattcggctgtgagtccatctggtcgtggactctttttggttggtaagctattgattattgacacaatttcagagcctgttattggtctattcagagagtcaacttcttcttggtttagtcttgggagagtgtgtgtgttgaggaatttatccatttcttctagattttctagtttatttgcgtagaggtgtttatagaattctctgatggtagtttgtatttctgtgggatcagtggtgatatcccctttatcattttttagtgcatctatttgattcttctctcttttcttctttattagccttgctagtggtctatcaattttgttgatcctttcaaaaaaccagctcctggattcattaattttttgaaggattttttgtgtctctatttccttcagttctgctctgattttagttatttcttgccttctgctagcttttgaatgtgtttcctcttgcttttttagttcttttaattgtgatgttagggtgtcaattttggatctttcctgccttctcttgtcgcatttagtgctataaattgccctctacacactgctttgaatgtgtcccagagattctggtgtgttgtgtctttgttctcgttggtttcaaagaacatctttatttctgccttcatttcattatgtacccagtagtcattcaggagcaggttgttcagtttccatgtagttgagcagttttgagtgagtttcttaatcctgagttctagtttgattgcaccgtgttctgagaggcagtttgttataatttctgatcttttaccttgctgaggagagctttacttccaactatgtcgtcaattttggaataggtgtggtgtggtgctgaaaaaaatgtatattctgttgatttgtggtggagagatctgtagatgtctattaggtccgcttggtgcagaactgagttcaattcctggatatccttgttaactttctgtctcgttgatctgtctaatgttgacagtggggtgtcaaaatctcccattattattgtgtgggagtctaggtctctttgtaggtcactcaggacttgttttatgaatgtggatgctcctgtattgggtgcatatatatttaggatagttagctcttcttgttgaattgatccctttacgattatgtaatggccttctttgtctcttttgatctttgttggtttaaagtctgttttatcagagactaggattgcaacccctgccttttttttgttttccattggctttgtagatcttcctccatccttttgttttgagcctatgtgtgtctctgcacgtgagatgggtttcttgaatacagcacactgatgggtcttgactctttatccaatttgccagtctgtgtcctttaattggagaatttagtccatttacatttaaagttaatatggttatgtgtgaatttgttcctgtcattatgatgttagctggttattttgctcattagttgatgcattttcttcctagctttgatggtctttacaatttggcatgattttgcagtgggtggttccagtttttcctttccatgtttagcgcttccttcaggagcttttttagggcaggtctggcgttgacaaaatctctcagcatttgcttgtctgtaaagcattttatttctccttcacttatgaagcttagtttggctggatatgaaattcagggttgaaaattcttttctttaagaatgttgaatattggcccccactctcttctggcttgtagagtttctgccgagacatccgctgttaggctgatgggcttccctttgtgggtaacccgacctttctctctggctgcccttaacattttttcgttcatttcaactttggtgattctgacaattatgtgtcttggagttgctcttctcgaggagtaactttgtggcattctctgtatttcctgaatccccattgatattttaattggacctccgctttggtgacttgttgactcatcattttacctgctaaaaatatctactttattgactttgtgaatattacttctatctttttactttctttagtatcttgtgtgtgtgtgtgtgtgtgtgtgtgtgtatgtgtgtgtatgtgtgtagtatcgaatggaaattgtactactaaatgtccaaacaagaacttctgatatttattcccaaactgtcagctccatcttttcttttctgttccccagggccaaacttttggaatcactttttacatctcttgcatactccctcagcaaatgccatcatcactaaacttctatcactgctatcatctgattttagacagcataacttcctgcctggaatgtgacagttatctccttattggtctccttcttcagtcctttccctttatagtgtatttgcaaaatgaaataatgtcattcactgtaaaataaactcttcacatccttgtcttagtaaaaacagaatctttagtttggtctataagctgcgacatctgatgcactttccattatctgacctcatgtcctagcacttcccctggtttactcagaaacactggctttctggaagttccaatgacacactggagacacctaggctttacagccttcttgcttgtctgctcaagtccctcttcttagaatgctctttcctcaattatccacatggtttctttgtcttcttcttattattaattattattatttgctattttctgaaacattaccttcaaataaacctatatgtttatatttttaaattgcaaaataatcctcaacatcttcctgtcctattgtattttcatccacagtacttatcatcatggaatgtattatatatttcacttactttcttacttatctttattctaatactttaatcatattttatccagagttcaatatttttcttgaagtaaatcttcaattatttatcatttttggcaaacttgttttttgttcatttgaattttttccctctctcttatgatttgagcatagaattatatgatgaaagtgctttttataaaatatttttgctgatatatttttattgaatttaatgttccattgataaggtaatgattctgccaatccagtgtagtttttattgtcaatctgtatattctttcagattcagcattaaaaaaaaatcatgttttttgttgtttgttttcctaaagcttcacttcaaatgtttgtgtagactgcttttgatgtgtgctacccagtggttgatttgtatcttcaatctaaacatttatgtcttttaaaattttcgtaatattgcttctttaactttgtaatattacttctatctttttactttttatatgatctattagatatacatatatataattaaatgtattgctaggctaaacagtttatccttcatacctcttataaaacagtaaacacatttttatttagataaaacagtacagcaaaataataagtatctggctgtgtacttttcataaataagcatctcctttctctattgtagagcaatataaagaatattaccagtattaccatcccaagaatagcagcattgttttgccaagagacacagagtaggaggggtagtttcagaggcttttgcttgtcctttcacactacattgccacttaaatccatgctcatgaaatcaatgtgaaggctctgttactaccaagtatattcatccttattataaattgcaggcttggtgaaatgaccactggttaagtttattggcctagtagaccaactctgagccagaccctgacaaggattttatttgttaccttatccacatatttttctttccctaatgagaagccatggtggcattttgaatactgagtatcaattcaagtatcatatccaataattaattaatggtctggttactcttttctcccaattaacagttttctcatatactagctagagttctccagaaaaacattagcaataggatgtgtgtatatacagagacatttgtttaaagaaatcagctcatttgattatggaggttggcaagtccaaaatctgaaaagtgagttgacatgttgctgacccaggaaagagccaacattgccatttgaatactaaggctatctatcttctggcagaattctcatccctaccttattaggatgtgttttctcatttagtgaaagagttaatagtcttataactgtgtcagctacctgatccgaaatcattaatttctcttaatgacataaatttagcaatactttagttgctgtacatctgtctttcttgtaggaacaccttgtacaattaactatcccttttattaactgcaggtctcacattcatggctgccactctgattcttgctacccgctaaagtaactgcacttaccttgattgtgatatttaaacaatacaacccagattctgtaactctgagactctaccttcacagtaagtgattccaatgtaacaatatctcctactattagtcctggcatataaaccagagccactactgagcttgtgaatgatgtgggtgccatctcgacagagcattccttattgctttggtaaacagattatctttcagaaatttttgtagaacatagttggctggttgattttctggcctttctagtttaccactctatttaatttaaccttctgactttttcttttttttttttcctttttttttttttttgctactgaaatacagtatttctggaattattaattcttttggtgtaggctatcatttttttctcattcattcgactctaatgttatattaacactatttcttgtggctttttccagggtcctttctagaaaattataatttggcggttttttctttcatcactttaacaatataattccattgtcttatggctgccattattttagttgggcagtcagctattagtctaacatttcccctataaacacatcttcttttcttttttcttttcttttctttcttcttttctttctcttttctcatcttttcttcttttctctctttctctagactgtttttaatttgtttgtttttaatatccccagttctcttatttttaccttcagattttcaataatttaaatactgtcttctgttatggataatatgcttatgtttgtttgtttgtttgttttttccagctcacttattttctcttcattttcatatctggaagcagatacctaattgtattttatgataagtcttacatgttctattttttaaaaattccttcaatactataaatactttaaaactgttattttatagactctattttaataattacattatctgaagttcttggaaatctaacctttcaatttttagtgtctggtgctgctcacaatgtctataataggtaaatttctagtttcttgttttgtgtaactatcatatctctttgggcaccagctctttcttaaatgcattgattttcactttgtacttagttttgtttcccagataactttattgttagctaaactaaatttattaaaaatgaagttttatattaatacaatatccaaaatattttcatgttttagtgggaatttttttcattcagatagtcttttataacttctgagattgttttttcacaacacatcggtaattcttcatctgttttcacttcaatacatgtagtttgattaatttttttgaaaattacattgtttttcgtttttagtatactttactgtactacttctatcactcatgcagtctacatttttattttcttacttcaaatattgcaatgaaccccatttatatatctttatgaactgaaatttttatttccttataagaatctttaaagtgggattcccgaattatgggaaatagatatgatttaaacactaaataattaaatgtatattattatatttgtcttctcttgatttcagtcttatgagtttatatcatagcctcttccttccagaaagagtgtatcaatacattcatagacacagaaatggaaaaatatactgtggataacatagcttgctgaattaatcatgctgttttggaaatgacgagttaatgggtgcagcacaccaacatggcacatgtatatatatgtaacaaacctgcacgttgtgcacatgtaccctagaacttaaagtataataaaaaaagaaaaaaaagaaaacatttttaaagaaaaaaaagaaaaaaagaacaacaacaacaaaaggtaggagagaaatccactccagtaattttaagtggaccagagatttagaaatctttgtatttgttaatggattcataggtatgacaccaaagcctgatcaacaaaagaagacagagataaattatttgactttatacgaaaaaaactccatacatcaaaggacacaatcacaaaagtaaagtgacaacctaaaaaagtgggaaaaatgttggcaaatgatatatttgatgagagtacagtgtccagaatacatacagaaactcgaaactcagtaacaaaaagaaacaacctaatttaaaaataggcagaagatttgaataaacatttctccaacaccaacaatcacatgaaaagactcccaacatcattagttattaggaaatacaaattaaaacacacaatgagatgtcactttacactcactaggatagcattaataacaatattttacaaaaaaatgataataagcataaaggtgaagaacttggaacccttgcacattgtttttgggaatttataatggtgtaaccactgtagaaacagtttgatggttactcagaaagataaacatagaattaacatatgacacagaaattccactcctaggtatactcctaaaaaaaaattaaaaccaggtattcaaacaaatacaaacaaatgacaatagtagcactatttatattagccgtaaagtgaaaacaacccaaatctccatcatgaaaaaactggataaacaaaatgtggtatatctatataacgaaatattatatagctataatgagacatgaagtactgacacgttatatagtaagtgtgaaccttgaaaacgttatgcattggtaagtaacactgatatctgaagaaaaagaaaacattatggaaaatgaaagaagccagacacaaaagaccacatattgtatgactgcatttatatgaaatatgtagaacaccaaccttcatagagacaaaaacagactggcagttgcccaggcctggggtcatgtggaaggggactcactgcttaaatgagtatgagaaaccaataaaacaaaaagatgatgttttgagaatgtcaacaaaatgtattacatctagccagataaatcagaaaaaaatagagaaacacaagttactaatatcagtaatgagtgagatgatatcactacagattctacagacattaaaatggtagtaaggaaatagaacaactttatgcttataaatataacaacttacatgaaatgaacaaatcctccaaaagacacaaactaccaatagtcactcaaaaagaaatagaaaatctgcttaggttgatatctatgaaagaatttatttacactttaaaaactccaaatattaaatagtttattttcacaaaaaaataggtacagatggcttcaattttgacttgtattaaacattaaagaaaaaataaagaaattatacaaaaaatgtttaagaaaattgaataaaagagaacagtctccagctaacgtttaaggccagcattactacgatgccaaaaaataaataaataaatacactacaagaaaatattgataataaaatcctaaaaaaactttagaaaatcaaactcaacatcatgtaaaaaagataatataacatgatcaagtgttgtttatcttagaaattcaaatttaacttaataataaaacaattatgtaattcaacatattgacacaattacaaaaggaaaatcatacggtcatgccaatttatccagaaaaagcttgtgaaaacatttaacatccattcctgataaaaaccatcagcaaagtaagagcagagggttactttatcaacctgccagagagcttctttgaaaaacaccgaagctaacatcatacttaatggtgaaacaatgaatgtttcttctctaatgtcataaataagccaaggattccttttgtaccacttatattcagcattgtgctggctaatcttgtcagtgctatcacacaagaaaaattttttaagtatatacatttgaaaaaaaagaaatgagcctgttttcatgtacagacatgaccattatattaaaaaaaaatctgtggactctacaaaatgttactagaattggagaatttagcagagctgcaagagcacaatataaaatcaattctgtttctatatagtaatagcaacagacaataactcatattaaaagtaattacatttacaagagtaacacaaaatgtaaaatatttaagactctattttttttttttttaatagagtctcactctgtcacccagggtggagtgcagtggtgcgatctcagctcactgcaacctctccctctgaggttcaagtaattcttctgcctcagccctccaagtacctagaactacaggcatgaaccaccatgcctggctaaattttcttttatttttttaattttattttttgtttgtatttttaagtagagacagggttttccccatgttggccaggctagtcttgaactcctgaactcaagtgatctgctcacctaggaggactccatttttacaaaagatgtgaaatatctaaataataaaaattacaaaacactgctataagtaataaagacctaaataaatgctgacgtatacatattcatgaattggaggactctaatttgattatctaaattctcctgaggttgatctgtggatacaatgacatttcacaaaagtttttataaaatttcttaaacagattctaaaattaatatggtaaagaatacagaatagtgaaaacaactttgaaaagaaacaacaaagtagattaggattacctttattcaagatttattataaagctacaatatttaagaatgatgtgatattgatactaagagaaatgaatgaatgaacagaatcagaccatatgtgtgttgtcagctacttttaaagtacagaggcaattagttacataataaatagtctttttaaaaatattgctaaaataataggtttatgtaattagatatgaagaaaagaaagacatttgatctatgcctgacaacatatatcaaatataactcaaattcattttttaacctaaatagaaacctcagtttataagaaaaagtataaacattcatttatataaaggtgttatatgcatcttcatagcccaaaactcttaacccgatacccatctatcaatcaacagatgaatggatagactcttgtataagtacacaaaataatggtagtcagtaataaaaataataaactattgatacaacctacaaaatggatcaatcacagggtgattatgctgattgaaagaaattaggcaagagggtacatactgtatgattctatttaaataaaatagatttctaggaaatgtaaaataatccatattgacagaaaacaaatcagaagttgcctgtggtgtaagattatgggaaaggaaacacagagaggtcgcaaaggtttatgagaaatcttttggatgacatatcttcattatcttgtggtgatattttcatgggtatgtaaataggtcaatacttaccaaattttatacttttaatatgtgtaatttatgttgattatacctcagtaaaactgttaaaactgaaataaaattgatgtttggggcataaaaggctttgaactttacatttttatatgtaaagaaatataatacagttatttttatgggaaggataatgacacatgtaacacgcttgagtgttgctatgaaagttggtccaatgaggcaaattctgtgttaacacctagcacttccaaataatctatctgtagtaaatcaggtctagctttgtataacatagattgatcaatctagataggaataaattttgatgaatggacagatgaatggatggatgatagatggagagtgtgttagtcaatttaatgttactataacagaatacttcaggttgggaaattataaagaatagagatttaattggctcacaattctgttggctggaaaattcaagattgggtagctgcatctggtgagagtctcatgctgcttcaactaatggtggaaagcagaaggagagcaggcatttgcagaggtgacatggcaagcaaggaaacaaaagagaggaactgaagaagccaggctctttttaataggcagttctccattgaactaatccagtgtcttaagaatgagaactcacttacccatggtgagaggacattaatctgttcttgaggaatccacctccacaaaccaaaggacaaggcacatcgaaagtatagtaggtagatagataattgattgactgattattgatgatgtagaaatggggaaataaattataaatacctagataaataaatcaataaacaaatgtgttaggccaaccttgaggttgatatttttgagtatttacataatccagcttaaaccaaaatgtttttcaaattgttctgccatgcttataggaagaacaaccatatggatggattcttaagcacagaggcgtctcatttgcaactgataacccacaagagaaatgaaaatgtgattaagctaaccatgtacaacacttctgtttttatctttcttcacattacctttcctgcaaaaagaatattttaaaatgatgctattactttaatagcttccatctgcattctaaattttcattgtgccagttatccaattccacttatatgatgaaatttgtgggcctcatggctattttaatgtaatgccttttatactgtaattgagagaagtctccaatgaataaaataaatggtttcagagggttcttaagtcctcaacagacatcagctaaaatgttaagagtgcctccaaatcccactggtgctatattttctaaccatgaaataaatgtcattattgtaaattcccagcttttgtctaaaaatcttgtactagatcccttgagcaccagctcagttaattaattcaaacaatttcctctctaatctctaaaacattttcatatttaagacaataaatgaggtacttaaggggtccactcattgttggtcattaatatgccagggaattagaaaaatcactcttagtcttcagtgacatgaataatgtctttttttttttttttttccaatggttctgacctggacaaggttaaaagcatggtttctctgcaactgaatttaagaaaatcctattttccacttgctttggttttaatatacatccgaatactcttcctttcctttgagcaataaatttgatatgtagtgtgataggttatgccaatttaaagattaaattagttaataataacttcgaaattagtgattagttcagaagaagaataattgcattttccttgaaccagtacataaggttaatgcagttgggagtgtgatggctccagtaactttgacactaattggcgattgtgttacatgttaagataaggagtcagcgtgaataaattctcatgaggtttgcaggaagacaaagctatttgttagcaaacccgcttttcaccatgtaaaaggtttgtttaatttcataaaagggtggtctgtgaccttcaggataaaatttcatagtatttcatgtctgactctggattatcaaattgaaacaaagcacaggttcttaaaccctcagcagacatcagctttttgtttattctgtaaagcaaaattagccatctatttgtcaatataaaaataattgtttgatcttctaaaattgactatctccagaggaaaaaaaaaacatgagatgaaaagaacatcaggtgtgcaattgttcatattgctttgcatttttatagtccttacctcaaaagtcttctcattttgtgcatgtgcacacacagatccatgtaagcgtgattctgcagtggtaaagaacaatctaaagatctgggggtagtgtagcagaattatctgtagcacactgtccataagataattgaaagaaaaagaaaaaagagacaattcccataaattctagtgtagggacatacctattactagatcaatcttatctctatcaatcagaagcagcaatgtttcagctttatacaaaagattcctattatgtgtttctcatttgtaaccttttagaagtttggtcatttatattgttgaaagctaaatggttttctcatcaaaatattaaaatttgtatatctttatttgaaatatttacttaccaatattactgtgagtgataaaactttttatactgaagaacgcgtttatacaaaacagtagtataggtagatattaaaaatatttaatgtgttacaattagttactggggcattttgttttacaatattatgtcacagttttgctaaagctgtttaagattgaagtatgtatgtataaccttgcctatcttaccatagacaatatgtttttgtaactttcagggcttaaacaactgtaataatctcgttcatattttccttttttttttttttttccttttttgagaaagagtctcactctgttgcccaggctggagtgtagtggcacgatctcggctctctgcaacctctgtctcccaggttcaagggattctcctgcctcagcctcctgagcagctgggattacaggtatgtgccaccatgcctggctaatttttgtatttttagtagagacggggtttcaccatgtttgacaggctggtctggatctcctgaccttaagtgatctgcttgcctcagcctccaaagtgctgtggttacaggcgtgagccaccaggcccggccatgttttccattttcaaacaggcttttctatttaaaaaattatgtttttgacattcttttagtcattagaaatgaagacaaatgctaacatggtttcaacataaacaagaaaattattttcccaataacggaaattaaattaaatacaatcatgtgtctcttaatgatgagagaaatatattaagtgatttcaccattgtgcaagcatcatagagagttcttacacaaacctagatcattcagactcctgcacacctaggctacctagactacaaacctattcagaatgttacgatactgaatactgtaggctgtaggcaattgtaacacagtatttgtgtatctatacaaatctaaacagaaaaggtatagcaaaataatagcataaaagataaaaatggtatattgtataggacagcttcattatacccttatgggatcactgctgtatatgtggcctaaatcatctttatgtagcacatgactggatttgtaaattgaaacataagaaatccaacaagggaggtttgtaaaagaaaattagaataactttttaaaaaatgaagtatgtattttctggtcaagattctgcctaaagatttataaacaaatatttcttgaaatgttatttacatagctttagccaaaggactctacatttttagatggatggacactggactcgccatgtccgtaaagcttaaaatactccatcttgacttagagaagataaaacacatgtaaatcataaggttcctatttgcagctatgttacccagtgtgagaaacccatattttttgttatcttatttctgcttcttattccttagttcacagatttttatattctaaaaatggcaataaaaaatgaaattttctggtgtgttttttttttttttctcttgatacagagtctcactctgttgcctaggctggagtgcagtggcacaatctcagctcactgcaacctccacctcatggtttcaagtgattctccttcccctcagcctcccaggtagatgggaatactggaactcaccaccatgcctggctaatttttgtgtttttagtagagacagtgttttgccatgttggtaaagctcgaactccagggtaatcctcccacatcagcctcccaaagtgctgggattacaggcatgagccactgctccccaccaaaaaatggaattttcaaagatagtgtaagaagaaagaaataggaaagataaatacagacacaagatgacaatattttttagtggttttattgacagaaaatgtaaccagaatgtttttaacaactttttaaataataaattaataactaaactaattctctttaaatactgaatttatatgtttataattctgtatgtaattcttattacttttaaatttcaaattaattattaatgttacttgtccaaaatatgcaaatgtattagtacaaacataaatactctcactaccatgttccttaaaaccctaaccaacactttttaaataggttcactatctgcataatatagcatatatagatgtactttattcaactattattgactttgtaacttcacatatttttcaggagttgagtagccaactatccaacttatcttttgatatgatagaccctgccaaagtaaaatgtaaataggcacaatagctcatgtataataaaactataagaatttacacttttcctagtaatatgggaaaatgtttatttttccaatttttctcatatcctaacagtattagctaggattgatcatcatgttttagtttgatttggttttggttttgtccactgaatgcataaaaattatattcctttttggtggatttattttcccttttttattcactagttagatatctatcaccaaatttattgataatttgcatttcttcctttgtaaatcctcagattccttttcctcttatctatatttctaacattcattatattcagggttctcaagagaaagaaacataggagatactggagaaagagaaatttattttaagggatttgttcatgtgattggtgggggcaggcaaatctgaatctgtaagtttagggaggccagaagaatgaaaattgaaataagagttcatgttgctgtctttagtctaaaatctgcagggcaggccagctggctggaaactcaggcaggtttttgatattacagtattagggcagaattccttcttcccagagaaaccttagtttttgctcttaaggactttatctgattaaattaggcacacctacattatgtagggtcatctgctttaattatagtaaactgattataagtgttaatcatatctgcaagacaccatcatactaacatctagaatagtgtttgatcaaagcatcatagcctaaccaacttgaaacattaaattaaccatcaccatatatatatatacataaatatatatatacatagatataaatatgcataaatatatataaatatataaaaatatatatatatatatagtgtgtttgtgtgtgtgtgtgtgtgtgtgtgtgtgtattgccagttaggccctgaacccttgaattatagataacttggttgacaataagtgttaagttttcttggctaactagcacacttctaaaaataaagacggggcctgatgtgataattatacattgtatgcctgtatcaaaacatcacatataccccataagtatatatacttgtgtacccataaaaattaaaaacaaaatacaaattgaaaataaacaaaaggaaaaatgaagactaggaagttaggccttgtcctacaacatgtcaagacctgttatgaagctaatctgattaagacagtttggtaagcacagagatagatcaactgatccacggaataaaatataaagcccatgcatgtgtcgtacattaatgacatgctgggtaaattggaaatataaggacttttcaataattggaagtagaagaaattatatttcatatgaagaaaaatgatgttcgtttctacttttcactttaaggaaaatgtattaatgaaaatgaaagtcgagttataactggaagtagattctcatgatacacagttgaaaacatattattatcaacgtatacaaaaatacattcctcaaagttagaaagaagagcacaaacaactcagaagtccctggacacgagcatgattatgcatttttccaaaagggaaaaacaaatgaagcaatgctaagcatcatgtgactcacgaaaattgaatcaaaataacaaagtaacacacatacacaaattctacaatcattaacatgctcattttgtaatatggtatgtatccaatcaatttgtagaaactatttattagtgatgctgtttttgcctgctatatgtgttatacataatttccattgtattatttgtcttagtctttgtattgtatcttattccatataaatattttattttattttttatttatttatttttttgagcagcatcttgctcagtcgcccaggctggagtgcagtggctaatctctgttcactgcaacctctgcaacacaggctcaagcaattctcgtgcctccgcctcccgaatagctgggattataggcgtgcaccaccacaccaagctaatttttgtacttttagtagagatagggtttcatcacgttggccaggctggtctcaaactcctggcctcaggtaatccacccaactcagccttccaaagtgctgagattacagtactttgtgaaccaccatgcctggcctttttcactttttgagcgagcgtctcctctgttgcccaggctggagtgcaatggtgtgaacactgctcactgcagcctctatctccttgcctcaagcaatcctctcacctcagcctccaaagtatctgagactacaagtatatgccaccatggccacataattttttaagtttttttttttttctttattgacagagtcttgagttttgaggctggtcttgaaccctggactcaagcaatcctcctgctttggcctcccaaagtactgggattacagacatgagccactctgcctggcccataggaatattttaattttatatttaaatcttccaattgaggtgtccaatgtgattgagcttttttatatttcatgtagccaagatgtctatagtttgccgtcatccaatgctatgcaaataataacctaaattattcattataataaagaaaattaattaaaagccaccatgaatgtatcttattaaatggtaaatttggaaaacatattcaacaacgtctggcaacaatgtccagaataacaacttccactaatattattcaatgctgacttatgttttagataagtaaaggtatagactagtagacaaagctaagttaacttctttttgaatttttagaaaataccatttgacagatgatacaagtactattgtaaggtactattttaatgaaagctgtgttttgtcacttgggctttattgttcaaaaatactgtgactcactgagatagatcagcgggaaattccaaatatatcccagacaccagctagattgattctcttttagctagaaataaaatgtccttaaactttcattacagtgatattgaaacatgcattgccctccacaggatttctgaatattcgcaagaggcatatgttcttataatcatatatggctcataaattctgcttctgctaaactcgttcaatttagcaatcatatgccattacttttgggctattctcattctctaccacatttgcccaattgtaaaactttgccctttgttttaatttttacacacacacacacacacacacacatacacacaaacatattcacaccaccatttttaagtcaattgtgtgtacagtgtactctagtgaaagtacaatgaaaaatgcagaggtttacattacctccatttgaaatattgtacctgctgatcattacctcccgtcttctggctcgtttcctctaacaacccaatacaaccctcaaaacaaatctgcaagtgtcttagtccctaggtcctatctggttttcactgtccatgacctacttcatacatccctcgcccttctaacatcacaaggaaaatcatcatagtcactccctcacataaagccctcaaatcctttctggcttcatagtactcactgggttaaattgcaatccttgttaaacctaaaaatctaccctcgcctcctatgtacttatacagctgaacacaaatgagaaaaataagtggccttctttcgtatgaaattcatgatcagtaacttcaattggggctttacgttgttgacagttggattgcactgaattggggctttcccattttcaagttcccagttggttatttcctaatttcttaatttcatcaaaatccagcacttcttttcccattatcacatcaaactaatgacattacttcttattttactgaagaaatctcccatgattacatttttctaatttgggtccttttactttttttgtgggggaaacaacccccttgcctataaagtacatctcaatatttctcacttattcaaagagtttgctctgaaaaagtttcactttctcctgcattattattatttatggcatcactggagtattcctatatacataaaaacatggtaagcccttccaatatgaccattaacgagtagataaaatcatacttattttcttattgttaataattatacatcttagcatcctatagaaacacttcttacagaaattggaaataattacataaaattagggaaatgaagaagataaaggaagtgatttttaaccaggaaagggtttaaaaggaagtattaatccaggctttcttcaggagagcattttctaaacaatcatggaacagaaaataaaagcaagggtaggcttttcaaatcataattgtctttctgagtggaggaaagagagactgaagatcagagctgccttaaagttttgaactttctcttaggtgaagatccacagagtaaggatttgcagaaacacagcctgataaatctgtgtaagaattctcatcagttccttggctggcccctattccatgtatgcacagggcaaaattctaagaggcttatcagagaacagccactataagactggattacctaccagagatttcagaggttgtacaaaacagaagaaatattaaagttcatgtgcatctatagtagagataacctcttcacgtgcacatggtatgtttatgaaactaggtcatatcctagccataaggctagctttaacagttttcaaagaactgattttatacagaggatattctctgaccactgtgaagtataattggagctcaataacagaaaatttgctagaaaatatttgaaaattaagaaacctatatgactcatattttgaagaagaagcaaaaatgaagattacaaatactgaatcataatgaaaatacaacaggtcaagacacatggcatgcagttgaagtggtgctaaaggacatttatagctttaaatgaatatgtaagaaaataagactcgttttaaattaatgatttaataaacttctaatcgaaagatctataaaaataaaaggaattaacccaaagaaattaaaggcaggaagtaacagtaacaacaatgataaatagaagaataaataaattcaaaaatagcaaaacagagaaaccaataaaacaaagtatattctctcaaaagcttattaaaattaacatattagcctttaagaaaattaagaacaagtgtccaaaaggcatgattaagggagttaaattaaaagcaaactacagtctaggaaaagatatgaacagtccatgccaggagccctgatgtacaaaatgtaggagaagaagagaaagtgaataagtccttcctctgcctttttggtctatccagactctcaacagattgaacgatgtcgggccacattagtgaggaggaatcattactcagcatgctgattccaacattaatctcttccagaagtaccctcacaaacacagagaaataatgttttaccagatatctgggtattttatgattattaattattactattattattattgtagacagggtcttgctctgtcacccaggctggagtgcagtggcacgatcatatctcactgcagcctccacctcctgggctcaagcaatcctctctcctcagcctcctgagtagctgggattataggtatgcatcaccacacctggcttatttatttatttatttatttataatttatttttgtagtgatgggatcttgctgtgttgcccaggctggtctcaaactcctgagctcaagtgattatcccaacttaaattcccaaagtgccgagattataggtgttagccaccactttaacccagtgaggtgatccatagaattacccatgatgatatctatgaaaagatatgtacaataatgttcataacagtttcactaacagtaatttctaagttgtaaaccacccaaacattcaacagtagtagaatgggtgaataatttgtggtataatcttaaaatgtgctgttacacattgtaatgctacccagtgaaaatgagccattttatgataccatgtctaaatttttagacatatttttgagtggaaaaaaataagaatctaaagaatgtatatcatacagcactttatttttgtgtaactcaaaaataagcaaggctaattgatgatgtctgggtacgtgaccacataaatgtacacaggtaaaaatgaaacaatctacatacttaagacttgtggccttatgtatattgtatatcttctcaattaattaatttattgataccactgcttctgtagcttatgcctcagtctttccttttcatagcaaaattccataaaatacttgctgatatttgtctttaatttaatttctcttccaattttctattaaatctatcacaatcaggctgtcatgtccactgcttaagcaaactttcttatcaggcttagcaatgatcttcacattacaaaattcagtatcaattctcaatcttaatattttagcagcatttcatatagtttatcactctcaccaaatgaaggctgttaccttcttggctttgtttgtgtttcttcctatcttactgatgactactcctcctctgtctttttcttttctttttttttttttttaccaatatttcactccccgatgtaatggatgagtaccccagggcttaggtgctgcactattttctcactaaaataacttcccagttggtcatcagatcttatggcttgatgactgctgattttatatctacagctctgacctctctgttgaaatctaggctcatatgtccaattgcataatcaacattttttagacatcagatgagattttatacctcccgaactgaactgatctccaatccgcttctttcttagtattcttcctctcagttgatataaaattcgtcattccagtagttcaagccaaaatttctgaaatcatttttggcccttttctttcattttctgcatctgaagcaagatgattatctttcaaaaatagatagtatatgactgcttgttacgacctcttttctcaccaccatggttcaagttagtattatattttgcctggattgttgcaaaatacttctaactggtctttctatttctacttcttaaaaaatcacagtgcattctcaacataacactgagagagttcctattaaaatatgactaagattgctacactcctctgctcaaaacgtctcaataaatttctatctcaaatttccatgtggagtaaaaggcaagtcctcataatttagcagccccgtgtaatcccctctactcattaactctttggtatatcatattaccgctcttcctcttgttccttctggaacagccacactgtcctcatgattgtttttactctatgcacttaaccaactcacagcattcacaattactctttcttctactagaacggcctttcctctgaccatatccacacagcacactcctgcctttcttcagatcagcttttcagcatggctttcgcttaccaccaaacttacaattttaaacttttagtgtatataaacacttactatccctcttcaaagctttgtttttctctttttacacgtcatcatctaatatgctatgtattttacttatttatcagtttcctattgtactagaatgcaagttctataaaggttttttgttgatgttgtttgtttgcttgtttgagacggagtttccctcttgttgtccaggctgaagtgcaatggtgtgatctcggctcacaacaacctccacctccggggttcaagtgattctcctgcctcaacctcccaagcagctgagattacaggcatgcaccaccatgcctggctaattttgtatggctctataaagtctagaatttttattgttattattttttcaaagcattcccggaatctaaaacagtacctcaccaatattagggctcagtaaaacattttacataaataattgaataaattcagataaaatatgagatatatctattcttaaatttcacagccccatctcttttttctgcactgcagattatggtctcttctcatagtactcggactcattcttatgcctcccttcctgaggtgtttctagaattttgacttcttccactaaattgtatagaacaattcagtgcttttaattctcaaactcatatccaggcccacactgtcttagcaaaaatccatggatattctcaagagaaaaaaaaatccctttgttcaataatatccacttttctgaaaaagcagttgcttagatgttgtataaccatggcttaattcagtttctaaatatattatacatagatatatcccacccagccctgccatctgctggggtatgtgcctgtattctcaaaaggattctttattttgttattaaactaacatgttcatggaaacttatgaaaaatctttctgtagttttgggttggaagttatgatcaaggtagtatgtaaatgtatatatttattatgtggaatatgtaagagaggaagtatgctaaaagcaaaagctcagttaagacacattcacttttataagtgtgaggtatagagtatctagcttttcatttaagtaatagaagcagaaaaaggagcgatagttgctaacaagaaataaatgaattcaaatgatgactggcatcagagaggaaaatgtagagaaagaagaatcaagatgggatcagaaaagaattaaaccactcttgttttgagatcttgccttctctagagatatatttgaaccttttaaccttttaagtcataagccataaagatagcatgttaatgctagatgccatttaaaggcatcttttaagacatatccacagtacattttcataaaacatcagtttaagctctgtcagttacatctgctcctgagagatttcaccagtcatattgtattatatcacatgactgttcataaaatgattgatagtatacagacagaacacatccaaataagtaggtttcatttgaagatctttaaatgatctatgagcatttcatataggcctctaataacaagagtttatcataattttatttaacacataggttttaattcagatagttaaagaaactttcattgggttttttgtaggaaaggcaaggcagagtacagtgatgagttaaggactggctaatttgaataatttcagcggggctctaaactaaggatggttcctctttgcctggtgcctggccctgggatggttaaagcaggggaatactgctttccggggtaagggccaaatagaagaggtatggctccttctactactttgcataacaaaggcatgctcctggctgggccaatctctacaggtaaactaacctcagtagaggcagtctttccccagctagaaatgttgtttaagatgtgtaaacatactataccgaaaaacaagtgtatacaatacagaacctcaaacaaaatgtcaatatgtaatataaaatgtagctggcatatcatctgccaggtattcataacatttgtattttaaaatctatcaattacctttcatttacacttattttcatcattcacttggcaattcattacatgctaatatataaacttgcaatatcattgggtgactcttcaagacctttagtcttgtttgggaacttacaataagttgagaatgatcctattaaaagagactatgaaagttgcactataagatgtcaggtcctagtgaggagttataaatagcccgccggagaagcaaagaaatgacaggttttaatgatgaaacttcatcattaaattacctacaaaagaactaatatctaggcatgtggcaaacaggaagctctgatgacagcactttccattaatgtaccatgcccttttcctttaattttctatttttcctttgcccaacaataaaggagctagaaactgcaactattgagagataaaaagaggcggaaatcacaacagtgttctctccctcagtgcctaacaacactgagtcagatcagatggtcaaaggaaaacacattgaagtgaatgacagtgtacctttttaatctgaataataatgaactaaattccttcctgtgatttactcctctctactacccttcttttctcttttactgtagtatctcagataagttttaaagtgtttcaatattactacgcttccctccttgttaatcacaaatgacatcctagttttatttttctataacatacccactgaaaaactagcctcttatccaaccatttttcaaaattctgatttatgaaactttggacactgagtaaagaagaaacttgtgccttagggagactggctttgataacctgaccataaatatagaacaagtacaaaaagaagtccccagtatactagctacagtatacatgatcacatccagggctgtgcctggttccctatgggtgataaattataatcagtactaacacttcattcctgtggtcctctgctacatcagacctttctatgttgccggagtggccaataattacagcacagcatatctttcaagttttgcttgacgcttaggataagcaattaggaagatcttccagcaaggacccatacatattgaatcataagaaaaaatgtgagtaaaaaagttagaaacaaataattatggagaccataaacctatcattaatatgtaaaatatatttttgcataaggttattaaaaatatttaagcaatattttaaaaacagaacaccatgcgtaaaaactaagatttggagattatcataacaggtttatgttcctactgtcaaaaatcaaaaggggctgaatttgtctctacactttataggagacatttttttcttgtatatatattacatatatatgtatatattatatatatttatatgtcttagccattttattctatccacatctttgattattttatatatgtatcacagaaagagagagagagagatttattataaggaattggcttatgcagtaagggaggctgcgaagtcacaggacctgccatcagcaaactggagccccaggtgctgcagattaaatctttgtattgtgaaacttgattatatatattgggccactcttgtcatatccaactaaatcagagtcaaggggtcaggtagaaaaaaacattcagggcacataacaccaactccacaactgaattttctaccaggccacctgctgaaatgttttgctgtagctctaggaccaattttcccttgtagctgttgaaacaacctgccatgactctaagactagttttacccactgacatcaccaattagagcttgcctgctcctaaaagctttcctagtgccaatgagctttattttaaaactatacataacatttctctttctaataaaacctccaactttctctttgttcttcggacatatcaaagaccactccagtctgtccctacgctgtgaattgaaattctgtgattcttgaataaagcatttaatttggagattcatctctacattttattttgacttcaacaatgttccccctgcccaagtcaaatttatatattgaaattctaccccataatgtgatggtattagaaggtgtggcctttgggaggtaattaggattagatgaggtcatgagtgtggagtccttataaatgggattaatgtccttataaaagaggccacagagagctcctttgcccttccaccatgtgagaacacaaagagaagatagccatctatgaaccaagatggaggatctcaccaaacaccaaatttgctgtagcctttattttctatgttccagcctccataactgtgaaaaacaaatgaaaaacaacttattatccaaccagtttaggtagtatttgatagaatccttaacagactaagatgccaggaggattgatggtataaatgctagactgaaaagcagcaggctatagactcaattcttatttttcagattgaatccaaaggcagaaaaataaaaatagctcagtcacagggagaagatgttccttcttacttagccattttgttctattcaggtctttaattgattaaatgaggccctaccacattatgggggggcaatctgccttacttagtttactaatttgaatgttaatcttatccagtagcatcctcacagacacacacatagtaatgtttgttaaaatatctgggcaccctgtggctcagtctagttgacacaaaacttaaccatccacaatggttgaactagtttacagtcccaccaacagtgttaaagtgttcctatttctccacatcctctccagcacctgctgtttcctgactttttaatgatcgtcattctaactggtgtgagatggtatctcattgtggttttgattcgcatttctctgatggccagtgatgatgagcatttttttctgtgtctgtttgctgcataaattcttcttttgagaagtgtctgttcatatccttcacctactttttgatggggttgtttgattttttcttgtaaatttgtttcagttctttgtagattctggatattagccctttgtcagataggtagattgtgaaaattttctcccattctgtaggttgcctgttcagtctgatgatagtttcttttgctgtgcagaagctctttaattagatcccatttgtcaattttggcttttgttgccattgcttttggtgttttagtcctgaagtccttgcccatgcctatgtcctgaatggtattgcctaggttttcttctagggtttttatggttttagatctaacatgtaagtcacatgtgtatacatatgtaacaaacctgcacgttgtgcacatgtaccctagaacttaaagtataataataataaaaatacttaaccatcacaagtctaccacttgtcaaattggcacccatacatatccccttaaaccataattaatcatcaaataaagacagtaataattttatataaggtaataagaagggagaaaacaaaaatattttatctatctatatatatgtacatatatatatgtatgtgcacctatattcataacaaaataaggagaaaatactcatgacaattacagttctaacttacataactggttatatggttccagctggtatatataactatcttcttccactatccattttttattctttttacctacagcaatcccctcacttggtcatggttctttacctggtgttgtgacccaaatctttattctgaaagggtttgggtcattagtagttgtgttagttcattttgggctgctgtagcagaataccacagactgagtaatttataaagaacagaaacttatttctcaaaattctggaatcaggaaagtacaagatcgaggtgccagcagcatcttgcaagggctcccttactgtgtctgcatggcagaaggcagaagggctagagatagcaaagctattttcacaaaccctttttataaggacattaatctactaataagggcagagccctcatgatagaaacaccttcaaaaagtcccacctttcaacactggcattgagaattaagtttccagcccacgaattttgggggacacatttcaaccaaagcagtagtcttgcctaggttggattgttgtagtttcttattgacatcattcacagggcatggtaatactaaaagtcaccctaagggatctcctgtattccagacatattgttctttacttccatcatgtaacagtagtttgatttcctcttggtagtcaggattaatgtgccccagccagcacagtaactccctctttacctgttaattcagaagcaagaggtgcccaaagttgtcttagtcttaacttccggtttcttgtagtcattgttgtgtctccaggtggaagcattccttcctttggaaccaaaacctgaagggaaacatgagataaggttggggaagaagaagcaaaaatttcactagtgggtcactagcagtgacaatgtgtaatggcactcccatttctacccctcaatacctggctatgggagaaacagcacctggtaggattgaatatgagtgtcccttcaaaatttatatgttgaaatcctaacccccaatataatggtattgggaggtgggagcctatgggaggtagttaggtacttaggatagctcccccataaatgagattagtgctcttacaaaagaggcccagagagctcactaatctcttctcctactttgtctagtaacgttgggaacactcaatctcattatcaaccaatataagcatatttgcaatattttgtaaatctctgctgctagatcatgacataaactatcagtgctctctttactactggaaagagagtcattggcatatttaaatgtaatcagatatgtacccaattctcaaacccctagaatcaattgagaaaatgtctccttaaaattccgtttctctagaactgatcatgatgccaaagtctgtatttgtcagggttctctctctatatatatagattagatatatccaatgggatataggattggatatatcctactaaatatatctatatggatatagatatttctcacagttccagaagcattaatgtgttcatgagggcagaaccctcatgacctaaacacctgccaaaaatcccaaactttataatatatatttttatatctataaataaatatagacatacagttgacccttaagcaacatgtgattgagctgtgcagaaccacttacacatgaacatttttctgcctttgccactcctgagacaagatcaatccttcttactcctcctcagcctgcttaacatgaagatgatgagtatgaagaactttatgatgatccacttttacttcatgaataataaatatattttcacttccttatgatttttaataacatttttctctagcttactttgttataagaatacagtatatatatattatatatacatacacacatatatatgttcattttgcattgctgtgaagaatatctgaggctggataatttataaagaaaaaagttctatttggctcatgattctgcaagatgtacaaggatggtacctgcatctgcttggctcctgaagagacctgaggaagtttttactcatggcagaaggtgaagggatagcaggagtgtcacactttaagaaagctaagaggtgagagaagagaagggaggaaagaaaagaggaggggacaggctcctttaacaaccatatcccacataaactcactgccaaccattaccactggggagggcaccaaaacattcctgaggcatcttccctcatggcctaaacacctctcattaggccccacctccaatattggggatcacatttcaacatgagatgaggagggaataacatccaaactatatcagtatataatacatataacatacaaatatgtatttctaatcaacagtaaaccattagtttattggagaaggaggagtcaaaaattgtatgcaaattttctactgcactgaagtcagcattcccaacctttgcattgttcaaggatcaacctgaaatatatatatatatatatatatatatatatatacacacacacatacacacacacacacacttacttaaatcactacctcctaccatgataacctcttggactcacatccagcaggagttccaaattgtctagccaattagaatatagacagcaagatccctgtaaaaccccaaccatccacaaatggcaacaactcttttcctgcttagatacttacggacaaatggagggaaaaaaaagtgaacacaactcatcttataccaaaaatatcagatcagaatagtagaatttatatgttcaaacaagtgcatttatccaagaaaatcccttaacattgagaagcagagtttatgacagtaaagttaatcttgaagttaaaatgaaagaaaacacattaagacaaatttcctataaacctatcaaatataaaatttgaatctaaaaatatatgatttccagaaacattaatattatttgtctttttatttacagagacttttttgcataaaatgcaacagggcatagcatacttcatttaagtattttatcatcaaatttgtgtttgtgagttggaaagaaaaagatttaaaatatgttactttgcctattaaattaagttattatatattaaattagtttttgcctatggaaaattaaagtatttggtttatttccttcgttattatgacattgaaaaatgtttttaatatccagattatactgagttatattgagagacaatagtattacaatctgatatattttaaaagtctgactctctaatttgcttaaaagcattttcttggatgttctgagtcagtttttttctaagttctgagagccattgccaaaagtgcctggtttaattaaagtcactttttgtttttgaagtagttgtttctaatatattatgtctaacttaaatattcaccatgggaaaattttattttgtttcaaccaagcatcataaattatttccattcaaagcgatactagaaattattagaataagagtaactttatgtaagcagaaagcactagtcatttgtagaaacacttgcattacaaagtttccacatgcaaacgcctgatggagtcagtgtttctcaaaatactgaggtttatacttagagcagatgaaactcatgtgtttaaaaaataatatgttccatatgtttctgattgcattttaaaagtcactgccttaaaaactataatccaaaacaaattgaatttctagctacatgatttaccagcctaagaacagctgttggaattgaacattattttaccccattgttaactaatgtcagtgtgagcatcatggtagagactataatatacatccatctatatccattagtctctcctggccacatgagaggattattcttgtttgtttttagttattcaggaccaaatgactggttccagccaatgaaatctgtgtaaaaaataaagatataatgtgtgcatgcaaatgtgtgtctttctaaggcaaagtgtttaactggctaatacaagagcctccagcagccacagaagtcatatacctctgatggtgcaatttcaaggtaacagagctttcctatccaagatatttgagtcactgtgtatagcagagaccacattgacccatgatgaacatgttatgtgagtaagatatagtctttgttggattaagccactgggatttgggagataattcgttactgtggtattacctagtctaaactaatacacatgtagacacatgtgtatttgcatatatatgtatttgcatatattagtaccatttatcaattaataaccaatgtttacagcatttaataaccagcaatacaaatagtgtctctgcagttgaccattacaggttattctattttgtccatgaaaatccaaatactctatgtgcatgtctatttctcttttgttccctatcttctattttctaaaactagtcctatgacaatcattaagaagttagcacctttattcaacattattataaatttatttggtggtttgaattttttgtttgctttttaatgacagatagggaaaagagtcattgctatgttgtatgtaaaaagttttagcttcctattaggttgtaaatatacattgtgggtccagagctacatcttataaactatttctaaaatgattagcttttcaatagagtcactgtactatccatactgtcatatggataactttaccatgaacagtctggacatctagaacatacagactctgaatcccacttgtctttactatttacaatgacttttttggtgagagtttcctttctttctgagaagtttccttttttcctgtgctccatgcattctaccccctaattttgttatattctctacatgtaacttattttctaaaattagccacctgtttctgtttttttaaataatgcttgtgctgttatctaacagtaatatatttggaaagatacaaaattattgatatgttcaaaataatgtttcttatttgagaataagttatgccatattataattttttctagagaattttacataaaccaaggtagaagccgatctagtcattaataaagaaaataataaaattactttgtatatttttgtgattcatgtatatttttgaatagcttgctttaggtatataggactttcttttcattccttgacttctataactacatgcttattcaagttaaaaatgataactgcttgaaatacttttgttatctatgtaaacataaaaggaaggataatgttatgcattcataataattatcacttcgttaacaatatttatttacatttctccagggaacccttaaatttaacacttcatcataaaacaaaacaatatatgcaaacaatatatgcaaacaatataaagcaagctttatgtttgaatcaaagcaatatattttgaaagccaagttaattttttttaataatggatatggttacatggcatagtttctattattagaaaatgaaggaaagtggcaatagaagaaagtagatgacagttaaggagttcttgttagaaacagaagattgtagctcaaacataagaacatatgccaaattaaattgattaattgtttcagtcctttctgtcaaactttccttaaagtacttcaactcagagtaagtgtgccaattagaacaactcaaaaagattgtcaaaattttattaagtgaagttaaaataaagttgtagctaaaattgtttcttaatctgaattaatatgctggctgaaaatgatctagtcatacagtgtcaaagcattctagagctttgggagaaaactaagagatcatatgaataaattcttctttgaagcattgaaaagtgtagtttagaaaagtaaagtgagccatttgtgtcatacaactgttgacactttcaagctttcttaaatttagtattgcttttgtggtttgtttctttgaggttttaaaatttattagttacccattttttttctttcttaatgctataataatgttaaggaaatgagggttttagtcctaaggcaagatataatgtgtgcatgcaattttgtttactttaaattataatgcaatttctaataccgttacctttgtaattatttactagtaatatatcctacagttatttcttacttttactagaagcaagcacagagaatatctgactgctagaaaagtgaagttgggaccctgtgacaaaagcatctgctgattgtaggttttggaaaagcctctctgtccaagtattgattttgtgctgcctttttaaaaacacacattctagaggtaaacaacaggagacatgtactctagccttttttctgtgtatttaggaaatacttttcctacaactgcctgaatattctactttacaatgaaacttgcatagttggcatgagctgagtaacaattaagaatatcatttttcataccatgccaaatattgttctattttacttagttcatattttgcatttcggactttcatatttaacttgattcaaataggtagttttggtttaaaatagtttgaaaataacaaacgtatttgttttagtctttaccttctatacaagtttaaagcaaaactgatcactgaaacgaagcgtgggcaataattagaaacttttttttttttgcttttcaaaatttttttaagatcaaaagagtatggaaatttaaggagagtagaagtgatataatgggtaggaaaataatatgctgggagctatgttcagcaatccagcattatgtgtttgcttgacagcctgcctttcatgatttcaaatgcactaaataaggtttgtagaaatttccaatggtcagcattaattcagagtctctactgctagtgcaaggaatgcatataagttgcgtgatttgttgagagcagaattaatgcaacttaattgagtctattattctgtggatattaataggggacactgctgagaagtgaacattgagagacaaacggaaaaaaagaaaggatatagacctgggttttagaaagttataagtgagggcttgatgtgacagctcgtagttccattatatctgtgagtaactcagtggtgcctgtccatatcaaatttcttcacctggcatgattacccagtggggaaaaaaaaggagttaatgtgttactaaattgtgtctggcttacttaattccattcagcaacgtttggagattgcatcagcatgtacctaggattaccaccatcctaaaattttattgaaaaagggaaatataaaatacattatattaaaatactgttctgtagcagggtgcggaggctcatgcctgtaattccagaactttgggaagctgaggtgggtggatcatctgaggccaggagtttgagactagcttagccaacatggtgaaatcccctctctactaaaaatacaaaaattagccgggcatggtggcagagacctgtaatcctagctactcgggaggctgaggcatgagagttacttgaacccgggaggcggaggtggcagtgagccgaaattgcgccattgcactccagcctgggggaaaagagcgagactccatctcaaaaaaaaaattaaaaaattgttttgtaaaagatattgggaaagtgttggataatcttctacctggagaactaaataaaatctcataaatagcaatcctataacacttcctcttattattgcccacagctaagcaatcctaaagtccagctgattctcttttcttaaatgtccattcatgttgtcaactcactgccaactacattcccactactactgatcaaattctcattgctgcagttccctatcaactcttaccttcaaatttatctctctgcctataattttctctccatatcattctccatattgcctctagagttagtgcatttgaaaaaattaccaaaaaataaaattgcaaaattgttcacaaacatcagagagagagtccgcatcataaagaaagtgattctcaaatatttgtatccagaagatttacctaaaatccttgtagtctggcttagaataggaactgaaaactatgtgttctataaacaaagtcacatttgtcctttaagtttggtcttaaaagacaaaaaggtgtgatctgggttaaaaagtaagggaggacattctaggtgtaaactatattttgcagaagaaaaaagatttggaaaaataattttagtgagtctataacatattttctattttaaaggtctaaggtatacataaagcataattaacaaatgtctaataaagtataatgtgtgtataaatatatgcatgcatacattcatatgcatacatatatatgtatatataaaagaataaattttaaaaatagatttaaaattctttaactcatgcaagaaatacttgctatacctggaaacatcttgcaacttgtcatatttttcaaacgatttctaattatctgagctgcattttattttaaattgataacctcaaagatatatcaactggaatatcttctttgatgtcactgtcatctgactaattttccctgttcaaacaactgtaaaagtgggtcaattataagttatgaagtaactgttttcacattttgaatgataggctgcacaggatggtgagccatgatagaagggaaacaaatgaggcaaatgttgagagtcagtcctccacaggtgtttcacatttctgtacatgtcagcagaaatactgacattgttttacccaatccttcttttcaagtacacttatataacaaacacgcttggaagagagagtcccttcctcctgggaaaaggttgggcaggtttgcttgcaaacccagtataaaatatcggaattccctgtaatcccagcaccttgggaggccgaggtgggcagatcacgaggtcaggagatcaagaccatcctggccaacatggtgaaagcccatctctactaaaaacacaaaaatgagctgggcatggtggcacgcacctgtaatcccagctacttgggaggctgaggcaggagaattgcttgaaccagggagtcagagatttcagtgaggcaagatcttgccactgcactccagtctggcaacagagcaagactcggtctcaaaaaaaaaaaaaagatgggaattcactaggctctggattctttagctgtaacacaaactcactgcatgtgtagcattcacattggcctttctgtgggacttcagggacaagggaaactcacataaagtttattatgctgcagtaccatgagtaatataaagtcttttggtctctgaccctgtatagtgtcttctaccagcaaccatgagactatggcaggttaactagctaacttgtaagtagggtaaatctcagactcatcacagattttgacaatgagtcacagttgctccagctttctgtcaaggtcccctccagacttggaggggtcccgccttcccacaaggaaggcaaactcagagcatggtagttttattatgaaagagaggtattagagtttggagctatttgatctctgggatttgtggaacagagcaccatagagagaagagatacctcgaaaacaagatccagaaatatcataggcaatctcttgaatgtttcacatacacaaagccgctcattcattgagcaaggctccaagggaccaaagaacaatttaaaataaaaacaacatctaccataaaaagagcaattattgggaaactttgagctgaacaacctggggttgtgagacacttgagttttaaataatgaccatggagagatttcttgagcattccaagtattgtatatataccccagacagggaatactttagaaatagagttaatctagatctagagataagactacttcaaactcattctaacaaagctaaaaaacaaagcttacgggatcaagctaatctgaaagtgaattaatttaatattctaattgagcaaggaagcaaaatcttgaaatataaaaaccatagcatccataatgtctttaaaaattaatagacaatggaagaagaaaaaaatgtgatccataatcaggacaaaaatcaataaatagaaacaaactagaaatgtcagagattttagaattatcaaaggactttaaaacaggcactaacaatatattcaaaggaatatattggaaggaaaaattgaacataatgaggaaactcacagggatataaatagagaaatagaagatataatagagaatcagcaggggattctagagatgaaaaatataatctcctaaaaatgacaaattcactgaatctacctaatagcagactagagacttcaaataaaaagataaataaacttgaagagagggcaataggaattatacaaattgaacataaagagaaaaagggttgaaaaaataaacaacatggtccatggcacaacatcaagcagtctaatgtgcatgtaattgaagtgtcagcatatgaaaatagggaaattggagcataaaaataggaaggattaattgttacacatttttatgaaaactataggccaaaatatccaagctgttcaatgaaccccaagcagaataaagagataaaacagctccaaagcacattacaatcaaattgctgatgctcaatgatatgaagaaaatcttaaaggcaacgtgtaaaaaaggacatactgcatttgttaccggaaacaatgataagaataaccactgcattatcaaaagaaaccaaatggtgataatttataaaatatattcaaatataattatgtttattttgtgagcatacacaatttttaaaatgtcttcacattatttgagaaaatatgtaagatctctttctccctaaaagaatgtctttccttgtcagtttctgctcctaaactattcatgtttaaattattttggttgaaatttgtgatcattgttttcaagtgtcaacttgactgggttaagagatactcaaacagctggtaaagcattatttctggatatgtctattagggtgtttctggaagagactggcattcgaatcagtgaactaagatctgtcctcacccaatgtggacacaccccatctagttggctgagggcctggatagaacacaaagggagaggaaaggtaaattgactctctgtctctcttttccagagtggggacacctttcttctcctacatcttgtacaacagaactccaagttctctggcctttggactctggaatttgcaccagctcttccccaaggttctcctgcctttggcctcagcctgcgagttacatcattagcttcactgattctgatactttaagagttggactgagcaacgttacaagtttcactggtatttcagcttttggatggcttttggtcagacttctcagcctccataattgcataatccaattccctttataaagccccattatatctatctatctatctatctgtctgtctgtctgtctgtctgtctaactatcatctatctatctatctatacaatgtgtatgcatagcctattggttctgtctacctggagaactctaatacaaaagtattttaaggtaaaatatatttcaatcaaatagttaaatttatgaaaattaaatgcagagaatatttttcagtattttttgccattttgagagattatgtatccagttgtttttttctggagaaacagttgagagaagacagaaaaatatagtaattttagtaataaaacaagttatatagtagaatacaggggcaaatattgatcactagcaccctcaatctcagcatatatattaagcgtaaaaataaagcccatattgtgctctcaagtttatccttaaactgctgtaaatttctattccatgggcacaaactttctactgcttacatctccccagacatgcatattcagctgtgtcctcttaaagctaattatatatatattattcaacatccctggtgtttttgttataatattaaagctttcaggtataaatattaactatgattatataattgtataattttaggcttcagccataagaggaatccaaggaacgccaggctgtttcttgtgtccctgaactcattctatataggaaattacttactcaatacatgcattaagttaaataaagaatgaatattacaggttaacaggcagccaggaaagacgggtaattaaaggatacatctgaatgcaaattaagcacacatcataaggaccatgataaagtatgatttaactaaacagaagaatctagaatcaagaaaagtaggagcacataataggcccgtagatgagacacacaaatgaatttacttacattcatgattttgatgaataccagttgtagggtaaaaatagtattgtgagtgaaaataattctacaaccacagaaactagttcagtattttcattaaaagttgaaataatccatatcctgtgaccagcaatttcatacctaggtaaatacattacagaaactattgtagttgtgaacagaagatgtgtacaaaaatgtttttaacatcaacactgtttaaagcaaaaataaatatttgtgtagtaaaaatgaattgtagattcatcattatcaccaatgaacataaaattgaaacctaaataaacaaatcacagaggaatacatgagaaatgatttaattaattcaaaatttcaaataaaactaagccatatatgttgttgtcttacatgctattatgagatgatacaaatgagattaataccataaatcaaactaagggaatgagttccacaaagtaacgaaggtattttcttttgaagtttaggagagaaatgtgattggaggaggacatatggaaggcttgaaatgaacagatagtttctctctttaagctgggcacgtagtaagtacatgttttttgttgttcttttgtttgcttttgcttggacatattttgacagtctgtagggtgtggtgtttgaaaacatggcgtggttaagttaaatagacttaatttaaactgctttcactacttactagcttgtagctttcagcaaattacttaaaccctttgggcctcagtttgctcacctggctgtcaattgggaataactcatgacattattttgagaataaaatgattgatagatagatagataattaaaatatggcacaaagaaataactctttgaggttaagctgatattattggtaatttttgtaggtattataagtatctcttttggagactacattttaacttatatggcatgtttttccctgttttaatttaaaatctttctaaaattacacatcttctggtacgctcacagagtatttttctatcaaaaaatttattatagaagctcaactaataaacagtataatttaactgtctttggtatgaattatattgaatttcacatacgttatcataaaaatttgtcttatactagtctaatagatttaatagtgacaataattatcaacagtattaatgtgttaaaagatatttaataaagtgaaatgacaatctcgaattttaatttgaagcacttttgaaaaagtatgttaacttactgaacgactatctgcatattgaaatatatttagttgttatggaagcaatttgcataatcagaaaagtagagaattatatagtaaacatttttatattcactatcataatgtaagatacatgtttaataacttattttaatttttttgaaaagtgaaatgtaactgataactatgtggttacttttattttcattcacatacctctattctacctaagaagcaaccatgatcatgaatttggtgaataagcatcttaggtctatatatgtgtatgcatgtgaatatctatctatctatctatctatctatatatatatctatatacacacacacacacaaatacttggatatgtgttcatatgaaatatatatcatgcttctgtgatttctgacaaattatataattatattatgctacaaatatctttatgaaaccctatttttcatttaataatatttttgaaattttgttaacagatatgtatctatttttactggtatattggtatatagtgaccatcttttatttaatgattccctactacaaagtattcaggtggtctataatttttcataggtccaaatcatgccaaaatgaacataattatgcatattaacttataaacttatatgacattttatctaaaataaaattaattttgtctcccaaaagaaaattatattcctgtataaaaacatgaaatatttattttcttttttcttaaagattagaaatggacacatttagatagggaagcttttatgttagttctgattgagtcttcctgaatggcaatcacaaataattggtatatttaccaattccattaaaagatgaatgctttattcactaaatcatggccaattctactaaaatatattaatttttaggtgacgttattttgaaaatgatattgcttgaataatttagtttcattttatcctattgtttattaaaatggtaaaattaagtctaatttccccataaaggaaaagtaaatatatagaaatttattttatactaataaaattatagttatttctaccaaaaaatagacatgcctagttttgtgaaaagcaaacctgactttgatctctcactactaaacacaatccaagatatgtctgcaactcttaaaaaaagagacagattcaacatgtattacattaatgacatcttgacataaatatttagattgtgaaagaaatacacaattaatactccataaattatagttaaagtgtaattatgagcgtttggggaggatatgtagtcatttgatatgacgcattttggtcttgctttagccaaaaccaaagtttgaacactctccaaataaaaatctaagattttggaaaccaacttcacatatgtaaattttcttccctacactattcagaatacaacttgatgggtcagaatagaaattccatagtctttttttttaattattattatactttaagttctagggtttatgtgcacaacgtgcaggtttattacatacgtatacttgtgccatgttggtgtgccgtacccattaactcgttatttacattaggtatatctcctaatgttatccctacccccttatgtgatcctgggttggatcctgtgctagaaaaagaatgttagtacaacaaagggagaaatttgaataaggtctttagatgagataacagtattgtatcaatgtttgatcattgtactgtgattatataagatgttaataattgggaaatctgggagaagggtgtataagaaataattgcactaattttccaacagtgtgaaagtaattcaaaatgaaaggttaaaaatgaaagtatggtgcctgaattctagtcaaaatattcatcaactgatggtaattaacaaaatgtagcatgtctgtaactagacaatcgaatattattcatctctaaaaagaactgaagtactgacatgggctataatatgatgaaccttgaaaacatgctacgtgaaagacaccaggcacaaaatatcacactgtatgattgcatttatgtgaaatgtccagaatgggaaaatacatatatagagaaagtagattagtatttgacaggggttgggggctcaaggggaattgagagtgactgctcatggatatggggtggcttatgagggtgacaaaaatgttctaagattagatagtggtgacagttgcacaactatgtaaatatattaaaaacttctggactgttaaaaagaaagaaattccaacaataattcatttgttagtttggacttttctccacaggatgaggaaaaagtatcccaaaagaaatgcattatttttatttaagtgttatagcttccttaagtattaccatgaaaattagactcctggacatgatgaagtaaacagtcctagatttttcctcccattatatcctaatttttcaaaaataaacaaaataaataaacttttcagcattgatcaacaggaggcacaggattgttatctctgagaaaaagaaaacaaatttggttttctttctttccaagaaagggaacccacgctgagtgcggtgctctcactgaatagaagagccagagatcagagcgtggagggcctaaggaagctggaatttacaggtagagtataggagaggatgaagcaacaataagatagagctctccgtaggggacacctcgagtctttgattagatgctgaaccaaatgtggctctgttgaggcttcagcagactaggaaaagagcaggtagcatggagttaaaagatgaacaatttccagagctcacaaagtcctaggagacctctgagttttgatcatccaagtcagagagaatgtaaggttgtttcatattcaaaattaatcagtgtaattgcttatattaatggaatagagatgaaagaaatcataggatttaccatctatcttgagaaactaccttaatctaacaaagagcatatacaaaataatgtacactgaaaatcacacttaatggtgaaagacaaaatgctttctttctaagattggaaacaagacatttattctgactaattatcatcaacactgtattagagtccataaaaagggcaatgaatcaagaaaaggaaataagataaacaaattgggaggaaaaaagtggaaccgtacctattcataatttatatacatagaatattccaggaaaactaaaaaagaactcctagagttaatgactgaatttaactgtatgttcataaaaaaacaacaaataatgagaaaataatgtaagaaaaaatcaaatttgatagcattggaaatgtaggaaaaattcttaggaagacatttgaaaaaatatgtatgagatatgtacactgaaaattataacattgctgacagaataaagaagacctatatatatgaacaaatgttctatgttcataaattgaacatttatttatttatttatttattttttaatttttttaatactttaacttttagggtacatgtgcacaatgtgcaggttagttacatatgtatacgtgtgccatgttgatgtgctgcacccattaactcgtcatttaatattaggtatatctcctaatgctatccctcccccctcccccccaccccacaacaggccctggtgtgtgatgttccccttcctgtgtccatgtgttctcattgttcaattcccacctatgagtgagaatatgcggtgtttggttttttgtccttgcgacagtttgctgagaatgatggtttccagcttcatccatgtccctacaaaggacatgaactcagcattttttatggctgcatagtattccatggtgtatacgtgccacattttcttaatccagtctatcattgatggacatttggcttggttccaagtctttgctattgtgaatagtgccactataaacatacgtgtgtatgtgtctttacagcagcatgatttacagtcctttgggtatatacccagtaatgggatggctgggtcaaatggtatttctagttctagatccctgaggaatcgccacactgacttccacaatggttgaactagtttgcagtcccaccaacagtgtaaaagtgttcctgtttctccacatcctctccagcatcagttgtttcctgactttttaatgattgccattctaactggtgtgagatggtatctcattgtggttttgatttgcatttctctgatggccagtgatgatgagcattttttcatgtgtctgttggctacataaatgtcttgttttgagaagtgtctgttcatatcctttgcccactttttaatggggttgtttgtttttttcttgtaaacttgtttgagttcattgtagattctggatattagccctttgtcagatgagtagattgcaaaaattttctctcattctgtaggttgcctgttcactctgatggtagtttcttttgctgtgcagaagctccttagtttaattagatcccatttgtcagacttctgttgccattgcttttggtgttttagacatgaagtccttgcccatgcctatgtcctgaatggtattgcctaggttttcttctacagtttttatggttttagatctaacatttaagtctttaatccgtcttgaattaatttttgtataaggtgtaaggaagggatccaatttcagctttctacatatggctagccagttttcccagcaccatttattaaacagggaatcgttttcccatttcttgtttttgtcaggtttgtcaaagatcagatggttgtagatatgcggcattatttctgagggctctgttctgttccattggtctatatctctgttttggtaccagtaccatgctgttttagttactgtagccttgtagtatagtttgacatcaggtagcatgatgcccccagctttgttcttttggcttaggattgacttggcaatgcaggctctgttttggttccatatgaactttaaagtagttttttccaattctgtgaagaaagtcattggtagcttgttggggatggcattgaatctataaattaccttgggcagtatggccattttcacaatattgattcttcctacccatgagcatggaatgttcttccatttgtatcctcttttatttcattgagcagtggtttgtagttccactcaaattgatctataaactcaatgtaatcataatgaaaatactaggagttttatttttttgctgaaattaaccaactgattctaatatttacgtgaaattacaaagaacatagaatgactgatattattttgaaacagaggaagaaaattagaggatatttgccagatttccaagcatactataatgctaccataatcgagacagtatgttggaataaagatatagcttacagatcagtggaacagaatagagagttgagaaactgacccacataaatatgtttatttacttttttacaaatacaccaacgttttccaatgggggaaagaatagtattttcatcaaatagtggtggaacaattagctatttataagaaaaaataatggaccttaactcttactacacacacacaatcttaacatttttcttagacctatctataaagtatgtggaaaaataagacagaaaaaaatccgcatagtcttggagttgaaaaagcctttttaaatgatataattacaagcaaattttaggaaaaaaatgataaacaatcaaataaaatacctctgtgattcaaagacatatgaaaatgagataaaatacacaaaatacatatgtctgggaaagaacttgcatctagggtatattaaagccttctataactcagtcataatttaaaaaccaagtcacaaatgtgcaaaatgtttgaaaaggtacttcacaagagaagacatataactagccagtaagcaaattaagctgtgctcaatataatttgtcattagggaaatgcaaattaaaactacaactagatacataagcactataatagctaaatttaaatgactgacaatattaaatattggaaaggatatggatcaactaaaactcatatcactgatgtgaatgtaaaatggtacaattacctcagaaaatagtttgctagtgttttgcaaaatacggtaccgcaaagtacataccgcaacatgattgtggtataatgcagcaatatcacatcctggtatttgtcaagataaactaaccatatactgaaagaaattatcctgtatgactgctcatagcagctttattcataataatcccaaactggaaacaatctaaatgttcatcaataggtgaataaattaacaagtgatggtaccgctatgcaatagaatactactcagcaataaaagaaacaaaccaatgataaattaacagcctgaatggacctgaagccacttggctgctaagtggcccaaggaaattttggggattctgaaaatattttactttttgataacggaatggtagccattgggagtatatgtttgtcaaaacatatcaaactttatgatgaaaatttattttatataactcaatatagttaattacatgattaaaaaataacttcacctatacattttcaactggtgacacatttatatcacaattttattttcagggtacatacaataaaactagaataaaatagtttttacacagatacatatttctggattttggcataaatagcattaatgatacataagaaattataaacttcagacactggctataaacaatttacatttaatttggttatataagctatgtatactttttcctcctgtttatttatggattgtttaatttttgtttttaagatcaaaagccacagaaaaacatatcaagtatcacaaatgcaaagttttaaaaaatggcaaattagtggtaataagtaatagttgccattaaagtcacaagcacttagctggacaaaaggacgctaagaaaactttatttagcctagtccacaaaattataatacagttatgccttagagaaatataaaataagactacttacatagattttggaaatgctattccaaataataaaaaaaaagatcatgaacaattggggtaaagataaaagtaattttcctcttgattgatacacattgccaatattaactaggtatgtgaacttatattttcaatataaattagttttacaccagaatcaaatagctgtttcacaaccttaactcaatgaatctttattaatccttatctgaaaaccaaaattgtatttcaaagtccaggtttgactggatgaaaccatgagtttgcatatatttgtttatttaatgttcttttagtctatcgcctcattcagattatgactgatgacctgggtaacaaatgaaatgataaagtatcaggtctgacatacttagagaaaaaaaaaaaaaagaattaagatacaggttctaaataaatgaagttatttaaccctggtttcgttttccttttttcttcactaaccatgggacagccagagttttctgtgctattcccaaaccagcttgcagagcaaatagggcattgaaaagtgccaaaagaaaaataaaaacacacattacaatgataattaccatcttgttaaaacacagtataataaggttccaatttggtccatagcttttgttacataaaatgacgcttaaaccaccgtaaaaggactgatccacatgctactgtatttaatattataccaatgtattttcagagcaaaataattaaaatacttaagttagccaacaaatggccctgctaaaaattccccagtaaatttcttaatatataaataacaaaataacaataacaaataataaattgtttataataattaacaaataataataacatataatacaataataattatggtatggtatctatggtgtacttatccctgcttgcattatttagttaagtttgaaaattactgtaaagtggaaatcccaatgaagagtctctaaaattttaatgatatgaataactattgtgaaattaataattatccttgtcatattactgttgaaagttaacatattaggtattaatttggaataattaaataatagaaacaattcacatgtaggttaaagtaactgctaccaaaaaggattacaatcacaagcacaacttattctctttgatcttctattgaattgctatgtaatataaatttaatcacattattctgcatatatattatttgctaatttacagaaacacagccataatataatgtttaaaacattaagctatttttggaatcatgtattaaatattttaattaaaattaacatgcatgttagagaaatttaataacatgtacatggatattgattgttttcccaatgagaaatttaaaagtaatccaactcagaccaataaaatatgtattttaaatattctaaagaatattctaacacactaagactaatcaatttccaaaattctaaaatatttacatttaagttataattttaaatttgctaagccatagtaataactatcctggaatgaaatgtagttttatacatagaagcacaatattaacaatgaaaacatgagcctttttccacttttctagtacaatatattatttggtaagcagcttgacacttagctttatttcccaggaaatactaatttttttctcttctcgttacaccagcttattcattatagggattaatgtgatgctggatataagatattttgaggtcccaataggatatgagtaagttgctgttcagaattttctgagtattcaaaaatattatgcattgtagcagcaatatattcatttacaatttggtctttgctacccatgaacttagcttcctgcgtgttacaaatgcatcggcagtattggttttagaattatttctagaactcagggtttatattgattagccttctaagagagtttttgtttcttggaggaatttcacagctggaaaaaatgcaataaagaaattagtaaaataacaaacttctttagaacttatgtttatccttaagatactattttggcaccaagtcggaggaaagtaagagaatatttaaactaccactcattatgccccattttcttttattcttctaactcatattaaatactaaacagattttatatcctagtttttattttttgaatgttggataaattatatctttctcatttccacactatatttcactttaagctctaaaaattacctaaaatcagcaaaatgacataaaaaaagaatattagaaaactttcattgcagaattggactttaagtttcagtggttattaatgcctcattggaagattgaattggccattaagcttcctttccattatattatcttcatggaattgtataatttaggcataataataaggaaaatagtggtcattgctcaaaatctattcaaaacccctctatataagaatagaaaacaaaaaaataatgactatactactgatgactcaaattttgaattgtgtgcattttggaggactaatacagttggataattcaatgtcctgataaaagtattttcaaaggaaagggttatatattttttttttcttttttgagatggcgtctcgctctgtcgccaggctggaatccagtggcacgaccttggctcactgcaacctctgcctcccgggttcaagcaattctcctgcctcagcctccagagtagctggtattacaggcgcatgccaccattcccagctaatttttgtatttttagtagagacaaggtttcaccatgttggccaggatggtctcgatctcttgacctcatgatccacctgcctcggcatcccaaagtgctaggattacaggtgtgtgccactgtgcccagccgaaagggttatattttgatgtcccccactcaggatttgaaaacaaatcagtgctacatgccatgagtacaggtaggttttagactgatggtagtctaaagtaatagctgaatacatacctgcaagcaataaaaaataaatatgcttttaacatgacgcttttagagtacccaaatgagttaacatctaaaactgaaacattagccaaaatgcgtgatcataagttttctatgaggaaagatattattaaagaacatatcagatgccgtaagaatatttctcttcagagttaggccacaactctggtacatgataatattgtgttatagaacactgacagaagccaaaagctaaccaaataataaaaatgaaggcatataccattatctggaataatgttagttcagcaataagcaacatgggaaatagtatccaaaaaacagacctttagcattataggtagtatgaagaaaagtatggtgagaagagacatttaccactttgggatgcaaattaggcacacttcttagagtaatgaggcatttaatgagaatgatgttcttaactaacataggatctgtgttccaggaattattctaagtgcttttcgtgcatcataccattaaatcacatcatcctatgaaataggaactattattacctccattgtacatatgagaaaaccgagggttagatacataagcagcttattctagtcatatcactagaggtagaactagaatttaaatgcaggcaatttgaagccagagattagacgactcagaacatgatacccaaaaatatggcatttttacatatttggtattttaagctgaaggaaattgaggaaacaacagaagcagaaagatcattctgttactttcttccacctgtctgtgtgaagacaggccatagagaattctcggacctacttccactgaaagttcatcataagacactcatgtgacagatgtcctgccctatatccagaggaaagaaatgaaagcacagagataccaagaagaatttgaatagacaggccttgctaagtttctctgtttattaccattagatcataactccttttgtccaatcatatttctatacaattctccagtcttcattgaatataagcttaaaatagttttccctgagttattggacctttatttctgacagctcctgggtcatgtaaaaatttggctaaataaatgttatatgcctttcttccattaacctgtggtttgctataagggtgtcagcagtgaaccttgtgatgggtgaggaaaatagatttcttctctatagagttttgtccatttcacaatagtatctcctcataaactcagtatttagttgagccaactttgagaaacaacttaaccagaaacattggttgaggcaaggatgatggaatatttagtcacacatttttaggtagttgtcaaatggcactcaaataggagcaagcccaggcaggaagagtagggtgatggatattctaggcaggttatgagttaaggagtgtgtcggtaaatcatgtatctttcagaaaatgtatttataggcagaaggacctagatactgagataattagattcttcaagtagaaagatctcttaaaaacatcaggataagatgagggatgaagggacagaaaatttaaaaagcaatttttgcagtatgatgatttaaaaaaattaattacttggtagtcctagacattttaagaaattctaagagaaccaaaacataacctcttcctttatgtaacctatagtccagcatggtaaacgatttatgcataaaaggaactttaaaattactgattgttggtctatctaatcataagtgttcttagaatatgagaaattcagttctgctttcaagatctgatatattgtataaaagttattctaagatgaagaacatggttcaccaagcctctgagaagttatgagtgaaacttagataacagtaccttctcatttccagtatgtcctcagtatttctcccattcccacatgtctatctctcttttgtgatgagatcaacaccacattgggttttggtgttaggacacaaaaatgcttgtatacgttttagtattttaaattacaagggcagtaaatattgtgatttttgacactataaaattatggtttagtgctaattgccagtttacaacataatttccttattaatgcctactaattgtcaattaagtgctcatagagaatggattttaaaaccgaaaacgatgaatgcattcttcttcattagggtggaagtgagatcatttaccatgctattaggctagtgggaagtgcaatatttcatcaaaggccagtaataatctgcagacctcaagttgcttcagatatcaactggcatttaccatctctgccaaaatttgaatgaacccttataataggagtcagactgaagtacatgacaccatggttagtgataactggtgttaatttttatcaagtacttgatagcttctaagtcttgactttaaataaatcttttaaacagataattgcatgattaaaaactgggttttaattttgactaatttatctttaggatagttttatatttgcagaaaaattgtgatggtagtatagatggtttccatctaccgcactcctagtttcccctattatcaacattgtccattaccactgtatatcttttatgattaattaaccaataccaatacattattgttaacaaaagcccataccttatttagacatacttagtattttacctaatgtcctttttccattccaggactccattccaggaatcaatattacattaagtttttacgtctccttatgtgttcctttaaactgtgacatttcataacaatgtttcctatttttcatgactttgacagtctgggcaattaataatgctcaggaattttttaggatcaccctttattgaaatttttggatgttattctcactaccagactggttttctggaatttaggaaggaggataacaaggtaaagtggcatttccatcatgccgtatcaagataacatactactaacatgatttatggctattgatgatgaccttgatcacctggctgaggtaatattttgcagatttctctactttaaagttacccataaatatagcctcttcctatacgtaactcataatctagtcttatgcatgaatagattttttaaaatgactgatggttggcaaggcatggtggctcatgccggtaatcccagcactttgggaggctaaggtgggtggatcacttgaagccaggagtttgagatcagtctggccaacagagcaaaaccctgtctctactaaaaatacaaaaaattagctgggcctggtagcacatgcctgtaatcccagctactgtggagactgaggtacgaaaattgcttgaacccgtgaggcggaggtttcagtgagcccagattgtgccactgcactccagcctgggtgaccaagcaagactctgtctcaaaaaaaaaaaaaagttactaattgttgtggtatctaaccgtgatactctactgtacatggaagtcagtaagcacagcccacacttaagaagcaggagttatgctatacctcatatagggaggaatatccacagaaattatttgtacttcttctacactgacaatttgtgtcttctccatcattcattaaaatgttcatctatgtatttacattagtatgaaaagttttttttctgtctttatataggttttaaacttcttttcatatttttttttcaaggaagatccactgttgatgaattcctcagttttagtttgtctgagcaattatttatcgtttactttttatagataattttgttaggtatagaataataaataagcaaatactttcaaaattttgccctagtctttcctttcttgcaaggtttctgattaggagttcaatgtaattctcatccttgttcttctagtcactggccgctttaaagttttccttattgtttttggtcttctacagtttgaatatgatatgcctgagtacaaagtttatatatacaaatgtgtgcatataaatcttgcttggtgttctctgagctccctggatctatagttttgtgtctgtcactaattttgcaaaattattgaccattactatttccaatatttattctattctgacctttttctagttatggtattccaattgcatgtactgaaattgtccaacagttcttggatattgtcaactattttttcccttttattttctctttgcatttcaaaaatagaacaattttttaataatgtcccaaaattttaaaatggcagaaataatttatattgccttattgagtatatgtaaagtaatatacccaagtatatgatgagatgagttgttatgatgataatggtaatggtaataaagcaactataaaaaagatgaatttattattaagattgaccttaaggctatgtgcttacaaaagacaactatacttctttttttggatgaaatatgttggcaagtttttactcttatatatccatttctttattcaagaaaatattattggtatgtactgaagtgcagataatttgctcagactaaggataaaaatataataatctatttcctgaccctaatgttgaagaacttaaatataataaagtgaatgttataagaaagaaaacgaacagctaatgaaaaaatgaaatttggaaaactaaataatgcatctatcatagagcacagaagaaagactgctttgtaatgctagggaattcagagggaacttcacagaaaaggcagttattgaggagtttcttgaacaatcagtcagaattttgccacgtgggcaaggattagaagacattatacttataggttataagatttgttaagaatgaatgagaaagaccaggataattatgaggtataaattgtgtaggatttgtaaactgtagaatgtaagaaggggaattataggaagtaaagcagacatacaagcaaggaccaagtcacacaaggctttccagactgcgtgtttgaggagatccaacatgaatattgtggaatacatttctggaacctatagtaatgtagctttttaaggggactagtgttctcttgtaagaagtcagctggaggaaataaagataaaagcatgtaaatttttatttaagaaagctagttgtcaaagaagaggaacaataatcagtagaacacgatgctgtcttgaatacttcaggaggttttaggcaactctgagtatcctgattttcaaaaccttgaaatacttcctacttactctgctttacctgaaaaaacaaaacaaaacaaaatccaaaaataaaaacaccattatcttgtagacaaaattaccacttctcaaatcttcccctcgttagaaaccacttaataatttacagtttcataacagaatatccaccaccagaaaatattcaccacctcttgttgacatcacctgataacataacttgtggaacaaggagaaacatgcttttatgtagttaatatgcacacatagtagacaatggtcattaagcccaccaaagcacaacaatcaacaacttcagtgaagtttctgagaagctgaactatataaagtaaaaaaaaaaaaaaaaagctatttatattaaaccatgtggtcactaggatctcttgcaagagattgagaaaggacattggttgagttcatttggttgatcaaaactgtaatccagaaaatccaaaataagtatgatcttaacactataaataaaaggcaggatttgtaggcatattaagctttgtaattatctaaatacatgtttgagaaaataactagcaagctatgactttacaactaacttcattcattgaaatgttttctatatctataatttaatctaatgaacaaaacccctcctattccccatgcttaatcatacatgcatatgaatatgaaaaatttgttttcatagtttggtgattaaatgaaatatatgcaacattccaagcagattgggttgaaccatttccttccacacagatgttttggtaccaagttgacggtatttctttttatagtatagagcaatgtaattttatagttcattgctgagcatttcattaaatcataaaataataataattcaattaaatcatcaaagagtatattgtgataattctaattatgttttaacagcctcattactataattagtcttagataaccaacatgattgggccctagtaagatgagatttaattgtctcatttccataattggagctagcctatttaacttatcacttttctcttttaaaaacaaagttgtctcattttcacagaataagctttttgaatcagatatgagatgtagaatttcagtgaaacttaagcactggtctccatttatccctgagattaaacccaatggacctcctccttaattttaattactgatccaggatgtaatacacgttttgcctctggcatttctagataattcagctctgtctgtctctggggttttagtctttaaaaacaaaaagaaaaaggcggagtaatttctcctcacatggacattaaaataataaaatcaggttatagatttctaaacatatgacatttccaaacttaatttctaaaatgccataatggttctgctaaagctctggtaatttaggatttgtgtgtatggtattctgattactggagttaagacaatatccttattagcagctgcctggccaaattcagtgtcactgaggatcttagtgatgctctctgatatgaaatgtggagtcaactcatcaagaagagcagtaaaagattcaggaaatggcctactgataatgcttcatctgtaaacattgaaaaagaactagaagtgatcaaagatgtatgacagcatcccattaaaaagttttactcaggaactccagcaatagatttgtgctaaggaatatattgtgtacctgaatatattaaagtggtctatttgggaataaaaataatatatatgtcattcctactttctaaataaagatatcataagttttcataaatgctacctctgtaagcaaagtgaaaatatcagacatttccccttcctaaatttattctcatttgcctcacccaaatcctcatctttttatagatttacaatattttatttagttactattctataacattgatttattgtcttttggttgaaagtatgagttgtgcacatttgctcagttcattgcagaatctttagcaccctgggctaaggataaaatacccatagtgcatcacatttactgtaatagccaaaaatgctgccacatttctttctttcgccactccctaagcccccggagggaggatacttaagtctcactctatttaaaataacataataccatacaaatttactactaggtatggttctgaaaatagagtgattgattttctttccttccttccttccttccttccttccttccttccttccttccttccttccttccttcctttccttctttctttctttcttttttgtttgtttgtttgttttgagacggagtctcgctctgtagcccaggctggagtccagtggcgcgatctcagctcactgcaagctccgcctcccgggttcacgccattctcctgcctcagcctcctgagtagctgggactacaggcgccggccaccaagcccggctaatttttttgtatttttagtagaggcggggtttcagcgtgttagccaggatgatctggatctcctgacctcgtgatcggcctgcctcggcctcccaaagtgctgggattacaggcttgagccactgcgcccggccctttttttttttttttttttaatttatcttgtattttgagttcaaaggtacatgtgcaggtttgttatatgagtaaaattttgtcatggggtttttgtacagattatttcatcacccaggtattaatcatgatccttcctctccttccacccttcaccctctaataggccccatgtctgttgttccccactatgtgtccatgtgttctcatcatttagcttccacttgtaagtgagaacatacagtatttggtttactggttcctgtgttagtctgtcaaagataatgcactccagcgccatgcttgtttctgcaaaggacgttgctgcatgtactttttttattgctgtatagtattccttggtgtgtatgaaccatatttcctttattcagtctaccattaatgggcatttaggttgactgcatccctttgctattatgaatagtgctgcgatgaacatatccattaatgtgtctttacggtagaaaaatttatattcttgtgggtgtacacccagtaatgggtttgctaggttgaatgttaattctattttaagttctttgaggaattgccacactgctttccacaatggctgaactactttacactcccatcagcagtgtataagcattctcttttctctgcaacctccctagaatctgttattatttttattttttaataaccattctgactggtgtgacatggtatctcattgtggttttgatttgcatttctctaatgattagtgacattcggcatattttcatatgcttgtcagctgcatgtatgttttcttttgacaactgtctgttcacatccattgcctacttcttaatggagttgtttgctttcttttttttttctaaatttaaattttataaagtaatatgtgtacataagagacaaatagttccacaaggcttataatgaaaaactgcagtcctctatcccaccatcccaaccttggggtctcactctccaaaaagaaatgctttgagcacttgagctgtcttctggtacttacctcctcactgctacaaaacatgctcatattattatttcctcatttgtttccattacagacattttctctaggcttcctaatatggagatgaggaattaacctcctcctatcctcttctacacttatatcacaatttctcatgtttgttttctgcttgtaaatctaagttccttatctattttggatattagactttcatcagaaaaatagtttgcaaatattttctcagattgtgtaggttgtctgtttactttgttcttaatgtcttttggtatgctgaagctctttagtttaattacagtccatttgtcaatttttttgttgttgttgcaattgctttttgtatcttagtcattaaactttgcccattcctatgtacagaatggtacaacacttattaccactttatggatgagaaaactaagacatgaagagattatgtaattcaatgtcacccaaaattatagaaaccctggaagacaaataccattctggacgaatccctatctttatcaatgcttcacagcttagctaacggtaattctcacaaatattgagcttttactttgtgtcaggaaatgcttcaagtattttgcttatattatcaaatttaacatgaaaaataagcctgaataatgattaatgagtcagttatggaaactactcttgactaggcaaggaacctctagttaaagtcttgtcactacctatattttgttatattaatggaattttattgttataattagttttattttcttcaccgctacattttaaatacagtgtgggtagatgcagttcctattcatcatttactcacaccacataatacattactgtcttcataatacatattttaaaaggacttattgggctatacaacaaatagagatttgtgttagcagggagaaaattagtacattttgaagaacttagagttaaaaataattagacggtataaatgaattctgcgattactcttttaaatgcttgcaatttgaataatgttaaagaatagaaaaagtatattactagtaaaatgccttgatttcaacaaaatatgtaaacaactagtaaaatgctttcattttgtcacaggatacttgaggtgttgcttttatgtccagaaacttccgtggccagtgggcctttgcctgggttttgcttgggcccactgggctcgttctgcccccttggcctggcaggctgtactctgctcatgatactggcctgaatcctatgcccgccaagggcgagccagacacagagcagggaggggtgtgtgagtgagtgagtgtggggtccagccaactgtgcatacctaggcatgccagctgcagcgggatgggcagctccaggtgctggcacgggtgctggcttcctgcaaggctgtagctggaacaggtgaactgcaagcagctttcacagctggcaccagggattgtggtggcaaccagaagcttggagatgtcaggaactgcagacggtcaaagagggtgtcacagccttggcttggggacctcctaagtcggggcttcctgaagggcctcagctcttctctccttctctcttctctccttctcatcacctacaacgtggcgagcaaggggtgtgtttcagccctgtttgtgttacagttccttcaaccccaccatttggcagttcccaagttcttgccctgcgtctaggaagaatgaggtacacagaaagtggagagtgagcaaggtgaagagttgatttattgagtgacaaaacagctcagaggagacccacattggttagctcttctccacaggcaggttatcctgccagagtctggctgagtcctgaggtttttgtgggcttcagaggggaggaagtgtgtgctgattggtccatggacagccataagctgcctggcaaaagcaccagaagttctcactctgatccacagactggctgcctggcccccaggcctcaggccatccctggcctgaaggtggagtttcactgcagatccatccctttctgaccaggaccctgtctgccacctgttgtcattaaccagccaggctgtttgtgccaaggggtgcctgcaggcccatgccaagccacctgagggcatgcacacccagcccagttgtgacagcacccgggctcgcccgcaactttgctcaaaaactggagtaggcactgggattgagaagaggccaggcagtgggagcagaaacttctgagcctgccgggacaaaggagcttcccgggcccctgagaatgcagagatgcccgggtctagagctgtggcttggcagctgcagctgtactcaggagggcagggttcccgcccctccaacgtggaaggggacggggcttcagcctgttccctgctcctaccggattcctggagtgcacagtcgtgacctcacctctactgcagccagcctcatggcaggggccactccagatggtatcaatccagctgctctcatcaatttcaacaacatatctaaacaactaaattttttcagctgccttcttttggcagttgcttagaaataaatgcatgagcatatccgaatgaattaacacactggtcatttcctccagtacagttacacagagcttatttctgcccgcaagtgaaaacaacatgtcttaaaacctaaagctaaagtgttctctgattttgtctcaagtggtgattcagatccataactgttatgcctatcaacctgtatgaacattgattttagctctggaatgtgccatcttgaacattttaccagctgactgggctttgtgcaaatgtttattatttctaccccatcctacttctctttccgcgttttgttcttgatcagttatattcccttggggatcaaagcacttgctttaatgggtttttccatctctgttatctttttctctgcttccaccgttttcagctgtttcctaatatctttcctctatgtatgaaaaaggacaaaaccctgagaggtacatgaaataattcagggaatattcttctaagcttaagaggccaaatgttcaaggaactcttctacagggaagtatgcttaatagtctttcatgtgtacaggttttatagatttaaataaatggtctttgacccaatgctcaaccaagttattcttccatcattatagaaatatgcagattataattgtaattttattatgaaatatttgtcagtatacatgacatcatatataatttttacaatatgttgtaatcaattttatttcagttggtttggatgataccttattacctgttaaggacaatctaaagaaattaactcacagacaagatccattgagggtataaaatttcaaattacatgtgtaacttggatatactaaccaattaaattttgttaaaaacaaataattcactccaaaatcacattaagcaatagaccctaagcccacagtatgtttttaatcaaaaacttttactgaataattaaaagagatattaagttatttaaatggttgaaggttaatcagattgtttatatttaaaaactatatgaaattaatattattgattagaggccctaaattaatatttctgtatttgagaaagttttcttttccaatttttgaatggacagctggatttttaagtgattttcagcatatgatcctaaataataataatcaaatgtgtgcatatattttacaagtagaactttgaaatatgtataatattaatatgtgcaaaaataacaaatatattgcacatattatatgcttaatgttgtaaacagtttacccatgttaataccttttgtcttcctagtaatcctatgtaataggcacaactcttattaccactttatggatgagacaaataagacatgaagagccaagattgaaaccaagaattgtagttcaaggcaatatgcatgtaatccctattctataatacagctctacgtaagttacatgaataaagaacatgagagtttttagagtttatttttgatgtctcaaaagacattaaacatcaagggagctttctctagtaaatgtttgcatcttttcgtagtccaaacactaatccataacaaatagtttttccaatttaagaacatttattattgccagaggcttaaaagtaaactatttctaatagcataggaaattgaacaatgctcattcttagagtcagtgtatttttgtttgtagaaaatgcttttagcaatttgtgcaatgcttgccctcaaagtcaatatgtattttttaaagtataatctaaagtgaagtaaacattgagacatttcttaggtatattgttaatattttctgtaccgtacactatctaaataatgaaagatattaataataggagtgagaataaaaataaatctcaatggagtatactattttaattttctactgctgtataatatattatcaaaaatttactggctcaaaacagcaccaattcttcacttctcagactgtggtgtgaccaagttcactaggtatctactggagtgtcaggatagataaaatgtttaaaatattcttagtcacacggtttgcagttcgggctggatctaaacttctgttaaaaggaacaagggctccttggagaaatggctgattcttggactggttgggataagaaacatacaagattgagcttggagcacattttatctccataaaataaagaagtgtcaaaaaaaaaaaaaaaaaaaaaaagaaatgatccataatcttggtggtgatatatcaaaagaattcaaagaaagggctcccaaaagccaaaggtggaacaagttaagaaacaaaataaataaagtagcattggactatagcccaaagtttaaaatagatataaacgaatccatgtgttacttattcaacgtaaaattgaataagtaagtaaatgtggagaatagacaaatctttcttgcagaaggactccaaataaattatgttaatactctgccctcaaggaggaggagcataactctttattccttaaatgtgggctgtacacagtgactttctttcaaataaaccccgttactactaaaaaaaaaaaaaaaaaaaaattcggtgggcgtggtggtacacacctgtagtcccagctactcaggaggctgagtcaggagaattgcttgaacccaggaagtggaggtggcagtgagctgagattgcacaactgcacttcatccagcctgggcaacagagcaagactctgtcaaaaaaaaaaaaaaaaaaaaaaaaacctaagaaaccttcaaaggacaagctgactctcttgttagggataacatttaaaataaaagtattttaaatattaatgaaaactcttaaagctggtgactttaagttaaagctgttgctaacttacttcaaaaaggcttgggcccttaagagttgtgcttactctatcttcctgtgctctatacatagaaaaatgaaacctgagtgtctacacatctgtttacatcatattttatagaatattctaagtatattgggacatattgctcagaaaaaagattcctttcaaaatagtactgttcattgacaatttatctggtcacccaagagctgtgatggagctgtgcaaggagattaatgttttcatttcttctaccacaacatctattctgcagttttttggatcaaggtgtaatttctacttttaaatttccttatttcagaaatccatttattaaggctatagctgccagagatcatgattcctcggatggatcgggcaaaggcaaatggaaaccttctggaaagggtttaccattttagatgccatttagcacatttgtgatatcatggggggtgatcaaaatatcaacattaataggagttagaagtaagttgattctaactttcatggatgactttgtgtgattcaagattttagctgaggaaataactgtaaatgtggtggaaaaaagtaacaaaactagaattataagtagagcctgaagatgtgactgaattgctgccatctcactatcaaacttcagcaaatgaggagttgcttctaatagataaacaaatgaagtcatttcttgaggtagaatctactcctgatgaagatactgtgaacgttttcaaaattacaacaaaggatttaattgatgaagcaaagacagtttgagagatttgactccaattttgaaacatctactgtaagtaaaatgcaaacagcattgcatgctacagaaaaatctcttgtgaaaggaagaatcagttgatgtggcaaacatcactgttgttattacttgaagaaattgtcacagcctctccaagcttcagcaatcaccaccctgatcaattagagccacacacatcgaggcatggccagcgaaaagattataacttactgaaggttcacatgatttttagcattttttagcaatgaggtgttatttaaaattaagatatgtatactattttttaaacataatgctgtcacacactacagtatagtgcaaacaactttcatatacattggtaaaccaaaaacttcgtgtggctcactttattgcagtggttatgaactaaacctgcaaaatttatgaggtatgcttgtattattttactgaaaattgcattttagaagtaaatgtaggtatcaaaaaaaaatgaagtctgtagatagatattacattgcaattatcattccagggatgatagtagacacaccacttggtatttttttttaatcttatgagacccataaagggcagcctttgtttaatagcaccttttgacatttattacccttcttctgactttttttctttaatttatgaagtcataagtgcatcatctcttttcttaaatatcaggttatcactagtattctaacttgctcttattttctttgctttaagtgagacgggttttaatataatgttcttaaataatgaagacaaagtttgcatctgcatagttagtgtttctaataatggcagaaagctttcctgtttagtgagaggaaagctacaggttaaaaaattaaattaaaacaatataacataagttattatgtgcttgcatattcttttatgcataggcaaattcatgtacgtaattttgtggtggaatagcatgtaaagccaatgttttgaattttcatttacttgaattatagggtgataaaatatctttgattcttttcattttttaactttgcattcctctattgttatataacagagagtaacttttatgatattttagctaaatacttgcgtttagtataataatttagctactgtatttacctctttcaattctcttattttcttggttgattacctttatcattcaattgtcatgtcctttataataatttctctgttccttttatgttttatagtcatctctgtctttattcatcataaggcagaaattcagaatatcaatacataaagaaaaaatgtatttttattattaatggaaactctttgtttaattaaacttaataaaactgaaactttttgccctcctttttaaaaataaatgttgttgtatatattttaagtatacgacatgatgttatggagtacgtatagatagtaaaatgttaactatatcaaagcaaattaatatagccattctcttacatagttaactcgttttttgtgtatgtggcagaagcagctaaaattttatttagcaataatcctgaataacataccataccatattaataactttagttttcatgttgtacattagatctctaggcctgttcatcctgcatatgtaccactttgtaacctttgagcttcatcttctcattttctccttcccattttgccacccattttgccacccacaattactgtttcattctctatgtctgtatatttgaacttctctgaccacaatggaataaaactataaattaataacaagagaaattttggaaacactacaaatgcatagaaagtaaacaatatgctcctgaatgaccagctggtcaatgaagacatttagaataaaattaaaagatttcttgaaacaaatgataatgaaaacacaacatacccaaacctatgggatattgcaaaagcagttctaagagggaagtttacaggtataagtgtctacatcagaaaagaataaaaacttcaaatgtacaatctaacaatgcatcttaaaaaaactaacagagcaagagcaaacaaaacccaaaattagtagaagaaaagttataataaacctcagagcaaaaataaataaaattgaaatttaaaatgcaaaatattaataaaccaaaaggtgtttctttaaaaaatatttaaattgacaaacctttagtcagactcactaagaaaaaagagataatccacataaataaaataagaaatgaaaaaggaaaccctaaagttgatgtagcagaaattctaaggacctttagtagctactatcagaaactatctgccaataaattggaaaatatagaagaaatggacaaattcctagatacctacaacctggcaagattgaaccagaaaaaaatccttacttgaatggaccaataacatgtaatgataaaagccataataaaaagtctcccaggaaaaaaggaaaaagaaaaaataaataaaccctgggcctgatggcctcactacttaattctaccaaacattagaagaataactaacaccaatcccactcaaactattacaaaaaatagcagaggaggaaatacttcaaaactcattctacaaggccggtattaccctgatacccaaaccagaaaaagacatatcaaaaaataaaataaaataaaatgacaggccaatatctctgatgaatattaatgcaaaaatcttcaacaaaatactagcaaaccaaattcaacaatacattagaaagattactaatcatgaccaagtgagatttatccctgaaatgcaaggatggctcaacatatgcaaatcaatcaatgtaatacatcaaatcaatggaatgaaaaatataagtcacatgaccatttccattaatgctgtgaaagtattctataatattcaacatcccttcatgataaaaaccctaaaaaaactgagggtagaagaagcatacctcaacataataaaagccatgtattacagacccacagctcatatcatactgaatggggaaaacctgaaagcctttacattaaaatctggaaaatgacaaggatgtccactgtcaccactgttattcaacatagtactggaagtcatagctagagcaatcagacaagaggaagatataaagggcatccaaattagaaaggaaaaagtaaaattatccctgtttgcagatgatatgatcttatatttggagaaacctaaagacaccacaagaaaactattataactgataaattcagtagagttgcagattacaaaatcaacatataaaactcaatagcgtttctatatggcaaatgtgaacaatgtgaaaataaaacctcatttacaatagcaatacataaaattaaatgactaggaatcaacctaaccaaagaagtgaaacatctctataatgaaaactatgaaacactgaggaaagaaattgaagaggacacaaaaatggaaaaatattttatgttcatgtattggaagaatcgatattgttaaaatatttatattacccaaagaaatctatagatttgatgcaatccttatcaaagtgccaatgatagtttttacagaaatagaaaaaaagatcctaaaatttatatggaatcacaagagacccagagtagccaaagctattctgagcaaaaagaacaaaactggaggaatcacatgacctgacttatactatagagccatggtaaccaaaacaacatggtattggcatgaaaacagaaacgtagaccaacagaacaaaatcaagaacccagaaatgaatccacacacctagagtgaactcattgttgacaaaggtgccaagaacatacactgggaagaaaacaatctcttcaataaatggtgctgggaaaactgaatatccatatgcagaagaatgaaattagatcctaatctcttgccatataccaaaatcaaatcaaaatggattaaagacataagtctaagacctcaatccattaaattacttcaataaagccttggggaaaatctccaggacattaatcaaggcaaaaattattgagcaatacttcacaggcacaggcaaccaaggcaaaaatggacaaatgagaacacatcaggtaaaaaacttcttcatggcaaaggaaacaatcaacaaagccaagagacaactcacagaatggaagaaaatacttgcaagctatgcatttggcaagggattaataatcagaatatataagaagctcaaacaaccccatagggaaaaaaagtctaataatccaatcaaaagataggcaaaagatttgaatagacattaaaagaagacataaaaatggaaaacaggcatatgaaaaggtgcttaacatcattgatgaacagagaaattcaaatacatgttaaattgacatattaactgacccttaaaatggcctatatccaaaagacaggcaatagaaaatgctggagaagatgtggagaaaagggaaccatcatacactgttggtgggaatgtaaattagtacaatcactattcagaacagtttgggggtacctgaaaatactaaaaatagagctaccatatgatctagcaatcctatagcttggaatacacccaaaaggaagaaaatcagtgtatcaaagataaatctatactttcatgtttgttgcaacactgttcataataactaagatttgaaagtcacttaagtgtccataactagatgaatggataaagaaaatgtggtatatatacacagtggagtactactcagccataaaaataagaatgatatccagtcgtttgcaacaacacggttggaactagagatcattatgtttgtgaaataagccaggcacagaaagactaacgtcacatgttctcacttttttctggcatctaaaaattaaaacaactgaactcattgacatagagagtagaagaatggttatcagagcctgggaagtgtagtgtattgctggggaaaggtgggcatggttaatgaatacaaaaaattcattagaaagaatgaataagacctactatttgatagcacaacagggtgactatagtcaataataactgtacattttaaaataacttaaagaatatagttggattgttagcaacttaatggataattgcttgagtggatggataactcgttcttcatattgtgcttatttcacattgcatacctatatcaaaatatctcgtggaccccataaatatacacacttactatctacccacaaaaggtgaaaatttaaacctaaaaattttaaaggaaaatatacatgtatgtaattttacatcacctaaaccagactctaatagctattaaagttattcatttaatctattttttttctggttatagaacaataattggttatacttttaattctaagaatattttttctttcatagaaaatgagccttcaaatagttactgaatatactttatataccatatcttttaaacaaaatctcataatttcattgttttcatttaaataaaagatgaccctgaaactggatgatgctctttctctcttgtgtctttgttcaaaacattcatgtatattagtggccagtaaacttcacaacaatccctttgtagtttagccttcttccagaaaatccttagtctatagccataggcattctgctttctttcataaggctgctttctttgggcacaatgggaaacattcttatcacacatcgtgttatgaggctggtgctagccacatttgaactgaatgtttggtgtgttttacaaatattcactatgtctccaggaaaaacactggcatgaaaaggtattcactattttatttgaagaaaacaggttgagctattgtgacatagtttgtgcgctgcatctggttacctcaatttgagattaatttaaataaatttagttggcagagtgtaactgacactgtaaaatttcatttattttattaatattttgatttcagtaggttttcaagggaacaggtggtgttgggttacaagaataagttctttagtggtgatttctgatattttgatgcgcccatcacgtgagcagtgtacatgtacactatgcccagtatatagtcttttatctctcaccctcctcccaacctttcccctgagtccccaaagccaattatattatttttatgcctttggatcctcatagcatagatcccacttatgagtgagaatatatgatgtttgattttccatttctgagttacttcacttagaataatggtctccaataccatccagattgctgcaaatgctattattttgttcatttttatggctgaatagtattccgtggtgtgtgtgtgtgtgtgtgtgtatttctttatccactcattgattgatgggcatttgggctggttccatatttttgcaattgtgaattgtgctgctataaacatgaatgtgcaggtatctttttcttataatgacttcttttcctctgagtagacacccgggagtgggattgctgggtcaaatggtagatctacttttagttctttaaggaagctccacactattttccatagtgattgtactagttaacagtcccacaacagtgtcaaagtgtttcctttttaccatattcacaccaaaatccatttttttaaattatggccattcttacaggagtaaggtggtatcacattgtgatttgcatttccctgataattagaaatttggggcatttttcatatatttgttgaccatttgtatatcttcttttgagaattgtctattcatgtccttagcccacttttttaatgggattgattttttcttgctgatttgcttgagtttcttgaaaattctggatattagatatttgtcagatgtatagactgtgaagattttctcccattctgtgggttgtctgtttactctgctgattatttcttttgttgtgcagaagctttttagtttaattctcatctatttatctgttttgtttgtttgtttgttttgcatttgcttttgggttcttggtcatgaagtccttgcctaagccaatgtctagaaggatttttccagtgttatcttctagaaattttatggtttcaggtcttagatttaagtctttaatccctcttgatttgattgttgtataaagtgagagatgaggatccagtttcattcttctacatgtggcttgccaattatgccagcaccatttgttgaatagggtggcctttccccgctttatgtttttgtttgctttttcaaagatcggttgattgtaagtgtttggctttactgctggattatctattctgttccattggtctatatgtctgattttataacagtaccatgatgttttggtgtctatggtcttacattatagtttgaagtgggtaatgtaatgcctccaggtttgttctttttgctaggctgggtttggctatgcgggctctttgttggttttgtatgaattttaggattttttttccagttttgtggagaatgatggtggtattttgatgggaattaggttgaatttttagattgcttttggcagtacagtcattttcacaatattgattctacccattcatgagcatgggatatatttccatttgtttgtttgaaataaatcatctatgatttatttcagctgcgttttgtagttttccttgtagaggtctttcacccccttggtgaagtatattcctaaatattttattttttgcagctgtggtaaaaggggttgagttcttgatttgatcctcagtttgcttgctgtcagtgtagagccaggctactaacttgtgtacattaattttgtattctgaaactttactgagtacatgtaccagttctacatttgaataattctttatggttttctatgtatacaataatgtcctcagcagaaaaagacagtttgacttcctctctgcaaatttggatgccctttacttctttatcttgtctgatttctctggcttggacttccagtactatgttgaatagaagttgtaggagtgggcttccttgtcttgttccagttctcagaaggaatgcttttagtttttccctgttcagtatattgtaggctgtgggtttgtaatagatgacttttattacattaaggtgatgtctcctctatgccaattttgctgacagttataatcataaagggatggtggattttgtcaaatgctttctctgcatcaattgagatgatcatgtgatttttgtttttaattctgtttatgtggtgtatcgtatttattgacttgtggatgttaagccatctctgcatctttagtatgaaactcatttgatcatggtggattacttttttgatatgctgttgggatcagttacctagtattttgttgaggatttttaatttttatttttattatgttcatcagggttattgttctgtagtttgctctttttttttattttttattttttttgagatggagttttgcctttgccacccaggctggaatgcagtggtgcgatctcggctcactgcaacctctgcctcttggattcaggcgattttcctgcgtcaacctcctgagtaactggaattacagatgcctgccaccatgcccagctaaattttgtattttcaatagagacagcgtttcaccatgttgaccagactggtctcaaactcctgacctcaggtgatccacccgcttcagcctcccaaagtgctgggattacaggcttgagtcaccacacccggcctagtttgctttttttgttatgtcctttcatggtttttagtattagggtaatgccagcttcacagaatgttttagggaggacttccttcttctttctctttttgaatagtttcaataggattgataccaattcttctttcaatgtctcataaaattcagctgtgaatcctctggccctggacttttttgggggtaactttttaattaccatttcaatctcactgcttgttattggtctgttcagagtttctatttctttctggtttaatctatgaggtttgtgtatttacatcaatttaaccatctccttcaggttttctagtttatacgcataaaggtgttcatagctgtcttgaaagttcttttgtatttctgtgatatcagttgtaatatctcccatttcatttctagttgagcttttttggatcttctctcttcttttcttggttaatctcggtaatggtctatacattttatttatcttttcaaagaaacagctttatgtttcatttatcttttgtatttttatttgtttcaactttagttcttctctgatcttggttgtttcctttcttctgttgtgtttgggtttggtttattcttgtttctataactccttgaggtgagaccttagattgtctatttgtgctctttcagactttttaatgcaggtgtttaaggctattaactttcctcttagcacaaccctggctgtatcccagaggtgttgataggttttgtcactattatcatacagttcaaagaatttttaaatttccctattgattttattgttgactcaataatcattcaggagcaggttatttaatttccatgtatttgcatagtttagaaggtttcttttgaaactgatttccaattttatctcactgtggtctgagagagtacttgctatgatttcaattttcttaaatttgttgagacttgttttgtggactgtcatatggtctatcttggagactgttttacgtgttgatgaatataatgtatattctgcagctgttgagtagaaagttatgtaaatatctgttaagtccatttgttctggggtatagtttaagtccattgtttatttgttgactttctgtcttgattacctgtgtagtgctgtcagtgaagtactgaagtccccaaccattattttgttgctatctatctcatttattaggtctagtagtaattgttttattaatttgggagctccagtgttaggtgcatatgtatttaggattatgatatatttctgtttgactagtccttttattattatataatatccctcttcgtattttttaacagctgttgctttaaggtttgttttgtctaatataagaatagctaatccttcttgcttttgatgtccattagcatggattgtatttttttttttcatccctttaccttaagtttatgtgataccttatgggtcaggtgagtctcttgaagacagctgatacttggttggtgaattattatccatgttgctattctgtatcttttaagtggagcatttagaccatttatattaaatgttagtatttagatgtgaggtagtattcatcatggtatttgttctctgaatactttggtgtgtgtttttttttttcattgtgcgattttttaggtcctgtgagatttgtgctttaaggagattctcttttggtgtatttcaataatttgtttcaagatttagaggtccttttagcagtttttgtagtagtggcttggtagtggtaaattctctcagcatttgtttgtctgaaaaagactgtaccttttcttcatttatgaagcttagttttgctagatacaaaattcttggctctttattattttgtttgaagagcgtgaagataggactgccatcccttctagcttgtagggtttctgctgagaaaaattctgttaatctgatagatttttctttataggttacctgttgcttttgcctcacagctcttaagattctttccttcatcttgacttagataacctgatgactacattcctaggcgatgatctttttgctatgaatttcccatgtgttctttgagcatcttgtatttgaatgtatagatctctagcaaggccagcgaggtattatttgattattccctcaattatgttgtccaaacttttagatttatcatcttccttggggacaccaattattcttaggtttcatcgtttaacataatcccaaacttcttggaggctttgtcaatttttaaaaaattccttttctttgtctttgttggatttggttaatcttaaagccttgtctttgacctctgaagttctttcttgtacttgttcagttctatggctgagactttccaatgcactttgcatttccctaagtgtgtccttcatttccagaagttgtggttgttttttatttatgctatttatttcactggagatttttccattcatttcctgtatctctctttttttaaaatttttatttctttaagctggactttaccttttgtggtgcctccttgattggctaatagttgaccttctgaattctttttctggcaattcagagatttcatcttggtttggatccattgcttctaagctagtgtgattttggggagctgttaaagaaccttgttttgtcatattaacagaattgtttttctggttacttctcatttgggtagactaagtcagagggaagacctgggacttaacagctgctgttcagattcttttgtcccatggggtgctcccttgatgtgctgatgtcccctttcccctagggacggggcttcctaaaagctgaactgcaatgatgtttatttcttttctggatctagccatgcagcagagctactaggctccaggctggtactgaggagtgtctgccaagagtcctgtgatgtaattcatcttcaggtctttcagccatggataccagcacctgctccagtgcaggtagcaggggagcgaagtggagtctttgagggtccttggatgtaatttggttgtgtgctggttggcctccagccaaaaggtggctctttcaagagcgtaatagctgcggttgtatggagaggattcaagcttgccctaggttcaggcaatgggcggggccatagagctcccaagggattatgtcctttgtctttagctaccagggcaggtagaaaaagatcatcaggtggggagagggttaggcatgtctgagttcagactcttcttgggcagggcttgctgaaactgccatgggggatggaggtgtggttttcagacacatggagctgtttccagggggattattgctgcctctgctgcatcacttaggtcaatagtgaagtaggggaaagccagcagccacaggcctcacccagctcccatgcagcctgcagccggcaaggccagtctcacttccactgtgccttccaccaacaacacctagtttatttccaggcagccagtgagcagggctgagaacttgcttcaaactacaagcctcccacctgagaaagcaagctgtctcacagttcctgggctatcccacgaagcccgcagtggcaatccacctcctccaaagggtctgcgtatgctctcagctttcctgatatgttcctgtggtagttcttgcagcaaaagttcacgatgtgagtttccacaggctgctctgtgtatccgagtgggagctgcaagttagccctgcctcctatccgccattttccccaataataaagattttatttataatacctgagattccaatattgcttttattttgaggaaatcaagatgttttatattttcagatttctcaaaattgtttgagatttttaaatactacagtagacaggtaaagaaacttaagttgagataagttaattgagtcctctattagtaaaaacaattaaataattaaattatttaataattattttattattaaataattattttaaaatcctgttattaactcaacaaaattttatcaagcacctattatgtgctaggcaattttctaagtgtgggaaaaatggttaaataccttgacaaaattctctaccttaaatggattgtagattctaaatgaacagaaaaaataaataaataattcatttgatttcattatttctagagttctctgtttattgactttcctccaaaaaattaattattcttttattttgagtcttcaaaattattaaccaaacatgctcaaataaataagttacacagaaaaattaatggtgaaaaccatgacccatggaatcaatacaattattgatatccacactttaaatttaataagagcgaatgatgttcttgcactttagatacattttctataaccctatttcaataagagattgatcactctataaaattatagcagaaaatacagacttctccgttaattcaataacattatttttgtttcacccatatgctctgattcactttatatcctagactacatatcttaattattgagctcaaaataaatatttttcaattgcatgaagagaagtataagattgaaattatgtttaaactggacaaacttagtacagcatctggatattctttttacacatggcttgtagaatattctatgattaatcaaataagaattcttccaatttgaatttgtatagtggaaattaaactgaaatttagaagacttaaggtaaaacataaaacttgaggaacaactcatattatactggccttggcttttgttctgttacataaagtcattggtttagataatatgtaaaatgtttttgagactcaaacccctcaagctattctggtgaagtctaaatctaggcattctgtataggagtaccataagtttgacagcataatcttgaaatccacaaaataatctcatgctaaattttaaaaccagcttctttaagagatatacagaagcagaaatcaaggggtttggaagaagacttgcttgggtagagggattacaaaagaatccagagacagcagagaacagaactacagaactactattgagttaatctgcaacttcaggattaatgaatgccaaagttctgaaatctcatagaaggtccactgtatctttctgcagatgtttaccaatcaaaattttatcttcattctgaggcaaagctatgatttgttctggttctcattggtttccaatgtccaatatctcacactgtcattggacagcaagcctggttattgaagcagtattttcaagtgagatgtattcaggagaaagttgttttgtgcttataattttaggtatctattatgaagttgtctttatgatagttttatttgtcaacaggatctgataattcaaaatacactgaaaaatatcaaaaactaagaccaatgagtggatattcaaatccagattatatgctatatgtacaactatgaagtacacataataatcattttttaaaaagaaaaaaaatttatttggaaacaaaagatgctgtttagtgcaaaataagtatataaaattttggacttttgtaaagaagtcatattttttgtttactgtcagaaaaaatttttacagattttggaatcgttcaaagaagtatttggtgcattttgtttgaaaactaactgctttcaagggtacctagaaacagtctgggttatgtgcacctttcattgtctttgatctactttacaaccctgtaactttgtgaaaaattgaaaataatgttacgtctacagaaaagcaaattagttgtgtccaatctaatacttattgccctgtgaacatgtttgtacctatgtacatgttcatgtaaatatttcttttctgccaacatacgtgtgatattttaattttcctttggccagttgtaatatataatagcatatggattgcctccataatgagttaaataatatattttacagtgtttattgtacgttgttattactctttttttttagcattttgccatttttatctttagcagtattcaagcatttgtctttacaaaagtcagatcagttactataataaacattatttggtttctccttcatttaaaaaaaaattgaaggttcagaaaagtactaatcacatgatgacatgtcacatatatgtcgatttgctttgtgaatgtaatagtttacacacacataaatacttcatatttcaggtatggcttatatgacttacatacattctacaaaatactttaaaagcaattgtgtctgatggacctcaggcaagacacagttattattagacacttactttatctaaaaaatctaaaaaatcaaatctaaaaatattttagatatttttgcttgtaactttaataattaaaacaatggagaacagattttcaaaaaaataaagatcgttctctttgtattttgggtgagaatacggtcttcaattgttgatatgcatcccactgctagctgcctgactttcagttatgatgtgacatgcctaaataaaaattcactgactttatgcctgaaactaatttacttatatttactagaaaggctgctctcaattcctataggtgttcttgttcaaaatcaatatgcaaggcataacagaaaagaagaactcaaattgactttattagcttcagtctatccacaaacatataaacaaggcaaattctcttttaaattattgataacctcctttagcctctactaattcttttcaatggagaagtaaacattcatgtaaaagactataaaaatggttaatgaagtcagaaccactgacctggtagctactttccctatgtaagactaaattatgcacaatttataactgagtttattgtatttccttatttcacaaataggcattaaaatatgttttaatggctgggcaaagtggctcacgcctgtaatcccagcactttgggaggccaaggtgggcggatcacgaggtcaggagatcaagaccatcctggctaacacggtgaaaccccttctctattaaaaaatacatacatatatatatattagctgggtgtggtggcacatgcctgtaatctcagctactcaggaggctgagacaggagaatcgcttgaactcaggaggcagaggttgcagtgagctgagattgcgagatggtgccactgcactccagcctgggcgacagaccgagactgtctcaaaaaaataaaaaaggaaaaaatgataatatgttttaacaatttagatttactaggtaactttgttattttgttttgtttttctgtatttgcatgtggaaacaatgtatgataatttttaatatccattataacctcataaaatatttttataattaggagactttaattcattagtagtagatatgcatttttgtatgtctaatcacaggaaaaagtttttaaacagagtcattccttacagtgtaatagaataaacatgcatttccattttttgttctttacacagaaataatctctgagcttcaaaactgtcaaggaaaaattaaaaagtttcactgcttcatattggctgaaaacatggagattaacttttgtttctttgcttcttatggcttagagaaagtaatacatacatgtaaaaattaacatctatggttatgttgtactttgagaagagatactttaggaggatttaaagttaatgatatggacgtgtaacagaatatgaatgtcctaatatgaaaatttaacaagtatatttctttcttctccttgcattgttaaaatcgaatgcaaaattttctccatactcctaggagatttggaaaattaaggcttccacaatctctagtttttcagttgtacgtaataaatttatctattattggaattttgtgccaactctggggagaagtgaggcagctagtgacctaggattagctagataaatggttttgccaaaagaccactgtaagaaaaatgtaaaaaccagaagcttaaagtttctgtgaaaaacagaagacattatcactgactatgaacaaagctatgaaattgccactgactgcctagctgccatggatataaacactacatgatctgtatccaggactaaaccaatccagccacccagtggtatatgaaaaggacattcatcattcatcaactaccacctccagttttctgggaagaataactcttatctatactgcaaaccttttctggttgtagttttatttggagaactacctatatgatgactgggaatgttcataagccatcctcccattctcctctccctcagagaaaaatgatagtccacaaataccagttgaataagtagagaagccacttaggaaaatacccaaataattttgagattccctaaattaaaagacagttattggtgacacccagttaaaaatggaatatatagaatacataaaatatatctgtgaatattcatagtcttggtgaattactgtcttctgtttcacagtatctgaagaaactctatgaaaactaaagataatacacaaataaaatatatgcaaacacactatagttacatttgcttggtatttgggggtgacttttagttccactatctgaaggtaggaaagaagaaccccttttctcttttcactccattcacactataacacaaaataaaaggctgggcatggtggctcatgcctgtaatcccagcactttgggaggccaaggtgggcagatcacctgaggtcaggagttcaagaccagcctggccaacgtggacagaccccatctctactaaaaatataaaaattagctggatatggatatggtggcaggtgcctgttatcccagctacttgggaggctgaggcaggagaattgcttgaacctgggaggcagaggttgcaatgagctgagatcgtgccattgcactccagcctgggcaaaaagagcaaaactctgcctcaaaaaaaaaaaaaaaaaaaaaaaaaaaaaaaaaaagaagctcatctaataatcctcctcagtgaaaggaattttagtcacttattttcttcttatttatttcttttcaagagaacagtaagtaattaggaaagacattacattaattcagctacataatcagggttttatgtctctaagctagaaacatatttcaacgtgtgttttttttaaacaggtctattgagatataatcaatgtatgaagagcttcacatttttaatgtgtacaatttgatgtttggatatatgcaaatacctatgataccatcactacaatcaaacatgtagtacatccaacacctccaaaagcttctttgtattcttctgttttttatttctttgttttggtgttgagaactgttaacacaaaacatatcctcttaaaaaattctgaagtgcacaatattgtatttttaaaataggtactatgttgtacagatctctagaacctattcattatggattactgaagctttatacctattaaacagcaacctcccaattcatccactcttccatctcagacaaccactattgtactctctggttctattagtctgaaaattattcatacttcatatagatggaataatatgtatttgttcttctataactggctaacttcacttagcagatatttctccaaacaagacgtacaagtggcccacaggtatatgaaaagatgctcaacttcattagtaacagggaaatacagatcaataataaaacgagacataatctcaaacctattcagacagctattatcaatttaaaaatagataagtgttggcaaggttatgtacaaactggaatcttatgtactgttggtaggaatggaaaaaggtgcagctgctgtggaaaacagtataaagatttctcaaaaaattaaaaatagaactaccatgtgattcagtaggtctcatttcttggtatgtttaattggatggaagtcaaaattccatgtttatatcagcattattcacgatagccaagaaaagaaaacaactcaagtgcccattcatggaagaatggataaataaaagttgctatattcatacaattgaatattattaagcctaaaacacaaacacacacacacacacatgagaaaatcttgctattgacatgggggaaactgcatggtgttatcttaagtaaaattagccaatatgttttttgtgttatctgatttatgatttgtttaaataattgtgtgctcttctttttttccttccacaatgtattaggtactcctttattttagtaaaattaagatatataatgacatatttaaaactacaatgtgatgttttatatatgtatacattgtggaaatgtgtaccacaattgagctaattagcatgtatgttactcacatagttaccttttttggagagggaacaggtgagaatacgtaagatctacagtgttagcaaacttcaattgtaaaataaattattgttaactatagtcgccatgctgcaccttaggtcttcagaacatattcatcttataaacgcaaatctgtaccctttgaccaacttctctttttttttattattatgctttaagttttagggtacatgtgcacaatgtgcaggttagttacatatgtatacatgttccatgttggtgtgctgcacccattaactcgtcatttagcattaggtatatctcctaatgctatccctcccccttcctcccaccccacaacagtccccagagtgtgatattccccttcctgtgtccatgtgttcgcattgttcaattccacctaagtgagaatatgaggtgtttggttttttgttcttgtgatagtttactgagaatgatgatttccaatttcatccatgtccctacaaaggacataaactcatcattttttgtggctgcatagtattccatggtgtgtatgtgccacattttcttaatccagtctatcattgttggacatttgggttgattccaagtctttgctattgtgaatagtgctgcagtaaacatacttgtgcatgtgtctttagagcagcatgatttatagtcctttgggtatatacccagtaatgggatggctgggtcaaatggtatttctagttctagatccctgaggaattgccacactgacttccacaatggttgaactagtttacagtcccaccaatagtgtaaaagtgttcctgtttctccacatcctctccatcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctattcatgaccttcgcccactttttgatggggttgtttgtttttttcttgtaaatgtgtttgagttcattgtagattctggatattatccccatcaagctaccaatgactttcttcacagaattggaaaaaactactttaaagttcatacggaaccaaaaaagagcccgcatcaccaagtcaatcctaagccaaaagaacaaacctggaggcatcacactacctgacttcaaactatactacaaggctacagtaaccaaaacagcatggtactggtaccaaaacagagatatagatcaatagaacagaacagagccctcagaaataacgccacatatctacaactatctgatctttgacaaacctgagaaaaacaagcaatggggaaaggattccctatttaataaatggtgctgggaaaactggctagccatatgaagaaagctgaaactggatcccttccttataccttatacaaaaattaattcaagatggattaaagacttaaacgttagacctaaaaccataataaccctagaagaaaacctaggcattaccattcaggacataggcataggcaaggacttcatgtctaacacaccaaaagcaatggcaacaaaagccaaaattgacaaatgggatttcattaaactgaagagcttctgcacagcaaaagaaactaccatcagagtgaacaggcaacctacaaaatgggagaaaattttcccaacttctcttctattttttgccccttgtcccatgggaatcaaactctactctctatttctatgagtttgactttttaaatattctctatataagtaatatgtagtatttgttttactgtattactgtacttgatttatttcaattagcataatgttcttcagttcatccatgtggtcacagatgtcagaattccttcttttgtaaggctgaatagttttccatttcaattagtataatgttcttcagtttcatccatgtggtcacagatgtcagaattccttcttttgtaaggctgaatagttttccatttcaattagtataatgttcttcagtttcatccatgtggtcacagatgtcagaattccttcttttataaggctgaatagttttccattttgaataccgcattttctttattcatctatcaatggacacttggggtgtttccatatcttgactaatatgaaaaatgctgcaatgaacaagtaagtgcaagtatttcttttagacactgattgtacttcctttggatatatatgaataagtaggatggctatatttcctttggacacacacaccctcccaagattgaaccaagaagaaattgatatcctgaacagaccaataatgaccaataatgatttccaaaattaaactagtaataagtagcttaccaacaaaaaagagcccagaatcagatagattcatagctaaattctaccagatgcacaaagaagagctggtgccattcctactgaaactattccaaaaattaaggagagggatttctccccaactcactctatgagaccaccgtcgtcctgatactaaaacctggcagagacaataaaaaaaggaaactgcaggccaatatccttcaggaacattgattcaaaaatcatcaacaaaatactttcagactcaatccagcagcacaacaaaaagctaatcaaccatgatccagtaggcttcatccccaggttgcaaggttagtgcaacttatgcaaatcaataaatgtgattcatcacatatacagaaataaagacaaaaaccacatgatcatttcaatagatgcagaaaaggcttttgttaaaattccacattctttcatgttaaaaattctcaataagttaagtagtgaaggaacatacttcaaaataataagagccacctatgacaaatgcacaggcaatatcagactgaatgggtaaaagctggaagcatttcccttgaaacctggtccaagacaaggatggcttctttcaccactccttttcaacacagtattggactccttggcccagcaatcagaaaagagaaagaaataaagggcatccacataggaggaaaggaagtcaaactatccctgtttgcagatgacatgatcctatatctggaaaacaccatagtatcagccccaaagcattatatgctaataaacaactttattaaagtttcagatgcaaaattaacatacaaaaatcactagcattcctatacaccatgatatggtttggctgtgttcccacccaaaacttatcttgaattgtagttcccatcatccccatgtgtcgtgggagagactgggtgggaagtaattgaatcatgggggaagttacctctgtgctgttctcgtgatagtgagttctcacaagatctgatgctttcataaggcttttccccattttgcttggcacttctctttgctgccttcatgtgaagaaggacatgtttgcttccccttccttcatgattgtaagtttcctgcggccatcccagctctgtggaactgtgagtcgattaatcctctttcctttctatattaccaagtcttgggtatttcttcatagcaactactacacaccaccaacagccaaagaagagctgaatcaggaacacaattccattcacaattgccacaaaaagaataaaatgcttaggaacgcagctaaccagggaggtgaaatatctctacagtgggaattacaaaacactgctcaaaaaaattatggatgacactaacaaatggaaaagcatcaggtgctcatggataggaagaattaatatcatcaaaatggccatactgctcaaagcaaattatagattcagtggtattcctattaaactatctaaagcatttttcacagagctagaaaaagctattttaaaattcatataaaaccaaaaacaatcccaaatacccaaggcaatcctaagtaaaacaaacaaataaacacaaagctgaagacatcacgttatctgattccaaaccatattacagggctatggtaaccaaaacatcatagtactgcaacaaatacagacacgtagaccattagaacagaatagaaagcccagaaataatactgcatacctacaatcacctgatctttgacaaagctgacagaatcaagcaatgcgaagaggagtcttgtttcagtccattttgacacagctataaagacataccagggattgggtaatttataaagaaaaggagtttaactgacacacagttttgcagggctgtggaagggcatatcttacatggaggcaggaaagagagtggtgatggaagtggggagagccccttataaaaccatcagatctcgtgagaactcactcactatcctgagaacaccatggggaaaactgctcccatgatccaatcccttcccaccagatctctcccttgacacttgaggattacaattttagatgcgaattgggtggagacacaaagacaaaccatagcaactccttagtcaataaatagtgctgggataactagctagccatatgcagatgattgaaactgaacaccttctttagaccatatacaaaaatcaactcaagttaaattacagacttaaatgtaaaacctaaaacaataaagactctggaaggcaaccaaggcaatatcattctggacatagaaacaggcaaagattttgtgatgaaaatgacaaaagcaattgcaacaaaagcaaaaaatgacgatgggatataattaaagttaagagcttctgcacagcaaaagaaattatcgacagaataaacagacaacctagagaatgggggaaaatatttgcaaactatgcatctgacaaaggtctcatatttatcttctataaggaacttaaacaaatttacaagagaaaaacaaccctattaaaaagtgggtaaatgatgaataggtaattttcagaagacatacatgtgggcaacaaacagatgaagaaaacctcaatatcactgattattggggtaatataaatcaaactcacaatgagatatcatctcacgccagtcagaatggctattattgaaaagtcaaagtagatgctagcaaggttgcggggtaaaaaaaaatgcttatacactattggttgtagtataaattagttcaaccattgtggaaagcagtatggtcattcctcaaagagctaaaaacagaactaccatttgatccagcaatcccattatgggctatatacccagaggaatataaatcattctaccataaaggtacaggcacataagtgttcattgttgcactgttcacattagcaatgacatggaatcaacctaaatgttcatcaatgacagattgaataaagaaattgtagtacatatatatgaatggaacactacacagccataaaaaagaacaagatcctatcttttgcagaaacttggttgaagctagaggacattatacttagcaaattaacacaggaacagaaaactactgcatattctcaattataagtgggagctaaatgatgagaactcatggccacaaagcaggcaacaacagatactggggcctacttgagggcagaaggtggaaagaggaagaaaatcagaaaaacaaaataactatagggtactagacttagtatctaggtgatgaaaaaatctacagtaaacccctgtgacgtgggtttacatatatagcaaatctgtgcatgtacccctgaacctaaaagtttttaaataatggacaaaagatttaattagacatttctcaaaagaatacatacaaatacctaacaggtatatgaaaaggtgttgaacattattgatcaacagtaaagtgcaaatcaaaactataatgagatatcaacttactccagttaatatagcttctatccaaaatacaggcaataacaaatgctagcaaggatgtggagaaaaggaaatccttatacaccattggtgaggatgtaaattaatacaatcactatggagaaaagtttggtggttcctgaaaaaaataaaattagagctaccatatgatccagcaatcctattgctgggtatatacacaaaagaaaggaaatcagtatatcaaagagatacctgcactcctatgtttgttgcagcactactgttcacaacagtgatgatttgaaagcagcctaagtgtttatcaacagaataaagaaaatatggtacatatacacaatgaagcactattcagccataaaaaaggatgaaatcctgtcatttgcaacacatggatggaactggagattattatgttaagtgaaataagccaggcacagaaagacagacatcacgtgttctcacttatttatgggatctaaaaatcaaagccgttgaactcattgacagtgtagaagaatggttaccagagcctaatgtaaaggatagttaccaggagctacaaggaggtgggtgtggttaatgggtacaaaaaattagctggaaataatgaataagacccattatttaatagcacacagggtgactataattaataatggcttaattgtacattttaaagtaagtaaagggtgtagttggattgtttgtaacacaaaggataaatgtttgagagaatggatacgctgttctccatgatgtgattcttctacattgaatgcctgtatcaaagcctctcatgtacctgataaatatatacacttactatgtactcacaaaaaataaaaattacaaaaaaatgatctgaagcgtttcttcaaggaatgaacaggagatgaaacatgactttaccactacaatcctgaagaaaaagcataatcaaagtaatggcaagccggacacacatgtggtccaattaaataaaaacaaacaggtcatgagcaaaggtcatggcaaaagttttactggatattcaaggcattttgcttgttggctttctagggggtcaaaggcaataacatgagcttactatgaaagtgttttgagaaaatcagccaaagccttagaagaaaagcactcaggaaacctttaccagagagtcctgctcaattctgtcatcaaacgagggcaattttgccagagttttgatgggaaatcattatatatttaaattacaatcctgatttgacttgctctggctctttttgttttctcttctgaaaaaaaaaaacatttttcttcacttaataatgtaaaaaagagcacattgacatggttaaacttccaggatcctcagttctttaggggtggactaaatggctgatatcgttgcctataaaaatgtcttgaattcaatggaactcatgtagataaatagtttgtatttgaatttttagcttttaattccattttccacaaactttttccaagttctcttgtaaaaacagagaaaatccattattattcctcctgtctctgcaaggcaaaacttcctgtttacaaaaatttcccatttaccttctcctgtcactcgtggggatctaggagtggagatcaatgctgccatgctactcttgttactcttgctgttgatctgaatttatcagaaaaaaagaaagaatcaaggtgactcatatttctgtagtattcatatatatatatatatatagagagagagagagagagagagagagagagagagagagtacataacagcaagtctgggtgacgtcatagcatcttcacagttcttgacaaaatactcctgtacttctaacaaaaagctttgtatcataaagacttgtctctcttacaactaaataagctcattcctctccacaaaaaggtcagtttgaaatattattagttaccatattcaggtttgagttcatgaaatctgggtcaaatcattgcctcatctggaactcttacaattacattaaagattaacagtttataaactaaatgttaaagttatgtgtagtcaagtcacccttgactaaataaatgttatgtgtagtcaagtcaccctctattaaatgggtgtagaggagaaagtttaaaccaaatggagaagatatattaattataaaatcatatgattctagcacagcaaggaataaaaaatgacaagataaatatgttgaacatttcttgtttctaaggctctttctatggcattcacaggtatttgaaactttctttttctactactttttaaagaattctcttcagccaatatatcagtgatatcattactttacatatgaagagaataaatgaaactttattcttaagaggtagacttctcttgttttttttttccttactttatgaaatgataatagttttccattcactttggttattggatatggcaacattatcaggcagtaacttgggagatcctgtggttttcatttctgtaactccttgccccacttggtaaaagaaaaattatttctctgtagtaatctggaagaaaatttctggctcagaatgtgatctttttttgagaagtaatatattgagcctgtgcataaattccatttgagtgatggttgacaattattattcattagtacatgaagcaacactcagagaatagaaatgaattgatagtaacagcgagtaacacccaattattgagagcctcctcaaagtggaggcacttttgtgtatactcacatgaggcacaatactatcacattctggaccgattctaagaggtccatcaatttatccttgaacaatatttttattagtcaaatatactgttgactgcaagtacctaagattatccaacaatttaatttactggtatagaagtcaagggacaagacagcttgaattacagtttgggattaccttaaagataattttttagttttagttcaaaactcaaaatcttttggatcaatggagtgcaacatccaattgagacatatgttaccttcaaaatttaaggaacccaaacaagtcttgtgattttttaataccatggggatagatgacatagaaacttgcattttactatgaagagtatgcatcttcatttccaactatatttaatcttcagggcttgaattcttttactggttcctgtatttttgtgaaattactttcgtactgacaggcagatatttgtattctcaagtcagcttggtgttattgctattactttctttacatatattttcagtacaatgtcctttaacaaacttagaaaatctaagacaataggaaacaaattgtgacacagaacaagacagatgttaccatatgtcaagatgtttcaaatgtactcttcccctgaaaagtcctaacaatcagatatcccttattaattggaaagggaagaaaggaagaattttccacatctgtaattgtatactaggtgcactaagctggctgactcagtacagtcagctttaatacagagaaaatatatggaaaggtaattgcaattgaagtaacaatagaataagttttttattatataaatttgaagtgtacaacatgtttggatgtgtatatatatagtaaagttattactatagtcaagcaaattaacatattcatcatctcacatacttacatttctttgtgtgcttgtatggtaaaagtatccaaaatctgccttttaccaaagtcccattatgcaatgcaatattattaaataaaatcaaccctccatatccaggaattttgtatccatgagttccacatccctggattctgccaaccatggatcaaaagtattctaaccaaaggatagtgcatctgtaccgaacatatacatacttaagtttcttgacattatccctaaacaatgcagtataacaactatttatgtagcattgacattgtatcaggtgttgtaagtatatatcccacatcaaaaatttcacttccagcatatattcgaagtaaataaaatcagcatttcaaagagttatctgtattctcatgttctttgcaacattatttacactagatatggaaagatatggaaaacaatccaaggtaatggaaacaacccaaatcctacctaaagaaacaaagccaggtaattaagtttctcattaacagtgataaagcatgttgatagtatatgctcttgttatataattaaactggcaatttatctctatggtcttccttccaaaaatccagagcctcagctgaacaatgagcaaaaacaatgaacaatgagaaaattcaattaagaggaattctacaaaatatctgactagccctcttcaaactgttagtcctcaaaaacaagataagtctgagaaaatatcacagacaataagagtctaaggatatctgatagctaaatgtcatctagaatcctaggtggacccccagaacagaaaaagaacattagataaatcttaagcaatattaattacataaaagatccctcacttgatctaacataccttataagattcttagggcattcagtttcatctctggactgctcaggaaggatggctcttcagagtatgagaatcctatttctaggaatattggcccaatattatattaaaaacaacccttaataaaagcgtcatccactaatcctaccagaactttctctaggataatagaagaaaaagattgctttaaatagtagaaaatcaaaaattacatatttagtgtattttggttgcaaagaactgaaatgtaaaataaaccgattttggtaaaaaataaattaatcaatacaagtaactgaaaattgccagttgagattggctttatcttatggtttgggctacaggttcatgacgttagggctcaagcttcatataactgtcgttgcttctaatatgtcttctgctattcaggctgtcttctcaaatggtagcaaatatgtctttagacatttgtgacagaacatctgagatccatgcaccagcacttcccataaaattcttcaagttcaccctaattggaggactttatttgcatagtcaccctggagttattactgtgacaataaggatgtgataatctgcttaactttacaccattcagtacacaaccctagagataagttgacgacaatcccaaacaaatataaaagagagtaagaattgggttaattgtgcccaaatgtaatgttagagaagtagaatgaatactagaaagtgaaaaacaaatgtatataaaaacattatcattaaaacatactcggagggatgtatataaattcatgcattcatgatcaatgcgtaacatagcttttaaaatcatccaaacagattagagaaaattcatcacataaataggggattttgcagacggtgcttctcagtccttttcatctgatggcacatgcagaaaatatgaatgtgtacacagaaaaatgagataatcagacaaggctgttctctgtaagagagacctggcatagagccactggc

SEQ ID NO: 449 - DNA, 20001 bp, Homo sapiens
catagcagcaagtaagagagagcatgtgcaggggaactcccgtttataaaaccatcagatctcatgagacttatttattaccatgagaacagtatgggaaagccccgcccccatgattcagttacctcccaccgggtcccttccccgacacatgggaattatgggagctagaattcaagatgagatttgtgtgggaacacagccacaccagatcacatagtaaaagaggctttgcagatgcgatttaggtttaaggacttgaagatgatgatattatcctggattatatgagtggacccaatttgattacatgggtccttgaaagcagagaatctttcccagctgtggtcagaggatatgatgatggaaaaatggtcagagaactgttaccttcctgactttgaaaatggaagaagggagctctggtaaaacaaatgcaggtggcctctagcaggtgagaaaggtaaggagacatattctcacctagaggctccagcacagaaagcggtttctctggcacctggaattttagcccagtgagaaccctgatgaacttctgacctccaggactgtaagataaacgtttgtgttttaagtcactaagtttgaggtaatttattacagaagcaatagaaaactaataaagtgggataaggagctgtaatcttattttatttcaggtgaggttatgaaaaacctttgggtttttagagctttggggttatgaattgcacttagggattgtagacctgtagaaggaatcgggaatcttggtattttaactgaatgatcttattgggtgtgaatttttaattctagcagaaagcgttccttataaaaatgtattttggttgttaccttcccaatacttcagcctttgctgatttttttaaagttgtattaacttccgttgcctttatggatcttatgctggatgatgatttatccgaccaacttggctgatcatgggccttggttcactgtaaatcagattaagtaatgtatatgaagggcctcacactctaaagtactgtgcaaatatacattggtccttgttgattatttttattattgagcacctgctttctgtccctccttccttctaggatggttgggggttggaggggaggaaatactgcagggtgattttgtgagtgtggcagtggtaccgcccctttctctggctgccagaaatcccttcctgtactcagtctttacactgtgtgtggctccaacggaggtggcgactggaatgaatgcctcaccacagaaagactggatacccttgggctcacccatgttcctcattgttagccacctaattgcatgaacattttaagtgaggaagagagattatcgatgttctggttcttctcttggcagaatccagggcaaagtccacatactgaaacttgctgagaaaatataccgtaaagtataaagcatattttaccatacaggtcagctgttcacattacaaatgcagtatttgtttttcttgtaatgctgtgccattgtagtatactccattattatgaaatgattgtggctgtctgattcatgtttgaagtttatgttttcagtgatctatttcagaatgatgatattacctttgattcaaattaaactgccaactcttgtactgtccttaatctgtagctgaatcttcaggaacgtcaattttcctattgatccttttgatgtccagtcactggaggaatgtcatactgtgcctgaaaattatgcgtgtggttgcattattgtttttccttcatttttttttaagaaaactgataggttttgagctatagtttacaatcaatataagtccaaacttttttccttgttaaagacatgtatcttctctttgccttaatattctcattatccctgcccccaacacaatgctttgtctttccaacatttttggtatgatacatttgaaatcttttctttgcttttgatgaaagtgattgcaattcaaatacaacttgacaactttctctagacaagtcatgtctttgtaatcaataacaagatagttggccaggtgcaggggatcatgcctgtacgttggaaggcgaaggaaaaagtattgcctgagcccaggactttgagaccagcttgggaaacatagtgagactccatctctacaaaaaataaacatacatttgctgggtatggtggtgcacaactgtatccctgctacttgggaggctgaggtggaaggatcgcttgaggccaggaggttgaggctgcactgagttgtgatagcacccttgtactccagcctgggtgacaaagtgagaccgtgttttaaaaacaatgacaaaaaacaaatatggctatttatgtcaaagttttaaataactttatctagaccatgggctcaagtaaaaaatttagcatattaggaatgctgtagagaaattttctcacctgaaatctatcctggaattgctataatacgtaattatgattttgtttcaatgcttattgattccactgaattctagttgaagtatttatttaaaaagttgcagaacctggagagtgccttattcttcacactacaatgtattaggctcaggctagctgctgggggtgagtttggagggaaaaaggatgtagaccttaataagtttatttctagtatgtgaagtaagacttgtgcaaaggtgtagtgctgtagaaaagtatgagtttctgtagagaggagcagattaaggaggagaaatctgggtaggaaatgctgaacgcttaatggaagaagtggcatatgaactatgaagggtggcatttggatgtgcagagatagaaggaaagatattctaaccgggaaatggggtagtgaattattcaggcaaaattctgtttactctatggcaaatgggcctttaggagtcaccctcaccctgccctgccttgcatccagttgtcttcaccacaccttccagctgtgttgagctatagggagtgtcctgcaggtgtcaaactctttccacttcgaaactgtgtgaacagatgaatttctgtacaatgagactttcacgtggagtttttaagacaattcatattaaggtgtgggaattgctgtttgtaaatgacttcttcatagttgtttagtctggccaaccacaaagtcctagctttccagagcttgtatttaggggatgtgtattgcctgactccactaatgccacttgtacattcattcctctgcttattctcaaagcaggtctattctgttcagtgctcaaaagacatggatgaaagacaaaatagttgcttctgagctcaccggtgatgagagactttttttttttttttacttttttgaaaatataaaacaatcatagttgtacttaatgtatgaagaaagtgtatggaaacagaggtgggtgtgacaattctgcctggtggctaggcatcagggaagaatgcccagagaggagatgcttgagctgagtcatgaaacatgagtgggggaacctgccagatggacacaatggagggggatgtttcaggatatgactgcaagtgtacaaagggaagggaacatgaaaagtttggggacagttagtcctcaggaacaggactgtgtgcatgggacatgtagagcatgatgaagctggaagggtaggcagcccatgtagtgtataaattctagatcaagggtttatgcttcattctggaggtagcagtgatcgttgaaggatgttaaacagggatgccatatatatattccctttgagaacaggtgtcaggatgataacatcttaatataaaattgttcaatgcagaagcaatactaggtgtcagctaagagctgaggcttcacaatataacatttcttataggcggtatgaatggggtcaaatgaacttctccataactcagtttctttatctgcaaagtggggctaataatagcagctgtctctgaattggtatgagaattagatgagctattgttgccaaagaatccaactattatagtaaatgcaataatcatgtgcatttactatgcattctaattttattaagaatagtgactaagtgtccaatgagaaggtggtagagtgagaactgaaaagcacttgaaagtcaattggagtctgtgttttaacttactaatgaagtccagaagctataagatgaattttaaatatttcttaatctgaggttgttttgtttactggactgagcaaagacaactggaaaatgagaaaaggtagaaattaaaaatgcattgctagtgtggcaaacaaacagcatctgggaccctgactggtattagcctgattcaggtgaggttattgaaactccactgcacagttaatattattgtgtccccatactggcaaaggtagaatcatcacagggaaatttacaaaacatagggaacgctgaggttggaagagctttaccaccatgactcaattggcccaggtcaatgtggcctgaagtctgggccaccaaaatggtgcaaaggtttcctatgacttctgctggccttttagggatgaatactaatcagtaaaatgtggataaccataaaattgtatgtttgaatactcaaaaatctctcatatactatacttagtaacttaaacatatatttaatgaaaaaatttcagaaaagaatgaggcacagatttagtgcttcagctggtaaaagcgtattagtgtgtgcaaagtatttcacaaactgccatgcacattctaactatgtgataatacctatatgttaaatatatatatttgtattatatatattacatctatatctatatatcataggtctttctgttattaaaaagcaaaatatcatttttaagaaggaaagatagactgatacttcataacatatctgtggttttgttaattataagtatattttctttgctatttaaaaagatgttttgattcatctccctaacactttagcaaattttaaggtaataaccattataatttttggcaagagagtgattttatttcatgggatttccagttaatattgaaacattctattttattggatagataaatctaaacagcaggtcaggacttttatttttgtgttttgtttttttgagacggagtttcgctcagttgcccaggctggagtgcagtggcgagatcttggctcactccaacctccgtctcctggttcaagcaattctcctgcctcagcctcctgagtagatgggactacaggtgcgtgccaccgtgcccagctaatttttgtatttttagtagagatagggttttgccacattggccaggctggtctcaaactcctgacctcaagtgatccacccaccttggaggacttttaaatgtttacaacttctcatctaatctctccaatgttatacaaagcagcagtcagaccttggccccttttgctgagcatttacttaaagattaaaagatgaataattgctactctcccagtcatgtgaatcactagtaccaaaggaaggaacagtggaagtttttaatgagttggtgctgttaataaaaaaagaggtgggtggtaaattatatatccaagcccttgaaaattaacctccagcacacgttattagtttctttcttttttttttttgcttagagttacagtttaattttttgataaagcagtttattgccctctaaaagatacttaagttagaaaaaagtgttgcttatccgaaaggatcaatttatcaatggccgtgttgtgctgtttttttcatttgcattgtgaacccccttttagggttcttgttagaaacctgtgtggatttatttgtagagtagcacacactgaattggacttaaggattaaatgaattccatgaactagaaggatgaccttgtaaacaggaaaagatttcattatatgttttccttgctatcagtgtaatagaatttgtgttgtatgcctgatgttcagacctttcttttttatttttgcatgaattatattaaaaaaagattgaaatttatcatccagacagcagacaataaattggctgagttctaattgtgaggattatagcactacattttattttccctctgtcatgctcagcaaataaataatcccgtttacacttcagcctccaaaacatgcttgcatctttgggcatgatgggaataccacgtgggcacatagttttatggtcagaatcctagttatgtggatttttatttcttgtctatgtagccaactagtgtaaagtctggtattttgtgcaggtattaaagctctgttagactgagagaagataaaatagaggggggatgaaagaatttaactgtcagtttctgtttctggtggaaatacagcccactgctgctgtatgctagagagggaagctttggaagcctcagaatgatcaagccaaatggtaaagttctaacagtttactgctaattgattagctttatgtataaggaggtgcaattatatgctattccagccaactctctttttaaagtttgtctgacttttaaaccagattaattccgtctgttcaaaatatccgccccctgccaccccacccccgcttccgtacaagggcctgattcatttgaccaaagacctaggccatgacagccagctgtgacaatagggggtaaattaaaatagcctatggccagggtcagaccatctctgagagataatagaagagtccctaaggcctggtgaatgaaagtgttcaaattctattgtgtactctggttaagaacaatctataaaaaggtagcatttaaagtacatgagaagcaataaatcatttcctctttctacaaattggtttagagaaaatctctaggactacaaaaggatattttactgtttctatggcagtttaatattaataggaaatacttatttggtatatattgtgttgttacatttatataattcttctgatattttttggaaagcctttatcatatgatagcttcaattttggaaggtacatagtatatgtatttgtcaccagtttacatgtaactaaactgaggcttgtagtaaagttcagaagtgtgagttcccaaaaatgattagtggtagaatcgaattagaagccagccctaatttctatacttttgaattgacatctatgattcagaaaagcatgtagttgcttaggcaatgggacagggattgtattactcattacttctggggcattctcaactatgataggactttagtcatacctctacaatgttgggaggagagatacatatttaaaaagcaataacagcagttcaagggaaaaaacataatctacttgttttcttaggggggcataaatggaaggaattatttttacagaaaacacatctatcccacttgttctggggatacggtgtcttatctttgaaatgggcttctgcaaagtcaatagtgatggcgaattagtagttgcatgatgcagtgttttctatatatcataaattggtcaagtatgatgatttttatttccattcttattagaaatgatcattgtgaataatctgcccatttttctcaggagtgtatgatttaaagtgtcatcatgtttttcattctcaaaatggactaataaaacctacctctggaatgaataaataccttattatagatgttgaaattgtataaataggaatgttcatcctctccttgagtgaagatttattattccaaacacaaacattcccaatcgaagggtttgaaagtgtccttcaatcaactcaagatcattttgtatagccagggttcaatcaaataccactttttaatcagctaattacatgaagcagaacaggttttcctgccaaacaaatgactggggaggaataattctctaagtgcatatccttgaatattttttccccaacaaaatagtcctgtcaggaaaccaagctcacaaggttaaagtgatacatgctttggccagtttctaggtttgctcttaaacttcagttggaattacatcttgtgggcacagacttgctggttttaattttgaaatagtttatcattattttaggaagaatatgggaacgtttgagtgtgtttgggaaagaaaattagttcctcattacctcccctgtccctgccaataaattcatgaatcttcatgtttctcattctgcgttaaccttttctctccatcatccagatatactgcggctcaggaagccaagaacagtctcctattggacatcatcagttcgtcatagggataatttcctggccttcttagataagagagttcaacttccctgtggtctttttctaaaagatcttaacttgtaatcctacaaagttaatagtacatatgtttatctcatggaggcccagggagccaaaaaagatttgcacaagcaggttagtgttagaatgcagagacaggaatgcaggtcttttttcctgccagatctttggatttaaactaggaaactcaaaagtaatgcagttgccaaggtgaaataatctattcatcttcctacttacagtgcagtctcagttacaataggaagtcatatctcagttaggcatctattacactgagcacacacaataaatgtttttaaagcttcaagagttgagaaaataacatactgttccaatccagggactactggaagatatgctatagcttttttccatcgctttccattgtttattgcctacttctactacttaggttttttgttgttgttgttgttgttgtgtttttctttttttctgacaccagtagttttcatctgagcattaggaaaatagcagaggttgataagattttctcatgtcaacaacctagcatatagctgggaacctgggaacatacaatatttgggcacatgatatattgataaggggcttgatataatgcttgttcttttctctctgcatctgcattttgtaggcaggcctctggatgtggaggccacatggctatgctgaagttaatgtggctgggtcagcatttgtgggacttcagtgagtttcagaagtctttttccactagctagcaagaagcctgtttggatgttgatagcccaaatggggcttggccctaaaagttaggggaaaaggcagagttcatttcagggaggcacagagaagatctcattctgaaaagcaatgatagtgattaccatggcaggtcagggatgtcagccacaaatcctaaagtgttaacatggaacaccactgtaaagcttatcaacttgcagtgctcctaaaaatggaataagactataaatacatgccctaaggttcacgtggcagtctacagacacaagtaggaaattgctctgaaatctcagatttcatactagaaatgaatgtagattctgtactccataatttttgctatattatccaaacataaataaaacaaaacaaaaacatctagaaaccaggaccttatttatactggggtattattcttgtgttctctggtatacctctctggatcagttccagagagttttcacatctcagttttagtcataactctactgaagaagaaaaaaaacctaaataacttttcaaaaggatcatacaaacaagctctacagtgtttggttcatatccaaggcaaagaatcagtgtggtataaaacaggaaaaatatccagcgacaatttaaatgttttccaagcctgctattaggttttaatggaatttttcctctgctggtgaaacaaatagaaacaaaaagtaaataagtgaaacattttctgttgacaagagaaaaatactgtgtagtaggaagactcttaggaggcacgttctggtactggctgaacttcatatgaacgtgggaccctaggctgacctgtgatgtctctagcttggtgactatgtaatttattgtctctttgtggaggtgctattcaaacctggagtgtcctggtgtcctgggcaaattgggcaccctgtcttccattctttttatttgttggcgaatgagaagtttacattaggttagatgtttttaagcattcttttgtcagcaaactcaaaattaagacaaagttcagtgtgaagcatggacgggggcaggattccagttccccaccctctcttccacacacaccctacccaaggactctgagggatccttggcatgcagtttaaaaattatgacattccatggtttattccacccattattagccttcagttggaatcacatgccacatcttcatgtacagatgatgtttaggtaaatgcaaatcctaacagaagaaagaaggatgcaatctcatctaagataaaagcatcttcttattcagctttgcttgtttatgcctttcctttcttaatacatattttgtctatttggaggatgagtttgagtcagacttcatttcttctatcctttttaatgccttttatttgaaagacttgaacttgaagaatataattttaggggtgggcccatatagagagagcatttcaagacaaatatcacatcagacattcttctgggtgcccaagaaagcaactgtgttgttaccttaccctccatagtcaccaaggtgactattccagggctgagaccttaagcaatatgcagtgtaaaaatgaggctatattcaagaaggtatatgcaggtcctcaagaagcagccctgactggcatttccccagtgtgaataatcagttttgattgtgccatttattctgtccccttgtttctctgctgtattctttcccattcctagtctctttattgcagatatctcatccatcttcctgcacctgatttgggagtgttgttcctaacaccactctaaccactgtgtctgtatagtactctcagttaagctgcctctcctctacacatataacattcaggcagcaggaagccaagtcccttgcagagggagtggaatgaacttgccaccccttcccatgtcactgatgtacttgcagacacactgccaagagagattgtaatattccgtgcacactggacatcagctggaacaggagggaggggaaacagcttttatgatagctcctatgttagtgcttttcctcaatattggctggcgcaggcttttgaaattttgtgtctcacacctcactggggattatctggaggccccttattatggatgctatcaaatttgtagggttggtggtcttagacctgacccaaggcacgtagaaatgcttctttttttaaataacatttactggtttactataagggatattacgaaggatatagaagaaatgcataggacaaggcataggggaaacttccatgccctccatggatgtgccaccatccaggaaccaccatgtgctcagctatctggaagctccctgaaccctattctcttgggttttatggaagcttcatgactcagcatcccttcctctagggtatggagccagatcctctctggaatgagggtcttatgacccacaatcagaaaggtaaggaagattagagccctgccttgggacaggtgaaagggaggcaggagaaagtcagagcggctctgtttcctgaggctgcccctgaggcttaacacatccaccattataacaaaagactgtaacaagggctatggaagttatgttctgtggctttcttctgtttagttataagacagccttgggcctaatgacattcctgtgtagatctgcacatcttcagaattcagctgcttcttggctgatggtacttccccttctggttcatttagttacctggactatttcaggcacaattatctaagaatgagtggttagaagacagtatctatctccagctgtttgatatacagtaggaagcatacaggttgcagcaggtaacaagcattagctgccatggcatactagagggctgctgtattagtccattctggcactgctataaagaaatacctgaggctgggtaatttatgaagaaagagatttaattggctcacgattctgcaggctgtgcagaaagcatgattctggcatctgcttggcttctggggaggcctcaggaaacttacatcatggccgaaggcaaagggagagccagcacttcacatggctggagcagagggaagggggaggaggaggtgctacacactttcagacaaccagatctcgtgagaacttactcactatcatgagaacagcaccaaggggatggtgctgaatcattcatgaaggatccacctccatgatccaatcacctcccagcaggccccaactccaacactaggtagattacaattcgacttgaggtttgggcagggacacagatccaaaccttatcacctgtggttccttggagaggcttggagtctccctgagttactgccatccctcaaatatagctcaccaaccatcatttattcagtgcctactatgtgccgtgtgttttccccacacttgcctattttctatattaataaggtaatatgttagtatcctattgctgctgtaacaaatcctaccaatgtagtagcttagaacaagacaaatttattatcttacagttctggaagtcaaaagttctaaagtcaaggtgaggtgtaagcagggatgcattctttccaaaggtcccaggttctagaggctacctgcactctttggcttgtggctccttcttccatctttaaaaccagcagtgtgccatcttcagatctctctgtctgacctctgcatttgtcattccatcctcttctctttctttaccttatgaggacccttgcaattacattgagtccatctggaataatccaggataataatcctatcacaagatacttaatgacatcttcaaagtctcttttgacacatagagtaacagtcataggttccagagattatgatatgggcctctttggggatgggggccattctatctaccgtcgatggtaataactgtcaccaccagaatgatagcaatagccaacatgtattgtgttcatgttatacaggcaaagcattgtcttattgtaatcttcacaacaactgtaaggaataggtagcagtatccttattttacagttgaaggcactgagaggcaagtaacttgggagaggttaagcaacttgcctaaagtcacgcagctagttagctgcagaaaaaggattcaaatccaatgcatagcattacttttgagtttcctagtttaaatccaaagatctggcaggaaaaaagacctgcattcctgtctctgcattctaacactaacctgcttgtgcaaatctttttggctccctgggcctccatgagataaacatatgtactattaactttgttgctatgcaaccctacaattattacttctgtagtacaggtaggcttaagtgaaaagaaggctctttctccagatcacacaggcactcagtaagggagttgatattcaagttgaatctcttggactctgaagcctctgccttaaacgctgatctacgtgtgctgaggatatcagaggattgttccacctctgattttgctttcagctgtggtttctctgacctttgttttgcatctttgttttgtttccctttgtggatagtgctggtctatcggtgaagtcagctggagtaggttgccgctttggtcatgatgtcacaggctgagggttaatgggagaagccctttggcttagagcagctgagcttgcttgtttgtggctgctgctgtgctctgcacaaatggagttcgttcttggcgtggtttattgtaggttgaggggaccactagctgcctcatttgaactaaagaccttgacttgcattgaattttaaacatgggccctgggatagaaaagctaatgttttatggaaccagctacaatttagttaccataacaacttggtaacccttattctgtcttggcttgctgcctctgagtgtgatgtacagcagtcattctggccagctgaaatgggctctcaccttattcttgttaggcttattgataaatagcttggtttcgtgatacacatttcaaagtcatcacctttttttatgctgctgaccttcccttaagctgcaggttgtataaggagaaactgcaggagtaatgctgtgctggttttctgttcctgagatattttaccatgaaattgtatgcctgtgtgtgtgttgagagaaaggggtggtgaggagggaaataggtagatgaatgaatttgtgtttgtggagcagagtatcatagtagtgtatttctgtcatctgcaaaagaaaaaaaaaccttttgaaataacagtaacagtaatttaatcttgttctttaaacagtgaatttgacatactctgaaaaagttgtgggcaatacaattgaagacgggattcctttctttcattcaagcattttgttattcactaaactatttaaatgtgaaacttccttgataagtaacctgaagtagagtttaaattttgtatatgggaaaatagtgagggggctggtgggaatttgagggaaaacttagatcagctttttttaaaaaaaaattccagtaggtagaagagtgttctgttctgtttcataaagggttagtaggtattttggttgtggggaggcaaaggtagggtgttgatgccttacgtattcctccttgggagatacagatctatatttgtactacatgctatgaaaaggtcagcagtggagaaacctatttaactgtttctttctgcatttggtcccagagccccgttttcagataggcaactgtgaacatctcatagaacaatgtttgggaagtggtgctttagaggtgtaataataaagaggaaaccaaagtcaggatttcaccttctattcctaaccctctctgtagtgatttggctatagaacagattcagtacttttattctgtattaagaactgatgcattttctgtacttccctccccaaatgttaaaaaggtcatttcttgtggtttgtgttagccaagactccatctatgcattgatttgagcaatttgtataacattttattctgctttttctccttatctaaatatgacagtatattgctaagggacattataaagtcacctttggagaattctaaaggaaaacagtgaccaccatttttataggatagctagagttcagtcttccagtggataaaatgtgcattcactgaaatctgtgttatctttattctaatttgttcactttaaaaagtaataataaaccccaagctgtttttgtacactggagataatttagactaagctacatacacctttctttttttaacaatgaaaaaactctcatctaaagaagtgagaaacccaatgtcaccaagtgagaatactggatgtagcatctgaatctctgactccccaagaatgcatttccttgttttgtcattggtaatcttaagaagttgaattaagcaaaaatatttaggaaagggatattaaacccctcttgacagtatccctcctttaagagatatggctctctaatactttgcctgttgtttaagatacagacctcttattaaggagggaatttttgggattactttattcatgtatgcctatccatgatgttatccagtgttaaattattttcttccaatacaaaaaagctggaggacagcatatttgagtaatgaggtgggcaggaaccaggtcattgactactgtttactacatatatgttctgacatttatttctggcccagttagcttgctgaatacttaatcctttgtgtgctagtggccagtatattgtgtgtgatttagcagagtcagtagcttttctaattctgaacagcctttgtgtactgtggtgtctgtccatggttaatagtattcaaataacaatgccacttgatgattttgaggcaattgttaatctctgtctgaagcttcctcaggtcccatttgctagaattttgttgtctttctctttttccccttctcttttctttaaaaaattttggctgggtgaagtggctcatgcctgtaatcccagcactttgggaggctgtggtgggtggatcacgaggtcaagagatggagaccattccggccaacatggtgaaaccccgtctctactaaaaatacaaaaattagctgggcgtgatggcacgtgcctgtaatcccagctacttgggaggctgaggtaggagaatcgctggaaccagggagtcagaggttgcactgagccaagatctctccactgtactccagcctggcaatagagtgagactctgtctcaaaaaaaaaaaaaaaaaaaaaaaaaattctacaagaacattgtatgaaattttgacataactgatttttgcatttatgtttagattagaaaaatgtatgtcctaagcaagggagttagattcatccagcactgtctacattattacccaaaggaattgtatgctaggaaaacttgacgatggaggacccaaatttataggttcatttaatattttcaagcaatattctttcctgctgatataaaattagagttagtggcagtcaacaacagataatacctcaaagtggtataacatgttttaaaatattttggtcttatacacaccgcaggcaaaagaaatagctgctcgtgtgtattactgctgaaattctgactttgtttattttctataaacataataactagtttcatgtgagtacataatttctaggaagaaattagaaagagttggagtaaagtggaacatacataagacatatttacctactgcaaatatacttcctggtatacactaactcaatttttatttttaggaaggaaatcagataaagacaatgtgttaaatccttcttggcttcagaaatgttagtagtttgcatattttcttaggtgctgttagcacgattactcattttctggcatgatgtggtgaaagcatgtctttatgaagattaaaatgaaaaggaaaagagatataaggatttggctttttgaaaatcatctcccaaggcagggcagacaaagaaagaaatgatctatcttgcctcaataaagctataaaaataaggcatgcttcaggcataaataggatcagaacctaatgtgaatcagatataataaagacaaaaagaaatgtgttgacactgtcgtttcacatgctttttttgctgccccgattagctgatgagctaaagactacatatgtcatttactacttggttagtgagtatgagttggcttctccattctggtcaactctatcactgatggaattgagctacactagactgtggtgaaattaactgagtttaaagcatgcccttggggtgggtgtccagccttttctgttcagtcccccacactctcaccaactgacttccacagaatgagccatgtgctttggaagtgtgaagaatacatgtctactattaggctgccatttcttgacaggtggtaattgctaggaggtgagggtttatgtcatggaaatcttcacagaagtgatgtttgagttgagtcttgcagggtctataacagtttgcaggaggcatggagaggtaaagtgacatggcctgtgtagggtactaaaaatatgatcaaagtgctgcctggctggagcctagaactaaaggttggaaggggcagtaaagtcttgaagggcagataggatctatattatgcagaactcacatgctctgctaagggtttagaacccgtggcactggaaagaatgatagcttgcatttataaaggtaagtccaccagcaatatgggggaagagctagaagaaggctgagacttgagaataggagtttagtagggaaatgcattcactggtttatgttaaaggggaggagggcccagtttagtgtagtggtagtggcgatggaaaggtgcagatggctggagagaaatttaggtgctataattaccaagagttggtaacattcgaaatggggagtgaaggatggtaatgagaattaagtgagatattagatcttaagtgcttaacacagtatacggcacctggcacattgtaagcacaaaagaaatggaacatgtaattctgctgttacccataacggcaataagaaacatcttggagattcctgtctgtaataacagtaactcaggacttcacctctatgtagccccatctccaaatacacatgaaaccttacagatttcatactcttgcatttttctttctgtggagacttttctttatatgatggcctgacaataatattgaagtactttatagtgctaataacttaatttttacatgcccttacccagtgacctgctacattttaaaaatgcactcagatgtggaccacatctgtttacctctatgctatcattaagagagaaagtcccagcctccaattcaaatttgattatttgcccagggtattattctgtaagtatttcctttctctttgtgtctttagagctgtattttaatccttgtttcagacacagtatttcttccaatttagtaagttatgaaatgaagctattcataactctccagtaataccagcaaacagttccttgatagtatgctaaaactggggctgagaagtttgagagtctgttggttttatgccctgccttatactctaccatttatagaccagtcttgattgtcttatgctggtagtgtctgttgtttcagatatgtcaaagagtcattggtgattcattaaacaagcactgagctaggattcagaagtcaataagatattttttgcccttaaaacttataaagcacaactgtggtttccaaagtgaaaggaaaaacaaatgcaagtacagatttttgtgggagtaattgtctcttaggggatggcaaaattggggatggtacaaaataagcgtctgagtaaggatgctttccaagatcactttcaaggtcagtatggtattttatgtgctgctgaaattgacattgcaccatggtgtatttctgtctggtgattgagttaatcttcattgcaagcatagataattttccttcaggtatagtcgtttatttatagaaagctgttaatttaattacttttagttagtatcatttctctttgatgctaataaacaaatttttccacattttaaaatctctcaaatctttacaattaataatgcatcttggttaattggcactcttctcttttcctccctagtaaaatatgttattcctttatcatttttttaatctgttgtttcctattttcttgttataacatgatagtgtattttacaattggtggcaatgaatattcaattaatacagtagtgtacattacactcaaaattcctgacttatgctagtttttaaactatattatattatgatttctatatttatatgttgtctaattttggctagtatactctgaaccacttgaaacatgggactatgtattttatctttatattccaccatggaacttgcatatagtaagcacttaaaggtagaatgaatggtagaatttacagctattagacacccaatgcttgcttgttgattaaaggctcataataaatagaaaatcacttacaggaagtagtttctgatcacatcatctgtgcctgatgatgagtccatgcatctaggcattggaatagtactcttcagcttttgaatagttattacatacctttctgatccatctagtgcttaatctattaagttttcacagaattgtgctgtctctgaaaattcttagatcatattttactatatgacttatacattaagtatatatacatatatacattatataatctttatgaatgaatgtttataatagcttgggttttttatagttcaagtattttagagtgttcaaatgtgtcactatttctttagtttattgctgtggatttctttattttattgctgtatgcctagttcctagaacagtgtttagcacatagtaggtattcaggtgttgaatgaattagaaattgtaacacactctgtcttcttggggagaggaaaaatatcagtatttcaaaaatctttagatttggtatattgtttgcagtttgattca

SEQ ID NO: 450 - DNA, 85203 bp, Homo sapiens
gagtcagacctatctgctgacatacattatttcttctttctaccttatttacagaattgattcctggagccatgtactaattaaaaggccgagaaaatcactgatatggctgctctgatgtgaggaaacgccaaactattacttccagcggcttaccttaggcattttgtctatgagaaaagtcagcatttatttgtttatgtgactactaataataggctggtgcaaaattaattgtgggttttgctgttgaaagtcatagcgaaaactgtaattacttttgcaccaacctaatagtttattgttaatggcagccaaattgatattctgaagttagaagtcaaaatcactcatatctggtttaccttggatctagaagcaacactttaagaattttttctgaaaaaaatgacctaaatattcttatttatttctaattattagaaataaatgcatgttcttattattcattaaaaaatattatcgatgtgggggagggggcaagttctagtatctatagaagtacaatgagagtaaacagaaaatagtaacaaaagaacataaaaatgtattttcttctaaatatttataatgttatgtgacaattattaatataatgcctctccccatgaaatctgttcttccttgtctactctgcaaaaatggatctgacactttatatgtatttttcttttgtcagctggcagtaagctttgccaatagctggtgctagaaaggcattgctggagaaaaggcttctgcttcccttcctggttcagttgtgcttacttagcaggtaaatgtagcacacttggcttctccagcacttagcaatagtgatgtggatggcttgtcagtttctgcagtgtccaggtcttgcagcacacacagcttttccattatcaggctcctccagtgcttgtgcaacttcttcagttcatttcctgtagggcatgccatccagcagtactcagcagccagtagcgtcccccagaaacttcttaggctgttttataatacttttccatgaaacacctttttttgtgatcagctttcttctgcaccctagagaatggaattccagcaagtttcagaggaaagatttccagcaagttccactaatgcttcttctagtgacttctttaccattcagtgagaaatggccatgccctttccaacaaggtatagcttttcgtcctggtaggatggaaggcagggcatcttcctctacacgtgctctatctcggtgagagggtactggctgatccttgtaactgctttttccatgacttttagagttctctttatgttttaccaccccatctctcattatgctaatccccattatagtttaaaagtttaattaaaaattttcctgttcaaatcactgtgtggtctccctgatcagactctgattgacacacatcatatgtcaaagctatatctccaagttatttgaggctattgtctataaagttagagcaatattttacaagtatttatagaatttgccttaaaacagcttctctcaaaaatgcttttcagaacatgatgtactttgtcacatgatgcactccgagaaaaatcgattccatggtccaatagcttattttttttcaattagatgttcatagtgcttatgagaatattaaactttctcagaggttctgtagttaatataatccacttaattttgtttaagccagcatttcctgaacctttttgaccttgaaaacagttcactgaacaaaaacaactcttgtaacttgtgaaatgttatgttgagaaataaactttggaaaatgattccttaaggatatcagcataataaatagctctattgatttaaagaaagggtaaaagcatttgaagagcatggagaatgtgtttttgtgccattgcgtgctatttcttaggctcttcttttgaaagtgccatgaaaatgtggctgcaggaagggtttcccacttttacatacgtgcattactactcatgctgggtatatacaatcttggtatgatttataaatagatctctaaatgatgactagctagggaataaatcgagctttcagttcatgttttctactcctaatcttaaccatgtgtgatattgaccactttattgctatatatatatatatataatatttgttataagactagctcttgatcaaaaataaattcctaactgaaatctggttggcctctccctcatccaaagagaatttaaatagaaaaaaattgccatccaacactcaatagttgtggctagccactgctgagtaagcttagctgacaaaaactcaacagtatctgctataataagggaaagtgacattgtatattactgacgtgatcattatttgtttagactaaaactgcaaagattgccgttccttcccaaatccataaccgtatcataaccaaaaaatccagtctcacttttccctttctgtaattactgtggtgatagattatactaaagaactcaaattgaatcttcaaaaaacagaagtatttatacagttttactgattaaaaaatatccaaaaatgtttttaagtgtttacttctgagtgattgaggtgttttgttaaacaaaataatattttattgatttttgtgttccttggcattcaatggtaattataataaaagttatcttggaatttacatggtgtcttgaaatgttgacaacctcttgtaaagtcgatcagagcagcattatggcttatgtttcttttgtagctctgtgtaagttcataacatgtagtgggccttcaaaatataataaagtcaaaaactgtcataacatgtaataaaacgtcttacaagaaaatgttcaaaattttgttaatgaccttttatgacacaattcatgtcttaattcttcagctgtcacagattatggatgcttgtgcttcttaactacactccatatatgtggtagaaattcttggtgctccactcatatcccctttaccagattaccatgctgtgagtaccgcagctagcagcttataactgtgacctcaaaacaactgcccttggttgaaggaagtcaacttgcccataaacacatggatggttataccatttactgactaatatttgctgactaataaaaagataccaagtactgtccctaagccttaagttggtacaactctagggtgtaatttactcttcagaaaggcccctcattcctctatgtatcagagcaaggatagtctacattcttgctcagcttttttgtctctgctactctgcttccctaatttccttcaggattttcttgaagataattcactcaaaaaatcacttattcctgaatccctgtctagggcttcacttctagggaactgacctaaggagggaccccagagaagcagatttaagaatgaggttctggacttgaacatctggtgaccagctggagtaagggcctcatctctgatggtaggtggaaaattgatagtcactggcaggctgtgagactgcaattgttaaggctttcacctacaatgaattaagctaaactacatttggaaagggtacatggcattggatttttggtataatatctccgacctttaagaagtatggctctatactttaaatttttaaatataattttatatttttattttttatttattttaatttaacttttaattttttaatataattttaagcatattaattgaaaaactagatagttcttggtagacagcactggtactttgaaaagagaaaatgggagactcaggtaatcaaacattaattccaataattaaaataaaaatgtgagagtgagaggcttccttagcaaaacttgaaaacatcattattttctgtaacaagaaggcttaccatatcgaggaacaggtatagaactttatctaaagattaaaatgtagtaaaatgtagtagtttgattactcacgttggcaaatctcttccatgaaatttgaggtccaaccaggtacagtggctcacaccatgagctgcaatcccagctacttgagaggctgaagccaggagttcaagaccagcctgggcaacataatgatatcctgtctcaaaaaaataaataaataaataataaataaaagggacttggggtccagttatgaaaggaattggatcccgagccttgggatgggtacactagatagaccaagtgaaaaaccttgagggttcaatgtccctgaagattctaggcctagagaagcagctagcacctcttgtaaaataatcaggagtatgtggaactatcaaatgatacagacatcttactagtcaatgttcgtctttttcagggtctgctcacataaccccttctgcttaacagaacgaatcacaacatgattacaggtgcgtgccaccacatccaactaatttttgtacatttagtagagacagggtttcactatgtcggccaggctggtctccaactcctgacctcaaatgatccgccttgcctcggcctcccaaagtgctggaattctggcattagccaccatgccctgtcaaaacttttaagaattggcaaaactgcctgtaatcccagcactttgggaggccgaggcgggcggatcacgaggtcaggagattgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaagaattggcaaaactgaaataaaaaaagtatatccttaaatttctttaataataaataacagaatgaaaaaaagaaaagacagaagaaatgaaagaaggaaagaaagaagaaagcaaagaaggagggagcaaggaaggaaggtagttcttagcttacaaaatacgtcagaaagatgacacaaaataaaccaaataaaccagaaagaaggaatcaataaagataaaatataaaattaatgactatataacaaagcatatatagaaaaagttaaaacctctaaatgactttttaaaagagtttagaccagcgctgtccaatagaactttatgtgatactagaaatattttatatctctactgcccaatactgtagctcctatgtctgctgacacttaaaagtgttcagggaaactgaagaactaaatttttaattttatttaattttaatcaacatgaatacattaattaaatttatataattttacaatttaagtcaattaatataaatttaaatttatgttgctattggacaaaacagatatagataaatgtttcaccagcccaactttttaaactgaataaaaatttaaaacatttttatgaattaaaaaattctataaaaaattaatgtacaaaaatagagaatttatatataatataaatttatatattcatatataaattctctctatatgtatagaaacaattctatatatatataaacaatttatatatatatatatgtatacacacacacacacacacacacacacacacacacttagaagccatgcctgaacttcaaatttagagaatctatgagtgttgttttaagctgcaaaatttgtggtaatttgtaatgtgcaataaaaaactaatatataagaaaacaagatgctgaaaataagtggttcaaaaaaattaaaattgaagaaacaatgagttatttctattgtgatggttttatcacatggattcaccccaattaaagggggagtccaattcttcatgaatataaaccagccttattcactgacttctaatgactataatgaggtagaagtgatgctaagtgactctcatggagttctgagatttctttcctggaatgtttgcccttggaactcagccatcataccatgaggaagccaaacagcccttgaaaaactcagatgtatgtgttctagccactaccccgggtgaaatctcagccaacaaccaccatcaacttgccagacatatgagttagtaagcctttggatgagtccagcccacagcctttgagcaagcccagctgaagttgaacaatgagctatctccagtagagtcctacccacactgcacattccttagcaaacattgtcattattttaagccactaaatgtgggggtagtttgttatatagcaaaagataacaggacatcttcgtactcatctgactgcatctgactggcaaaaggctatttttgttttgtgggtcttcttgttgttgttgttgagagagggtctcactcttttgcccaggctagactgcaatggcctgatcatagctcacagcagcctcaatctcctgggctcaaacaatcctcccacctcagccattggagtagctgtgactataggaacatgccacatgtctggctatttttttttcttttttttaaatttacttttattagaggagacaaggtcttgctatgttgcccaggacagtctcaaactcctgagctcaagtgatggtcccaggttagcatcccaaaatgatgggattagaggcatgagccatcacatctgaaccacttgcaaaggttttaaagaataataataatacctatggatggatggcgtgttgggaagaagctaactgtggggcaacgaacaaagctgttcaaaaattatttagggccctcactctggttaccagtgagatgatgactgcaccaaaactctgcttcccacaggactagtagctaccttcgaccaccagcaaaataaactttagggtttctaggtgttgggcaattggctttctcccaaaccaatgtaaatatctgacaagaaatatctgccttatctggaacaaactagaatatttatttctccactgacaaatttacaacagtgaataggattcctttcttggaacatttatgcactgagtgtgtatccaataagctgctctatccctggcaggaatttctgtgggtgataatgaagactgaggatctctggctcctcttcttgttgaactctgttttaaaagctttcctaaaaatttttgtgtgatattacagaaaatgtcctgaagtctagtgtgtgattggtggcaaacattacaggatccaccttgcttgagagtgaaaataaaagttctcaacttgctcaatatttactcaaaccatgctggtgattggttattttgaattatttgtataaatttatggagtacaagttaaatgttgttacatggatagattgtgtaatggtgatgtcagggcttttagggtatttatcacgcaaataaatacattgtacacatgaagtaatctctcattatccactcccctccaaccccagccacccttccaagtttctattgaatatcattccacaatctacacccatgtgtacccattttttagctcccactaatatatgagaacaagtgatatttgtcttcctgtgtccgacttgctacacttaaagtaatggcctccagtttcatccatgctgctgcaaaatacatgatttcattcttgtttatgggtgaatagtgttcatcatatatatgtgatgatataataaagaagttatatatatatatatgtaacttttttaatccaatcatccattgatggaaacttaggttgatgccaagtctttgctattgtgaataatgctgtgaaaaacacgggagtgcaggtgtcctgttgatgtaatgatttcttttcctttggatagataccaactagtggaattgttgtgtcaaatggtagttttatctttaattatttcagaaatgtccataagagattttccatagaggttgtattaatttattacaatctcttattaatttatataattccaaccaacagcgtataagcattccctttttctctgcatccttgccaccatttgttatttttttgcctttttaatagttaccattttgactggtgtaaagacagtttctcactgtggttttaatttgcatttctcacatgattggtgatgttaagcattttcccatatgctttttggccatttctatgtcttcttttgaaaaaatgtcaattcatgtcctttgctcactttttaatgagattatttttgttgttgttgagttgtatgagatatttgatatggaacaaaaacacaatgaaaaacacaaaaaaatgaaaaaggatcaaaccaattttgacatccattgatagaggaatagtaaaataaattattgtatatcaataacatggaaaataaaaagctattaaaaggaataaattagaactatacaagttggcttggaaaagtttccatatggtaaaagtattatgatttcatatgaaaactaaagatcaaaaaattccataaaaggaaaataaaccttggggccacagaatcactaagctgaagggaaaagtcaagctgggaactgcttagggcaaacctgtctcccattccattcaaagtcatccctctgctcactgagataaatgcatatccgattgcctcctatggaaaggctaatcggaaactcaaaagaatgcaaatatttgtctctaatctacctatgacctggaagccccctccttgcttcaagttgtctggcctttgttttgagttgtcccacctttccagaccgaacccatgttcatcttacatatgttgattgatgtctcatgtctccctaaaatgtacaaaaccaagctgtgctctgaccaccttcatcacttgtcatcagtacctcttgaggctgtgtcatgggcatggatccttaactttggcaaaataaacttcctaaattgactgagacctgtctcagattttggttgttcacaatcccatgcatatatacgggtgtgtataaattttatatatatatatatatgtgtgtgtgtttgtgtgtgtatatatgtgtgtataccatgttcattatgtatatgtgtgtgtgcataaatcatgtgtatgtatatatacacacacatgaaaattgtatacatgtacatatgtatatgtgtataccttgtctcaagatgtatacacatatgcaatttatacacactcatatatagaatttatgcatagccatacatatgatattgatgaaaatgaaaaatatgaaagaatctacactgggttatttatatggagagtgcaggtggtagagaaaaagaaaataaaggttgattatgccttaaaatataaataggatgtgagagtcaaaatgtgtcaaggtcagcagaaatcagttattttagaaagccagaatttttaaccttgagaatacaagccaaatcatagaatattttaggttttccttagctacatcattactcaacagattgtgataaaaagaatcaccctttttttattcttatttttccagacagatactttccattgttgctgctcaaactaatcagtagaatgaaagactgagtaataccacatttctttcaaagtcgaagagtctgcattattgtataattgatgctacttcagaaaagcaatctcctgatcaaaataattgattacttcagagattcaacccccctcggaacctgctgggagactgaggaatatgctttataagaatctttgcatgttcctttgcatttaaagtgcaagaaaaataagtaaataagagaataataacaataagtaaataagattaaggaagtaataaggaaatggagcagggtaggtgtgtacattcataattgaaaagtaatagcacattaaagttatttagggactgtatggaatagttttttatttgttcatctgttttactaactactatgaactgcttaagctcagaagccatatctcatttatctttgtatacccaagccctagcatattgcctggtacagaagagctcaatctgtgttatctctttgatggtggttgaataaatttatgagtttcctaaatggaaagacacagagagatgcgtatcaggtgggtggcatttggaattcagtcacagactgagggtgggccacatgcctctatgctcagaggaaattccactttagctggctagcacaactggagaacaaaaagtagctatctagaccacagtggactagagctgttttgcccaaaagggaaagataacaatccttctggtgccaatgcacaggcctgcctgcacacacacacacacacgcacactcatacacccgtaggaaaaaaaaaataccagtaagagaacttggatttaaagggaaagaaaaacaaagcattcattgaaataagttataataaggcagttagttaagggcttaattacccatagctccagaggagcgtatgatgttacagaagaggaagaaatcataaaacttagcagcaggggttcatcttcccagatattaaataggtaattaatcttaactgcaagaagcaattatgcctcactgaataaggtggagctttttagtctcacaaagcaaaacttcaggtcaacacaataatggcaaaggcaagggagcaaaataaatgatacctatgagtacttttctcttaaaaaatatattaatctgtactcttttgcagatgtctaggttgtgcctgagataatatttgattttattttatttagaaaaatattctaatttgcccttatgtactggattttattattcagcagctattataggtgtgccacactgctgtagatgcttagaatgcacagttgaacattctacaggttacagaaatgtaatctaatgacaaatctatagaaatccaggctgagaagcatgggtaggaggataccgtatatatacctttgacagtacgtgggttctttttttaacttttattttaagttcagggatacaagtgcaggtttgttacacaggtaaaattgtgttatggggaattgttgtacagattatttcatcactcaggtattaagccttgttatttttcctgatcctcacactcctcccaccctccgccctccagtaggccccagtgtgtgttgttccccactatgtgtccatgtgttctcacaatttagctcctacttataagtgagaatatgtggtatttggctttatgttcctgggttagtttgctaaggataatgcccccagctctatccatgcccctgcaaagaacattatctcattcatttttatggctgcatagcattccatgctgtatatgttccatatttttttaatccagtctattattgatggacatttaggttgattccaaatagtgattccactatttaggttgaatagtgctacagtgaacatgcacgtgcacgtgtctttataatagaatgattttaataggattaaaatttacaggaaactaacaaacaactccataaaaaagtggggaaaccacataaacagacacttttcaaaagaagacatacatgccaccaacagtcatatgaaaaaaagctcaacatcatgaactttagagaaatgcaaatcaaaaccacaatgagatattatattaacaccagtcagaatggttattactgaaaagtcaaaaaataacagattctgaagaggttgtggagaaaaaggaatgcttatatactgttggtgggggtgcaaattagttcagccattgtggaagacagtgtggtgattcctcaaagacctaaagacagaaataccattcaacttagaaagtatttgggttccaaaagaaacgtctcattaaaataaaatagcagtaattttgtcccatataaaatattaagtaaactaaatttgaaaaaattgctgattttataagtttgataaggaaaaataacatagactatattcatttgctggggctgtcattacaaaataccacagactgagtggtttaaagaacagaaatttattttctgatagttctggaggccagaattccaagatcgaggtgttggtaggtttggtttctctctccttggcttgcagatggccattttctcacgttaggtgcttttctctgtgtgcgtacctttctagtgtcactctgtaaatcctattctactcttctttccactctccaataagattgaattgggatccatcctaacaaccttattttaacttaattaaagtcctatctctgaatacaatcatagtctgaggtactgggagtcaggcttctttgtataaattttgagagaatacaatttagtccgaaaaatatacacataccgaaataaaattttaaaagcctaaatcttggaggtaaaaaaacctgtgtcaaaatattcattcaactttcttgcttactgatttgaagctatttaaacatacaaagccttagatatatgattggattaaagtatatgtgattggataaaagctgttaatattattatggaagttccccctgagttccacctgctctacaataaaaaacctgttcttggcagatttcagctattttatcgccatgtaaactttaccctcctatggccccagatgggattgtctttgccaaatgagttactggatttctcacatataaaataagaactataatagtacctactgcatagggtggttatgaagattaaacaattactattgtgactactaaatactatatgtatattgcatgtgtaatatatacataatatacacataaagtgcatgtcctagaacttggtgcatagtgaggttgcattaaggtattgctacttttattataacttgtctttactacaaatatctgtttactacaactactactagtattattatttaattactgctattactattaccatacttctgttgttactattttttccaaaactactgatctttctaaaatgcagactggaaaaatgtcactcccctgattcaaacattttagcaaattggccattgtttttgggaaaagcctactcgatttttttttgagagacagagtttcactcttgttgcccaggctggagggcaatggtgagatctcaggtcactgcaacctctgcctcccatgttcaagcaattttcctgcctcagcctcccaagtagctgggactacaggtgctcaccaccacacctggctatttttttttcttttttgtattattagtagagatggggtttcaccatgttgaccaggcacgtcctgaactaccgaactcaggtgatccacccgcttcagtctctcaaagtgctgggattacaggggtgagccacggtgcctgaccaagcccactcttttatagagcccataatttcctgcagattgtaaacctgatgagctttatctctaacaatgtcaaacctcccacaatgcacccacataaataatatttcaattccatttacaacaaaagtacttattgcttgactctctactatgatagacacaattctctgagcacaggagatatagttgtgggcaaaatagtcaggatccctacactcaggaaaaagagattgtggaaacagataacaaataagcaaccatataaaaatactttcaatttgtgaaaagcactttgaggaaaagcaaacagaagtacatgagaaagactgaatggttaacagcttggggtaggttggttgagaaaggttgctctgaggaagtgacatttaaggtgatacttgaatgaagaaaataagtgagattgaacattccaggcagagggagcaacacatgagaaagatctaaggtgagatctaatttagtgaattcatgcaactgacaaaaaggtagagtgaccaggccctagggatcacaattgagagaactgttggaagcggctagttccttcaaaaacttgggagcagctagatccttcaggatccagcctgcattaaagaacttaataaactttcaacttaaagaactttaatgcaggatctagcctgcattaaagaacttggcttttagtataactaaaacatttatccttttagtataactgaaaggaagccattagtataactataggaagccattaagcaaacttggacaggataaaacaaatctgaattatatttccataaggcaactccaactgttttattcataattgattggaagagtacagtcatggagaccaggtagggggtgataatgatagtctagatgaggagtgacagttgccttgaggagggtggtagcagtggagataatggagaagtggacagtttcttatgacatatatttacttttacaattattgtgtgtcatttgtgtaatgtgggtgtttttatttttctactgaatttgatcaacaactcatgcctagggtttccagaattttatgaagagaataaacatattaagttaataatgactgaactaacaatagagaatgagaatgatatataggttactaaactaactgaagcataaacatgagaaagactgaatgaagctgcaaggaaagctctcatctattcctttgcattatcttcctcatcaagaaagcagttaaatttagcctggagaaaaactttcttctttcagaaaaaaaacttttttcagaagtaaagactggtctgagagtcaaataagccttccaaatagaagttgtttaacattaaagtggctgcttactcattcttagtctaattttttcatcaataaaatacatatttttaattattgaaagcctgctataagaactcagttcaataacacataaatggttttgcacagagcctgccacatagttgtccatcaataaaagtggctcctttcactgtgaacttatcaaggtccctgttttcctcttccacacaattactgcagattcttttctgtgtttcatccttttttcatccattgccatactgagctagaatatcactccctttgcaatagttttaattgcaaggaacagaaacacattcatgttccttcaattcaaaaaaaaattgttattgttgtttttgtttcccttaaaataaaatgctaaaattaaactcactggaatcaggaaaagctatcctgccagacatgatgcaaggaacagaaacaagtatagtgagattggaggaaactggcatatagttcaaaaacaagatcactcaggaccaagatggttctggggactggtttctagccttgtctattagaagccactgcttgttaatccgtgtactagtaatctctccataatagtgactcagttccaaccaatgtgtggtattttcattattcctataaaccacacacctcctctgtattataaaagtctttcaaaaggcactcttcacagcttctgcttacttatgagcatttttactttttggcatctgcaaattggcactgttcattacgtttctgcctgtattagtgagtctctttgcatctcaagttcaaattactgagttgatccagttaatcacaatcatctttattgaaaaaatcctctcatactaggacattccatgggacattacctagcctataaattgggtactttggagtcagatatcctcatcttatccaatcagttctttccataattatggatcatatgacaaagttcatgaacacatatgtctaaggccaggccacctccttctgcaggtgtagtggatttggtagtttctctcagagtctgtaaatattcttaggtttagcctatttgttttaagtacaaaaaaggtcagtttatatatttacatatacacatgttcttaaagttcagtttaatttgtttgtgaacaatattataggtaatctgaaagtgtcaactgctggttacttaatataaaagtatggcatatttctattgacatggcctcatttagaagcaatctaagtgtccatcaacagatgaatggataaagaaaatgtggtacatatatacaatggagtactattcagccataaaagaagaatgagatccattcattttcaacaaacaacatggatggaaccagaattcattatgtttagtgaaataagccaggcacagaaagacgaacactgcatgttctctcttatttgtggaatctaaaaatcaaaacaaatgaactcatggacatagagagtagaagaatggttaccagaggttgggaaaagcagtggggtgatggggcatacatggggatggttaaagtgtcaaaaaaaaaaaatgagtaagacctagtatttgaccgtacaatggggtgactatagtcaataataacttaactgtacattttaaaataaagggtataattgagttgtttgcaactcgatggataaatgcttgagggtatagacaccccattcttcatgatgtgcttatttctcattgcatgcctgtatcaaaacatctcatgtagacaataaatatacttgctatgtacacctcaaaatttctaaagattactatataactcttgaaactatttgattttatgtctgtatggcctcatgaaactttatgcatttcaagataagagccatttttttttacccatccatatactcctatgaatgtttaatatgtttgtggtctattatgtttcttagtatttgcttataattcagctgttttctgcccctattagtgaatctctttgcatctcaagttcaaattactgagttgatccagttaatcacaatcacaatcatctttattgaagaaatcctctcacactaggacattccataggacattaccttacctagcctatgaattgggaaatttggagtcacactctgacacagagtctaccacagtgtatggtaaaatttaaattatattgttttgtttgagaaatgtaacttctatattgagtccaagctttattgtttgtctcctgcaggcagcgttaactccattctgcgaagactttcttccacaattgttcattgctctattcccaatgtttagaacaagacctggtaaatgttagtttggaaatatttttggaatgaaaaggaaaacacacacacacacacacacacacacacacagtcacctgtttaacactaataaatatcttctggatccctaattgcttgtggggtaattttcagttattttgtgtccactgccataaaggtcaaacctgtacatcacaacagattggcaaagccagctaagcagcacttattattttgtaatatatttatctttactatacctttatctttaatagtaggtactcattctgtcgatgaatataatatatgatactaagtaacctttccttcaaaaatgtcattaggctaatatagtattatcacctgaaaacaatccattggcattttcctaaatgtaagtgtaatacatataggcttaactttaaagtactataaactatctccttttataagatactagatgtaattattcaggaattcttatgatgtcctttaatgataatatattctataatatacaaaaagaacattaagtattatgctttgaaaaagctcaatgaaatctacacttggcccaaactgtataagaaatagaatcttatggaaggaaaaaaaaaaatacccaagagtatatgtgccagtatctctaatgcaaaagaaacaagaagctgaagtgtattttagaaagaaaaacagaagaatgtgagtttgttgcaaataaaagtctatcattcaatgatataacagcctatgtttccaagtattttacaagtttatacaaactatatctgtttccctatctgtagcagcaaacttttccatctggctaacttctatacatgttgagagtacagtaaaatgactgagagcagattctggaggcagaaggtctttgttggaggccaaactccagtcgttacaagttgcatgattaaactccctaatgcccgatatcaaccccctctctttctccatattcttcttcagataggtgatagaagttataaagtaaaacacttcctctggacatctcccttggggtgtagcatcagcattcctcatttcttccttcaaaatttgtataccctacatcttcaacaatattgaactaatgcaattccacgaatgtattttagaggaatttctagacaaagataaggcagtcaccattaactcttcaggttactgactaattagttaggttttggtttgttttattttttaaggcatgaatcagaagttcagaacagcatgagacagactagaagttttttgtttatttataatgttccttcattctgtactcacaataacatcaagtaattaattatgagatattagttgtgtatgttgttttctcacctgttggtgggccttttatgtttctaaaaagtggatcacctacttttttttgagggtagataggaagaggtttatctagacaaagctccatgatcattaacttgtcgttatgttaccctttgacaaggtgacctctgttcctcttttacaccccaaatgatttagaatacaagaatacttaatgctagtttctcacatagagatatgaaaactacccaacatataaaactacccaatatttctcataatatagtaaaatgtgtaagtgccatattacatatcctgccttccagtctttccaactgttagaaattttataaattgtctcttaagaatggaatggcccatactatgtgttcctattttctctggtgcaattgatcaagtctatgtactgctgaagggagaaagcagtgccatatggcaaatgaccatgatcaggcctgtctgaggtcctctgacttgtatttcagtgactgtgtacatgttactctctctgctttgagtgccttgcctcttcttgcttcctttcttaatctggttcatcttcctttcttcatcctccaagccatggataaatttatttcttacatatttatttttattttttacatatctacacacaactctgttgatatttatttcaatagtttgcacttgtataagccccttgaagaaagaaatcgagcttagcacagggtttgtcacatggtagatatttaaatgtttgactgagtgcatactttgatggtattgaaccattcagcaagcacattgcaaaatatattgtgatcaatgatgaggagaagacactgagctgataatatcgctgtgtagatagtggtatctagtgataaaattttggataagaaattctccacttacatgaaaatagatacagattctccctttctaacagccatggaaacttaaactttactggagaagacaataatttgtggcaaaaggaaaaggataaactaaagaagtttatttttccccgggcacataacgcccattacaattaaagtgttaagctgaactgtaaagggattatagagtctccatttttccatataatcagttcattttctccataaagtgaattacaatagggacatgatctctcaggaatataatgaaagttttataccagtagaccttaaaggcacaagcctcattttttaaaaaatgaataaatgtcttcaaaaggaatatcttacaaaatgatttgaaaataagggtactcatggaaaatcctaattatcagaatgtttcattatagcctttcaattgcatcaaccaaatagaaacattatttcttcattttctgttttgtagtcataactgagaataacgatggccaagtgggattgcatttctctaaagacaaataatagctgttataaataagcaacatatgaggactgtaatattgatacatttatcaagcagagtagaaataaagctatacctggttattatgttaagcacttaacacacgaacaaatcaattaataaattattatttagtggacactaatttcactaaataccattacattcactaagtgtgcaaggaaaaatgaagctccaaaattgcaattcttaaaagtttttcaagttactcattataggaatattcctgctaataaattaagaagtaatgatagactgaggattgcaccctctaataaatattgaatgtaggaataaataatgttgataacatgagaaaaagggagagattagcacaagccttgtgtcctgatgggagaacacaataccacttacattcttcacaaaaatgtatcaaatttgcatctcatgaagtctctgtatctaaccttcaatttctaaaaaatagaggggaaaaaagtacacatttgacaacactacagatatgtaatcagcaaaattgagaatgtggcaaactttaaggaaaaaggactatgtgtcctcaaaaaatagtagggggaagagaaatagggaagaagacaaatgaattaagattggggacatacaagtgattttaaacggttaaaaagtgaaattatgagacggagaatgtgaacaccagttaggtatgcaattatgttgaagacttatcattccttttcagggcataataatggtactatgacgattttttttaaatagccattatattttagaactaactgaaatatttaagaagtaattataggatgactgggatttgattcaaaatgatccagggggagtgtggaaaggaaagggatctgggcacagagaaaacaagtatggtcacccataggtaactgctaaagctgggtgacagggacagggggcatgatttaaaaattctctttatttttgggcctgtagtcccagctactcgggaggctgaggcaagagaatggcgtgaacccgggaggtggagcttgcagtgagcaaagatcataccactgcactccagcctgagcgacagagcgagactctgtctcaaaaaaacaaacaaaaaaatctgtttatttttataagtttaatatttcacaaagtaaatatatgatttattagatgtttaaaaattgaaattctggccacttcaccaacgagatttcttgctagctcattttgtgcaagggctccagccttttgccctgttattcagcactctttcctctctaccatctgcttcccctattttctggacctgttttattcaccaatccatctacatgcacagactcttaattctcacacttacttaaaggagaagttcggtctccatctcctacagcttactgaggttctgcctttgcagaaacaaagactcactaatgtattctactaagcaatgggccacctacaccaggtgccaactgttagcaccccacactggcaaaggcattattattaataaaatgtccaatatttaatctccttctgacaacaaagccctataagataaaaggagtaaacatattttaatttcctccactcctctgaattatgcagccactaacctcattcagctctttaaaaggcagaaatggctaagatcagaagatggttcagttttacatgattttttttttaagggaagggttccctctctataactgttacttttttttcatgagacatttgtattgcttgaatataattggcacaaaattggagacaagaaagttctctcagaatttaaatttataacaagtaccatgtaaagcgagtgctttgaatattttagtgaatattctggggaggcaactttgcattccagttatgtatttcatatcttaatttagaaagacagagaggtgtgtcatttacttaaaatgtccttttaagtcattaattaaaattacctctaaattaggattgcatagtctaatttcattcctgactatgggtcatatatcatccatttaaatagctctaacagaaaatcaatctccttttctcactcagagcagaccatttaaatcttctaagtgtaggatgcataatagaaagttgaggactaaaggaggcaagagttagtgagtttctctcattagggtttctctttaggatcaaggcaatttcatgtataggacaatcttcaagaaaacaacataatcttgtcataatgcagtgcagttatttggattccagtgtagcaagttttgctctcaattagcctaagttatctttccctaaagcttcaagtcaccagtttcatccactatgtcacatgtaataatggaaggatccagaaagctgctttgttccaaggccgacgggaagtattagatgcagacccaaagttcccatgtggagggagccctaacctaatgtcaagcatctcttctgtcaagcccgaaagcttattttactaggactgactcatccagcaacacaacgtagctactgcatgaaagggcttcacgatcacataacctctctttgtgaattatccaaacctaaaagcagtttctcaatattttcaactgccaagcaattactccagtcaatgtagttaccatctatcctcagttttctcaaatgtttttcctttatgaccttggcttctcctgctacaattatttgttccactttttaacaacagcaacaacaacaaaacaaggttctactatggtggcgctcgcactggtatcggatcagctttagtttaaatcactgctctggaaggtactaacactatgatttggggctagtaagttaccctcaataagtcttaatttcctgatctgcaaaaatgaacatggtaacaatatatttctcttgggttctttaaatgagataatttgcagcagacctgaagtacagtgtcccatatattatattcaatcaaaattggcagctgattgttttcaaagaaagttaaaagcatatgtttgttaactttagaaattaatcagtgacataactgaaattttaaatccaggattgtaggccttagtagcacaccaaagtttacacattaaagagtaaccaattagtctctgctggcagactagctggtccacaccacacagcagtgctgtcttcatactcacttgtagtcactaagcaattatttggtgtcaagaaatatttaaatccaggctttctgacccctaaactattacagtctctttcttgtgcaactaaatgtccttaaccacaacttcttttccaagggcttgaaaagagcaaatgttgaactccacacactaaaaaagaatattaacaacaaaaacataaaacagctacaacttcagcttttgccattccgtaggagagaatatttatcactctctgtatttctcttttaattcatattgcaagcttatcagggaatactgcctcttcaatgaggagaactataatttggggggaagacattcaattcagagcacatattagggaatgtgattttacccctacgttgaaccattgtctccaatcagattcctttgtcttatttcccagttgtttctaaactcaatttcagagcaatatttattggcttctacaaatactattatccatcaataggcaacaggtatagtagaacaaactgggtaagcaatgtagttgtattcctcaagctaatgggtaatttgctgtgctcttttcccatgtccagggcaagtggtaatgccccagataaaggaggctgtgtcacctgttgaaacagagggaatatgtcacagatgatgatcccacagttgctgtctcagatggaacatggggtcaactgtgtttatgctgtattttagaataagataaagatattctagtttatgtttcataccagtataagaaaagaaacctttaaaaatatatatcagatagtttcactcgctggcttaacattctctaaatggctccatttggcacttagcacaaactccaaactccataaaatagtgtatgttcattgttttaaaacagtgctattcaccaagtcttttctgattttcttctttctgccacatagtaaatttacatttccccaacccctctgtagatatgtacatacatctatgtgacttgctgttgcaaaggaaatgcaagcagaaatcaaatgacctattctggaagtaaatttttagggacagtgtttgattcacattttcttctcattgctatagtgacattggtgaaccaagaaaggataaacttctctcagcctttaagtgactgtaatgagttttcctattgacctgctctgagcaagaaatagtgttgtgtttgtttgggtacatgagcgtgcacgtgtgtgtgtgtgtgcacatgcactttatgtcactgagattgtagggttctattgtcacagcataatctagctcaatttgattagtctaaaaattggtacaatgttatgtaactcagtgttaaaatattagattggcttcatggccacttggtgggtagtaaaaaatcttttatcaaatactggaaatatagtgttctatgtccttgagaggcaaaatatttggtaaactaatattttaaataacttagaagcagatgttgtattataagtctaaggaaagagattggatactagaacatgtgtactgtatagattcctcttttgaccaggaagagatgagcacagatgagaattggaggatattaagggaatagaaataaattgaagaaactagaggagttgatgaagtaattaccatcccactgtacaaagattaaaatatagaatattaaagactttgctggctgctatatggaaaatgaattgattagagtgaagactgatgaatcagaaatatcattttgtgagtcatacaaggcatgttaatggcttggacatggaagacagcaacagtgatatgtagaactcgatagattcatttggtatatattttacagggaaaactagctggatgtgcgtttgaagagagatatcaagaatgaatttaagattctagctcaagtaactagaaaaacattgatactatttgagggcatagaaaatattaggtgaaagcaggatttctttgcatgatatgcttggcatatatgatttctaaatggtaattacaagttgaaatttgtgcatataaatctttatttcagtggagaagttagagtgagaaacacgtatttgatcatcaggcaattgaagaagatcatctaggaataagtgcaaatagagaaaataaaaaccccaaaggtcaaggataatccaggaaaggatcatgacaagaagtatcaaaaaggaagagggacaccattaaaacaaatagagagtacttcaaggatgattatcaactccaactgatgccagtaggaaatcaattaagatgaggacttccaagtccactagatgacaaatttcaggagggcaggacattttgactgtttatttcactactgtatctccaatacttacagtaatgcccgggggaaaaaaatgatggtagagtgggataagatagctgctagagggagataaggagtcaatacaaattttaagatgagaaaactagtcccatcagaggttttacttcaataatcttttccttccacagtcttttcttttggcattgtttctcttccatttttatctactaatacagttgcaatatgttattgagctttactaagaactgaacccagaattttttaaaaaatacactcatttttgtcctcacagtaaatttagttaaggggttgcatgtctctttgatctcattcttgattccccagttactagcacatttcctggcacataataaataagcaataactattgttaaatagattataaatatttttctccttttaaatggcaatatctttccttgaccattgtgaaatttctttgttttcttaatttgtatagagagaaacccaagtctactcagcacttggatttaatatgggatcaggacgggatggcagaaggtaagatttgatgatttctataaactactgcatacagttcagaaatccttcagagtggaagtaggatagaaatacctgggactatatgaaaggatgatagggacctttacttctctgataatgtttttttctctctctctttttatttggtatgaagtatgtgaatttgcaccagaggtttccatgttttttgtacagcattattatccaaacttcagcgctgttcttccactattaattaatgtatcgtttatcaaatgaggcactcaatgaatgagaactctgtctttgctgttgtcatcatcttcattattgttattattgacttagaatttcaatttctcaaatctttgtcttgagatagcctcctgaaaaggaattccttcctttttttttttttttttttttttttttttctggagacgtggtttcgcttttgttgcccacgctggagtacgggggcacaatcttggctcactgcaacttctccctcctaggttcaagccattctcctgcctcaaccgcctcagtagctgggattataggcgcccaccgccacgcccggctaatttttttgtatttttagtacagacggggtttcaccatgttggccaggctagccaggctggtcttgaactcctgaactcaggtgatccatccgcctccacctcccaaagtgctgggaggtgtgaccaccgcgctcaccctctgaaatgtatttcttagtccagtgactagatggcttttgggttaagtgagtggtaagcacacagttggttctcttcctgcttcatcattcactcctttctgtagtttaactcttcagcattcaagctgtcagtgagattctctcagtctcctgtccttattttcttatcactctacttttctcagatacaagagaattaccattggcaacttttactcttcctccttggaattcctcaagagtaaatgtcacccttccagagtttctctagacatagaaactttgtggtagatttcaataaatcactgataaagtattaataagaaaaaaactcctttatactaccttatataaaagttgtttctcacctatttttaaattatgctagcttgtattttatttaattatgaaaatactcttaagaacattttaaataaagtagtatatgtataaaaaattactgccaaacagaaagtggagagagagagaaggagagagaagaaggggagtctgtgactgtgtttgttgggggtaaatgtcttttaaaatataaaaaaaaatctgtactcagtaagaatctgaggtgaaattgtttcatattgctgaaacatgtccttattttctactgaatgtctatatcctttctctctttcacagcacatcatttgggagggaaaaatcaatgatgtagttgtcgctttctgaaattatatgtcttagacacatggattccttgggtcattgctgtttttcactagtggaaaatataatgaaaactgcataatggaaagaacaattccaatgagagcaggttaaactgtagcagaattttaaacttgaaatgtgagctacagaataagcaattaatgtaagtttcatctctgtaaaaataagaagttctttgtctagaataacactaaatttaagaaatcttgcaaaatttagaatcttcctatgtattaaaaaatattttaatcataaatgaagttggcattcctaatgacttcaaagctaggacacagaaattaaaaggtgtcctaaaatgaaagcgtacccctgaggaattatcatttaagtgttatctgcatgtgtaaatccatgaataaagctaagaaatcagtttcagtgaaactatataaacatggaaatgacatgaatattgaatataaattgttaaataacaatatctcagaacaactaaaacctgggatgtatttaataatacaaatcagaaagtggcatgatgttcctccttcttctaaatgaaataattcactcttatttaccctcaatcaagaatttcttctatgctgccctcctccattagcaaaacttgagttaatttatcagtcacattttcatatataaaacagagagcacctcaggctaaattcagacatagttagctagagaacacagtgctcagattacagagacagaaagttgaagaaccatggatacaaagagaaagaagccttcctaaaccaataagaaattttaaaatatactctgggaggagaaaagcgattcccaacatatgtaaaattagagaaaagtattacaagacactgaaaaagttaaccatgtgtattagttgtctactgctgcattaaaaactacccccaaatttagcaaattagcacatttattatcacaaagtttctgtgagtcagggattgaatagtggcttagctgggtggttcaggatcagtgtctctcacaaggtgcagtcaagatatcagctgggactaaagccatcagaaggtttgactgggactggaaaatctgcttataccatggctcacttacgttcttggcagaaggccttagttccttgctagatgttgacaggaggcctcaggtcctggcttggagctcataggactatttgagtgttctcatggcatcagatacagctcctcttattagagaaaagctccaagccacagtgtcttttatgatcccatctctgaagtcatatataatggcttctgttatattctgttggtcaaacaccaatccaattaacatgtgacaggaaactacacacaaatgtgaatacctaaaatagggatcattagagccctctcacaatctggtgatcacacacagggcctgtaactcattttctccttcttaggagacatctgaggtgctgtggacataaaccagagccttctataaatatgctcagagtagtttacttgctgggaagtaactagaaaagttttcacctatggttgctcttagcaggctatgtttgatctcattaaattgattattgaaaatcccagaattcattggttgagagatgcacctggctagaaagttgaaagtaacacatagtctccctacccttgcatgattcaccaagcataagacttaggaaagtctaaacttacacatctgtaccacagggattgtcagtgttgatgtagcaatccaaaagttaaacgtgctacactgtgggaaaagaggccattaaaaaactgcatctgataagtttggagacctctctagaaaagaatgctgaatctgtgcctgatttttgcttgcatcatttggtaagtgttataggttgaactgcatccagcaaaagtaaaagttggagtcctatctctcagtaccacagaatgcaaacttatttgaaaatagagtctcacagacataaatagttaaaacaaagtcttactggagtagaatgggcccttaattcagtatgacttatgtccttattaaaaaatgatatgaatatgtagggggagaatatcatgtaacaatggaggcagaagttggtgttattcatctgcaaactaaagaacatcaaggattgccagctacaccagaaactaagagaaaggcatggaaaaaattttccctagaatattacttagcatgtggccctacagaaacatgatttcagacttctggcctccagaattataggagatacattactcttatcctaagccacccaacttgtggtgctttattaagtgaatacaacaagcattagcaaattttggtgggagggatttatgatgtgcctgagtctactttgacaaatcaacattctgtgcaatgcagattagtggcagtagtaaaattggcattcagaccacaaattataatggctaaagcatttggaggcaaaaagaagaaaaggaagtcaggaaaagcatgataataacttaataatgacatcactttctacatattcttgatataaagagatgagagccttgaagtagattacagaggataatcttcttaattaattgtaaaaatttgcccttaggctgaaggaaatggattaaaaggatggacagagaaggctaagcaaggggaaagttgactaaaagtactatttctagagtttatagcagtactggtgaaaattaaattcctaaagaagaaaactagaataaaaacatcattttctccactcaaatgcattgttaagaagaaaattaaaactaatctcaacactctacaatatgttgtgtagatcctacatgtatgcttattaaatgaataattacttttcagtatataatataaattcaggcatcatgaagtatttatgtgtggtctttataaagcattgaggtaaggtattcatcaaagtatttttataaatagtgttaagagatacactttggcaaattaaaattttaaggagtgtatctgagtgatagtgattcattaatcaggcatctctagactgcaagagaacagggtctcagataaaagggcacagggaaaggctcttatagggtgaagtcgaagctaagcaggagaataatttggttgacgtttgagcaattgagttatttgagctatcccactaagaagtttaaaacaatgtaagtgatgcctaccttgtgattggctgagcttaagtttcatttttatgcagaaacccagggtgttggagctgcctcagtctaaaagcctctcatttcacaaatttaacaataaatatatgagaaatgtgcattctaagtggctattttttttttaattttgttgctcagagtgggaagtgcttgattattgcttaaagttaatgatgttaaaaaaaaagttaaagaaaaactaaatggatagtggataagctattactaatgtgaccctccattaagaaagttctatgaaagtaagaaattacgatgcaaagtgaatgaagatttagtaaagtaaaacatcagaggaattgacagatcacttctaagagaaatggcttcgtgttagaataatttaatgcagttatatttatttgttactaattttctttgttaataaatttaatactagtccattaaaattccactaatattgtaaactgcttgggatgggtggattcattcttcatagcattttagtagtaagagtaatattgttttgtcatccttgtcacagaacacttatgaaatcagactttggatatgttgcactatatatttattgaatgcttactaaatgactaagtttatgcacagtagatgtcactattatactcaatactaaaaggaatataactctaaataaattataaactatatgacatattctcttatgcccaatgccctccagaggattgcatttatatctgttgttaatgataaagatgatgaccatatacatagggaaagagacaatatgcctattagctatactcagagagaatacatttactgtaatcaaatagaagacaaaaatggcaccctaattctattattttagttttcaactataagcactttcaaattactgaatctttcaagagatacaagaagtaatttggaatttgtcaaagcaatttttattcatttaacaagaattcaatttaatcaacaaatcatttgtgaataatactggaaaattaacgaatttggtgctctacaattgcctaaatgcttcaatcctttaagatgaggaaatataagcaattgaatagtttgaaagtaaatgttctatacttacatttgggataagcaatttaaaatgactgttgcctctgaaggatgtcagtctaattttcagcaattgtaatacattattactatgtacatatttcattaacatggaagtaaaatctgtcccctcttttaagtataagactaaaagtgttgcactcaaagagatcctggtgaaaagtcattttgacatgagacaaaaaaatagaaatggaaacaatcacagggaaaacttattggtttaagtatatctatcaaaactacaacacttgttgactaggaactcagtttaattataaaactttatgattaatgtatgattgttcattcaacaaatccttaccctttcctctatccatttcatcttcattacactaatcaacgtaagtaacattttcacattaaccttgcaactttgtattgtactgtctataatcactaaaattcagaattgttgatttttattgattcctaatatatgcacctgttcaggggatacatgtgataatttaatacattaatacaatgtgcaaagatcaaatcagggaaattaggatattcatcaccttaaatatttaaaatcatcaatttttattgccaaagtattttcccacttccttgcaattaagatttcctggtgaaagaacaaaaatcaaaatagttatatcctgaatggacatcaactccatctcaagaaaggcagcaatttctaagagaactggttgatcacaagcttttgagctgactcagctgcactgctaaaagccctgaccttgaatcaagattaagggatccactaatgaaagccagctctggcagtttttcagcactaccactggcaaatggtcttcaaatcagaaattttcataaaaatccatggaagatgtaagcccatcaaaatcttgtatctacttattttcttaaggattttgttttataagcaagagttacaaccaaattttaatatgaaaaatatataaatctaatatgcaatataagtaaatctatatttgcatgtgtgtatgtgtgtaaatatgcatgcctttaaaagtttttcttattgagtttaccatcataatcttcataatggttgggaagccagtatgcaatttaccagaaagtgataacaatgccagaagggatttttgtttcattggagttctggcagaggttgtccaaggaattatttagaaagtttaacaccttgcttaaaccattttacaaaggcaccccatcatttcgttgtggccaaataaaaatatagaaatgaatctctatgcaaaatgttttattttggagtgtatgtaaagacagaatggcaattcaaggcatatccatagacctgggtagttttgggtatgtctgaagaatgaagagaaggttggggattttatcagaaaaaaataatgttacatattgccttaaaaaactcattggcatgagcaaagttttggggagctggcaagctctgactggtgagtgatagtggtaggtaaaacaaatctcagactaagagcagtttgttttagcagttactaggtaaaactggtcttaaggttatagctggtcattttggtagctggtttgtgatataatgcctgggcaaaatgaggtctgtgtcctgagtgtaccacctgctctgtacaccacctgctctgtctcttaactctaatttagttgggtataacaagatcactctaatatatataatcagttcttacagaatccaaaacctgtttgacttgaatatccattttaagaaatatttattgacatctttgtcagggactggaatacacactctgctgatacatggaggatataaacacatggcgccagcttccaagtctagtgttgaaataacacatagatgagccaccacttacaatatttagtgaaaatccccatttagggtgagtatagacaaggtgtataaattctggcaacactgtcaacttagtggagtagaaattgtttttgaagcaatatatgagtttcttttgtataaacgaatgatgttttgctaaaaacgcaaggaaaaaagacatctctagcaggaataactgtaagagcaaatatgaaaagacctgggtacaggtggcatgtttgcaggctaaaactagtcagtattcctgaaatataaacagcaaacttgtagacacaagatctgaaacacataagaaggaggtccttgatcttaaatagcattggattttatgccaaggaatttaaatttgattttgtagataatggagagtcattgaggaattttgaaaagggtgaaactgaggtaaaaacaccagtcacaggatgatgaaagtccaaaaaagagagcacaaaacagacaaactaaggtagcagagaggaataaagaatttcagttattatttaagcaatcacatgaaaataattgagggaggaaagagtctgcaatgattttcaagcttctagcttgtggtacctggcgaatggggtgctattcatccatgcagaaaataagagaggaaaaacgtaagttttaattctaaacatgttatatctgaggtaactgatgggactgattaaaagtccaaagtatacttagacacaaaatgctgcttcttgggagagagaaaaaagatgtatttattggagatacagaagcagttggggtatatgtagtaattaatgccacaggtttaaatttactagtaatttgactctatcaataaatgttcttatatattatgtgatttataaagtttatatacataagatgtataacaaatataaaagtaaaacctaaatagacatcacaatgaattttacaatatagtctctatgaatatatcattaatctaacccatggcatctcacacactatctcttcctcaacacaagcaaatgaaagtcagaaatccttaacatttaagcccttcccagactttaatagtaaagtccttactgtagtaaggaatgcacagtagtcatgtacatgtagaacattcttatgtcattacactcatcaaaatatggctgttttccacaggccatcaagagaaaaaaggttatcagcctggacatcacagggagactattataatggtctttacaattagaagtatggtcatgcagtaaggcagtaacataagtatggcaaagagagctcagaagaaaagccatttctatggccaagaagaaagaaatgggtagtcaattgaatatgatagtagtgagtgactacttcactctttttcatggatgagaaaactgaagcacagagaggagaaaagttcactccagcacttacacaacagtaaaccctgttcagtgacaacctaggttcaaatccatgctgtaatcctctagatgattggccattactaaattttaatacactctactgggttccatgaagtagtattatacatatttatcataacaaaattatcacaaatgaaaaggctgaattgacttatgagttcagattggtaaacctacacaaaaatagaccagaagtatacatttttattttgtcagttgaatgtaagctcaataaagataggtagggatttatgtctactaagcttttgctgtatccacagcaactaaaacttatagcacttagtagactcttgaaaaacaactttaacaaatgaataaacatcctaatgatgcctcaattatccaaaatattggagagtaatatattttaattgagaatatatattaataaacgtaaggactttctctaaaaaattgctgcatagaaaatttgtttaattttaagaagagttagagaagaaaaaaataaaatttatttaagatatgcctaaataccaataaaagtaaccaatttataattttaatatgtaggcataatttctaatcttttttaaaaataatacttctattattatagtgatacatcgtttttgaagcaaatgtgtaaaataaaagaatgtataaacacattcgaaaggatctgtcatgccgtcatccagggatgactactgttgaacattcagcgtctctatatccagtatatactctatttacatgattacatttcaatgaacaaataaggcttatactatgtgtatagttttactgtattatttcttcttttaatagtttattatcaaaatttcctgtgccattgaatatttgcaaactctgattttgggatacattgcattccatttttaaatacactacaatatatctgacttttatgatttctagtatttcatttccaggatttttgtaaataatgctgtatagacattcttacttataaatatttgtacatacttctaattatatccaagaataaatgtgtagatgtggtatccaccattatttgtaagttgaaatggctgtcagtgatatgtagattttagtgttttatacaattgcctgtctccctcaaatattctttcatttgtttttctttagtcagtaagacaattacagctatattgaacaaaatggaataataggcattcatacttaataaaagttaaataaagttaataattattattacatgttattctgccaacaggtttaaattttttaataactgttcttatacatttattttaatcatcttttattaaattaatttagacctgaattttgatccactcccaaattttacaactatataggcttgcaaaatcaagagttcttatatctcaaatctatgaaaagcctgatagctttccagatagatggcagagatgaaaatttaaagagattctgcaagaacaaatccatttttaaatttgcatgtaagattcaattggctattaatatcttaaagttctttaaatttagaagcaactcttttattcatattttttactctagcaatcatgataaaatcagacaagattcatctcaataaatattatgttccctacagtcatatgaactttcattttagaagtatataagtcatattttttggcacggcaggaaaattaaagcttgttctgtaaaactcatctgatatctaaagtattattttgtattccatttgcctggcttgttaccttttcagttgtgtgaagtattttgagaacttcttatatgcacaatttaatattgacccattagtcatcgaccattgaacactttaatctgatatgtacatgactcagtgtgaataactaaccctcaagtatgtctggcataaaatgatcttctacaaattttttcattggaaccataaagattgagggcattttgtagcaaggacaagaaagggaaaacattacatttttttgagaaagtacatgttataaacctgaccaaatttagctaaacaaactattttaaaacaaatagaaataataaaaatggacaaccccctttgggtcccctcctattgtatgggagctctgttttcactctattaaatcttgcaactgcacactcttctggtccgtgtttgttatggctcgagctgagctttggctgacagtccaccactgctgtttgccgccatcgcagacccgtaactgacttccacccctccggatccggcagggtgtccgctgtgctcctgatccagtaaggtgcccattgccactcctgatcgggctaaaggtttgccattgttcctgcaaggctaagtgcccgggtccttcctaattgagctgaacactactagctcggttccacggttctcttccaagacccacagcttctaatggagctatgacgctcaccgtatggcccaaggttccattccttggaatccatgaggccaagaaccccaggtcagagaacaaaaggcttgccgcaatcttgggagtggcctgccaccgccttgagatctctaagaacaaagacccaccggtaacatctggtggcccatatggggcttctccaaagcgatgggaaacattccccccaaggcaaaaatgcccctaagatgtattctggagaattgggaccaatttgaccctcagacgctaagaaagaagcggcttatattcttctgcataacacctggccacaatatactcttcgagaggggagaaacctggccccctgagggaagtataaattataacaccatcttacagctagacctcttttgtagaaagaagggcaaatggagtgaagtgccatatgtgcaaactttcttttcattaagagacaactcacaattatgtaaaaagtataagttatgccctacaggcagccctcagagtctacctccctgccccgcgttcccctggctccttccccaactaataaggacccccttcaacacaaacagtccaaaaagagatagacaaaggggtaaacaatgaacccaagagtgccaattattccccaattatgccccgtccaggtagtgggaagaggagaattcagcccaatcagagtgcatgtacccttttccctctcagacctgaagcaaattaaaatagacctaggcaaattctcagataactctgatggctatattgatgttttacaaggactaggacaatcctttgatctgacatggagagatgtaatgttactgctagatcagacactaaccccaaattaaaggagtgccaccataactgcagcccgggagtttggcagtctctggtatctcagtcaggtcaatgataggatgacaacagaagaaaaagaacaattccccacaggccagcaggcagttcccagtgtagaccctcattgggacacagactcagaacattaagattggtgctgcagacatttgctaacttgcgtgctagaaggactaaggaaaactaggaagaagcctatgaattattcaatgatgttgattgtaacatagagaaaggaagaaaatcctactgcctttctgagagactaagggaggcattgaggaagcaaacctctctgtcacccaactgtattgaaggccaactaatcttaaaggataagtttattactcagtcagctgcagacattagaaaaaaacttcaaaagtctgccttaggcccagagcaaaacttagaaaccctgttgaacttggcaacttcagttttttataatagagatcaggaggagcaggtggaatgagacaaaactggattaaaaaaaggccaccactttagtcatggccctcaggcaagtggactttggaggctccggaaaagggaaagcctggacaaatcgaatgcccaatagggcttgcttccagtgcggtctacaaggacactttaaaaaagattgtccgaatagaaataagccaccccctcgtccatgccccttatgtcaagggaatcactggaaggcccactgcctcaggggatgaaggttctctgagtcagaagccactaaccagatgatccagcagcaggactgagggtgcccggggcaagtgccagcccatgccatcaccctcacagaaccccaggtatgcttgaccattgagggccaggaggttaactgtctcctggacactggtgcagccttctcagtcttactctcctgtcccagacaactgtcctccagatctgtcaatatccaaggggtcctaggacaggcagtcactagatagttctcccagccactaagttgtaaatggggaactttactcttttcacatgcctttctaattatgactgaaagccccattcctttattagggagtgacatcctagcaaaagcaggggccattatacactagaattagaagaagaaaaaagggtaactatatatacaaactctaagtatgcttacctagttctccatgcccacacagcaatatggagagaaagggaattcctaacttcctagggaacacctatcaaacatcaggaagccattaggagattattattggttgtacagaaacctaaagagtggcaatcttacactgccagggtcatcagaaaggaaaggaaagggaaatagagggaaaccgccaagcggatattgaagccaaaagagccacaaggcgggatcctccattagaaaagcttatagaaggactcctagtatggggtaatccactccaggaaaccaagccccagttctcagcagaagaaatagaatggggaacctcatgaggacatagtttcctcccctcaggatggctagccactgcagaaggaaaaatacttttgcctgcagctaaccaatggaaattacttaaaacccttcaccagacctttcacttaggcattgatagcacccatcagatggccaaatcattatttactggaccaggccttttcaaagctatcaagcagatagtcagggcctgtaaagagtgccaaagaaataatccctgccttatcgccaagctccttcaggagaacaaagaacaggccattacccaggagaagactggcaactagattttactcgcatgcccaaatcccaaggatttcagtatctactagcctgggtagatgctttcactggttgggcagaggccttcccttgtaggatagaaaaggcccaagaggtaataaaggcactaattcatgaaataattcccagattcagacttccccgaggcctacagagtgacaatggccccgctttcaaggctgcagtaacccagggagtatcccaggccttaggcatacaatatcacttacgctgcacctggaggccacaatcctcaggaaaagtcgagaaaatgaatgaaatgctcagacgacatctaaaaaagcgaacccaagaaacctaccttgcatggccttctctgttgcttatagccttactaagaatctgaaactctccccaaaaagcaggacttgcatacatgcaagatgctgtatggatggcccttcctaaccaatgaccttgtgcttgacagagagctgaccaacttagttgcagacatcacctccttagccaaatatcaacaagttcttaaaacattacagggaacctgttcctgagaggaaggaaaggaattgttccaccctagtgacatggtattagtcaagtcccttccctttaattccccatccctagatatatcctgggaaggaccctacccagtcattttatctaccccaaccacggttaaagtggctggagtgaagtcttggatacatcacactcaagtcaaaccctggatactgccaaaaaaacctgaaaatcccaggagacaacgctagctattcctgtgaacctctagaggatctgcacctgttcttcaagggataactgtgaggaaattaactagaatcatagatccccatggcccttgcttgtcatgtttttctttttactgttttcttaccccctttaactctcactgcaccccctccatgccactgtactaccagtacctccccttaccaacagcttctatggagaatatggcttcccagaaatattgatgccccatcgtataggagattttctaaaagaaaccccactttcacctccatacccatatgcccctgcacttcaggcaatacatttcaatccctgtatctttaacctccttgttaagtttgtctcttcccaaattgaagctgtaaaactacaaatcgttcttcaaatggagccccagatgcagtccatgactaagatctactgcagacccctgaaccggcctgctagcccatgctccaatgttgatgacatagaaggcacccctcctgaggaaatctcaactgcatgacccctactacaccccaattcagcaggaagcagttaagagcggtcatctgccaacatcctcaacagcacctgggttttcctgttgagaggggggactgagagacaggactagctggatttcctaggcctactaagaattcctaagcctagctgagaaaggtgactgcacctacctttaaacacagggtctgtaactcagctcacacccaaccaatcaggtagtaaagagggttcactaaaatacaaattaggctaaagcaggaggtaaagaaatagtcaaatcatatatcgcctgagagcacagcgggagggacaatgatcgggatataaacccagacattcaagcagggagtggcaaccccctttgtgtcccctcccattgcatgggagctctgttttcactctattaaatcttgcaactgcaaaaataataaataaataaataaaaacattcccactttatattttctgggaaaatatactttaaattttatggtgttgctgaattctatagaagttccaaagtatgctctaaagactattatatatatgtatatgtagcaattaatacattaatattaaaaaaacagaaaatgatcatatgaagttttaacaccaaataatttggagaaatttgttagatggaattagatacgtttaatataatcgttttggttatgtaggttttttttctcattgttaatattgcattcattaagtattttaaattttaagatatttttattcattaactactgatgcattaaaaactactccaaaactttgaatctatggaattttgaacagttctgcttatctggaccaagtaccattgatctctggacttgtccatgcttctcttgtcagctggcagatcagccagagaccgaacaatctaatatcctcagctggggcaatgtgatggtcttctgttttctagcaggctagcctgggattgttccccgagcagaagcaggattccaaaagagaaaataaaggcatattaagccctctggaattatacttcaaaatcgcaatacatcacttccgctgtattctgttgagcaaagtaagtcacaagtgcagcacagatggaagggaaagagaaaaagattttacctcttgatggaagttacattacaaaggacatttatacagaacagaatggtgtatgggaaccaatattgtaatcaaactaccatagaatttgaccagggaactctgtttatcacatagtgtcttccaagattgaatttgtagctcacatcttagaaatattgatatacatgaattttattcattcagcttatccaacaaatattagctgtgcactacctgagtccagttaacaacgaagtttttgttatacaagatgaattgagaacatgttctttcttctcaaaataagtgggtctttccaatgataatacaaaccaaatggtaaaaacacaattcaatgcagctttctatgctttcccaacgtaggtgtagtagattgttccattggcgttctcccatcaatcacacttggtagtatttacactcctgtgtataccccttgcccagtgactctgaggttggccatgtggtttgcatgaccaaggggacattagtaatgtgatgcaagcagaggcttgataagtacttgcacatggtctttgtcttcttgaaatgctgccttttgaatctataaaaccactctctatgagaaaactcaagctagccacaggtgtaactcgatgggtaggaaacaaaagatcaaaacaatatccagatccaagatcccaagtgtatggtgctaggtgacctattttaatcagcccgagccattccagtcctagcagtttaggctgtagatattgtacagcaggtaccagctatctctactgttcccagtctaaaattctgacccacaaaattgtgaacaaataaatatttcttgttttaagatactatatttggggtggtttgttatgtaccaacaaataactgtaagacaaattgatactagaagtggagtgttgctattataaaaacctaaaacatgtgattttggccttgggcctggaaagtgggcaacaggcttgcatatgtagagcatttcttatgaaaaacaaagccatactcagggggaagaaaacaaaaacaaaaagaaaacccagagagaatcatcccatgatacagaactggcccttgataaaggaccatttcctgctccctggggctgtatggatttcagaattgttacaggtcagtggttgttatgtgccatatgttccccactttttaactagcttgtatactgtaattttactattactgttacatcattaaatattgggtgtttggaggtagaactgcatctaaggatcctcatttgcacctaaacctgatttagatgacaaaatgctgagcctgacaccataaagcaatatgatattgggggtttggggagaaatattacgtatttcatatatgagagatctgttaattttttttcttttcttttttttttttttttttttttttggagatggactctcgctctgtcgcccaggctgtagtgcagtggcgcaatctcagctcactgcaacctccacctcccaggttcactccattctcctgcctcagcctccccagtagctaggactacaggcacctgcaccaagcccggctaatttttttgtatttttagtagggacagggcttcactgtgttaaccagaatggtctcaatctcctgacctcgtgatccgcccgccttggcctcccaaagtgctgggattacgggtgtgagccaccacgcccggccctgttaattttgttttatattaaaggatggactgtagaaaacatttacattggttgctaacacaaacccttgcctcccagtattcgccttctatacagtctcctctcactgtttctggaattggctatgtgacttattttggccaatgggatattggaaaatctgatgcaagcagacacttgctaggcacacacattgggtttagtcctcatatattgcaccctcttgaagctctgagaccacctttctatgaaaaagtacaaggtagctatgtggagaggtcacatggaggtgaacttaagaaaccagtcagtcactaaaatcaaatcctcagatataaaacttcaataaagctatggaagcctgcttcttcctttttaagctacagcacttccactgttccctgcccaaatttctgactacagaatcaggaaccaagtaaactggttgttattttaaaccactacatttttggattgtttgttatagagcaacagataattgaaacaagtgggtatgctgcaggtggtgtaagagcaaatattgttgttgcaacatatacatcagcaagtatcagcagttacctcagcagcctcacataatgaagagtgtcctataacttcaagctgccccacagaaagagagaaagccacagtttcttcttttgatatggtttggctgtgtcaccacccaaatctcatctttaattgtagctcctgtaatctccacatgtcatgggagggacctggtgggaagtaattaaatcatgggggcaggtttttcccatgctgttctcatgatagtgaataagtctcatcagatctgatggttttataaagggcagttcccctgcccatactctctacctgccaccatgtaagacacgcctttgctcctcctttgccttctgccatgattgtgaagcttccccagccatgtggaactgagtccattaaacctctttgtctttgtaaattaccaagacaattcttaagcttttcttcacagcactatgaaaatggactcacacatcctttcactgggataattgagtaactgagacatagcttcatgactctgaggtattggatgcacacacaaacacacacacacacataattgactaactgcttccatgttatattataaattaatttcaaattcttacatgttaaatataggcttcatatataaatctagacaatcatattacaagcaagttatgtaagcctgcttttagcttttaacttcagctaggtctacaagcttaaagtaatgtaataaaaaatctggcaaataaaagggaaacaatcttgttccaaagaaacagatgtaaggaggggctaagcaagaaaggaaatgttcctaccactaagagtattcactacatgtaaaacactgtgctttatatttggataatctaaattgtattcaaccctatctccatatgagaacattttaatatgaaatcaaataaactgggattatggaaactcctattgatttttaaatagtgttctataattttacagttttctatgttttgagaaaatatctgacaatgttaatatttttctgtttataaattacttataagcatctatacattttaaatgatacatctacaatagaaaggagaaaaatgctaagcatgtttcactgaatatgaattagaaatttctgtatataaaaatcttaataatttattcctatattttgtcatattttcatgatctatattgatagaagttttatgtttttgtttgtttgaaatgcttgtatgacctaatgatcaagaacaaggaccttagagctcaaagtgcttaaattcaaatccaggctctgttacttcataactgtatgaccttatgcttctggtttcaccatgttgaaatggagacataaataataacttcttcagagcactggtatgataagtaaataaagtaacatatataaggcaatcagatcagtaccagaaacaatgtaatatgcactaaattagtataagctgttgttatttttagcagtttggctcctaaatttctcttcaatttaggtagattgtccattcagtcttttgtactccttttggaattgctgataaatttttaaaaagaaaaagaaaattaacacttactgactgccaggcaattctctaaaagttgtgcttatagaagtaatgtagtgattcatttaattgttacaacaacctcaatgaggcagaaactatcatcctcactttggagatgcaaaaacagagcttcgaatgggttaagtaatctgcccaagatatacccctagtaaatgacacagttgggattcaaggcaaattttggagccccagagcttgcaatcttaattatattttgtaacctctaaactgcttgggattatataacttgtattttattctgtcaaaattgtatcctattaagattattgctgccaatagcttatctgttcaacatcttagtctctgcagaagagacaaagcaatcaatggagcataagagaatcaaggaaaagttcaggatgataagagagttagaagaaaggaacattgggatatacaaatcattgcagtgagcacctatgccattttaggtagtgtgggcacaggaatggaaaagattgactctgagaagtcctctgcccatgtggagttagcagtcattccagaaaagtcagtcacacaataaaattcaagaatcagtacaagttaagtgagtactaagtattaagtaggcaaactagggtagtgacatgcaagggtcaggagcatgctatttttgagactgtgccagaaaaggcttctgagtccacatcatttgccttaagaccagagtggctaaaattgcatgttacaggcagaggaaacaacgaaaactgtggcttgaagtgagaggaatgatggtctgtttaaggcacagtgacagcactatgaacagagcacagtgataaagagagagagagtaaggagatgaggttctaggagaagatgaagatcagatcacagagggacttgtgcaccagggtaaggaattttgagttattctgattgaaacagaaagccagtgaataactttaagtgtgaaattgattcaatttgatttatgtgaatattttgtgtcattcatttatagtggtcaccatgcctgccctgctgcggcagaaatgtatgccaatatatggaattatgtttgttagatttggaaaagaagccttcattaaaatatccttgtctccacctacataatgtctaacatatctgcaaagtgttggaatttcaactaccattcaaacttaatagcaaaaaaacttgaacaactgtctttctttatatatatatattttttcatttaaaaatgcccatcaaacatgacttaaacttaatgacctcaaaatgtaataagaagtgtagtaaatgtgtaagttacaactggggcatttttattagcaaagtataaatattctatgtcattacagagtattttttgttttgttttaaaaaatctgcttttaaagcctgaattaataactgattgaagtgattacaataaagataaaactcatagactcctgaggattttattaaatctctacagccttctatttatattttaatttttttctcactgctcagcatgcaagtgggaattactggaacacaacatgaaggactgtcctctgggcatctacagtccctgcaaagcggctagaaaactttaatgtttcaaaagcaaactccagtttgctttggattaattttcttgtaaagatcttgcctgagagggtagttagaggtatgaaacaatgtttcattttaatgccaaagagactttaagtgacttgcccaaggtcatcaattgtcactaaaataatagagaaaaaaattccacctctttgtatgtgttgctctttcattcactagatcagtgatttatagtctctgcctaaagctgtgaaaagcataaccaaacctcctgataggcaactgaaatattcacttttcaggtgatttttcccactcggattttggcaagctatccagtgtggtgcactagaaagaacacaggagccggaataataagccggaataattaatccaaagaggagggttatagtctcagctatcacttatatcacatggctgccccccatatttgcagttgaatgtagccaattgtctgacttttagtcaggggaagagtagtgaaagtgaaatgtgcgactttcagcactagactgtgaaacctctcctgggcctctttcatggtctttccttatgcacttggttgatagagacgaacaatggaactttcaaaggtatgtgtatatgatggaaacattcaaaaagtaaccaagatagacataaagctcccctcaatttgacaaacttgagacagatttagataggtttcttcctgactgaagcttccaacctctttccttagggtgttcaaaaaatttgcgattactaattctttctctgcccctttgagatgcaaattttctacaacgcaggaatgtctttctcaaaaacctgagagccatccctttgaaatgcaatcatggagaaagatagagcccctacatctatgggaatgtaggagtctaacttcagtaagcccaaatagcaaatgcaaatggtctaatcacattgaccacactgactaatgccctccagcactccttcactccctcatcagagtgcttactcttctctcctttcatttcaatggcattgaatttattctccttctctgacagcaataatcttgacatgtattgctatagtcttgaataaagtctttcttgtctgtttgataggtccagtgcaatctttgacagaagtagcacagagtcactatatcacctcatggattttttttttttttttttttttacattcactatacagtaacactgttttggacttgtcataaatttaaaaaaaaaaacaattctattgtttcagttattaaggcatttggggttgatcaatagaacaattaactttaccttaatataatccctaaaacaaatactcactccttctttctttctttttttttttttttttttggcaaagtctcgcactgttacccaggctggagtgcagtggcaccaccttggctcactgcaacctctgtctcctgggttcaagcgattctcctgcctcagcctcctgagtagctgggattacaggcatgcaccaccacgcctggctaatttttgtatttttagtagagacggggtttcaccatgttattcaggctggtttcgaactcctgactttgtgatctgtccacctcggcctcccaaagtgctggaattacaggcatgagccaccacacccgggcccttctttcttattcatcattgtttccctataatcttgagaacacagaagaaggtgagaaaaaaaaaaaaatctaattgggaggagtcaggaaagttttccaaaaggtaacattgatataaaaacttactgagaagaaatttttcaagagctgatgtctttaaagagtgataagcacatacaaaccgaataccatagaagtaaccaggagatgtcacaaactagcttcaagctataattaggtcacataaaatcaaagagtttggattgatgctaaatcagtatatatgggctaaatagcaatatctgaatctctttgttactgttgatgaattttaaacttagccagggtgtaggtttttactggaccaagaatgatagaaaaaaaactaagattcagagcacacagaaatcagagaactgaggaaatccaggaagctggtggggaacttaattcaaaaagctgaagaaatagctagacagaagcatatatcaaagtcaagaatatggaactagcaatatactgatcacagatattagctagaagagtgtagatggttattgcagtagtacaggagaaaaaaataaggacctaaatgtgtggcattatggtggagggaaagaatcagataaaagaaatgcaatccacagaactctgtaattgatagactttgagagactttacagaggaaaatccactgggcctcaggttaatggcttctggcataggcaaatgatagataatgtagtcattcactgaaattgcatgaatggattttattgacagttttagttaaaaataacaagatcatttaggataaggcaaattttgaaatctttatgaaatatccaggttgaagtacaagtttttgaataattaagaacatgaagcatgcattctgatgagagttgaagtgtttggcaggttattgaatttgaaataggggtgacagagcccacagtgggttataaatggagtcatgagttgccaatgagtcagtgacagagtaaaagcaaaaaactctgactcagaacatgggaaaagactgatggctggaagagcttgtgagagtccacatcaatttgcttcagataaaaatgagtcaagaactccatggacaggggtgcaatgacaccaacttgcagcttaatagaatatggaagggagacttcagataatactctgtttactgccaaaatctatcctcaattaagttaaactttgatttagcttaagttaaaaaacaaacaaatataatataatatgcaagtaggggttatcagattatctatttgattcttggaattaacagcaggcaaaggacagatttgagtggctggtactttttattcacatggaatggaaagtaaggatttagacttaaagatagttggcaacagagcgtcagctatctgagtcacaaaaagatcacctgcaatcaatacaaaatttattttccatacttgaaggtgtagtaggagttggcatatggtatactgagtgaggtgctcatgaaacagtgcgtgctttgtctcagttaaacttgttaagcaatagtggcacttcatttagatttttctcacaaaataaactgatttattattgccaaaattaaaaaaaaattgtttccctaagtagtcaaaaatttaaaattgtctcaaggagattatcaatcagctgtatataaaattttgcctgtcttcttttactaggcctattatagacttctaataataaatatgtttgtgctatctgttactgacagaaaaattattccaaagtcttgaacagaaaaattaggtattgtcttacatgactgaaaaattcagaagttatttgatcagcagttgaaataatgttctaggatttagtttcctattctctatcactcaactctactatccctaatatcagtgctattctccagtaagctttcccctcttgatttaaaaacagcttaagcagctcaaaactatacgtgctccaagtttcatgttttttaagaaagtgtgagattatcctatccaagaccaccccctccaccatgaggtttcattcatctcattggccctgaatgtgtcatatgttcatctatgaatccatcactgcagccagagtaatgtgctctgctgattagccagatctaggtaatatatacttttgtgtcttcacagtaaaatcagctttatccaaaccacatggaatgaaactgaaagatattgcagttttcaagaacaaaatgtaccctataaatatatacacctactaagtacccacaataatttaaaaaaataaataaagaatagataagtcctgggtgcaaaatatatatatatattttttttttttgagacaaagtcccacactgttgccgggcaggagtgtagtgacgccatctcggctcactgcaacttccacctcccaggttcaaattgactctcatgcctcaacctcccaagtagctgagattacaaggtcacaccatcacactggctaatttttgtatttttagtagataaggggtttcaccatgttgtccaggctcgtctctaactcctgacctcaatagagatccacccgcctcagccttccaaagtgctgggattacaggcatgagccacagcgcctggccctgggtgcagaaatttttctatctcacatgcaacatgaaaagacaggcccactagacatcaaaagaacactttgggtttagaccacaaaagatatctctggtaatcagtaatcagggcattgcaagttattatctcatttggggggcagcatctagatctcctgattttgagtgaaactagaggtaaaataataccccaataatttctcaatggatgaaatatcatccaccataggagatggggaactctgagacaaaacaaattggaattaatggcatatacagagtaatgtttattttacacttggacttgtggagtaaaattagtatctcttcataagtgtctcagacttgcttaggaagtgctgacttgagcttgcaagattaaatgctattcctggaagcatggagagtcatcagagaaataccaatatttgaagacaatgtaaaacttgggataatgttcaaaatgacatattcaaaaattaataaatatacaaagctatagccattcaataatgtaaccatttactggaaactatctttaaaactgtagctgtgactccacaggatcatcatatgaatttaggaaaagtgaataaggaggaatggagggagtattttgcttaatcttaaagcctctttaaaataaaaaaatcaaagacaacaaaatccttgaccatatataataggtcatttttataccaatctcatttaactttctttaatggaagtattaaaaatatacatctgtactttagggagactcttttgttattggcagtagggttgtgtttaatgtaagagataattataaactataaatataattccaactgtaaatatgtgtggaataattgaagtcctagaatcttatatttttgtccacacactccagctgaataaataatgaagcaacatgacctccagtgatgacagataggctcagcttttgacaatatgattcctacatttgctcaaagctaaaacttctttaaacttgatggagaataaaatgagaattctgttgcacaatatgaaataaaactcatataaattaatcatcaaaatcatgaacctagagcattaatttgcaatgacttgagctacatataattatacaaacatgtattctaagtaggaaaagcagaagcaattttataacatagtagtccattttcccaggatggtacagggttgatggttaattagtttgctctcttagttcacaaaaatatttgaaaatgaatttatttattttagtaacttggttactttagtactttccccaggagatatcttccatgccaaaagctaatatcttcaaaagtctaagaaattgtcttaatttgattacctgtatgttcatggctttgaaataaattgctctctaaaaaatttattgtattaattattaagttacatagttttcttttttcctcctagcacttaattcatttatttaaatgtgtttaattatccataacatttttagccaataagtaataaaaagtcaaaagaaactaaaagttgagattttacatatagctttcattacccctcaatacactgagatagactaactgctgaacatttatgtatttatttatttcatggcaagacaccaaattttcctttttctttaagttgttatagttagctggaaagcttttcattttagtcttaaattgaatcaacagggggcaagtatgcctgcagttcagaatatatcatagaatgattttccactataactttcctgtgggaacactccgctaccagacaagtattttagctgctttccatcagatcatctgtattcagttatagaatgcataactactttgattcctgttttattttttattagattgtgttgtagaaatgaatattctgggtacatttaaaaaacaaatatagataaatcaagtagttagagaagagaaagggattcttttttatctcatttgaacaaacacataagtgcaataaaaattgtgaagtgttattatttaaattatgtaagccaaattaaccaatcagctttcttaattctcttctatctcttagctttacgtatgcaggggaagttgtatccaacagtgaatgagaatatagattcttttgtcatattacctgagtcctaatgtttatttgctacctatgtaactatggtagtcagaaattatgtggcacaagtgacaaaacccaactcatattatcttgtaggaaaagagagagaatctattgacttctataactgtattataaaaagataaattcagacatcactgtatccagggtcacaaacaagccaccagcgttctcttgctccatccgccagcttttcttcctcctatattgcagacaatttgattacgcatggtactaaatatggtcactggctgtttcaggaccataccattcttacaactcaggcaaaaatatttcttgagaatgactcttattggcttgaattttgttatacattcttccctcaacatgtagttagagaaagggaaatgctgattcactacagtcagatgaaggcaaataatatgtgacataaccccaaataccagattgacaaccctaggaggttgaggggacaattctcaaaaggaacagattatggacagataaaaagacatagatgcccttatgataatattgagaaagttacttacttactttaacagctgactctctcttctgtatatataaagggaataacactataacttctataatgctaaagagaataaaattataggcagctaagagacttcttaaaaagattccgagaaataaaaggaaaataaccctaatggtgatttaatagaaggaatgaaatcacaagcaaagaaagtactggaatggcatttaggaaaaaaaaaaaatagggccaggtgtggtggctcacacctgtaatcccagcactttgggaggctgaggtgagtggatcatgaggtcagtagttcaagaccagcctgaccaacatggtgaaaccccgtctctactaaaaatacaaaaattagtcgagtgtggtggcacacacctgtaatccaagctactcaggaggatgaggcaggagaatcgcttgaaaccaagaggtggaggttgcagtgagacaagatcatgccactgcactccagcctgggcaacaaagcgagacttcaacacacacacacacatacaaatatatatatatatatatatatatatatacacacacacacacacatacacacacacacgtatatatatatacgtatatgtgtgtgtgtgtgtgtgtatatatatatgtgtgtgtgtgtgtgtgtgaatctgtcatcttgaaataaccctgagcttgaaatcttcatagaattagaagaagaaataaaacattaaagaggtgaattgacaacatgtctaaaaagcaagtggcatcttcacgtcttatttattttccatctattctttgattttgctccctgggtgcaagtagccaagtgtttactctcagtcaaaaagaaaagagcattctttaaagaaatggaacaaactacttgggaagcaaattagagcaggattttcacacctcagtatagagcttccccaatctggtatttatttgggtctatgatacattaaaggctagctctgcactgcataacttagagcgaatcctgcaagaagatcagcacttaatattcattgtcctcacaggcagcctcaattttttttttttttttttttgagatggagttttgctcttgttgcctaggctggagtgcaatggtgagaccttggctcactgcaacctccgcctcccaggttcacacgatcctcagcctcccgagtagctgggattacaggcatgggccaccacacctggctaattttgtatttttagtagagatagtgtgatctcaggtgatctgcctgcctcagcctcactagcctcaatcttgaagaggaatgaactctatagaaaatagaatgacacgtacacatctataaaataaactcatgccaaccaccaaaaattaccaactcaagttcttctaaaacatgatgaaagtattaaagtttactagacatatgaaaacaatcaaaagcaagagagaaccaaaataatattacaattcactctatacataatagacaactcaggcaacagaaataactttttaaaatcaagtatcctcaatgatattcaagccagattactttgcccctatagaacagaaacaggatgttattttaaagcaacaattcaggaataagaaattccaaaaggagacagattttgcttttaatatttgatgtaaaggagtttatattttcgtgataccagtactttgtcagacgtatgatgagcaaatatttcaaacacattttccacatctgagatgtaaatatttgtttcctttatgacatcctttaatgaacagagttttatttgatgaggtctaacttatttttacttttatggcaaagttgtatatcctaacaaactttagcctacttacaagttgaaaagatattctgtcttctaaaccctcaatggtggttaactttttcatttaagtatataatccaaattattaatctcaaattaattttgtatataaggagaaaagaattgactttttctccataaatttagttgttttaccaccatttgttgaaaaaaagtctccttcccatgtttttcctgattcatcaaaatataattattttcatatttttgtattgcacattataaatgatatgatgtagaaattctgactcttatattctcacaaatactttattttgaaaccagtggtttaacttggctaaactctagtcaagagttcttgtttccctttcagtgaacaatagcttaaacctcagatcaggtcatttagcctcttctggactgcttggagacttcccccaagcacacatattgtggagtcaaacaaagatgtgagaagagtatatgtagaacttgggattccccttttttactttcttcctctcaggatttcacccctagctttccagtaactttggtcctttcctgagctctgccttgttctcaagcaaacaagactgagggtttttcattgaagttttaactgacccacaatgtatagtctcagacctgcctccaggcatgtattacactgtaagtgacaaattgtagctataagatcaccagtactcttaggtccactcaaacatcttgcagtgctgacactatgtgtcagttagcaatctagcccaggggtttttcagccctggcccaaggacttccaggaaacaagatcgtctcagcacagatgaaattctcatatacctaaaccataaaacaaagcttatccttaaaagtacagcttaaactccctttaagaaagaaacaccttgtaactgacacagactgaacaccagtataagaaaggaggaagtatcccccaaactctgagaatggtctccagatgtagaccttcttgggcagatagtcctctgacccctaactgcatctctctatctggcccatgtcacaagactgctttcactatctgtggtggcatatgccacaataaactgcttgagtatcagagggtatctaagtctctttttgttgtttgcttgtttttggacatggtctcactctgtagcctagtggcgctactctagctcaccgcatacttcaacttctgactcaagcaatcctcccgtctcagcctcttgattagctaggactacaggcacatgccaccacacccagctattttatctgtgatggaatccaaactggaagtgaaaagtaactcctggggaagctgattaactatgaccatccaagagtcctgagtacgacaaggtaaaagctgtaaaaatgggaaaatctcccagtgtaattcttttctttttttctaagtgtcacctccttttcagtatctgcctacttttggacagtctccagtcttctggtagtggtttgtatcttttccagagtttgtggttattcttggtggtatgactggtcctgattcaacaggagatgcacagctgtacctaattacattagataaatacactaattgttttacatccacttatatgtatattcatttcttctacaaatagaatacattatgatatagtgtgatttttcaataagattgattattttattccatttttgtcaaaaccaatagaaaatactaggtttaacagaatatgaactgagagtggaaagataagccataaagggaaaaagcgaaaataagtttctgttttgtttgataagtttatgccaaacatgtaaataatccaagaacaagactatttctttttcttttactttttagaaccgaaggtattttatatatccaatagatagcttttatgttactctaaaaatgtctttgctattcaagagaaaacaacttttttaaggccaatactttaaaagaagatataaaatttatcaaaaaattctgatgaaaataatttttattactcttataattctaaatacaaaatgatattttcaagccttctgtatacaagtgcattattttctatatatagaaagtatattatatacataatagatatcaaaataatgaaatattattacaaagaaatcaataaataacacagaagccaaccaatctgtgattatttattttatatatctacttccaaaacacctcaatgaaagttaatatatcaatcacttctataaaaattttgccaaaaattatcctaatgttgctaaataactgtctgaatgtttctaacatacataaaattgttttgaattagtttttgcagtaattccaccaagcagtcgatatttatggagtacctgtctgtgcaggcactgtctaaaaaacaattattccaaatgaagaaagctgaagaatgataaatacagaaaaacaaagaaagagaacacaaccatataagagaaacacaaatcatattttcttaaaaaagaggattaagattggcatttggaaagaactagaaaataagaagttatgagatttaaaagtgtaaaaggtgaaaataataaaatgtaaataaatgaaatccaaatcagaaccagctttgcaaaaataaaatgaaatgccatttaaaggttggaaagaacatacacagaacatgtttataacaaactaaaggcccaatcacaggacaccttaatgtgaagtccagttgacgtagcacgtagtaaacataattgtagttaaaattggaaaaaataattaagattaaatcggttagaatatgagtttgaaaaatatccatcaaataaagtaaataaaaggtaagtggtctataacaagttgaaataaacagtgcttgaaatataccaccttcgaaaggtccaatttgagatttgattatgctttccttctagagatgaaagaataacaattgacatttgttgctttctatcttaattttaacatatttattttctcagtctcatgtataaagcttgtggttcagatctatttggaatggagttatggtacactatattttttcaggctgtgaccttaaagaagtcttcatttccaattctaagggaattgaatggatttttttctctcttgaacttataaaaatgagtaaatcttctagtcaaacaataaaaacaagaaaacaaaaagtgttccattttgaaaaacgtttagtgatatttggttcccacacacacatacataaaaatctcagcacttatatgtactcttaaaatttccaagttatactgtctacttttgatttatgaacctgctttagattccattacctaaagtacacaaactatgtaataaatgatttaactatattcttcaacataattcttagataagaaaaatgttgcaaagaaagatgctagggtaaaatctatttttagtacatctcatttactgaaagtccatatccattctgcactgatgaataatgcgaataaaactttggcaaaattatcatatttcaaatattatgatatgcactcttttatagtttaacatcttttcgattggatatatcttagaattgataacatcttacagtcactttctgccagagggcagttgtgacaggaagtatgctatgttattctttatgctttgacttatttgtaattccttgtagcatgacaggataatcacaagttctcaaactttcagtcattacattatctaagaatcatttaagaaaagaatatcggttccagtagttacctgaaaatgttcaattgacatcttctggtaaaatcaacaaagtgctagcaggaaaaattagagtgtttatcagtgccttgtgtgaaaatcctggaaataatggtgaagctctcttaaggaaaagagaatcaacaaccctcttgaggacacagaagatgatattgtaaggaaaaccatggaaattgatgactaatgcaaaagtgattaaaaatattcagactctaagtgggaaaacattttagtgataccttaaccaatgtatttcacttatatttttctttatatgaacacaaaagatgtgtgtgtatatgtgtgtgtgtgtgtggtaaaaactttcaaagacaaaaataaaacttacatttattctaaatgtttctcttcttctgttagaatatccgaaataaattatcattattattgaaaattagaaatcgattttgcttttaaattagtaactagagtaacagtcattgtttcatatgcagtatacatatactaccttatgatgttagaaaagggggagttctggggccagacttttgagttcaaatcccttctttgaatgtttagttacttaacatttttatgcttcagttttattatttgtaatataggtataatatgttatatcatagatttattataaagtttgcatgtgtaaagtgcttacaatagtgcctcctatatcattactgttagagttatatgtatttactatgcaatgaagaggaactcaaaatttaaaactatgaatattacaaaccgttaagtttttacctatcagtcttttcttatcttgttatcaacaagtgatctttgaaaccaagagtgagggatgataaatgtggaagaatatcaatcaaaagagcattatttttttcaaaattccgccttgaatccacataaagcctactgattcagttttcaggatgggagtgaggtagagaatagaggtaatatgtgtgggtcacctttttttgtttgtttgtttgtttgttttttgttttgttttttgagacggagtctggctctgtcaccaggctggagtacagtagcgtgatctcagctcgctgcaacctccacctcctgggttcaagcaattctcctgcctcagcctcccgagtagctgggactacaggtgcgcaccaccgtggcctgctaatttttgtatttttagtagagacggggtttcaccatgttggccaggatgctctcgatctcttgacctcgtgatctgcccaccttggcctcccaaagttctgggattatagacatgagccactgcacccggcctgagtcacctttttatcccaactattgagagtcattttttttatatatgatctagattccagaatgactcacaaaaatgagactacccgatgtttcaacattgcagccttcttttctgtttcttaacagccaattcagaagaccaaaatgtgacaaatttttagttatttatttttagtttatgctcctctagagagtcaaggaaaagggaaaattaatagctcatgcttttctttgtttcctttgcctcatggaaatctcccttttctcctgaactgtaatgttacagaatgctatgactcttcctctttgataataacagcgaacaaattttccttacaagatcaaagaaatggcaaagcaaggcatttgagttgcttttagattttaaaaaaatttaaaaaattagctaatttttaatgattttcagtgtgatgttttgtgcttgctctaagaaagggtaaacaaaacttctttaacaacaaaaagttgaaaactcaaaccaaaatcatgatttaaagtaagtaatgtgtttacctttctgtccctggcttatttcacttaacataacgtcctccagttctatccatgttgccatgaacgaaaggattttgtttgttttttactgctgaatagtattctgtttgtgtatacacctcatgttctcactcatgtgtggaggctttaaaaaatttcatctcatagaagtaaaaagtagaacagaggatactagaggctaagaagggttgaggaagaaggaataggaagatatttgttgaaaatgaaaggtacaaaattacagcctgataggaggaataaattccaatgttctagatcactctaagatgactgtaattaacaataatatatgaaataatttcagatagctaggcagaggatattgactgttcccaacataaagaaattataaattttgagatgacggatatcctaattacactgatctgatacctctacattatatgaatcacaaagtcacgatgtaccccataaatatgttcaattattatgtgtcaatgtaaaatttaagtaaaaagagtaggtacatatgatctcctcttaaaatgttactaataatagtcaaataccactttctgttttaaaaataactgatgacaaacttggatcatcaaattttgccccaatgaatatgccttcttatagaaaacttgtgtaactaactataaccatgtaactaactgtaactgtacattgaattttatagcagactagcttttctatgaatctaaaagtcttgctacatataatctttaaccttaaccagggatccagaaattccatttaatgtccaatctatgcatggataaacatcaataataaaattccttgaaatttaggtacaatttattatttttccagtctatagaaaacacactgtaacctggaactcactctaactaagattgcattaggctcctctctacatatatatatatgattatttctgaaatgttagctttgtttggctctttgttaatttggaggctgctcttcagttccctctatttgtgtggatctttccacacaagtgaaggattcatggatccttcatttatttattcaacataattatttctgagcctattatgaacctgacaaagcaaaaaagtgctgttcctgtcttctgagtcactggaggaaaagtctacactcttgaaaaaagaatggaagggaactctcaagctaggtttaattgaagatggagttttattaggaattgagaatttcagattaagatctgagatgaagagaggatactgagaaggaaaccccagcatttcaagggaatgttttcccctggtttctaggtgactttagaagcaacagtcatgggaatcttaacagagtagagagaagtaatttctttgaaatacaccaaaaaggtactcagaaagaatcttcgtgttaataaaggacattgagtaaaatccatatattttatttatccagtcatttaacaaacagttttgagtgtctgtgatgtagaactatgataaaccttaggaaacagatccagtatctgccctcttggaatttgtactttagaagagccaaagttcatttataaatatgcttattgtgatatattctgtgatagagaaaataaagcaaaaatatttattcattatctatcatgtgtgttcagatgtaatggtaaataaagcagattggctccctataggtgaggaaatcataccagtcaaatacatacacagatatgcaaactggcacatgtaacaaagtgaaagtatggtgtatcacatgagagtacataaggggtgactgagaagattggggactcaaggaagacgttccttgagtaatgatgactgagcttataaccaaaggactgtcaagagttaactaataaagcgagatggaggatacgagtggaaggatcaggcctaggccaagggaccacctttagcaatgaagataaattccaatggcctgattaatacctttcatagcccgagttctaatctaccatggtggacccaaaagttacagtcattctcctacactttgcaaaatgagatactgaaaaagtctagagaaaacaaatagtgatttttctgggaagaaaccttccttagcaggattctataggaaattatttttcccctttcaaaacgatcaaagtgaggcaacaggccttcagtgggttgacatagaaaatgcaagtaagacagattatggaagtcttggaaaccaaaatggacattccattgtgtggaaggacagctctgcctaagccagaaggttaacatgtgaacactaagacttgtggacctggtgacaaaaacaaaaggaaaagcatgaagccagagacattttaggagaccagatggccaaataaataaataaaatacccctttaacagcagacccagaatacagtgtgaggcaactgcattcaagcaaaaccaatgcaatgttaaaaaggagaagaccaagaaagcacatagcagtggcattaacaaaagaagcaatgatgaagagcatttagtggtgcagtttagcaagcccttgcactgtgatgatatgatgctatatctgaaaatcactgaaggcaacctaagagctccagcattaactgagatggattaatgtatttattcatcagtttaacaaatattggttgaactcccactctgttctaagcactgtgctcgacattagggatacagcagttaacaactacaagaaaatcctagcctttattcatttaaagaagatcaataaaaacatataaactaatctttagtacagtaaatatttttaagtactgcgggggaaaatgtcagataagaaagctagaaaattctgggagtggaaagtcaaccatagctcagtagcaatgcagcattaaatagagtcccacaagaagagaaggagcaaacaacagggattcctggaaaatattccaggcagagaagaggaaatagccaagacccttcctccagaattttcctcctgagttcagagattacacgtctgtacaacactagagagtatctttaatagtggcttagacagcattcactaagtgctaggcactgtttctagtgattaacaaaagtacactcaggtaactcatttcatccttacaacaaccctagaagtcatatactattattatcatcatccctattttacagatgagaaatggaggaaaagagaagttgaacaactaatccagaattgcacagttactatgcggcattgctgggatttgaacccagatggtctggctctgtattggtcttgagtccttctcacatcacatcacatatcatctgacctcttccatagccacacctttctttgactctgtcttttctgcctctcttttttcaatttgaaaaactcttgtgattatgttacatctatctgtataatctggaatacactctctattttacagtcagctgattagcaaacttaattctattgcaaacttctttctccttcgccagataacataacatattcacaagctctggggcagaatgttgacatttttgtggtgaggacagagggtgggcaggcattaatctgcctaccataagctctaaaaatgtactctcagccactaaattactctacccttacaaacatagccagaacacaggtggtttctgtttgggtcagccagactaagtctcatatcgtctgcatattctagggcaccaacatgattaaagctagacaaatttgggttctgaaatatgttttgagtctagtcataaactcaacaggcattgagttgaaatgtaaaggacaggcatgctacgcattcaatctgcatgggatttgagtcatatatgattaattgaaacacaattttattatttctatgttgtaaaaacatgaaaatatttttaatataaaacattttagtactcttgcttcccacttagttcagttctattgtcatttgtataacttgtttctagtagctttttctctacttttttactctgcattcattttttgtattccacatgagaagctccaaatgttattcctgtctgtgatttgtgtttttcaatgaatttaaaggcaaaaataaagagtgtttgcctacaatatagtttctcccaaggattgagacaattttgcttttcctaaacccatcctatacttagtcttatctctacagtcttcattcattattccttcatcctctctccagccttgctggtaaattctactcacctttcaaagcctggttctttttcctgtgtgctcttaatggcatttgtttcttctttgtgatgacacatattgtatattgtcataagttatttgttgtattcatttttatgtattacttactgaatttattttatgtagcaggatatacatgcaaatgattttgatagataactgtaactctttaaaatgtttttttttttggcaaattaatgctggtcacatttttcagttatataaaaatgtgtttataattttctaacatttatttactttcctgaaattaaattcatatattaaataattacctgcctatgactaattaaaaaataatctctctaatatgtctaatgccaatttgggaatttggcatttaataaataaaaataaaataatttataataaaacactgctttcttttcctgccccagcaggtctgcactacactatatgaagtggcgaaaaggttgtgcctgtatataaaattacagtggattcactgccatgtatgcttattcattctgtgtattatactgtggacgtaaatattattaattggcattactattatttattttatttcccacaacgtgaaatactcttggtaagttcccaaacagaagagtatgcaattttctcttgatatatacagtagtggcatttctacacaattcagtgtaaatcaaaatagtgcaaaaatcctttatgattacatgtaaaagagaaagaagaatagattacaaatagagtacgtttaaaaaattgtaataagaacatgcaacatgagatatgcctttttaacaaattttaagtgtacaatagagtattgctagctatagccatgatgttgtacggcaaatctctaaaacttactcatcttgtgtaactgaaactttacatctgctgaatagcttttcatttccccttccctcatccctgggccaccaccattctactttctgcttccatgagtttggctattttacatactttgtataagtggaaaaatacagtatgcgttctttgatgactagcttattttacttagcatgatatcctccaagttcatccatattgttgcatatttcaggatttccttcctttttaaggttaaataatatttcattatatatgtataccacattttctttatctattaatccactgatggacatttaggttgtttccacatcttgactattgtgaattatgcttcaatgaacatgggagtgcaaatattaattctttcctttctctttttttcattatttactctcactttgcaaagaaatagtgctagagagtgtgattttacagcatttccttttcataatgttctaagatttttctaaatccaaacatcaaattcatctttacacaatatgcagctagtaattggttagaccaactaataatgatatatgtatatctatgtatatttgaaggtgatatattttgagcataaaataggtatcttaataaacatttgtttaattaacagcatttaaaatcattataatcagtacaaccatggtcctttcttctacttttttttcacattttgataattaagattgttgaagctttcttctctaagtatcctccacaacattgcgtatgttataggtttcagtaactattttgaatgaattttaaaatgaatgtgtaaataaagtgactactaattgttaggcaagaggcttagcaaaatatctaatatgatttgcattcagcacctgccttgtcaactctgaaattattactttgattttcaccattatcttagttttagaaaataatgctattggattttgaagttgaaattgaggattatttttcttgcctatacatacttgtgtttgtagctagatcaagaggaacaaaaaatgcacagctatttttggaacttcaagtatggtctcctgtgctacaaactatgcaaataaatcaacacacctgggtgacctaggtcagaaaaaatcacataaacaacaacttcaagtctgtttagcaaatctgggtattattgcctcatgcaggctacgccactgtggacagcttctacagctacagcatggctgaagtgctgtaccctggaaaatgtaggccctgctggatcaaaagtaaacaacaatgcaacagtgaactttcgatagaccacaagtatatttaagtagaaaaacagcatcccaccaagtgattactttagccagctgtgtgaatttgccttgggctgaggcagacccttcacagtgccaatccgtcattagtagaattctgagtatgtgtcttttggagccaagaaaatggtatggagagggagggaatatccaaatacctaggtgcattttggcaagcaaatcaactggacacaattatattctaaactttccacagtgaaagaatcatagcatacgtgagaaaaaatgtctaactgacttctttacccttgatcacttgaataaaagtgcattaaatcagccatcaacacaagacaatgtttttctatacagagaaatgtaagacagaaattacttatcgtgttatagaaatgcagaaaagataaaatatctttataaccccactttaacaaaaagagtcaacaaatatttctttcttatatactctgtattaggagctgttataattgcttactagatatctctgagaaaatgccgttctccttaaagattatatattctaataataaactaaaaaaattaagattatatatgtgtatgtgtatatggaaagagagtacataaggaatatataataatataatataataatataacaaagagtgatcaggacaggaaagaagtttgaaagtgggctcttatttttactgaaactgtcaaagaagacctgtctgaaataacaattgtgtttgtatgcattattttatttatgaaacatactataggagatgagggtttctaagaaatttgccaataattgtgaatagacaaatatccctaccatcactaccttccaatgatgatggaggagtgaaaaccaaaaatatgatcagtaaacataataaataactaatataagagagtgtgatatgtgccatttaaaggtgataacagatatttgggatcctaagagctggtggaaagctgccatttaaatagggatcaggaagttttaggggagagataatatttgagcaaagattttaaggaggtaagagatctagccataggatatttggaataagcatattccaggcagaggcaacatctagtgcagaatcttgaggtagtttgcttggagatgatcagaaacagcaaagaggccagtatgtctgcagtagggttaggaaggggatagattgcagagaggcaatgggaatccaggtcatgtggaaccctactggacattgtaaggtctccaggtttgactctaaatgatgtgtctgtagctatatgtcaaactattttgcctcaaaattcagcgctgcttcactttatagaaaagaagctttgaagggaggaggggcacctgctcagaatgaaaaccccttccttttctctcttgatcttacaaaacacttctaccccaaatcttcatgcacatatgtctccaacatgcacctatacctatgtgcactctcagcagagaaaataatttgtctaagtcagtggttcaccaccctggctgggactcatcctcactgatggagcttattaaccacacatgtcagaggcccacttgagtgaacctaattcagaactaggtttagacacaggcttctcttttggtgtgaaacctccctcaggtgactctgatgggctgtcacatataggactcactgctctagatgctagctactcagtgtgcggtctgtggtccagcaatatcagcatcatctgggagcttgttagaaatgagaaactcaggcttcatcagaaaactatgaaatcagaacctatattttaacaaactcctcagttgattcatatgcatactcaagtttgagatgcatttctctagctctttttctcaactctctattactttacactcagtctttgtacatatgcccaggtatttcaaatctatttcttagatgaaagtaattgcagatcaaggaaataaaataatctccttcccaacagaaacacttcatcgaacttcttatgtaaatctgttttctttctcacccatattttatagcctggaaacaatttgtaaaacagtttatgtgaccagaaatccttcatgataattctgtgtaatttgataccataataatacaattatttgttaattctttgttgaaacttttttttaagtttctatggagaagtcttgaaattaaacttttctcctgatatagtttggctatgtccctacccaaaatctcatcttgaattgtaatccccataaactccataatccccacatgttgtgagcaggaccaggtggaggtaactggattatggagacagtttgccccatgctgttctcatgaaaatgaatgtttctcacaatatctgatggttttataagtgtctggcatttccccttcttgcactcactctgtcctgccaccctgtgaagaaggtgcctgcttcttttttgccttccaccatgattttaagtttcctgaggcctccccaacaatgtggaactgtgagtcaattaaacctctttcctttataaattacccagtctcaggtatttcttcatagtagtatacgaatggactaatacagtaaattggtaccgagatagtggggcattgctataagttacctgagaatgtggaaacaactttgggactgggtaataggtagagattgaaaccactgtaggggtcagaagacagaaagatttgggaaaatttggaacttcctagagacttgttgaatggctttgaccaaaatgctaatactgatatgggcaatgaagtccaggctgaggtggtctcaaatggagttgagtaacttgttgggaactcttgctatactttagcaaacagactggcggcatttagcacctgccctagggatctgtgtaactttgaacctgagagagatgatttggggtatctggtagaagaaattctaagcagaaaagtgttcaaaaggaagcagagcatacaaattatgaaaatttgcagcatgacgatgtgatagaaaaaaaattctggggagaaattcaagcccactgcagaaatgttaatcaccaagacaatgaggaaaacatctccagggcatgttagataccttcatggcagtgcctcccatccaggcccagaggcctaggagggaaaaatggttttgtgtgctgggcccagggcatcctgctctatgcagccttgggacatggtcccctgtgtcccagctgcttcacctccaagcatggctaaaaggggtcaaggtacagcctgggctattgcttccgaaggtgcaagtcccaagccttggcaatttccatgtagtgttgagcctgcagatatacagaagtcaggaattgaggttaggaacctccatctagatttaaggggatgtatggaaatgcctgcatgtccaggcagaagtttgctgcaggggcagagctgtcatgaagagcctctactagtgtagtgcagaagggatatatcaggttgtagcccccacacagaatacccactgggacactgcatagtggaactgtgagaagagggccactattctcccattctcagaacagtagatccaccaacagcttgcaccatgtggctggaaaagctgcagacacttggtgccagcttgtgaaagcatctaggagaggggctgtaccctgcaaagccacagggccggagttgtccaaggccatgggagcccacctcttgcatcagcatgacctggatgtgagacctagtgtcaaaggagatcattttggaactttaaggcttaatgtctgccctattggatttgggacttgcatggcgcctgtagcccatttgttttggccagtttcttctatttggaacaggtttatttacccaatgcctgtacccccattgtatcttgaaagtaactaacttgcttttgattttacagggtcaaaggcagacaggacttgccttgtctcaggtgagactttggaattagacttttgggttaatgctggaatgagttaagactctggaggactgttggaaagccatgactgtgttttaaaatgtgaggacacaagatttgggagaggccagggatggaatgatatggtttgactatgttcctacccaaaatctcatcctgaattgtaatccccataatccccacgtgtcaagggtgggaccaggtggaggtaattggatcctggggtcagtttgccccatgctgttctcctgataatgagtaagtctcatgagatctgatggttttgtatgcatttggcatttcccctgcttgcactcactctgtcctgccaccctgtgaagaaggtgcctgcttctctttgccttccaccataagtatatgtttcctgaggccttcccaacaatgtagaactgtgaggcaattaaagctcttttctttacaaattacacagtcttgggtatttcttcattgcagtgtgagagcggactaatatatcccctctcctagcttgtaaatacacgtgggatcttctacatgttcaaaattagaaaatgttcaaattaatatagggaaaatttgggagaggagcgtattttttagggtctggcaaactgtgtaatttttttctcatattgttttctttctctctctgcttctaatgagtagacatgtgggatacacttatggctcaaaatttctttctccacatatgcattttaaataataaataacagtctataattgaaacaaaatattttaattaaaaaaattgaaaggaaattatttagggtttcacatatataaataaactctaaaagcctgatttaacatggtacactagagattatcactttttggtaaggtcaactttaatgagaaaagattattagctgaataaaaaatagcaaaatgagtaattagttcaggagataaaaataagtaaaataatttggaggaagcatcacaatgctgtaacgaactttaaaaaaaaaaaaaaaaaaaaaaaaaaaactggcctgcaccttttaaatccaaaagcttaaagctgtcagataaaatatattgcatgtaaaaagtgttaaagacaattcatatattttttctactttttaagataacttttatttgaaatatatttcaacctcactataattttgttagttcagaaggtcaaaatctttaggacagctcctcagaaatccaaactctttaggagtactcatcaaaaggtcaaaatctttaggattgttcttcatattctttaaacattaactaagctatcttccatctaggtatgtgctttccagaaataattatcttctctagccctttgtacattttctaaagatccagtggtttgaggagcatagaagaatggatgaagagaatacacaatatcagtaattggatttattgacatacctagtatccaagacggaatgtctttgtgcctccatttttaagaccaaagaaattgttccttatagttaaattaaattgccctaattttaactagaaccatcagattctaatacacagtcattatagcagaagttaaaataaactcaaggtttttaatagtgtatgaaattagtttgaataatatatgccaaaaaactttcactgaattatctcagaaaaagagaaatccggattatgcctattttcttgagtactgtgggagttgtagagataagaaattcactgatttatttttagcaactctcgattatatcaaatgtttcttcagaatggagctattgcaagaccaaaatatatacatttgaatcactgacaatttagagactattgtctggggaaaaattgtgaaagaagttcaaatattttgaaaactgtttctaaaggaaaacaactttttgataacactcacatcttttcatcctatttcactagttcccaaaattgaccacacactagaatttctcatactatttaatgaaaactacagaattcaaatgttaatccctgaagattctgagttgatagagctctagaagtggagttttttttttaaagatcccaacagacttggatgatcccctaatctagatatgaggatttataatctatgtcaaaagatgcaaatatataagattatgttaaagagataataaaataaaacataaaaataaaaaataactggttatatgtaacaattccataaaaatctataaatattatatttgagtgtggaactacttgaatattcaaataaattagattttttttctataaatgaatcagtctaacttgcttaaggctatgtattatctcagagatcaaccatattgactacaaagtgtaactgggcactcatgccagtgtcagcagtaaacagaattttttttagacaagaataaaatcccaagtaaatatttctgcaattactattttccacactccattatgtcatgtttattcttaccagtctttcctatgacattgctttatctatgactattttgggaatctacttgagaaatacaggaataaagtgtttggtgaagagattttaggcctatttagagtaagcctctttaaaagtgttcccaattaaattctgattggtggatttctgtgttactttatttacttttgtaacttttcagtattttgtaaatttacataatgtttctgaattactttcacaattagaaagaaatttcaaaaatagaccaaatgcaaatcgtaaatggtatgaatattgtcataataatcaaggatgtctacaccaattgccttattcatgtggtaagataattcattaagttaataatttatgtgctttcattcttgttaatatttttccttccctttttatcaaatcatgtccttgggcaccccttcctcagaagcaaagcgaaatactttccttttctctcacataaaaatttgagttcattgaatgtaaacggactgtgagtaggtgaaaggaagtatccatgatgatatgataaatgttaattattgacaggtcattaataaacatgaatttatgttttacagtagctttcaaactattggggtaaaaggaagcaaggaaagtgcccatgcaggggaaagaattagccaaagactctgtgttgggtctaaggaagtcggattatttagatccaggtgtttcacagtaggacagagttaagggcatctggtagagtaaaatagtttgtgcacctaagttagtacagtatggaatatactcactacttttttttttcttcttctcaattactaaagtttatttaatatactctatggaataatatttcctatagtaagtgacaaaaatcatttgcatcaagatccccaaagttatttgtttaaaaaaaaatgctggtcactgaaccccttccagatatattaaattagaatttctgagagctcagaagctattattcaaatgagcaatgtaagttgtttgaatcacagtaaagtttgaaaactattgttgtaaatgaataaattcatgtttattgaataactttatattccataattaacatttatcatatcatcattttaaatattggggcaaatcttgtatcctttcctcagactgagaggaagtcttctctgatccacaataacatgagaaaataaggataatgcagtgagtgtataactagttctcagcctcctggagaactgattgctgtggacaggaggataatgaatctttatcacccttttcacttccatctatttgcttctgtctaatctaaggtaagtaaatatggtatttagttttatgaaagaacttttactagaagaaggtatctgcaagggacagatgcttggaaaatgcacagcaattaccacagtttctcactggctcataaccctttgggtatggttttggaattagggagaggaacacaagggtgagttgtaacactttggtgttacatggaaggcaaggtaccctatagatacatagtgtatttaatatgaatacgggccatattgacaaattattatttgaaacttggagtaccaaaatctgattccagacctgtgagctacacctgaagtcccaggtctcatacagacagttctgtttaagcctcctctacctttcttaggcagtttattataaacagaatgacttagacctatgatatttactgaggtccatttattatgtctcccagattgtattaatggaaggaaagaactgattataaaataaggctggactcttcagttttcagtggagttttccaagagggaaaaatgaaactgtgatagcttacgggaaagtattgtcaggagatagagaacagagaaggccttcatgtagggtagcagggctaggttctggggagtcttctcatgggggcctggattagtctgaaaatcctttggtttaatggtttttaatagcatgggaatttccctaacactcatcataaaaggaaagacattttttcccttattctctaggggtataggtgggattaggaacttttgattgtcaacaacggaccttaaaatctgcatgaacttttcctcaaagaagataaaattaaccataatggaagtaacatgtaagattcattgctattttagtgttgtttttagaaaataggaagggaccacctgttcattgaacccatctcaaatgaggtgatagaattgtaattgcctgttcccatgacccattgtttctgcccaagtggaagtcataaaagtggccaaattcctctttactttgcaacagtcacctggttgtaagccatatcagaatttccccctctgggaagcccagaacttctcagagatttagaaaaggaggaagaagaaaaggagtcattctaattagaactaagcgatgaaacctgtggggatagaaactgaatgtgtttaatgctggtttggggtaaataattaaaacgcatagtagattggtctctgcctctgtgtcatttttgtttcttacagaagaatcaaactaaaattacatgatgtctgatatttgctttaaaatattctagaaaaaagttacagaatatactaaacaagattggtaaatcatttataattattccagttggatgaataagggtgcaagggggtttgtttattgttaccttctctcttccttatgtatttctgaaaattacacaaaaaacattgagttttagcccagaaaatagtgtcatctctgattttagctagatctaaaacagtgacccttttaaatgccccccacccctgcctcgagtccccaagtgaagtctggccttttgtatagcaacacctctgttgaaacattgtcacatatactggggagggcaatggtcctgaagctttagaccataatcagcaaagaagttgccgtgagttccattttagaagtgagagaattgggaaagaacactttaaatatctgcttccaaacaatctagttgaagatataactaccttctctcccaaatatagtagcagagaatgatcctcgaggaatatctgtgtatttctacatgtgtctgtgtccgctaatacgttgccaactgcctcttctttgaaagggttggcttcaattctgacagtatattcttcctccattttgtattccaatgtcttttctttatgaagtggtgagtctaacatatggtagtacggcaaatattttttaaatctcattttatgttgttctgcaaaactgttttgaaattattttaaaaatccagggatattgtctttgtttaatctccttttttgtctattccatcccttcatcttcttcccttaattatctgtttctccaatttgtttacttctataatttttctcctctattccatcaagtctcattatgttgagatttgtacaatcacagatttttttaatttttaaaaaatcactattcactctggtcaccatccaagattcctgtgaacacacaacaaacataaaacagaaagatgcatattatgtagaagtaataccttgattttccattttgcaacagtgaaggaatgatgaagtaaaaattaacaaagagactttcacctttgtatgtccgacattttttcagagctgtgttggttgatggtgattacattaataaagtctattttaaagaacagaaaccatactagttattttaatagatataatttaatataggtaatttgttaaagaggtattggtgggcctagaatatttaaaaataaaaggtatcacaggccgggcgcagtggctcacgcctgtaatctcagcactttgggatcacgaagtcaggagttcaagaccagcctgaccaacatggtgaaacctcgtctctactagaaatacaaaagttagctgggcgtggttgcacgtgcctgtaatctcagctactcagaaggctgaggcaggagaatcacttgaacccgggaggcagaggttgcagtgagccaaaattgtgccacccacaccagcctggacaacagagcaagactccgtctctgaataaataaataggtatcacaaagagagtaaaggaaagaagcagccaccatcctttcagatggaggaaaagggaagaagttgaaggtattagaacttagaagtttgaaagaggaaccctgtagagttaaggcttagtctccttagaaaggaggaagaccaagtagtgctaatattttaggagccagggaaaggaactcagctgagcctaggacctaggcgttggaatgaagatgctgcttggctggtgctggtacctcaggagctcagatccatgctttgcaaagatgcaactcagatctctaaagagagggctctacccttcaggaactagtccctctaaagagacgtaataagtctgtttggtgaagaaagttattactgggacagcactgtcaggaataacactagcatcacagagcagataacaagtgtaggtttggagataagagaaaaatgaccaacatgataaatcccttctgctactaatcacttgtacacacctttctgcatatattaaaatgtccatataacaataaaaacaattttatgcttttgcctcaaagtattcaaatatcttttatacacatgaagatgttctcatctactccctaaaaaagtcagataaaatctaaacagtcatagaatccatctctggatattatccattaatccccacctgaaaatactgtaatttaaagactaaattataaaattgactacccatgacaatccttaatatgataaggataagagtgggatacaaagtaactggtacacacacacacacacacacacacacacacactacatcacaacatgctaggagaaacaggcttagctgctctagtacttgtttttgtaaccagccataaagtcatagttgatattatgtcctgatttgtagcattggctgaattctgtggggataaatattcccacaaatgccaatttcaagatgccaaggtgatgtcactaaaaacagagttgggaaatggtgcacatcagtgattctgaggagtccatatgaacctgttgcagtgtgccagctctttcatagcattggaagttaaactgcacctacccatcttgcacttggccattttgcactcctcacgctgttgaaacaagatgcaaagaagatagtacactggccagggtgatagatcctaactaatataagatgaggttgctactccacaggggagcaagaaaggctctaaaacctatggaattctctaggggctcttctcattcttccattccaattggtaaaggttaatctaaaaaaaaaaaaaaaaaaaaaaaaaaaaaaaaaaaaaaaaaaaaaaaaagtcttcaatgaaaagttggagcaaagtgcaaaacaaatgaaaaaaccaacaagcaaccatacaacagatgaggcaggtccactcatgattcagacctttcagaaatgaaggttgagatcactaccaggtaaagaacttcaaccagctgagacttttgacacaaaactagaggcatatagaatatgtaatcaaaaaagaatactgactagtcatatttttgtccccaaaatctaagagtgttttggcacatttaaatgctcaaaaaagtatttgccaactgaataaaagttgtctaccagactaattaaattgtcattaaaccaagtgatgttttctgaactaaatgatcaaatacactgatgtctttgggtttgaaattcccatttcctgatacatgtgtgccaaaatataaccaaaaagtgactcaattaattttgccaacctgataaaaatcttctgagtaatcctgtacagaggttcccaaatttctcactttgctttttattatattgatatgaggatttttgaagaactaaagataaaacatttatcttcacctgactagaatgacagttgctgaataatagccattaatttggatactgagcttaaagaagaaataacaccaatccacctgtattagacattgtttgctaattctcagtatcatccctatccttcaaatctctccccaaaactgcaggggaagaaagctaaaggccccatttccctaatcccctgtcagtagggccgtgagaaacactcatataagtttgggaggtaggagatgagaaggagtattctgcgacagctgtgggcaagtgtgagggcatctgcaggcaagcagcagatgaagggtattttggacaggaattccacctgaggagtcccacattagtattctatgacttgagatcattagtagaggctccctgaggctttctgggatccttcagaaaatgacccaccctcgtactgcaggcagctgaggtcactggcaactacttttctgctctatttccatttctcaatttcctaaaagtgcctttctcagcccttataatggttttgggaagctacttgttattcatttaaatcttttccctgtattacattaatctgtggtcacctatgcacgataaaccattcaatcccatacttttccttcataaatggcataatgaagatagatgaagcagaaggaataagcagaaaaggcaaatagatcaatatttgtttatttttcttcgaaattaatacaaagatttcctagtcccagggatacttagagatggatcagatgaacatttgtcagaaaatgctgaaaatcagtatcgtttaaggaatctaataattatgtctaaaattagctttaatgctacaatgttgtatttatatgaaccatcattgaatggtaggcgtttagaaccattgtggaactgttattaagttatctaaaatgtgatagaataatagcagtaataggattgatagcttatattagcacttaaaactgtttttcggtacaggattgcataatttcatcctaaaactttccctatggaagcattattctataattcttttcactcttctaattattttttaaatgatataaaaatctccagttaattaatatataacatacacaaaatatttcatacaggcaagaccctatgctatgcatgtactttgggacatagcaaagagtataatttacatgctccctgattttatagagaagctcagagtcatccataatcgccatgggcctgcctcctcacccttgcttctatacatttttctccccatcccacgaccaccaccaagccaatttaaactcagcatggacaggacagtttttaaaaaaatcaggatcataccgatcacctgattttaaactttcagggcttccacttttttaaatgacaacatccatatgcctttggccactcaagtcctgcaagacagggctcctgcacatctctcaagcattatctcataatactgcaccctttcccttcctatgctgcagccactctgcccttctgtatcaacctccttcctttgtgttagcatcttggcattttcagttctctccctggtaaaatcactggtgtttccttttgttttgttttgttttgttttgttttgttttttgagacagagtttcgctcttgttgcccaggctggagtgcaatggtgcaatctcggctcactgcaacctccgcctccagggttcaagcgattctcctgcctcagcctcctgagtagctgggactacaggcacccgccaccatgccagtcgtggggtaggggaagggtgagggatagcattaagagaaatacctaatgtaaatgatgagttaatgggtgtagcacaccaacatggcacatgtgtacatatgtaacaaacctgcaagttatgcacatgtaccctagaacttaaggtataataaaataaataaataaataaaaataatttacatatttttagtagagacggggtttcaccatgttggccaggctggtcttgaactcctgacctcaggtgatccacccgcctcggcctcccaatgtgctgggattacaggcgtgagccaccacgactggcccactggtgtttttttttaataaaaataaatgtattttgaaataatttttgaattcacataaatgttgtcggctagtattaagaactcccagaaacactttttctagattaggacacttgcatcaataaccacagcaaaagaatcacaatcatgaaattatcattgatcaaatattgattaaatatcattatcttatccgcacaccgtattcaaatctccttgattgtccttgtaatatgcttctaaggacaagaatccaatccaatattgtataatacatttaactatcatgtttcattagccttttaagactggaacagttgctcaggctctccttgtatttcatggttttgagagatatgaagaatgcaggctagttgctttgcatagtgttttatattgatttgtattctcgttacattgtatcagaaagtacacaacggctaactgtcattttactgatgatgttaacttttatcattttgttaagatagtgccaggtttctccactgtagaattaactaatatatgcattaattaatacataagtttaagcattttgtagaaatatactctgacactttgtaactgtcctgttcctcatcaaaatttcacccaccaatttgcatccatttatgattcatgcatgaattattgctatgatgattgccaaatgctgattatccaattccagcatttcttttgcacttattagtcagcagtctacttaagtagaacttgccctctcttccatttaataattattcagttatcatttatttatttatttatggattttggatttctgtcctactcaaaatgttgacattgttactacagttattttgacactcaaattatcttatatttgttaagtagaagcctgttcaatgttgttgctgtatctttttgacacacctacattattctttgagcacattcttactccaagcccaagtggttcccggctcatcctgtatttccttgcccaagccttggagtgagccacttcttcaaagaatcttgcttcattttagtgaataattatatttatgaaccaagaccaatgtgctaatgtgctcatttcaaatgaagcgtcactatatattggctggtcggtggagagatttgggaaatatatgtgtatatatatatatatgtacacacacacatgcacacatacacatatatgtgtgtgtatatctatatatacacacacacgtacaaactcatacatgcatatctattttaatatcaacttatatataatttattcttgaaaatcatgatttcacactgctacttcaaattctagccattccatttccatgtctgtaactccattttttaacagtgtgaaacttagcttccttatttccttattccttgtttgcttattttcttcatcctcttatatcgtatgtagcaatcttacagcagtcttggtaatagctcaacacctatggagggggaaaaaagaaaagaaaaacgaagaaggagataatctcaccatgtctttcaactagttcaatttcacccttgaggtcttagctcaaatgcaactaccctttacaactggccttttcacacagggccacagagggccacacaagtcccacgtaaaaatataagaaaattgactacctagtttttataatgttttattttttcaatgtgtcaaatttttgatgctttattccagtaaactggttaagatcttagactttttgagatttgattctgccatttattagcattatgaacttgggtgatggattttaattctcaaatataaaatggagctcatattacaaagacagctaactcatacagatgttgtaaagaacaaatgagatcagaacttaaagttcttggcatgagttttatctggcatgtagtaatcacttcaacaagaaacgttagttgttgctgaaatatatttggggtagtattgttgttgctatcaggttcaattgatgttaatattagcattagcactcttaagattttttcctacaataatttatgtatcttccaaatcagaatcatatgctatacagttaccattaaactatctgaagattttttcttaagaaacatataaattcacaacaataaaaatcttgcataattttagcatagtattcataatgatgtgaatatattgattatgttagcctgcctattacaaagagattctattattttcaaagttgattcatggcattatacacacactaatacacacacacatatatagacacataatatatgcctaagcaatgatgaaaaaactggcaaattcatcttttaactgtttatattttaataaatgtgtttttaaaatatattactaatgtccagaattgttactagaaaatcaatacattatatcaattttcttgatgcctgcttttatttagaaaaacaaatgtttaatgattatctgtattttgtttttaggaatcaataatgttggtctctcatgttttttaaataaaggttttatttctaaatggaaataaaatacattttattttaaaattgcatgataatagagtacacaaaataaaactaaaacaacaacaagaaccaaa

SEQ ID NO: 451 - DNA, 50670 bp, Homo sapiens
attaacagtgaaaatgaaggatctagttggggtggaaatattctaaaattgctttctggtgatggttacacaacttggtaaatttataagaatctgaattgtccacttgaaatgggtgaattatttgaaatgcaaaatatgtctcagtaaagtatgtgtggggagaaagagggagggagggagggggagacagagagagagagcaagagagagagagagacaaagagagagagagagagaaaaggttggagccaggctgtttggatctgaaacctggctctgctacttactagctgtatgatctcaggtaagtttaacctctttttgtctgagtttcctgccagtaaaattggggaaaataagaagttatttaccacagagtcttgctgggaagattgtggtgatacttaaagagtgcttaacacagagccaggaccctagaaagaactcaaaagatattagcaatatttagcctaccaaggattcagcacggacttagttgaacttaattcaaattttggataatttggacagtggcttgcagaggatattgactggtcttgtggaaatgactcctggggagcctgagagcctatagcctatgatttgtcagtcgcatgcagactggaggattggaacacaggagcctcaaagatgaagagttttttttccaccgcagcagcatttacagaggcgtcatcctgctgcccataaatgtggccacaacttgcagcgtttcagccccagttcaacaagtatttaggtaacgcccactccctgccaggctctgctagggcagaggacaggtgatttggaggcacagaggagggacatctcaccttgcccatgcagttttctagaggattgatatcttagcatgaccttagaacccctagaagttacccagttgaaggggtgcagagagttacccaggcagagggcatagcttgagtaaagcccagaggcaatagggagcttgctgagttcagtgaaatgaggatgtggaaagcagagtgacaagaagaaagacttagggtcccagggaaaggccttgtgtgccatgataaagaattgtattgtaaatagtgctgcaataaacatacgtgtggatgtgtctttgtagtagaatgattagaatacatggatacagagaggggaacatcacacaccggagctggtcaggggttggggggcaaggagagggagagcattaggacaaatacctaatgcatgtggggcttaaaacctagatgatgggttgataggtgcagcaaaccaccatggcacatgtatacctatgtaacaaacctgcatgttctgcacatgtatcctggaacttaaagtaaaaaaaaaaaagtccatctagagggagaaaaggggaaaaaacaaaaataattttatttatcctgaggacaatgaggagtcagtggagagttctaagcaggttctagatatcttccggctcagaaatcttcaattagatggtcccaaatggcatctacgtatcatactttgagagagcctgctctgttgattaggagcaaataaatgtcctcctggatgtatgtggcctgggttttgcatttgggctactcaaatgcaagttcctcgtgggaccacatccatgctagtggctggctgaaaaacggcttcatgactctcatgaggggaataaaaggcatggagtggtggctgtgagcctgtctgcagggccagacctcagaaaagcaaagggctgtaaatgtttcataaatttctctctgggtgcctgctctggctgagagcccattcataagcccaggcggctgaggggcaggtattgtgccggttactatagcatcaccttggaaagtctcacttggtgagagcggcaggcgagctggggtggggcaggagggggacgcggctggctggaggggctggagctaggccacggatactgctgctggtctcaggactcctggtggtccggagctcatgttagcgtccccagctgcagcccagggagggagagaggctgcgctcagtctgagagtggctgcctgagacagctgccacaggctgctgcagagcgtgcagcttttgcaagggactgaattcccagccagacaccccttggactcttttttggaggggtggggagcagagagaggagggagttgtcttatcttggaagatccgagctgggtttcatctcctttttgattttgagtagttccctccacgagaactgacttccaggtgttcaccaagggaaacaaggtggttctcacactggaaatgaggaaggatgacagtttttgagactgactgttaacggctcagaggtgcccctcattcaaaatgccttttaaagcatttgataccttcaaagaaaaaattctgaaacctgggaaggaaggagtgaagaacgccgtgggagattctttgggaattttacaaaggtaaagtttgaatgcgaactttagttcctttctgagtagcttcgtattgccaatgtgtgagagacttggtatcacgtttttaaaaccacactttaatgaggagaggatgggtcagattagatccttctggagccccttctagctccagtagtctatgcctggaggaaaaacagatgcatgaatagtattgggttgtattaggaaaagatcaagacaaatatgctgtttatatagctggattagcactttctggagatgatgatattgcatatggtatgtttggcattgaattagaaaatatttagggagataatattttatgttaactcattagtaatgacaaatatgccttgaactgaaataatttttatgtttttcactgaatccactataaatgaaaattaaatatttgcaatttttagcttatttaataaaatacataaagtggttcctgattgtatagtttgcaaagagaaggatagttacacattaatttgaaggaagtaacttaaaaaatgtctttgaagcagaaaatctcacataattgcagtgggaaaatgttaagtactatcactgaattgaatgagattttagtccaaaccaaaaagtaaatattttttaaagtaaaatatattaatggaaggagagtttgctataaatgattgaattaatgtgacagtttaatttatgaatttttatagacatagtaaatgccttctcaaattatataaatgatttcataagtggtccttatgtgcaaggtaaaatgactgctttatctctctgatataaataaatgtgaaaaataactttgatacactttttatttgtttggatgattatttctaatcctggtgagtgaaaatgccatctggtgtgtccttttaacttttctattatctcttaaatttaaaaactttttcatttaaatgactatttccaggcaatctgagattcatcccatttcttgtgttttaaaacacatatgctcctgtcagtgttaaattttccatggtatcactgttaatattaactttcctaataagaaaaaagagttggacaccttattattttagtaattagaaacaaaaaagcttcaatcagacctacactgaattagcatgtctagatgaaaacctagctcagtgacagcagcataaaccagccaaatatagaaaaaattacaataacatttttttcagagtgttttatccttccgttgagcactccccaggtaacgtcttattgtgttggcgttcatttgattagaaacgcaaaaataatttttgcataataagcacgatagcttaattggcttattcaagtaatgacaaaggaatctggcaaagtcaagaataaaaaccataggccgggcgcagtggctcacgcctgtaatcccagcactttgggaggcggaagtgggaggatcgcttgaggccagaagttcgagactagcctggggaacatagagagaccatgtctctacagaaatacaaaaaattagccagcatgatggtgcatgcctgtcatctcagcttcccaagaagtgggagtattgcttgagcccagacattcaaggttgcagcgagccaagattgcgtctctgcactccagctagggtgacagagtcagactctgtctcaaaaaataaaaaaataaaataaatttaaaaacctatgacgttgggccatagtcaccattataaacagcaaactctgccttcatttataaaatatttgatataaaaatacttaggaattttcttttcaaccttaagtttaattgctttttgtgaaatttgattgcttttttcaataggaattattgatcgaagagccggttttgctatgtttgattggaggagctacatggagatctttttgtttacaaaattgatttgcttagggatataacaaaattggcgattttccaaattgtgtgacctcaaccagaaattgggctatgtgtctaggactgtttgaatagtttcctcagaacaatagaaaaacagctagcacagtactagggacagagaatgcactaaacaaatgctagatattgtcatggttgtcctaattgtagaatggctttagaaaaaataaagccaaggtcaaatcccttttttcagtgatctatagagagaaattattggcagaagaaacgaaaacagacattgcttgagcggtgatccaagttgatcctcagttctagtgaggaattatcaagaccagctctgccacgtgtttggcattaatcacaggtgtataaggtaattgtatgtaaatgaccctgcccagagcctggcacatactgggcatttccctctcatttcactgcttttcacgtaaaaccagttgacagaatcccatgtaaaaaaatcacaaagaactgttttctgttttgtaggagcttttggaagctagaagcccctacattgtaacttagaaggcaatgtaaatcacagctgtctaataatgtttgaggctgaggtcatcatctaaatggaattcttgagatgctttttaatcacagtgttcctcacagtcaggggagtggcaattgcacagggaagcatttgagagttcgcacacaggcttgattacagtcaggcatgattagctttcctggaaaacagtcattgataagaagcagctgagcaattaatcagctaaaggtaaaataatattttagaagtgcaggaagaaagaagatgcactcatttatagtttagtattgaattatatagatgacatagaaagcattaaacttggaaactaatgtccagaaagtgacatgcagatttgttcaatttaaattacaatttatgtgtcctttaattgttcatgtctaaaaaacataacagtgacaaaacagtatctttcagacactgtaaactcatttaattctattaaaatccccatgaagaggggattactataattacaacttttcttttttttgggatagggtctcactctgttgcctaggctggagtgcagtgatgtgatcatagctcactgcagcctcaaactcctggcctcaagccatactgcctccttggcctcccaaagtgctaggattacaggcatgagccacagcatctagcaataattttacagatgagaaaactgaggcacagagaggttaagtagcttgcccaaggtcacacagctataaatggaagagctaggtttcaaaccagatgttctatgcccatcattcttaatcactacattatgttacccctgtaatcaagtgtctttcctcttcccactcactgtcttgatattgggccacttatttaggtttagggaggtctacttggactgcaatgtagccagcaacttctggatctgctgtcaagtgtgggctattctcctaatcagttgcatctttattgaaggctttctccaagggaggcttaaggggagtctggtctccttacaagtatgtctatcttccctttaaatgaaactagtccctgcatcgtgtctgtcttcagcattcaggagtgtgccagatatgcacttcctgctccatcaacaaaggtgagtgtgttaaagcttgctctgagatcaggtgatcctgggttccaactgctgcaacatcctttacttccctgcctgcatgacctcaggcaacttggctgcaatggggtgactctaggaaaccaagtcagatcacatctcacccctgctcaaaactacctcactcagagttaaagccagtgccctttcaatggccttcaaggtcctctgtgatctaggacttttggaaggctctctgagttcatctgtgacattttcctgcctcactctactctggattcaccggcctcctggctcttattagaactccccagattcactcctgtcccggctttcgccctgtttcttttgcttaaatgctttcctcccagatagcctgatggctcattccctcgctttcttcaagtatgtgctcaaagatccccactttcctggccattctatttaaacatgaagctcacctgccctcctcctcctgccctcttctctgtccctctttcctgctttacttcacctctgtcttaggtaggttccctaaaaagcacagcctgagacagggatttgggtgagcctagaatgtgatttaatgagctcttcctgaaaaaactgggagggagtaaaacaagaagggaaaggagaggctgggtgtggtggctcatgcctataatcctagcattttgggagtccgaggcaggcagattgcctgagctcaggagtttgagaccagcctgggcaacatggtgaaacctgtctctactaaaagacaaaaaatgagccaggcatagaggcatgtgcctatagtcgtagctactcaggaggctgaggcaggagaattgcttgaatccgggaggcagaggttgcagtgagccgagatcacaccactgcactccagcctggacgacagagggagactccatctccaaaaaaaacaaaacaaaaaaaaacagaaaggagaaagagccaagcaaggatgcatgctcacaatgcccagtggccagatccaaaggggaaggctctggagcacaagcgatgtgctgagtccttcctttggggcaagtggggcagccttttatatctctgcctcagtcagtcatcagctctgggctgatgggggtgggtgaggggtttatttggaggccactgagcagtgggaagttctccagggttcctcatgccaggactagaagcccaggcaaggagtcaccatggtggcaagggtcatgggtcctgatcctcaggaggaaccagaactgtcacctcatcacgggagcaggaagagatgtgtttggcactgaggtggtccactcggacatctcctgatactgcctgggctagttttatttatttttttattttaatttttaaaataatagagatgggggtctcaccatgttgattaggctggtcttaaactcctgggctcaggagatcttcctgccttggcctcccaaagtgctagaattacaggcatgagccaccgcaccctgcctagttttaactgcaaatgggaaaatacagcaaccgtgacctgctagcagctctggaagtagaagtgtgcttgcccatcaaggggaactggggagtgtgctatggtgtctatgacagcccacccactgcaccgctcagatcaacttgcttctcacatgaagttcactccatccaggtacagcttctccaagactctatggttgtaattcctgaggagccttccaaagaagagttattaagacagactccaggccccactgtgatgactggtccctcctctccacccctttttgatttccctcacttctgtttgcttgtctgatgggttgccccagatcttcatccctgagaggtctaaatccctggttaacataacctcaccaggtcatggttgctgtatttgcccactgacagttaaaaactagccaaggcagtatcaggagatgtcccagcagatcatctgggtgccaaacatatttcttcctgctcccatgatgaagcgacagttctgattcctcctgaagattaggatccatgacccttatcactgtagtgacttcttaccatgtcttctggtcttggcacgaggaccccaaagtgactgagcagcagtcgtaaccatatgttgactaggatttccattgtgttcctaaatggaagaattcttccttgtgaatcgggatttctagctcctcagagcctaagctgaagagatgagatattcctcaggtgggttactgggaatgatggcgagtggggccactccttctctcatgccttgtttctttgacctgtgtgttctgcccactgggcacacagcaccatatcataactgttgggttttttgtttgtttgtttgggatggagtcccactctgtcgcccaggctggatgcagcggcttgatctcagctcactgcaacctctgcctcctgggttcaagcaattctcctgcctcagcctcctgaatagtgggattacgggcacccaccaccatgcccggctaattttgtatttttagtagagatggggtttcggtatgttggtcaggctggtttcaaacacctgacttcaaatgatccacccgccttggcctcccaaaatgctggcgttacaggtgcataactgttgatttatggaatatactgcatcctggaagatagcaccttaccctcccagggtttcatctccaagctgatgtcgcagctgcatctttaagaagcttcttcagaggccaggtgccatggctcacacctgtaatcccagcactttgggaggccaacgcagatggatcatttgaggtcaggagttggagaccagcctggtcaacatggtgaaacatatattttctactaaaaatacaaaaaattgccaggcgtggtggtgggcacctgtaatcccaactactcaggaggctgaggcaggagaattgcttgattaaacccaagggggaagaggttgcagtgagctgagatagagccactgcactccagcctgggtgatagaacaagattccatctcaaaaaaaaaaaaaaaaaaaaaagcttctttagctctggcaggctgtcagcttctggatggtgtggtatatggtggggcttgtgcatcccattgtcatgtgcccactgctatgccatcttcaccataaattgggtgttttggtctgaaaaaatgtgatgtgagatcccatgttgagaaatcagacactgaatcctcagatagtgatgttggctgagacttgtagtctgaataggcaaactcatacatggaatatttcaaccccagtcaggatgaattgctaccctttccaggatggaaggggtctgttacaaacaacttctgaccaagagactggtttgtcccctcaggaattgtgccatctcaggggctcagcattagtcttgttgctgaccgcagcaggagctagctcagtcctggtgagtgggagctccgacatagcctccatccctgctgccatggttactctgttcataagtgcactgctctagcactgggtggctgaggacggaagctagctgacatcaactggccaagtcagcctgcctatcgtctgttttgtgcctcttccaagtggcatgtgataatgtgcaatcaggagagctcatactaggcatccactcatagattgatccacatctcttccccagatctttttcccagtcctccaatattgctttaaatgtcccctgacctccagtgaggtcattcaccactgcctatgagtccatgtatatccttacctttgaatgtttctcttttcatacaaaatgtgtggccaggagactgctcaaaactctgcctattgggaggctttccccctcactgtccttcagggccatccctgggtgggctgaagtatagcagcagtccatttgcaacatgctctaacataccaaattgaccagctctggaccaaactaagttttttttcctcctgtaatttgttcacaggtgtgagctcatggagaggcattggtatagtagatataggtcaggtggaaaactggcccctctgacatgggattacttgtgtcctgtggccctgctggtgttagattccagatggaccacttccgtcttatgatggacagttggacttctcaggtctgatagaacctagctcctgatgggtcgttttggctgcatggtctcttgatattccatggtcagatgctgtgtctccaccaggactcagtaacatgccatgagatgttttttgtctgttgtatatttctctactatagatgacaaggccttgtcccagaatcctaaggctctatgctatatttctcctattgagttttgccagaaacctcatatagtgtcttttcctattcagatgactttagtaccaagggtatgctggagaatacagccctagtggcaagatcacccttattgcagcctagacttgctacagaacattttcttgtttttggatttcattaaaaaccagcagccttttatgtcatggaataagtgggttagaacaatattcccaagtgttgaatacactgcctcaaaaacccaaagaggtctgccaaccattgtgcttcttccttagtggcaggaagttcaaagcacaataacttttccttcactttgaagggaatgttctggaatgtctcaaacactagactcctgtgaacttcgcccacgtgatggacctgtgatctttgtagcaattatttctggagcacacatgtcttactgaggcatccagagtacttgtcaattcttgctcctgaggtctaaataacataatgtcatctattggtcataatagatcaatgtgatgttctgcagcaggtccagaaggtctctctgactatattatgagagagaacaatccacggatatatactgtcattcatctcatgtcattgtgaatttcttagcctcctttctaatggatatggaaagaatgcaccagatcaagacaggcaagctatgtacatgagttaagagtgtggtagttccctgtcatccaccgtgatcccttctttttttttttttttttttttttttcagggggtaggctggtgaattaccttgggatccaatgggggctaccacccctgcatcctttaaatctctgaaggtgcaataatctctgtcattctgcataatataatactgtttttgatttatcttcttacacagggatgacagttttaaggacttccatttgacttttttctattacaatagcttttattctacaagtcaaggaaccacggaaagcgttttccaaatgctaggtgtctctcttccaattatacatgtgggaattatacatgggggaatgaccactggatgggtccatggacatgaactcactatgagacgatcctgtgccaggactccacttattacctgacccttataagccccactctaatggaggaagaatagtgctataaatctctgagtatcaacatcaatttgcccctttatccaaaagtctgcaaaagatagaggtatttctctttcttcagtgtatgtttacccaaattaatggtggtagagtcctttggggaaggactgtgggcatcatgactgcatttccttctgtggtgttgcaggttccttagtcacggaaccttcggtcttctccttcagtctttggattctggcctagaaactgggcaagagagtgtgactttccactggggtggccagcctcagcctactgcccattcatcagctctttatcttttctggttttatgtatatgaagcaatacccttattggctgcccattttatttttgttccttggagcaccatgttctgtgagtcatctctgagattcctatgggctgattccctaactgtagttctgaattttctgcccttacctatgatggttaagtgctcccaatcatcccaattgccactggttctggagcagcaccttctactgtgagcctcagccagaagaggacagcagcttctgagcatcagtggtgcctgtggccccatcaccactgcattccttattatcttaagagcaggagtattcctcaggcctcctgagaaatatagttcgtttgtgggttttctggtcttatatagaaaatccattcctgcatagtcatttatttgaggcttttgatctttctttataatctgctgtaacagttcccaacatttctcatttttaaagaaaataagttaaagagagaccttttaattgatcaagagtgtgatcaacattaaagatataacaattatggaattcttatattccaaataatagagatcaaaactttacttaaaggaatagaagatagccaatttaattatcagtaattcatcgctatgactggttcaaattcagcaatttttataccaggcattaaaaaatgaaataggcttgtaaattaggtttatataacaatgaaggaaaagagaggatgtagacctggaccaaccaaaataaggacactcttgtggccttaggcattctctcctggaatggataattttttattcttttatttatttatttatttatttgagacagggtctcactctgtcacctaggctggagtgcagtggcacaatcatacctcacggcagcctcaacctcccaggctcaagtgatcctcccacctcagcctcctgagtagctgagactacagttgcgagccaccatgcttggctaatttttaaaatattctgtagagacgaaggtctcgctatgttgcctagaatggtctcgaactcctgggctcaagccatcctcccacctcagcctgccaaattgctgggattacaggcgtgaacccctgtgcccagctttcaagttattttttttaaaagtcatggtggccatatcctgtatctctgtgtataatgtaataatgactagaaattagtacagaattatattttaaaagtcaccaggctactctggacatatctattttgtttaagtttccaagaaccgtattagcagtttatcaggatcatttctcttaaggcctttgccgggatgttagaccctgtgtcatgggaccatgccccctttattagtttcctagggctgctgtaacaaagtaccacaaactaggtagcttaaaacaacagaaacttattctctcacaattctggagaccagaagtccaaacccaaggtgttggcagggccaagctcctcctgaaggctcttaaggaggcctcatgcttgcctcttgctggctgctggtagctgctgggaatcccaggcgtgccttggcttgtggatgcattgctccaattgctgcatttgttgtcacatggtcttctcccctggtgtctgtgtctatgatttcaaattcccctcttcttataaggacaccagtcatgaaatcaatctattatgacctcatgttaacttgattacatctgtgaagactccatttccaaataaggctacattcacaggtatcgggggttagaacatcaacatatctattttggaggacagaattcaatctacctcccatattgatgaactctcccttatccaactttattaccctactccctccaaatctagtacattcaggatccattcccgggcatactttcctgcttcttgatgtaaatgttcatcagattctacgactcctgctcccagtatcttttcttagctcaaaagtgtattttctcatctaaagtttatattctctccttttacaacttctcccaagtacttttacaacaatcaaattttctaagtgcttcttaaaggttagtaaggcctatagattcaatacctacagagtaaagcaaccatattatatattttgacatagacacactacatattaacacatagaaataggctccacttctgcaaggaaatatgttgtatcattcaaagttcttagctgcaatcaacagaatacactctagctaaagtggaatgaaatttcgtaaagaatgttaagaattgggctgggggcaatggctcatccctgtaatcccagcactttgggaggccaaggcagggagaggatcacctgaggtctggagtttgagaccagcctggccaacatggtgaaatcccatctctactaaaactacaaaaattagccaggcatggtggtacgtgcctgtaatcccagctactcaggaggctgaggcaggagaactgcttgaacccaggaggcagacgttgcagtgagccgaaatcccaccactgcactccagcctgggcaacagagcaagactccatctcaaaaccataaattaataaaaaataaaagaatgttaggaattgttcagacttcctggaaggatcaggtctggatgctgtattctccaggaaaaagcagcagagaacatatacttctagactgttctggataaaacacagctgccaccactgcctgcttctaagtgttgattatattgatgacttgttccagaaattctgccacagcagtcacagaggagccagttgcctctgttgcatttgaaaccatctgcactgccattcccctgcatgctgtatcctcttcttgttctgtcccgtatctaaatctcattcaagtgctttggatttagcagagtccacctctcatgcctgcattgtagctgcaagagagcctaggaaaagtaggtgttttttttgtttttgtttttgttgttttttattttgttttgtttttgctgctccagcaagattcaaaatatcaagaattcattaagatattggacagctataaatgatggttgtctgctacatatgtgtgctactagtctaatttttatttttcaacttttgatacagacatgggtacaaaacatatttttctaatgtcttgattttaactactagaaaagtaacagtgcaagtataacgttaaatggcaactgagctcactatggaagtgacaatagggagtggtggggactgtggtaaattgagagccaattgtagccatgacagagtgagagcttgattatttcaggtcttcagatttttcaaaatgaacaagaaatccaaagttttatatgtttgcttgtttctgcttttttgagctatctcctgatatttatttatttttttatttatttaatacaatttttaaaagtagagatgggggtcttactatgttgcccaggctggtctcaaactcctggcctcaagcaatcctctcaccttggcctcccaaagttccaggattacaggtgtgagccactgtgctgggccttggtttttaaactctgtcaattaatctaaatttattttttattttttattttttatttttgagatggagttttgctcttgtcacctaggctggagtgcaaaggcacaatctcagctcactacaacctctgcctcctgggttcaggcgattctcctgcctcagccttctgggtagctgggattacaggcatgcaccaccatgtccagctaattttgtatttataatagagatggagttttgccatgttggccaggctggtcttgaactcctgacctcaagtgatctgcatgccttggcctaccaaagtgctggggttacaggcatgagccaccgtgcccagccaattaatctaaattctaaaaaaaaaaaaaaaaaaaaaagcaaagacccatacacacattataccagataaacaaaacatggctatgggccacatatggccattgggctttcagcttgtcatctgtgacttaggcttttaaagccatagagactatctttttttcctcttgttcatctaatgatccctgctgaggtaagaagcagtgagtctctgcttaaatggggggataggaaagggtcaaattaccaggaggaaacaaaaacagcataggttaatacctcaaaatctatgaagctgggctgagtgctagggatttttggttcctgactttctgaaattataatctactggaagaggcaaatattaatttaaaaatgagagacatagatactgtgggagcattgactgggctggcgttggccaggtgcactttattgagctccttttgaatgtggtgtgctgaaatccatgctgataagatcctatttcaaatctcaaactagctctggggatcgtattttaaattctccttcctttctttaaaatttaccatttattgattatttatcaagtgccaggaattatgctaagcattttgtaactcggtctcatttaacgttcacagtagtcccatcttcctttcataaatgagggaactcaggttgagggaagttaggtaatttgctcaaggccacatacctaataaataccacagtcagcattgaacccagtactgtctgtctccagggcatgttctctgaatcccactgcaatactcctccagaacctttaaaaaaaagtctctgtaggtaaagcactcgccattcgtcaggcgctttctgattagttcgtgtggcacactggtagcaataggctggatagcaaatctcagttgtgttctcccttcaccagctgcagctggatgatccttgggcaagttttttttgtttgtttgttttcttttcttttgttttgttttttaagtcagagttctcactctgtcacccaggctggagtgcagttcactgcaaccgccacctcccaggttcaagtgattctcctgcttcagcctcctgagtagctgggattacaggtgcttgccagcacacccggctaacttttttgtatttttagtagagatgggttttcaccatgttggccaggctggtcttgaactctgagctcaggtgatccacctgccttggccttccaaattgttgggattacagccgtgagccaccgtgcccagctgggcaaggttttaaatattctgagtgtctcagtcttctgagcgtctcagtcttctgagcagtaagatggggatatctcctatttgtcaagactattttgagaattaagggagataatatatattttatagaaacctcgtggagtccctagagtgtagcaagtagtcaacgtccttcagttaattttcttcttccagtagaatagcaactcaaggatcgtgtaaaagacaacatgagctaaatgggaccttttcagagggcaaatttgaatgctgtatttgtttgctagggctgccacaacaaaatactacagaatgggtggcttaacaaacagaaatttattttctcacagttctggaagctagaagtccaagatcaaggtttgatttctcctgaggcctttgtccttggcttgcagatattgccttcttgctatgtcctcagatggctttcctctatgcatatgcatccctggtgtctctgtgtgtccaagtctctttttatttatgtatttttttgaaacagggtctcactctgtcacccagcctggagtgcagtggcgagatcatagttcactgcagtgtccaactcctgggcttaagtgatcctctcccctcagcctcccaagtagctgggaccacaggcatccatgccaccacacctggctcaaatgtcctcttcttataaggacattattcatattagatgagggcccaccctaagggcctcatttaaccataattacgtccttaagcacctcatcctaaatatagccacatttggtggtactgggggttaagacttcaacacatgaattttgggtcacacatttcagttcataccaaatacagtgagcaagtaaattgatttaaaaatactgttttatatatatatttaactttagataggctctctctatattgcccatgctggtctcgaactcctgggctcaagggatcctcctgcctcagcgtcccaaactgctaggattgcaggcgtgagccaccacgcccagccagtaaatggatttttaaaatacgtaaaattatctgcaagttctctcactttgtgctccaaatgttgatcttattacctatgaaacaaaacaaaacaaaaccttttccgcaattagtgggaacatttgaattgcaaagaaatagttctttaagtgcctaaggactagttagcatatcttaggcaattagacccctggggcttggatgtttgctggacaactgtgcctgagaacagagagcaggcacctccctagtgtgcagagggccagcagtctgcagaccgcggctgtctatatttggagaaacaacaatgagaatgtcactctagaaagaatgaagattctctgatctaaaagaccaactgcagtcaagcagggaaggaaaacgaaatgggataaatagctattatggataattaaagtcctccaactcctaagaaatgagttcgtttttcttctcttattcttaaataactttctcgtctcctcccctttttataaagccttttttctgggcaggatgaatagatccttaaccctgtctgtaagtgcttcaagccaggagtgatgtctggaattgatccaccaattccattcagttggacaaggattcattgcttccaggcacgatgctgaacatggagaataaagatgagttggaaatggtcctgggatcagggagaccttcattcatatatggacacaaatcagtgactttttttttttttttttttttttccgagacagagtctcgctctgtcacccaggctggagtgcaatggcaccatctcggctcactgcaacctccgcctcctaggttcaagagattctcctgcctcagcctcccgagtagctgggattacaggtgccagccactatgcccagctgatttttgtatttttagtagagacggggtttcattcaccatgttggttaggctggtctcgaacccctaatttcaggtgatcctctcgcctcagccttccaaagtgctcagattacaggcatgagccactgtgcctggcccaaatcagtggctatttacttagcacctatgctgctgaatgaaaatgactctaactccatgtgagaagtgttctaacagaggaatgtataaaatgccaaggaaacaccagggatggcagagaccctaacgttcaggcaatgtctattcatttattggtgataatgtgttagtctttgtagggtcggctcatgtatctctgtgagataaatatttattgtacagaagaggatatgtgagattcagagaggccaggttatttgcccccaagtcacacagctcgcgtatcagtggcagagctggaaatcaaatccaggttatctgactgcccagaagcctggtgtgttccatgatacagggtgagggggttctgtcttcctctgtgagctaggctatacaagaaatggcctgctatttgaatgcttttaaaacaaatcaaatctggtcaggcatagtggttcacacctataatcccaacactctgggagactgagatgggtggattgcttgaggccagaagttccacaccagcctggccaacacgctgaaaccctgtctctactaaaaatacaaaaattagccgggcgtggtggcctacgcctgtaatcccagctactcgggaggctgaggcacaagaattgcttgaacctgggaggcggaagttgcagtgagccaagattgcgccactgcactccaacctgggtgacagtgcaagactccgtctcaaaaaaataaataaaacaaaacaaatcaaatctgactctgagccccctgcctgggggaagttagatttctgttcattttgatgctccccttttgccacagcaatattatgcaaaggactcacaaacaactcaggaggtcctgctaattattgatcctcatttgctcctgagcccatgatcccttgaagtggtggctcagctgccactttgggcaaagaaaagtgagatcctgtgctcagacccctccccacagctcctgatatcccatctccaactggagagctgctgtgaggggctggcttcaggtcagccagctgtaggtcctgcttcttgtggagcccacagctccttctttcagggctttccctttgatcgttactttccccttctttctccccatctcccatactgtatgtcttccctctggaaagtctcgggatgtctaagatgacactgtgcacacagagggtgcttgtgttggttcaggtcttccaagaaagcagataccaagacaggactcggcacatacgagatatggtctcgctctgttttccaggctggagtgcagtggcacaatcacagctcactgcagcctcaaactcttgagctcaagtgatcttcctgcctccgcctcccaaagtacttggattacaggcatgagttactacacctggccaagagatttattgagggaaaatggggaaggagctggaggaggctgggggagcattcaaactgctacctgtgtaggagagagggaaggaagaaaagctaggtgggaagactttcagactatattacaatactgggacattttggcatggccagtgcagagtcctagagccagtcgctgtcagaggagtcctgcctctggcaggaaagaacggcctcacatccctgcggtgctcagttcttggcagaataacagcctgtgagaaagaggcgctgtccccacgccaaatgggtggttgattcagagcacagcagctggggctgtctgcaattaagcagtgcaaagctccacagcgctttcagttttcattagccttcatctaaagcatctgcatgtatatagagagcgctaagcttatgactggtgacactttattaatagcaatagtgatagtacttaccacttattaatataaagcactttttacgtaccaggcactgccgtgaatcatttacatgcatcaatcattgaacaaccctatgagatacccattacgattagcccagtttagagatagggattcttatgggctgaattgtgtcttcatatggatctgcccaaattcattatggtgaaattctaaccctcagtacctcagaatatgagtatatttggagatagggtctttaaaaaggtaattaaggttaaatgaggtccttacggtaggccctaatcgaatatgactgatgtccttatatgaagaaaaaattgggacacacggatacatagaaggaagactatgtgaaggcacagggagaagagagccatctgcaagccaaaaagaaaggcctcagaagaaaccaaggcctgctgaaacctggatctcagatttctggctctagaattgtaggaaaatacatttctgttgtttaggccacctagtttgtggtgctttgttacagcatccctggaagactagtagaaggtcaagtaacttagccaaagtcacagagctagcacaagggagagatagcactgggcatctctcagtccagagtccattctcttcccctgctcttctgagtcatgatggctgcgcaaggactacaaagtaacaggtacagatgacaaagtgactcaggaagatcattgagaaggagcatggcctggtgtgctgggaacacacaggaaagtggtccaaggaacctagacagcaaaggagaagggtttcatatcttgcctctacccactaagggctgtgtgaccttggccaatttgttcttgctttctgaactacagttgtattttgtgtcaaatgggagtattagatttcccatgtctcactgagctgtattaatgatcaaataagagaattacatgaaagtatctgtagaggagggcagagggagagaactgaatttgcctcatacaatattactgtggttgttacatattatccttgttttagctgctaggaatatactattatagtaatgtgtcaatattagagcatcagttttctttcttttcttttcttttttttgagatggagtctcactctgttacccaggctggagtgcagcagtgcaatctcagctcactgtaacctctgcctccaaggttcaagtgattctcatgcctcagcctccggagtagctgggactacaggtgctcgccaccatgcctggctaatttttgcatttttagtagagacggggttttgccgtgttggtcagtctggtctcgaactcctgacctcaggtgatctgcccacctcagcttctcaaagtgctgggattacaggcgtgagctaccacgccaggcctagagcatcagttttccatcctacttaagttacacgtatttggttgccagaaattcatggagactactagggcagcccattataaagtcctatcatccaactgcctctcagagctaatggcatcaatgctaagtctagcatcatagactcattaagtgacggtgaggattaacgtaataaaaatagctggtatatgttgctttttattatgtggcaagttctgttctaaattacctaagtttgataactcatttatgacaatcctaagaacaaccctatgaagaagaaactattataattcctagcttacagatgaagaaactgaagtccagggagtttaagtaattaggctaaagtcacacagctgagtaagtgggcgactcaacattcaaagtaaggtacatgagctcctcagttggacatagattggagaagtgaggcatccaagatggcttcaagatatatatatatatatatttttttttttttttttttttttgagacggagtctcactgtcatgaagactggaatgcaatgccgctatatcagctcactgcagcctccgcctcccagattcaagtgattctcctgcctcagtctcccgagtagctgggactacaggcgcgtgccaccacggccagctaatttttgtatttttagtagagacggagtttgccatgttggccaggctggtctcgaactcctgacctcaggtgatctacctgccttggcctcccaaagtgctgggattacaggcgtgagccaccgcgcccagcctgatggcttcaagatttttgctggagcaaccaaagtagcaaaattgtcattacttatgatgagaataacttcaggaattaatttttttttaggggaagtcagtttggacatgttaagtttaagctgccttttaggtgtccaaggagatgtcagataagtctagttataaagattgggagctgttagcatatacatggtatctaaagcccagagcctgcttagatgtccagagggcatagacagaaagcaagagacccgagaatggagtcctaggcattctagtgtatataggttgaggtaagaaggaatcagctataagagataaaacagaagaattaggaggatgaccaagtgttttcctggaaaaacataaaatggccaagaaagagaaagtggtcaattgtatcaaatgctgctgctaggttgattaaatcagatgaggactgaaaatgacctttggactgagccatgaggagggcattgataaccttaagtagggcagttttgggggctcaggttgggaatacctggctggagtgggtccaggagagaacaggaggagaggaattgaagacagtcatttctttcttaaaaaaaggaaaatgagaaataggaggataactgaaagagaaaatgtcttttattttagattctaatatgggaggaataaaagcttatttataggcaacaggaatgatctattatactagggaggagaacataatgaatgaagcgtgggggtggggatttctggagcaatattcgtgaggggataaaaggggacaagatctagtgtccagggaaaggggctggacttagctagaagcatggacaactgcatagaccccatcagtataaatgcaggccggcaggtaggtaggtacattggtagggaaatggttaggttcttttccaattgctttaatgttctggcacatttactaagcttctactctgggctcaccggttgaaattcaaagctccttcccttgttctaccattgcttttcactttgatttcaataaaacccacatcatccagtaattatagctgcttgtatatgtgtctttcttccccatcagcctaagagctggaagaaggcagataatatgtcacgttgtctattgctccccaatacttagcccagtacctgagacacagtaggcgctcaatatatatctgatgaactgaattgaatccagtgtatttgtttctctatacttgtgccggaaatttgatttccttgagtcataagaacctgccaaggtgccgggggcggtggctcacgcctgtaatcccagcactttgggaggccaaggtgggcggatcacgaggtcaggagatcgaaaccatcctggctaacacggtgaaaccccgtctctactaaaaatacaaaaattatctgggtgtggtggcgcatggctgtaatcccagctactcaggaagttgaggcaggagaattgcttgagctagggagtcagagattgcagtgagccgagaatcgtgccactgcactccagcctggcaacagaccgagattccgtccccaaaaaaaaaaaaaaaagaacctgccaaggttatctttcatatgaacttgtgggcaaatgacttgtgttttatccaaactattgggttaaccattatattagctatttatcactgcatttaatatttatgaaaacttgcaagctttaattatttttaaaaagacttggaccttaagtgggccatgacagtatcctcagaaagatgacaataagtaagaggatacaacttcctttataattgacagatagggttccgtttgtccaattactttttttttaaaagaagagataaattcactgtaatgaatgtgccataattggaatctatagaggtctaccatttgaataaaaggtgctggatgatcacctccttagaggaaccatctaaggagaaaaggatatacaaccaaatgggtgtgcattgtgatagaaaatgtccctctccacctccacttagtattttattaagacttagaaaaattaggccgggcacagtgcctcacacctataatcccagcactttgggaggctgaggcgggcggatcatctgagtcgggagtttgagaccagcctgaccaacatggagaaaccccgtctctactgaaaatacaaaaattagcctggcatggtggtgcagacctgtaatcccagctactcaggaggctgatgtgagagaatcgcttgaacctgggaagcagaggttgcggggagccgagatcgtgccattgcattccagcctgggcaacgggcaacaaaagcaaaactccgtctcaaaaaaaaaaaaaaagacttagaaaggttaaggtcaactgtatcagctgggtcgagcaatgtgaacaaagtctgtcaatgctctttcagcaggaaatgcagtatagcatattgttttagacatagactctggacttgggcctctatcctacctcaaatgacttagtttcctcatctataaaatgacatgatgacactgtctacctcatggggttgttataaaatttaaatgattgattgaatgtttataaaagtcccacacaatacccagaacatcagtagttttagccactataacttactttaataataataataatatttaataataataataacttactttaataataatagtaatacctccatagtattctactatgggtcttcctttttgtttttcatctgctggtaccttttttctttttgcttagtatactttctttttcctttaatcctggcttttattttctgcctatcctttttcccatgtagaaaaatcgatgggacaactgaggaagaagataacattgagctgaatgaagaaggaaggccggtgcagacgtccaggccaagccccccactctgcgactgccactgctgcggcctccccaagcgttacatcattgctatcatgagtgggctgggattctgcatttcctttgggatccggtgcaatcttggagttgccattgtggaaatggtcaacaatagcaccgtatatgttgatggaaaaccggaaattcaggttggtatcagtccatggtggaagacttttctttttgagacagggtctcgctcggtctcccaggctagagtacagtggcacgatcttggcttactgcagccccaacctgccaggttgaaattaacctcccatctcagcatcctcccatttcagcatctcagataagtagctcctcccatctcagcatctcagcatctcagcatctcagcatctcagatcagtagctgagactacaatcctgaggaaactgttgactgcagctgtgtcaatactttgctccttgagagaaagccctgcaattccttcagtgatatgacaaaaatggagagtggctacttgtgctgggcattgtgcagaatgatggggatagaaaggtgaatgacctagactgagccctgtcctcatggagacaagtaagtgatgacagtttgagggggtaggtgccacgttggaggtacacaggattcttgggctcataggagagggcacagcccagacttccctattgtgaacaaattcccaaagtgatggctggaccaggcaaagagggtgtggtgtggtgggaagaagaatgtttgaagaaaaaggtactgtgaaggactgtaagaaagagacagagagagagagagagagagagaacgtacacatgctatgtaggtatattttaggaactgaaacaggagctcatcatcttttctgtgtcatggactcctggagatgactaatgaacctttgccaaagtaatgttttaagttcttaaaataaaacacaaaggatgacaaaagaagccaattatattaaaatataaataccaaaacatttaaaaatcacatttgtgacatagaaacatatgggcttctttagtagtacatcagtgacaaaatctagtattgggtctaacatttactctgattttaagttggaatgtatgccattgttggaaatagtggccatgactgtaatacgatttgaacatatttgctatttccacgtgggacacagtcataggtactagtcatatgacggtggcttgttgcctacattcataatggcagaaaatgctaaattttggttaagagtgaaaataaagatgcatgttttcttcccatccaagttctcagatgcacaggattccatccacagactccaggttgagaactcccagtgattgggtagagcacgttgaggtggaggcagcgaagtaaatagggggctgatcatccatagcctggtaggcatgtagcaaggggctgcaagcatggaatgatcacatctgtgctccagattgttcactgccccattgcagggggccagattgaggtaagataggaatggaggccacagggccagttcagaggccatcatagttataagcaaggatacttcgaagtgacttaaatagtattgttttaggaatcactggaaacataaaatctggtttgctgcttaaacgatagacctagagaagtactgaggttatggggtaaaagaaacaaacaaaaatgtctgcccagtggacaccccataaatgcatgtttcatcgtactaaactcacacactgcaatgactcatgcagaaatccgttcatctgcagagagacatttaatagttctctggtccctccctctatttgaagaaacatttagatcacagttttttgaactagtgtctgggaaatcactgcactgcaggctgtgccatgaagaaggcagtgcgagacctggagcccatactgtgctgtgtcttatgagactttccaagagggagacgtggtaggcaatattttctggactgacttgatcatagaatgctctctttcatgccatatctattagcatcatctggcacagtctcctgccaggcactggtttgagaaaatttgatttcaatctgtcaaaagaagtctttagttggtctgcaagctatttgtttttgcttttttcaaaccaagagattattctgccagaggaaaacagcaccatggagatcctcctaactagtctctatttgatgccacagccaaatctgtcctaaaaggatatcctgtcttttgtggggtgtgggggatagaggtagaagggcatatcatgcgtttttaaaataaagaatgatgtatattagcaaggtttcagatgtgtatcacatgcattctttcagccttttgtgagcaagaccagctaattaaaacttgtctgctgaggcccagatcaaaatgagatgctgttttgcatttgtttgttgcctgaaaagatagaccttggtcaatagagtctgctctgaggcatatggaaaagacattttgattaacccgaggaacaatgctagtgtgcgctctctagtttctacggctgtgccctctggagtcttagagaaactgattaaaatctgaaatatggtttaaatttttttcctctggactcaggagtaggaatttagtatcagtaactctagtacagctctaatttatagcagattatttctcttgtccgcctagaacaaagcttagatatcaagtgagcatgttcaaccaaatgacaaatactttgctaattgtattaagaaaggctctgaatggctggtatgtttgtttggtttttctgttttaagggaaaaactagatatttggcactgagatatctttaaatctttatttcaaaagaaggagagaaataagcagtatgaataggtagatctttcaaatatgtggcatatgttctacaaggggtatgaagagtgattttaactaaagcgtgaacacttttttttttttttgaaacgggatctctgttgcccaggctttagtgaagtggtgtgatcatagttcaccgcagccttgacctcctgggcttaagtgatcctcccacttcagtttccaagtagctgggtccacaggctcatgccaccattcttagctaattaaaaaaaattttttttagagatgggatcatgccatgttgcccaggctgatctcaaacccctggcctcaagggatcctcctgccttggtctcccaaagtgctgggacaagcatgcaccactgtgcctggcccatattttaaatttaatagttatgagttaaaacatgtgaactcttagaaaagtgtttggcatatagtaagaaaataaaatgaccgaagtttgagaaacttgtgattttgttttctcattactctcaggaaaagtccaaagttcttcccatggattgtgggccctgtaggattcagagcatgggctttggaactggccagacctggttttaatgagctctgggaccttgaataagttgcccttgtgtcctggtcagagattgctggttgcgaagaaatgtgcagtgaaactggctcgagttaaaaggggattattggggcccggcatggtggctcatgcctgtaatcccagcaatttgggaggccaaggtgggtggatcacctgaggtcaggagttctagactagcctggccaacatggtgaaaccccatctctactaaaaaatacaaaaaatttggccagacatggtggcgcacacctgtagtaccagctacttgggaagctgaggcaagagaatcctggcagttggaggttgtagtgagtcgagatgtgtgagactccatctaaacaaacaaacaaacaaacaaaaaatggtagtggggattattgtagggctgtaagaggatctcgtgaaagccaagggcagaaagcaggtctgtggtgtatgtgtgcagtctgcacccaggacgcagaagccagcctgaggtggggctgaaacccaggctgtcctccaccctgaggagggaagggagtctttatgtaattctttctgaggccgcaggacaggccctgccagaagtgctgaatggagctttccctcgtgggaactagagaagcctttgctaaggtctccagcttgcttgccccacagagtctttcattggcttttcttggagtcagctccgttttccctggtccttcatggactgctttctttcctcttccctggcttctcactgccctccacagtggaagtgccttgagcctttgtcttgctaggaagctgatttacttggccctgactctgtgactccgtgggacttatttgggttcaagagtgcactattgtctaactagaatctctgtgggtttgggttgctgtctctctctctctctctgtgtgtgtgtgtgtgtgagagagagagagagagagagaaagagaaagagacagagacacagagagagggagaggctgactggctgagcctagcctatggctttgctgtcttaaacatttttttttttttttttttttgagacagaatcttcctctgttgcccaggctggagtgcggtgacatgatctcagctcactgcgacctccacctccccggttcaagcgattctactccttaggctatcaagtagctgggattacaggtgcatgccacaacgcccagctaattttcgtattttaaaaatagagacgaggtttcaccatgttggccaggctggtcttgaactcctgacttcaggtgatctgtccaccccggcctcccaaagtgctgggattacaggcgtgagccaccacacctgactggcttggctgtctctactcaggtgtccagtcagctgtggtagtcagtcggggagaatcccatgttgcgggggaaggtgcaatcctctcagaagtgtgagcagacaggaactgacatttctagaagttccttgctaaccctcattgcccttattgtgaaatgggaataaaaggactgctttgaagatcaaataagctaacctatattaaatacctatattagttccctaaggctgccgtaacatattaccacaaacttgatggcttaaaacaatagaaatttattctctcagagctgtggagaccggaagtctaaatcaaggtgttggcagcacctcatgccctctgaagactctagcagagaatctttccttgactcttctagcttctagtggctgcagcagatcctcggtgtgcgacaatgtcactctcatgtctgcctccatcttcacgtggacatctttctgcgtgtctcctcttttgtctcaaatctccatctgtctttctcctataaggacacttgtcattgggtttagggcccagctggatagtccagatatctcattttaagattcttgacattttcacatcagcaaagacttgttttccagataaggtagcatttataggtcctggggatttgatgtggatatcttttgggggccattttttggcctttcacaatatctgacacagtgtttggtttattatagtgatggtccatatacagggccatttttttaaaaatttataattttaaaaaattttattgtgataagaatgcttaacatgagagctactgttttaataaagtttttagtgtacaatacattatggttgactctaagtacaatgttgaatagcagatctctagagcgtgttcattttgcttgactgaaactttttcccattaattagtaactcctcatttccccctcccccagcacctgacaaccatcattctactcttcaagtctatgaatttgactattttaggtatgtcatgtaggtggaatcatgcagtatttgtctttctgtgactggctcatttcactgagtgtaatgtcctccaggttcatgccagttgttacatcttgcagaattttcttctttataaaagatgaatagtattccattggtgtgtataccacatttccttttttttttttttgagatggggtcttactctgtcacccaggctggagtgcagtggcacaatcttggctcactgcaacttccgcctcccaggttcaagcgattctcctgccccagcctcctgagtagttgggattacaggcatgtgccaccatgccaggctaatttttatatttttagtagagacggggtttcaccacattggccaggctggtctcgaactcctgacctcaagtgatctacccgccttgggctcccaaagtgctgggattacaggcatgagccactgcgcccagccacattttctttattcatctgtcaacgggcattcaggttttttccacgtcttggctattgtgaataatgcttcagtgaacatgggggtactaatatctttttggatcatgatttcaactcttttggataaatacccagaagtgggattgctaaatcatacattcgttctgtttttaagttttggaggaacctctgtactgtttccatggtggctgcacccattcccaccaacagtatataagggctttattttctcttcatcctcaccaacacttcttgtcttttgtttttgataatggtcatcctaacaggtataaagtgacgtcttatggtggttttgatttgcatttccctgatggttagtgacattgaccgcctcttcatgtagatattggccatttattggtcttctttggagaaatgtctattcaagtctttagtccactattatggttttaatgggtctcaaatgacaatgaaagtcagttctcagcagcctaggggctcttcttcatgtattatttctttcagagattgacagaagcactatttccccagagagaaaggcatgagaaagggatgttgtgattgacaattagcagctggttgaagtgggagttagagaaagggtctagttctccctctgtcttggatcctcaggtaattctgtggatctgggcaaagaagtcttgtctctccttagtgagaaaattaagtctctccaagcaatagaaagaatatcgtgttttggggttaggcagatgagaggttttgtgtccccttttccttgcaaatagttgtatgaccttggacaagtaaactaatctctctaagccttagtttcctcatttgcaattacctctaggtgttttaaagattaaaggaggaaatctgtagaaagcaccttagtgaaatcatattccacctctgctcaaattttccaatggttttcatttctctttgtttaaaagccagagttccggtgatgtcttaaagaacccttcatcattgtaacctctcttgcattaacacctattctcttcctcctcattcattaccctccagctgtactgacatactgcttttcctctaacacgcaagacacaaccctaccttgggtcccttgtacttgctgtttctctgcctggaaagctcacatctcaaatgaccatatgacttgctcccttcctttctttaggtctttacttaaaactcatcttctcagtgaagacttccctggccgttctatctaaaatttaccccaccacactgccatccaacacttcatattcccttcccttctttattttttcatcttattgctggttaccatctaactctgcctgtaattgtttatcacctgctatctccactggcatcttcaaaatggcaggagtcactacagctgttcactgctgtaccccagtgcatagaactatgcgtgttacacaataaacacaaaatacagatttggtgagctgatttgaattaatgatagctagctagttcctttttaccattgagcttcaactttctaatccgtaaaatgagaaatagagagtataggccaaagtggcttggactgtgagctcctagaaggcaaagacaatgcttgtttgagtctgtatttacactgtccagcacctaacattgcattcaggaagcacaggacgaacgttgaacagatgggcggataaatatgtaataacttgtgacaggaaaataagataagcagtgatgaaaatttataaaacatagtatgttgataattaggaaccctcttactccatatttgcattttgatatcaaaaagctttacaaagccattcatttattcattcatttggcgaatacacacttgtaccttctatgttcccaggcgtttgatttaggtactaagactataagtcaaacaggacatggctgctatcttagagtttcttggtgccctgtgtgggaaattgacatgtggatgtccattcactgaagacagcactgtgttggtgccatggctgtgggaccaaaggtctgtaagacaagcccaagaaaaagggaccagttcaattttcgggattcaggaagtttcctctgaggaaggaccatttacaatgagtctaaaaagaatgagttactttacctgggaaagaatatgaggaaagggattccagccctagagaatcacattttcaatggcctaagggttgtggaaggttgtgttgttgctattgccatcagcatagtatcagtaatggctgctaacatttattgagtctacactgtgtgccagtcactatcctaatctgttacatgcaaaatctctaagcagagagataacctactagaaatattcatgccatttatccccacacatcctatggataggtagaatgggctttattgtcctcattaagaaatgagagacttaagactctaattctctttgtgctatcacaaaactggcatctgaataatgtagtaaataacttagtagccccccaaaaccccattttttgttttattcacaagctattttattttctccttagcattcattgctattttgtgttttttctctctgtgtatatacatatatacacacacattatatatattatatatatatagagagagagacacacacattagatatatgtatttttagagacaggagcttgctctgtcactcccactggagtgcagtgtgtgtttgtagcttaccttaaccttgaccaactcctgggttccagggatcctcccatctcaacctcctgagtagctaggactacaggcacacaccaccacacctggctagatttgtattattattattattattattattattactattgagatggagtctctctcagtcacccaggctggagtgtagtggtgtgatcttggctcactacaacctctgcctcttgggttcaagtgattctcctgcctcagcctcccaagtagctgggattacaggcgtctgccaccacacccagctgatttttatatttttagtagagatgggatttcaccatgttggctaggctggtctcaaactcctgacctcaaatgatccacccacctctatctcccaaagtgctgggattacaggcgtgagccattgcacctggcctagctggctagatttttgattttttgtagagatggggtctcgccacgttgcccaggctggtcttgagctcctggcctcaagtaatcctcttgcctaggccttccaaagcattgggattacaggtgtgagtcaccatgaccattaatataaatacatatatatttaaatttgtacataatctcttattacaaggtgaaatctatgagagcagggacttttgtttgtttgtttcatttttttttttgagatggagtctcactctgttgcccaagctggaatgcagtggtgcaatctcagctcactgcaaattccatctcccaggttcatgccattctcctgcctcagcttcctgagtagctgggagtacaggtgcccgccaccacgcccggctaattttttttgtatttttagtagagatggggtttcaccgtgttagccaggatggtctggatctcctgacctcgtgatccacccgcctcagcctcccaaagtgctgggattacaggtgtgagccaccgcacccggccggttttgttttttaagatggggtttcactctgttgcccaggctggagtgcattggcactatcttggctcactgcagccttgacctcctgggctcaagccaggaggctcaagccaggctgaggtcccacctcagcctcctaaataactgggactacaggcacacaccactacgcctggcccaggacttttgcttgctgctatccccaagtatgtaagatgccctccataagtatgtgttaaataaatgaaaaaagaaagacctcatgaggtaattattgtgtaggctcattggtaaaaaatggttgtcagcctttttctaacaaacacaactatatctgatttctcatttccagacagcacagtttaactgggatccagaaacagtgggccttatccatggatcttttttctggggctatattatgacacaaattccaggtggtttcatttcaaacaagtttgctgctaacaggtaagataaattgatataacatgatacaaaccaatgaaatgtggctttgtacctataaattctgcatagctggctctcaatttgggggtgcagaatgaaaaacaggagccatctggatagatgcaattcacagatactgatcccaaatgaccctgatcttaatttatttttatttttatttttgagacggtgtctcactctgtcacccaggctggagtgcagtggtgtgatcttggctcactgcaacctctgccccaccccctcccccaccccactcggcattcaagcaactctggttcctcagcctcctgaacagttgggattaaaagtgtgcaccactacacccagctaacttttgtatttttggtagagacgaggtttcaccatgttggccaggctgatctcaaactcttgacctcaagtgatccacccgccttagcctcccaaagtactgggattgcaggcgtgtgagacaccagcgcccagtcaagagtttctttttatttcgtttttcatccaattaaatttaccttgcaactcttcaagtgattatgtggtaaaaagaccaatcaactctgagtcaggagaaatggttcctgccccctaactggatcactgggtgacctctattgagtcactttccttccctccctgggcctcagtttcttcatctgtgaaatgaaacattggactagattgtatttcagttccccttgaccagtgacattctgtaatcttaggttaatatcacccagtaccataaaggttttctcagatgagtggtgggggcttgcctctagactgcaagatgtgtctctaatgtccttgagactctgtagtgggtgtttgagcaattaaaagtacccaagaacagagtgagctgtctcaagaagcagtgagttctctgtcaccggaggtattcaagcagaggaggatggccacttgggggagatgttgtagaatgtatcatgtattagaaaaggagtgaactaaatctctccaggtcgcttccaattgtatttcccatatgactttccataaatggatttcatgaagtgcattccatttttaaaaagtggttttttttttcaaattctaaagcacaactcattagatagttgtgaaaacaatataatgatttaccaatgagcatttttaaaaaagagagaaatagaagaaaagataatcaaatagaataaaatagaaaatatctgaatgcattgcacataagggtaaatattggtttttgagacttgtttcagttacatttgtatgtatgagtatggactgggttgcaatataaaatatattttgtttatgggttaaggtaaaaaaattggaagccactaccataagatctaaataggaataagcatatatttatttaggttcttgtctaatttatgtcttttatttattgttagttatctattgtattctttttaaaaagtgataaaatattggttgctatggtttcctgggttaccgcttacacctcagccttgaaaaaaaatcacacataatctaatttcccagcacataaaaagagtggaaacatcatcaacataagtgagaggggaagaaaatgctgcttgctctcttttcccagggcaccctgagctggccaggaaatgggagctaagacaggtacacaacctgtcttgtgcttggctggtcccaggacatacaatgcttcttggatagtcagtgtttctgactctgggaagcaggaaacaacctcaaacatacagtaacagtcagaaaagatcagtcggtggggaaccaggcaggatggtaggtctctagcaagcttacctgaacctggccaatctccaacttttcaggacatcatccaggcaggacatccctgtgccaccaaaaatttgttcatagttggtccaggggccagagcttgggaatcaaagaagcccaagagtctagcttggggtgcactagaccctaacacatctatttctccaaattacaggtgccagccgccatgcctggctaattttttgtatttttagtagagatggggttcaccatgttggccaggctggtctcaaactcctgacctcaggtgatccacccacctcagcctcccaaagtgctgggattacaggtacgatctttccacagggatttccacagggatctttcatgaactgttaggtttgtttctggtgcttagctgaagtagcacatccatcagcagacctgccgaataacacaatgctttggtcccccagggtctttggagctgccatcttcttaacatcgactctgaacatgtttattccctctgcagccagagtgcattacggatgcgtcatgtgtgtcagaattctgcaaggtttagtggaggtaggagatactttccttacagtttttgatattgctagagacagcgcagtcctttagaaaattcaccttctgaagaaaatcccctttactcagtttttttctatattttcttccttttcctgctgtttccattctctggtaatggctaaaattgcaagaattttaattaaaatgccttgtgtgattttacatttatgaacaataaagtacccttgcataatgatcttagagataatctaacctgaccctcttcattttaatagatagtgtaactgaagcccaaatctacagttcacatagcagaggctcattccactaaaacaatttaagtggattcattaataaatctgtacattttcaagggtgtagtctgatgcagagatttaattcaatgaaggaggcagcatgatatggagccagaaggtaaatattttggactttacaggccttacagtgtctgttgcatctactcaaccctgctgttatagtgcaaaagcagccagagacaatatggaaacaaatgggcatggctacgttccaattaaacattttacaaactgaaatttgaacttcatatgattgttgtgtgccattaaatattactcttcttttgattttttttctcaccattttaaaatgtaaaaaacattcttagcttgtgggctatacaaaaacagatggtgaaccaattggcccatagtttgccaaccctcgatatacagcaatgtttcccaaacacagtcattcacctctgaccttcgccagtttgttatgcccatgtacaacttgtactattatttgcctattgttttcccctagatcgactcatttaaaacaaaaaacaaaagatacctattactctaagcaataccatctttgaaatcatgggtttgatgtgttagttacatcttttcctttttttttttttttttttttgagatagagtctcgctctgtagcccaggctgaagtgcggtggcatgatctcggcccgttgcaacatctgcctcccaggttcaagcgattctcctgcctcagcctcctgagtagctgggactacaggtgccagttaccacacccggctaattttttgtatttttagtagagatggggttttaccatgttggccaggctggtcttgaactcctgacctcaggtgatccgcccacctcagcctcccaaaatgctgggattacaggtgttagccaccacacccagccactagttacatctttttcaaagcatacatatatatagtagaattatatataaatttaattatatatagattaattataacatatatactagtgtatatatgtatatataatatatacatatatagtatatatataatatatatagtgtatatatatactgtatcatatatagtgtatgtatataatatacatacactagtatatatattataattaaaaatgtaagttgttatatcatttcaaatccaactctagtcccactagagggacatatatgacactttgggatgtacccgtgtagtggaaagaacacgatattagcatccatgaagactaaattttagtcacttaacagccctgagtctcaggttctgtatcttgaaatgagtggatggaccaactgattgtggaaggctcttcctacactgatagtctatgataatatgaaatataaatataaagaccttttcccccatctcctaccatgcttacatgtgaagtgtatttgaatttcagcatctgtactgtgagtcaaaatagctcaatcatgctgtttagtgtctgttttagtccatttgggcttctacagaataccataaactaggtaggttataaacaaaagaattttttttttttttttttgagacagagtctcactgtgtcaccgaggctggaggcagtggtgtgatctcagctcactgcaacctctgcctcccaggttcaagcgattcttctgcttcagcctcctgcatagctgggataacaggcacatgccactgcacccggctaatttttgtatttttggtagagataggattttgccatgttggccaggctggtctcgaactcctgacttaggtgatccgcccacctcggcctcccaaactgttgggattacaagcataagccactgtgcctggccttttttttttttcagtctcgctctgttgcccaggctgaagtgcagtggtgcaatctcagctcactgcaatctctgcctcctgggttcaggcgattcttgtgcctcagcctcccaagtagttgggattacaggcatgcaccaccatgcccaactagtttttgtatttttagtagagatggggtttcatcacgttggctaggctggtcttgaactcctggcttcaagtgatccacccacctcggcctctcaaagtgctgggactacaggcgtgagccaccgctcctggcctagaaatgtatttcttacagttctggaggctgaggagtcaaagatcaaggtgctggcagatcggtgacttgggagagctagcttcctggttcataaacaactaccttctctttgtctgcccatggcagaacggatgagggagctctctggagtttcttttataaggcactaatctcattcatgagggctacacccttattacttagtcacttcccaaaggtccatctccaaataccatcacattgggaattaggttttaacataggaatttggtggggacacaaacattcaacctacaacagtgtctgtaaattgggcttttatattgtagcctgtgtgaagaagcagcatccatattttaaacacaagcagaaactacagtcaaatcaactaatctattttcaactcttctgccagggtgtgacctacccagcctgccatgggatgtggagtaagtgggcaccacctttggagagaagccgactggccacaacctctttttgtggtgggtatattagaatcgtaacaaattttatttatgaatgctttttttgggttcatgcagtggctcacgcctgtaatctcagcactttagggaggccgaggcaggaggatccctggagcccaggagttcgagatcagcctggacaatatagtgacacttcgtctttaaaaaaaaaaaaaaaaattagccgagcatggaggtgtgtgcctgggatcctagctactagggaggctgaggcaggaggactgcttgagcctgggaggttgaggctgcattaagctatgatggccacagcactccagcctgagtgacagagtgagaccttgtatctaaaaagaaaaaagaaaaaagaaatggaatgcttttttggcttcaagcaactgaaaaccctactaagggccttaaaatgagtctatttattttatataacagaattctaaaggtgagtggtggctagtgttggttctgctgctcaaaaatccatccagggcctaggcatgttctgactttctactctgctatcctcagacatagctttttatttacttctgtgcttattccatctgtccctttcatcaggaaaacaaaagctttcccaaagccccctaccaaccttccactttaatttctttggccctaactgtatcatatgctttactaaatgcagaggaggctaggcaagcagatgcctagcttcaccagcctcttcaggagtgaaggggaagggagaaagggttggaagtggttgttggattagccaacaaatgacatttgctaaggacaaaagtggaaagatgggatcatcaagcatcccacgcctcttctttttatatgaaactaaagttcagtgacttgcccaagatcatggagctagaacaagacctgactgttgatctggaactttccttacttcacgctcctaccatgtacacattgtcatatagaaatgtaaattaatttttgtcattatatcccagataataagaagtagagaccatccatcttatctgaaagtaaatgagtagcccccaagtagtatgtgactttaattcctgcatctccaaacttcaccttgctgaggttgccatctccaagctacccctgtgggacaggcctctctaggtgtggctgggtccctaggaatcaatcaacaacagaacaacaacagcacatgccgctgccatcaacacagtggtaaatgtgtcgggggaaggggcccatgaaggtaaaagtaccttagaccagccaggcatggtggctcacacctgtaatcccagcactttgggaggctgaggtggaggattgcttgagcctaggagtttgagaccaacctgggcaacatggtgaaaccccatctctaccaaaaatacaaaaaattagctgggtgcggtggctcatgtctgtggtcccagctactcaggaggccaaggtgggaggatcgcttgagcccggaggtggaggttgcagtgagccgagatcacaccattgtactccagcctgggtgacagaggaagaccccgtctcaaaaaaaaaaaaaagtaccttagaccacaaaagtcacagtgtggcctaggcagtgtgaattacagcttaggtctgtctgattttcaaactagcacacttttcctaagatattcttctttgctaaagggagaaagatagctttctatttatttctgcatatgttttaattttcctcttcctgctggccttttacctccttgaaataataataaagtaatcctgagaatgtggtgtgaggtattcaccgctatgcctactttgtgcctcgttgggaattgcatgctcagctgagatgtctttacatattcagtgtctcttgtccttagaaaccatctccatccgctcatttgcagtttaagcatctccatccctactactgtgcttataccaactctagaagaggataagactcaccccagctggccttgtggcttgttagatccttgaccttactttctttggatggtttatttgtaagacctttcattttgatttgccagcaaaatgagcatgactagcagccactccccattcttagtgtgtttttatagccctaaaagggctgatttaagaaatggtttgactctcaaggaaagttacctgatcaaggacacaggcctcattacatgtcccagctaaggtgtggccttggtttcaaagaacagccaaaggaaaatgtggaagaaggaaacccaggcttggagtgtataaattcttaatctcaaaagatattggagttagaagggattctagaaaacatccagtgatatggtttggctctgtcgccacccaaatctcatcttgtagctcccataattcccatgtgttatgggagggacctggtgggaattgattgaatcatgggggtgggtctttcccatgcttttctcgtggtagtgaatgggtctcatgagatctgatggttttaaaaacgggagtttctctgcacaagctctctctttgcttgccgccatccacgtaagatgtgacttgctcttctatgccttctgccatgattgtgaggcctcccccgccacgtggaactgtgagtccaattaaacctctttcttttgtaaattgctcacacttgggtttgtctttatcagcagcatgaaatcagactaatacatccagttacaacccattgttttatagttgaggaaactgaggctgagggaggaaaaaagatttaaattcttacagctagtgagggccgaaccgggggctctttctcacccccagttctgttcttccttctttgcataccattcaacaatcatctgaggcccaggggactgagctgcagtctgctccccagggcagtctgggagcagctgggggcagctgcagtaagggctgagtgccctgttgtttgctcaaggggctgtgtctaataggaactgacattggagaatgtctaaaaggatgaggaagattttttctgatagaaaagaagggtagtttaggtcacattgtgtattagtctgttttcacataactataaagaaccacctgagactgggtaatttataaaagaaagaggtttaatcaactcacagttctgcatggctggggaggcctcaaggaacttacaatcacggcaggaggcaaaaggggaggcaaggcacatcttacatggtggcagaagagagagagagagagtgaaggggaaggtgccacacttttaaaccatcagatctcatgagatctcactcactatcgtaagaacagcacgggggaaatccgcccccatgacccagtcacctcccaccaggttcttccctcaacacatggggattacaatttgagatgcaatttgggtagggacacagagccaagccatatcacattgtaaagtttccccaatgatagaatgctttttactatgtaaggggaattattaggtgcttttgagtgaaggaggcatgactgaatgattaaataagagtaagggctttggggttccacagacctgggctcctgtcctgtgacttgtcacttctacctgtgtgacctcaggcaatctgcctcccctcctccagcctggctttctccttataaaatgggggtcatattggtacttaccttgtcaggttgaaggagagttaaacaaagtcataggtacagtatacttagcatggtactaggcacccagaaagcactcagtgcatcttagttggtggggttattctctacctgcccctgtcccaggcattcttttgcattacctaaaccagactcacccaccccacctcccagggtatttggcctggggacaaaggccaccctatctccacgcacagcagaatgagacctgcagcccattttcaacacatgcctggagtgctcaccttattggtttgaggagccctgagattgttttttgagtgtgttgtcattctgtacatgataatagcggtaatagctggcatttgtgtaacccattatagcttacaaagcatcttcacatacatagtttatttgaatctcaaaacaaccccttgagatggatatttcattcccatcttatctctgaggaaaatgagtctcttgacttcctcgggtgtcatgatgttcagattccagatctcaggctgggcctttcaccgagggtcaggctcaccttggaaagatgtgatttaatctatttctctggaagatccccaacctcccatttcctaaagatcttccttagcatcaaattctgggatatagaatttcctttcaccactcactttttctgaagcaagagttttttcattcacagcccagggggagtttcagagagtaacttctcctttcagctaataactcccaataatgggaggtcacagggctcatctttccctaccagacgtccagaggatagcagaggtcagctcactgcctctagtcacaattatcttgtctagacaagataaacattcacacacaggtaagcatttgcaaggttaagttttacaaagtaagaaatacatgtaaaaatgtacccattcaggagctgaatggagacagcagccctcttgccatctggaatttaattgttcacccctcacctttttttttttttttttttttgatacagtcactctgtcacccaggctggagtgcagtggtgagatcttggctcactgcaacctccgcctcacgggttcaagcaattcccgtgcctcagccgcccaagtagctgggattacaggcacgcgccaccatgccaggctaattttttgtatttttagtagagatggggttttgctatgttgaccaggctggtcttgaactcctggcctcaagtgatctgtccacctcagcctcccaaagtgttaggattacaggtgtgagccaccgtgcctggcaaccctctcctttttttttttaatcaagactttaaaaatcatgatcttttaaataattcaatgtccctcatttaaagatctggatgagaatcctcccagtcctcctaagcaaattttgtatgttcctttgcttgctctttttagcttccaatattgcgcctggttgaattttcaaaatttctcttagatttttttcatcttctgattccattctctcatgtaattccaaactgtgatgctggagcaatctttgtctaaatcctgtgtggtctctggatgaagttaaagggcatcttggtgaccttcctctcctggaagccctgttctgtggcacactgggagtttgcctgtctctgcacggaggcagtctgattcctgctcagtttgattaattcctgactttaccatatgaattctaaatgagctgaaaaggcttgcatgatgattggtcagattccctcaatcttttcttgttccaggttcctatgcaggggcagtggttgccatgcccctggctggggtgttggtgcagtacattggatggtcctctgtcttttatatttatggtgagtgatttgacttcacaagttcacatgtgactcatagagatggtattttactgcatatgggtttggctcagagttcattacatcaaaatagagattactaaaacaagtttattgtataaatggaatactttatctatgatttgattaatatttatattaaagttgacctaaaaaaataagtagaacattgtctttctttaaataccagttaacaagaggaacgtcaacaaaatacttacccctagctgaacatactgccatttggaaatattgtaaagatccttttgtagttcataaatgtgataattgggtgttcacgtgcatgtatgagatgtctgagtccctcaaaccttgttacaacattggtacattacccattttacctgaaaaaaatatatatggtaaaaattgaaaaatttagaaacggaagaaaatgagaccatataacccagccttttcttttttaactgcaggcatgtttgggattatttggtacatgttttggctgttgcaggcctatgagtgcccagcagctcatccaacaatatccaatgaggagaagacctatatagagacaagcataggagagggggccaacgtggttagtctaagtgtaagtataaaaagtcagatgaagacttaccttttttcataagtgattgtgttgccttcttacagaaaaaatgtcaatatctttactaaaaatatcatggtatttttactccctagaaatttagtaccccatggaaaagatttttcacatctttgccggtttatgcaatcattgtggcaaatttttgcagaagctggaccttttatttgctcctcataagtcagcctgcttattttgaagaggtctttggatttgcaataagtaaggtaaacacacagatgctccaaatatttttgaactttaaatctcttgattctacagagaataactttgtatgataaaataattaaattgctgatcataattcataacagttctgtgacacctaatagcctggctgtcagacaagttatacattctatgcatagtatgcatagctgtttaatttcttcttagcaaggatcagagccgtattaagctgctttaaagatttatgttgtacccaatcttagagtgtttttgaagctagctcaaggacggcatattaggcaaggataaaaagatttgagggtgtgggttttctttttttcctgtaagctactcagtgagtagcagtaagaaccttaccattcattttgcagaacaccccttctccataatggtggctatagcagtaacaatcattgcttgcaatgggttagaaagaacctctttctgccaggcgtggtggctcacgcctataatcccagcattttgggaagccaaggctggcggatcacctgaggttaggaccagcctgaccaacatggcaaaaccctgcctctactaaaaatacaaaaattagctgggcgtagtgatgcacacctgtgatcctagttactcaggaggctgagacaggagaatcacttgaacccaggaggcagaggttgcagtgaggcgagattgcaccactgcactccagcctgggcaacagagcaagactctgtctaaaaaaaaaaaagaagaagaaaaaataaacagaaaaaaaagaaagaacctctttcaatgctcccagacattatcatcaagccaattgtgttttagggaggaagggtgtggatagtgaatcatcaaccatcatcataagataaacctctttcctacaagggaaagaacagcagccgagcaaacacaaatgtctgcctagctacagatactgtcagaagtgaccatggaagagctggcataatcatgaaatggtggctgtcatcagtcatcagtgctcactgggtgccaagtgctttatctcccatgtgccatgccctctgtgatgaataaaagtcatcgctgccctcaaggagcttccaatctggtagaggacacagataggtctaaaatcattcgctcattcatcatttatttattatgaaattcaggcctacccagctcccacataattagatgcttaaatttggtggtggtaggtaggggggctgtggagtggaggtgggcaagggaattagggaggcccctctctcagaaataatgacaaactgcttactgtttctttcccttccaggtgggtctcttgtcagcagtcccacacatggttatgacaatcgttgtacctattggaggacaattggctgattatttaagaagcagacaaattttaaccacaactgctgtcagaaaaatcatgaactgtggaggtactgtggatttcatagatggcttaggcagcttttgtagaattagggtaaactgaactgcagagcatatattaagaagtgacatttagtcattggagtggatcttaaagacctctaagtctgtccctcagcagacacttgagtgttgtccatcacagtgctgccaagaggtcatccagctgggacctttccatacatccttccacatttattgtttgcttatgtagtttattcccttctctgcttacctttctacctatccatatgttttggtaagaaacagaagaaaagtagtctttcctcctagcctatgcttgtgcatgggatatatgcacacacacacacacacacacacacacacaccattctctttcttgattttatttagctcctgctttatgttttaattttgtaaagacaaagtgaatgttaggtgatttcccaaaagaggtaggcgaaagtaattgtgaacccctacaatgttcatgagtgctttttaaaaaactcatcttttttgtttagcttttaaaattaacatttattgaatgctttctgtgccagacactaagctaaatcttctacatacattattttatttaatcttcataaccaccatgtggagcaggtactattactatatgcaatttgcaatgaggaaacagaggtaaaataaagggacttgctcaagtagcagatccctgcaaggtatcaggtaggccggagcctaccgccaaagctcttagtttgcggctacccctctggaggactagtcaggatgagcgagcaggaggtagaggatagcgccacctatgggcaagagctcacaactgtgatattaagttgaaagggacggattgcgtatgctctgacagatagctaggtctggcacatttagaagtgaagactataccgagggacacaggagcaggcatgatctgatcccatagcatttcgggaagaaagcctaagagtctgttggcacctgttctcccagttccttgactgctggtcccaggcagggatgtgtgggcctgaccttagcttgaactttcttgtagaggactgagggttagcggatataggcctgctatctggtgggcaggaggtgaagctctgggacattgcattcaagtcctctccaagagagctgtagcagctagaataatgcccatgtcctaatcctcagaagctgtgaatatgtttccttacatgtcaaaagggactttgcaggtgggattaaattgaggttcttgagatgggagtttatcctgcattatctaggtgggcccaatataatcacaataatccttataaaaggaggaaggagggtcagagtcagaaaagaagatgtgatggtggaggcaagagtcagagtgatgcagccacaaaccaaggaatgcaagcagaccctagaagctggagaagacaagaagagattccgccatagcacctctagaaggaatgcaactctgtaggctgctgccttgactttagccctgtaccattttggatttttggcctccagaactgtacaatagtgcagagagt

SEQ ID NO: 452 - DNA, 40001 bp, Homo sapiens
tagcataagctcaggtgtggttgaaaggggctcattatgaatagcaaaagatgctcatctcactagtgtcactcgggaaattccaagggttttagaagctcccttgccaggaaccagggacaggatggaagaccaaatacatatttcttctcatttcacaatatcgtaggatgttggggcaggatgattctggagggagttcttacctaagactagaacaatgtgtgagtgttagctagtgagagaacactgtacaaaaggcctgggtgggaaagcggatggctcattcaaggaactgaagaagaccctcaatattggcatagcttaaagagcttagagagttaaaaatatatatttattttttatttttttgtatatatatgctggagaaacaggtgggtaagtgatggtcttgtaaactaaggaagggtattttgactgcctttggggcattgtgattcagccaaaaggtctaaagcagggagtaatatgatcaggtacattgttcagaaacattcctccagctgcaccgtggaagcgggactgagcgagcaagtgaagtggcagatccagttatgtggctggtgaggtgcatgagaggagatgatagtggccggaggtgtggcagtggaaatggagtgacacggttatatttgagggcagagttgatagtacttggcagctggctgggaatgggaagagggagagctgaagaccactcaggtttgtgtcctgcagcaggaagtaatagcaagagcagactcgaggtgacagcgaggacgaaaccactgatgtgtgtgagggcctgctgtgtgctgggtactgtgtccctgcctgttgactaacttagtcgttgtgagcaccccatgcggtggatgcggtagtatatctatttgacagacgaggaaaccaaggacaaagaggttgagtaacttgcccatggtaacccagcctggtcatggccgagctgggattcaaacccaggcagcccagaccccaaagcaccacattgtgcagctgatacttcatctccacagactgtcctaccatatttggcatagaatttaaaaatggaaatgattcttggtagcaacacgaatgtagtggagacacacagacctgggttgtaatctcactcagccaattcctcttagtgagacctggccataccacccaggttttcagaagcttagtttccacattaaataaagtaagaggccaggcgtggtggctcactcctataatcccagcactttgggagcctgaggcgagtggatcacttgaagcccggagtttgagaccagcctggccacatagcaaaacccaatctctaccaaaaataacaaaaaaataactgtgcattgtggcgtatgcctgtaatcccagctatgttggagaccgaggcacaagaatcacttgaacccaggaggcagaggttgtactgagccaagatcacgccactgcactccagcctgggcgacagtgagaccctgtctcaaaaaaaaaaaataaaacaaaatggcctggctcagtggctcacgcctgtaatcccagcactttaggaggccaaggtgggcagatcatctgaggtcaggagttcaagaccagcctggccaacatggcaaaaccttgtctctactaaaaatacgaaaatggcctgatgtggtggtgcatacctgtagtcccagctactcaggaggctgaggcatgagaattgcttgaatctgggaggtggaggtttcagtgagccgagatcacgacactgcactccagcctggagcgagactctatctcaaataaaaaaaaaagtaaaataaaataagggaatatctaactgtagggttgattaaaatgcaacctgtaaagtgtgtaggagagttcctggcatttaatagatgccgaatagctgcacctgttagctgttttttccccaggatattatagatgtggctgtggcttgggaggggagacgatgtggctggactgaaaggtcatcatgccagtatttttaatgggggttggagagagatacatattgtgaaaaagctccagtgattttttttttttttaaaccctggttgtgaactacttgcgttgatactggattttgaaaaaccaaaggctttaaactcctggttatggacattttaaaaaattatttttaattgacacaataattgtacatatttatggggtgcatagtgatgttttgaaacacagagtttatagtgatcagattagggtaattagcctatcaatcatctcaaacattgaccatttctttgtgttgagaacattccatatccttctagctatttgaaagtatgcattattgtttaactgtagttatcctaaggtgctatagaacatattcctcctatctagctgtagttttatatcctttaacaaatctctccctatctccttctcccaacccttaccagcctctagtaatctctgttctactttttacttctgtgagtaagctagcacagccactgtggtcaacagtatggaggttcctcaaaaatctgcaaatagagctaccatatgatccagcaatcccactacttaactgggcatttatcccaaggaagtcttttaggggttcataggaggaactcttttctctgccaaatgctgggttctgacttggatagtatttggatttgctactggacccactgtttttatcgtccagacatattctgtggggaatgtgatattctgtggggaatgcggttcagaagtggtccacagaatgtttgttattagtccataatgatagaaggctagaaacgaagaagaaagtttagaaattttaacaataatttgacagtgactgatctagtaataaacaatggtgttttaattttacatgccttttaaaatttcatttccccagtacattgtcagtgaatttcacaagtgttagtccagtggatgaattagaaataataataatttttaaaccagtcctgagtactactttaaactgagtgctcaaaaatagctgcagctccagagccagctgtggtaggctggcacagtgactcactttggtaaaaatcctgggcaattgagagcagtctttgactctgaggagtaattacttacaaaagttgacaaattccttagcaaagtaatttccaaagggaattactagaattctagaattgctgtaagaggagaggctactcttgtttgtcctgtgtgagagggattctcagcgcctggggcattagcaatgcatttgccgtattcagtgtgagatggggttggtggtcatttattctgaacacctgagccgcagtcattgagtaggaaacggattacacatagttatgaagttcacttgtagaggagaaaaacaatagttcaagaggaaaacatttgaaaatacttccttgtaatgtcttaaatgaattttagtgccaaatattaaaagtttttgtgttttttgtttgtttttaatttaatagtcaatataatcccactctaaagtgagggagccttctgcggctggaagtggtggggacagataagagtatgtgaggtggaaagcctccagcagctcctgacccttgtacgagtcctgtgtgttgggatggaagggcatggaggctgccccttctgctcattttttaaaaatacatgtttttataaaaattctaaaacagttgtgtacgaatgaaatctgtcaattgacccaagcagtttttttcatttatttgagatagggttcctgtcacccaggctggagtgcagtggtgtgatctcagttcactgcagccttgacctttcaagctcaagcgatgttcctgcctcagtctcctgagtagctgggaccacaggtacatgccactgtttccagctaatatatatatatatatttgagacagggtcgcattatgttgcccaggctggtctcaaactcctgggctcaagcaatcctcccgccttggcttcccaaagtgctgggattgcaggcgtgagccacggtgcctggccagttttttatttagactgatcaacgatggcagtttggcttcctccatctttttaacataagaacaacatcaatatgagaaaaaacagataagagctcattttggtggatttagttttgtatccacatctcctacaagttctatttctaaatcagtttctgagaaatagaacccaggcttgcaaattgataagcctggaatttgtttaaatgtattctttggctctttatttttttcctcattataaaaatggaaaagaaagcatgtttgaattgcccttaatacccctttctaacacagttatttttattatcatgtattgtttccccgtcctcatctgtactcctacattttttttaaacaaaggaattttattgcctttccaaaaaagttgtactagtttataatgtcaccagcattgcatataagagtgctaattaaaatgttgcaaaattcagtgtcaatgttttttctataatgagtataaaaaggataactattggccaggcacagtggctcatgcctgtaatctaagcactttgggaggccgaggcaggtgggtcacctgaggtcaggagtttgagacaagcctggtcaacgtggtgaaaccctgtctctactaaaaatccaaaaattatccgagcatggtggcaggtgcctgtaatcccacctactcgggaggctgaggcaggagaatcgcttgaacctaggaggcagaggttgcagtgagccaagattgtgccgctgcactccagcctgggtgacagagtgagactgtctcaaaaataaaaataataataaaataacgatttcaaggattttagcatatctttgctaacaatgatgagcctctttcttcttataatgatttttttttttggatatgaattatccatattttctaatgcatttgtattttaaaactttttaagatactggccattagtatttggtctggatttttttgagaagtaaaggctttgtcaccctctgaggctaaaacagactaaagacttttctcagtattgttcctcccttacacaaaactgttttcccccttattcacaagtatttttgtttttacgtacaggcaatcttgagcagtagcaagtaaagattgtctaaaactgtcaagtccacaaccatcaaatgtttgcaaggatatgaaacaaggagaacttgttagtcactgcaaatgagagtataggttggttcaggtaccttgaaaatctagtcaagccaaagtttcacctgccctctgactcagcagttgtactccagctctgtgtgcaaggagatgtgctggaatgtcacagcatcgtattgcaaagagcatattggcaacagcttggatggccagcagaaggagcccaaatgtgtgattcatattcactagtcgaataattgaatactacaatatacaccatatatactacactgtatgtgttgttctatactatagtgattgactcgaactccattcagtgaaaaaaatggaagaattagctatttgtatccatatgggatacaaaaaagcagggtaacaaaagaatctacatcatcttgccatttgcaggtaaagcttcttaaaaaaacaagagaaatgcaggaagaaatgcctaggaatgataagaccaactcggtggagggaaaggaggaaaaggccaatggggtggcacacacagggctaactgggcactttatacccttctttatatccaaaatattttatggtgaatttcttttagagggttgacaagcacctgtgggtacctgatctgttttaatcatcctcatgctaacaaaattcttcagtagatataacctaaattttttttctctttcatcttggttttaaaatgtcttcccccttttattctctggagaaatagaagatatccttgatcatactacttctctgttttattcattttggtagtcgcctaagatggttttaatgcatatggcattatctgaactgttccctgttacctcatttgctcaggcatctgaagatgttgtgctttctcttcccctgcaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcattaataatatccacgtgtgccttcttactgaatgatggtcttgggagtctttgcaagagtattgagtagatctctgatattgtgttgaaaagctagctgctgagtaggctccaatgatgctatgctgatttaagtatagaagaactaatcagttcattgccatttcccatcttctggcagtatcaggcacatagatggtcaataaatgtttccagaaatgttgattaccatgttcagattatgcattcacatgcacttaatcttcttaggtatcactttttaagcagaaactcctcttttatgtaatctttaccaaaaaccttcccagtttgtacttgtttttgtggtaagtagttgcagggtgctagtaataacaacagctaaatgagtgtttactgcaacacgtgcaggcactgtgcttgacacaccctggctgatgtgatccttacaacaatcctattagagaaggtgcttttgtacccatttatagatggagaaacaggctcagaagtgtaagtcactttcttaggattacacagccagttaatgcatcacgtttttgaggccagagttgggtctgtgacctcaaaggcgctacctcttagttacctcgcagtgcagcctcccattcatctctgacaaatggaagcttttaggtctgctgcatcaattcctgggacttcacattttcacatgccgtcaagcaatgctgtctacacgcttaataaataccttgtcttgagatgttctaacactttcctaactggactttccaccgccagtttacttcccactagagccaggctcttattgcctgaacttccctgtctcaagcctttgaggttttcccaaggcctgtaactagacccacagtcccctgccagaccctgaacctgttatctgcagctctagcctgcgctttcccttgcctgttctggctacacctgctctatgtccccatataactactagcctccctcaaaggtcacctgctctgcgtaacttccagctggttctctacctctactcccagggtactctgtattgtctctagagctctttgaattactctgcatggagtgtagtgtgtgtttctgtcaccaccactagataatgagggttctttacctctgtgtgccccacagcttctagcacaaggtctggcactacagaagcacttagaacattggtgtaattggattgacaggtagagccataactatcagagatggccatataggaagccttttaatttcttcctgttatgtcaggagccattgatttaaatgttaatgaaagtagaaagggcctaaacagaaaaaaagtcagcctcactagtgagggggaatgcaaattaaattgcagtgaaatgcaaatcaagctgaagtgagataccattttatacccactgtgagtggctactttttttttttctttgagacagggtcttgttctgtttcccaggctggagtgcagtggtgcgaacacagctcgctgcagcctctgaccttctgggctcaagccatcctcctacctcagcctcccaagtagctgggactacaggcatgcaccaccatgcccagctaattttttaagtttttgtggagattgggttttttgctctattgcccaggctggtcttgaactcctgggctcaagtgatcaccctgccttggcttcccaaagtgctaggattacaggcatgagccactgtcctagcctggatggttaattttatgtgtcaacttgactgggctaagggatgcccagagagctggtaaaatattcctggatgtttctgtgagggtgtttctgaaagagattaacactgattcgaatcaggagacagtaaagagggtcaccctcaccaatgtgggtaggcattgtctaatccttgaggcccaaatcaaacaaaaggcagaaaggtgaatttactctttgcccttgagcttggagatccatcttctcctgccctcagaccttgctgctctggttcttgggactttagactcagattaggacttgcacccttggttccctggtctcaggccttcaggtttggactgaaactccatgactcactctcctgggcctccagcctgcagatgggactgtgggacttttcaggctccataatcacatgagccaatccctcctaaaaatctctttccatattttatgtacacacatatgtataaaatccattgtttctgtggagagccctcatgcacccattgtatggcagatttaagagtgccagtatccagtgttgtcaaagacatggagcaactggaacacttattattattgctggtggggatgtaaattattcaatcacttcggaaaacagtgaagatcagcatatcaaacatttcgaaaatgatttgaaatttttttacatgttttaacaaagccagtttattttgtagttttaataaaaaaggtgccctttttgtccctggattcacttagcattcataattttttttaatacaatgaatttaaattgctaaaagatcatggactggctttctggttggatttcaggtaagatgtgtttaaggccagagctcttcctcaatatttgtttttttcccaatatttgatttttaaaatatacacatagatgctacatttatagcttctggcttaaaattctgtcatatgtcacgtctagccttttagtatggtaaatcatgttttacttctacttaaacattaataatttggagtatctgttactagtaatagtaattctataattgtataattgagttttgtacttaacacacataggtcattcctcatctatcatttgcacccagtgcagtttcatttttcagataccatgatgcaaaatagagtttttcatcatttaggtgtaagcaaaaaccccccaaaccaaaaaatgatactggccgttacccagtagaattaaacgcatggatagctcatgacccagctgttacacgcttaggtgaatacccagcacaaatgcactgtctacgtacctaaagacttgtacaggagtgttcataacactgttattaattgcaaaacaaaataaatcccaaaaacaaacgtggaagcagcccaaatatccatcaccatgagaatgggcaaatgagttgtggtgtgtccatgtaacagaagactaacagcaggatatatgtaacaaaatagatctaagaaacagtattgagtgaaaaagtcaaaggagtatgtgcaatatgatttcattatgtgtacagagaggcaaagctaagaaatacagtgtttagagataaaattgtaataccctaagggaaagcaagagaattcaaaatgatgatcataaaatagaagctagtagttaccaatgaaggggtagaacagtggatggtgtattagtctgttttcatgctgccgataaagacatacccgagactgggtaatttataaagaaaaaaggtttaatggactcacagttccacgtggcgggggaggcttcacaatcatggcagaaggcaaaaggcacgtcttacgtggcagcagacaagacagaatgagaaccaagtgaaggggatctacccttataaaaccatcaggcctcgtaagacttactcactgccacgagaacggtatgagggaagctgcccatgattcaattatctcccaccaggtccctcccgcaacgcgtgggaattaggggagctacaattaagatgagatttgggtggggccaaacaatagaagatgggattaggaaggggcaaccatgactgaaaggtcgctcaggacttgggcatttgtttatcagtattatctatctatctatatattttttatttggttctaccttaaactattaagggataatatctatatttttaataaactttttaaaacaagcagcttagaagaggtgggggtggagggtgcagcttggagtactggcagaatactaggtaataggaatatgtccatcaagttttcacatacagaaatagaccagactagaaagaaagatgctacagcagaaggcccttcctgaccatcacctaccatggttccaacatcagtctgaagtcgaggaatgggttaaacatgcactaaattttggggtaatttctgacacagcaatagataattaatacgtgggagttggagagggaggttacagaacaagtaggccaggccttataccccctttatatcacagcactcaacttttaacattttacaagattttatttaggaaaggaaaagggatgcattaagtttttaaatgtgaggttccgtagcaaggaagcagggtttccctgcagtacccttcctgctaatacacttcactgatgcgttgacacattgccttctgggcactttttttgtgccacaagatctcacaaggagctgagcagagcagactaggatgcttctgtgtcccttggccctcaaagtgagcatggtcttaccagtgaacgtcctttagtacagttgttcatctatccagcactatttcatagtatttgagattggaaagggaggtcagctcctccaagtctgtttgcagatgcagaaactgagagctaaataggcaaagctaccgagtcaacatcaagttcaaggttaaacagccaaacacagaagccagttttaacttccagttatctatttttccacgccaccatcctgcccatcatcatctttgtagattctcctacattcttaaacacacccagccacgtaagcacacttttgattgcagtgcaattgaagagcgtgaagaaagcatacattgcttataaaaaaaaaaaagccgacaggtccttggccctgcagtccacatgtggtaggtatgcgggaaacacatcctacagacctcaagtgaggcatcagaagtccttgccattggcttccttttgtgtatgatggtgataccctcttgtatgtcgggaaaatgaggtagaacctgcctaataattgcaaaagcaaacagtctgggtgagtgtgtgctaagtcagcagagtcaaggaagaaaattatggactatcctttatgtccagagcacagcggacacaaaatgaagaaacacaatctagggtgagtgtggtcaggtaaggtgggtgagtgtaaaagaattgttattccttcatttcttcaacaaatactatgcaccaggcacctttctaggcagtagagctgagcagtgaacaaacatcagacatcctcatcctgaaaggcttatgttatagtggaggtaaacaggcaaaactaacacaaataagtaaactatatagaagttagtgccatggagaaaaatctaagcagaggcggggttagggctgtggggcataggcagtggaattttaattaaggtggtcagggaagacctcagtgagaaggtgacatttggcttcttctatcaagcagatatctggggaaaagcgcattccaggcacagaggtcagcaagtgcaaaggcctgaggcagcacatgtctgggaggttggaggaatgtccagtacggtggagttgagtggggaaaggagtcaaggttggagacagaacagggagagaggggcaggtggttgggatcttgttgcactggcaccattgggagccactggagggctctgagcagaggaggggtgtgcttctaacttacaggttctcaggagcactctggggctgggctgagggcagcctgagggtgaggaaagggtggaaggtgggagcccagcagggaggccgctgtagtaatctaagggagagaagatgatgcctaagccatggtagtagcagtggatggacattctgacctaatttgagagtagaatttatggttaaattggatgtggggtgggggagagagaggagttaaggatgactccagagttttggacttgaagaattggaaggactgaggttggaggtgtcatttcactgaggtggggaaactataggaagatgggtgggaattatcagatgcttgggttttgggcactgagtttgagatgcttatgagacgtctgagtagagatggtgagtgggcagttggacatgagtcgggagttccagaatgaagtccaggatacagttaaacaaatgtcacagcatcagcccagaagggtgtttaaggtctcaagaatgatgaagtgtaccacagggcatgaatgcttatagaaaagagataagctctgctgggaacctgcagctataggaggggcccacactggaacagagctgcctgaggattccctggggatcctggggaccctgtccatgatgagggatggtgaggtttagatctagaaacacaggggcgaggaaaggacgctccaggcagacccctggcaagcgaaagcatggatgtagtccaggttcggggcttggaggggcatggagacagaaagagaagcgctcaaacgcaggccaacgctgggcaccgttctggggcagtgggaagcagagaaggcacacggggacagggctgggatgagattgaggcttccggccgcaaaatccaaggaggcacacgctctcccagagcaagatcggtcctttaacagcactgagagttcagtttcctattccctcaccctaagcctggccctgcagaaccaataaacagctgggctctgagcagattaaattcccaagccacacaggtttgaatcccagcagcgcagtttttgccaagttatctgtgcttaacctcacttggcctcagtttcctcttctgtaaaataggagcagtaattgtatgcttcaggccaacagataagccactttttaggcttctgttgttgaactgcctgtcccgagcttgggggtggggagaccaaagctttgtgtggaggctgctgtcttcccacctcctcttgcccccttggactcttctttggaagactagactttcccttgctttcccatcaacccagctctcagagcagctccaagtacactgttggtactttgtacatcattggaatgaaagaacactgtgaagtcccacaggtttcattctctttggtctcgtcttttccatggcaaccacctttttaaaggcttcctttatcttttgctctgatttgcaattgcctcctaaattgtctctttaaccttcctttccactctccattctgaccaaatcgtgtaataatagtcacattttcctcatatgcttacttcctgcatattagggttatgttgtaagtgctatgcacatagcaacatttaatcctcatggccactactcattctcaattggaagtcctggccaggcactcagtggggtccaccaatgagaagacaggaaggtgggtctggggctcaggagggaggagagtggaggactctgagtcaatatccacacacaaaaaagaatgacatccacaagatctgttagtgttgctaaggtagagaaggcgaggctgtttcatccccactaagtgccatgagcaaaaggcccagtgtttacaaaagcctttgaaaccattttgaaaatgctccagaatatgaaggaaaataactcaacagaagaaaattacaatggacaaatctttaaatgcctacatacttgccttatgccaatcaaatgcaattagatctgattcctgtatgtctgtaaatgaagtacattgaaagtgggaaagtgatgcatttcattatatctggaatgatgtgggctctggaagtacaagtgcgtagaggaataaaggccttaaaatggcccagagaagaaatgaaaagagaagaggcgttatactgaggagagctgcaggcagagaaagaactgcacatccaaaacgccctccacgcagtgactccactaatcttataagaactttagaactagtgttacactcacttttcttttttctttctttttttttttttttttttttttttgagatggagtttcactcttgttgcccaggctggagagcaatggcacaatctcggctcactgcaacctccgcctcctgggttcaaacaattctcctgcctcagcctcccaagtagctgggatcacaggcgtgtgccaccatgcccggctaattctgtatttttagtagagatggagtttcaccatgtttgtcaggctggtcttgaactcctgacctcaagtgatccacccgcctcagcctcccaaagtgctgggattataggcatgagccactgcgcccggccctacacccactttttagatgaaaaaagggaagttcagagtcagtcacttgcccaggctcacactgtgtggcttctgtggcatggggtgactccaaagcaaaagagaaggtgtgcctcctagtgtccatccctgtgaacagcaggcttccactttggtgttcagttttactggaacacactttgtttatgggcttgagtgaataaggtcacatagctaaaaaattttatagggcttgcaaatcaagggggatgggcaaacagtttagcagataattctgggaaaacttgtttgctatgtgtgtagctataaaactggatccctacctaacactggatgacaaagacagacttgaaacatattgaagacctaaatgtatgtggtacagccgtaaaatttatatggtacatataggaaaatacctctgtgacctagaggtgggtgagggtttcttaaaccatggtctcaagcacaaaccaaaaggcaaagcactgatgtgccagttgccccagaagttctgattcacgaagaccatcatggaaaaagtttaatagagagatgaccatgtgggaagggactgttctgtgtctgaaactgataaggaatttagacccaggtgacttcaaggaactctggcgaatcaacaagaagacaggaaccacaaaagaaaatgggcaaaggacattgaactgcttattcaccaaagataaaacccaaaagtcaaccaggataggagagctgtacaaacttgcgagtcattaagaaaggcaaattaaaataatgagagattgctttacagccatcagatttgcacacatcagaaagctggttaatgccaaatgatgagctaggcgaggggaccgtcaggccctgctggttggagaggagactgtttgctgctcagtgtttagacctcaagcactgtgtagcccatgacccagcaatacggctcttggctctcaaccccagagaaattctgtgtatccccaaggtaacgtgcacgaagacacccgttatggcaccgtgtgcagtgtggggaaattgaactccatcctgatgaccctcactggggaatagatgagtaggctgcggcagatgcaagatgatggagcggtacttggggagtactcatgacatgggtagaggcgagtggaaagaaaaagagaccgagccccctataaccgcttctgtgtactaaaaatgtatgcccatgaaaccatggtacatgttttacgagcagaatagcacacatgcaccgcatgagaggggccgtctatggagagggaaataggaagtgaatggaaataaagaggtgttgaagagaaagagcactgacccaggcaggctttcctacaagcagtggttacaagcccagcccctgcagcagggtaacttagcccccagtacctctgttttcttagcataaaatagagataataattgtgctcacctcccagagttgctgtgaggatcaagttaacacacacatgaagtgcttagaatagtgtggctggcacaaagggggtgctaggtgtataagggtgttcacagtgcttatattagtgaaaaatgaaaaataattgaaatatccaactgtgggagacagtttatccaaatgattggaaagatctaattgttcttctgtccttcttccctttgtctttttggtagtacaacctccccccgccccccccccaacctctacacatacatagattttagcaatgtgcttgggcacctagctatgtactgaatttcccagcctccatgatactaagttgctctgtggttaagctctgggatagaatggatgtgaaagtgttatgttccgtgtaagaaaaacacttgctctccactttctctttcccctgcatctgtgaatgacctgacacccactggagggctggaggccagccatgagcaagcagatgagtcaagaagcaagcagatgctgagcaacaagttggaaggaaccagggccctgatgacccacaccctgtagcatcctccacccccacctccatctgctgggtgggaaagaacaaacgtcttacgtagactactctttgaagacactgaattttgggtctctgacatagctgcttagtctgtactccaactaatatagccatttaaatcttgtttttcagaaagtagttaatgatatgagaaaaaagcttatagtgtatacctcagtggaaaaaaattggtatataaaaactagatttttttagggcagcgaaactactctgtgtgatactccaatgggggatccatgtcattacacatttgcgcaaacgcatagaatgtgcagcaccaggagtggcccctaatgtaaactctggactttgggtgatagtgatgtatcagtgtaggtttgtcaattgtaacaaatagaccactttgataggtgaagttgatagtgggggaggctgtgcatgtatgtgggcagggagtatatagaagtctccgtaccttctgctcagtattgctgtggtcttaaaacttctctaaaaaagaaagtctattttaaaaactacataggtgtctaccaaatgtataagactcacattttttctgtggtgtggcctcagccttctcaaggcttgctgagaagcaaggcacacatttatttgaaggtagtgcctggaacttggagcttttatctcccagtgaacatctctctgccagatgctcgggtaggtttctccaaagttcaactgggtaggagagtcacatgatccttccaaccaatgaatgagcaggaatccagtggctttaggaaaatcaaacctgttattatgtaagtgacgatcagtggtatatacagtgactatttgtggcagttgcatgcatttctgagtgtgtttttattttgcccttttgaaattaatctcagaattgttctgtgccatggtaaagttgtctcatcattttggaattcaacacagctcctaaagctgttgataagaattgtacgtgcttctgagttatgtgggctgatttcgacggtctgcttatgaggtaggaggtgggactctattctagaggcagggctcaaactccagaccagattggagactggctgaaacaggggaggggcaaaagcacctctccatatgacacacccaccagtgccatgccagtttaccattgccatggcaacacctggaagttaccattccttttctagaaatttctgaataacctgcctcttaatttgcatgtaataaaaagtgggtataaatatgactgcagaacgacctctgagcttctactctgagcacactgcctgtggggtagcctgctctgtgggagcagacatggagctgtaacattgctgcctcagtaaagctgttttcttctaccactggcttgctcttgaattctttcctgagtgaagccaagaaccttcctgggctaagccccaatttcagggcttgcctgtcctgcctcacacactctcctgaaatctgaatttagttatagagagtgatatgtgactctctgtaaactttgttcattagattcatgaggtgttgtatctgagaacgatatcattaattgtatttataatgaaattcattcatgcataagtgttcatgttttatgcataactattaaatgctgctgctggagagatcagtgctgtgctgagacagggagttttgagtcactgctttgtttctgcagcttctcctctcctttactgaggctcacaccctgggctcacaggcacacacgtatgtgtgttgtacacacctgcacccacgccccccatgcagcatggggagggacggcatccaggtgatacgttctttctggatgcaaatacacatcagttatgacctgacctgaaccgccattcccttggatgtagcaatagagacagagaggccccaaacgcttctgagcctttttggtcagggtctctgcctccaactgggtctttctgtccttcctaggtgaagaagggaaattgtcaggggctgctcttaagcagggggcctggatctaaacggaagaccttccaacctcccccactgcggagagcagaactgggagcagatgcccgtgggcttcgcagctcttggtctgtgtcatcacgtgcctcggtcatacattttgtcatcactgtatttactaacactgcacatcaaagcgattcctacttcttttaaatggaaacacatttattttaaaagacacccatagattgaaaccataaatggaaaccagtctgatttgccatacagactaatttttaaaataaatgcaaaaacacctatttctgtagcttgcatacgcataaggtatttctggaaggacatagaagaggtgcatagtgattacctgtggggagaagaacccacggctaggggcaggggtggggcccacttttaaggaacattcctgtgtatttccatttatactttttttggcttttggaattcaatcaaaacaaagaatttggggaagaaaagatgtgaaaacaaaacattggcattagattctggccagacgctgttgccagctgaagttgctaaacctgaggcttctctctgctgcggagcattcgtcagcagagggagatggtaaaggggctttcgcatccagttgaggtaacagaaaagctgacagctcgtgagggactctttcccaccctgcgatggtgctattcatgccgtctcagtttccatcttcagttgccctctctcccaggtctccgactcagggtttcccccacgaggccaccattgctccaggaacagaagttggaactgaaagcagtcttagaggcctccagccaaatattcctcacctggttcgctcactcccaaaggggtcccctgtgaagcctctgaaaccttatgcaaaatcctgtgctcaagtatattttccagggagatggtggctgatctctatcagagctccaaagagggccatgatgcctaaaagtccctatgggattcagaaaggagtgacatctccaaggatgcctggctcgtggtatcgctcagcatattgtttctagatgcacttgtgcattcatgatgaggaggaggatggatcttggagctggaggaaagatgccacaaggacccattctgtccagcacaaaaggagaagccttcccagccttaatgtccaaagggaggcatagaggctcagggaagctaagtgacttcaaggatgctaaggctccagtatttatacagtgatcaaatatcacacttgtacaaagcaatctcaggtggaaagacccactcctgaccatggggatgtgggactttctggcattgctaactgctcggggacagccaagatggcaatagtggctcatgttccagggcccctgtttcattgagggtgtttggattgtgctcttgcccaagtgttcagatgacttaaagattagaatgtgcagccaggtgcagtggctcacgcctgtaattccagcactttgggaggctgaggtgggcagatcacaaggtcagaagttcgagaccagcctggccaacatggtgaaaccccatctctactaaaaaaatacaaaaattagccaggcatggtgatgtgtgcctgtaatcccaactacttcggaggctgaggtgggagaattgcttgaacctaggaggcagaggttgcagtgagctgagattgcgccactgcactccagcatgggtgacagagcaagacttcatcttaaaaaaaaaaaaaaaaaagattagaatgtgcaccagatctaatttctccatctttttttttttttttttttttttagatggagtttcactcttgttgcccaggtcggagtgcaatggcacgatctcggctcaccgcaacctccgcctcccaggttcaagcaattctcctgcctcagcctcccgagtagctgggattacaggcatgcaccaccacgcccggctaattttttgtatttttagtagagacaggatttctccatgttgaggctggtctcgaactcctgacctcaggtgatccgcccgccttggcctcccaaagtgctgggattacaggcgtgagccaccgcgcccagcttctccatcatttttaaggttgtttctccactagaaagtggaaacctgggactgtgttttggccaacatgtttgttcacagccccagttcaagtgggaggttgaaggatcccttctttgattaattgacatattaactgtattggaatttctcaccttactgtaccagagcagtgatcctcaaccagggcaattttgcctggcaggggacatttagtgatgtctggaggcatgtttggttgtcacaactgggcacaggaattgggtgtttctcccagcatctaatgcgtggaggccaggatgctgctaaacatcctgcatggcacaggacagctccagcaacaaagacttttccagtccaggcccagcacggtggctcatgcccgtgatcccaccactttgggcggccaaggcaggaggattgcttgagcccaggggtttgcaacgagcctaggcaacatactgagaccccgtctccacaaaaaaattaaaaattaactgggcatggtgatgtacaccaatagtcccagctacttgggagggtgagatgagaggattgcttgagcccaggaggttgaggctgcagtgagccataatcatgccactgcactccagcctgggtgacagagtgagaccttgtctaaaaaacaaaaacaaacacaaaaaaagacttgtccagtccaaatgagaagcagtgctgaggctgagaaatgctgctgtcaagttgtttttttttttttttttgagacggagtctcgacctgtcactgtcacccaggctggagtgtagtggcgcgatctcggctcactgcaacctccacctcccgggttcaagcagttccttgcctcagcctcccgagtagctgagattacaggcgtcccccaccatgcccggcatatttttgaattttactagagacggggtttctccatgttggtcaggctggtctcgaactcctgacctcatgatccacccgcctcggcctcccaaagtgctgggattacaggcatgagccactgcgcccggcctctgtcaagtattaagaacttagactgtcaaagctgtttctaaagctatacacaaaaccccccatggaattctaaaaggacccacacctatggtattgggttgagtgtacaataattaggtgatttttggtaggttaacagaggctactagctgtcagaggtagtgaggtaagttactcccctaccttgctacttggttaaaatgtcactactcaattgacacataccagcaagaaggcccaaagcagtcattcaacctgtttgataaacccagaggaggcccaattctttgccctattaggtgctccacctggaccttggataaagggctcaccgaggcaaatgtccccacatcttctgaaccggcagctggactcaggccctttcatgaaccggatatatggcacaagccttaacaccagatctataccgtgttcccacagggatggggactggctctagaatattttagcttatccgcatacctgaaaatcacaaattttactaaagagagcccatttttagattccattctagtcattaaaaaggcactagtttatcaacaaaacccacttctaacatttattcttgctaaacagcaaaatctccagtgtagatcagagaggaagacagctgaagcacgcagccacccctctagggtgtggaccttgatgaaatgtatgctcctggttaggacagctgaccaccctgagggcagcttagatctaagtcacctttacatctccctatgtgggaagagtcttctttttttcttttttttttttttttttttgttgagacagagttttgctgctgttacccaggctggagtgcaatggcgtgatcttggctcaccacaacctctgcctcccaggttcaagcaattctcctgcctcagcctccagagtagctgggattacaggcatgcgtcaccacgcctggctaattttgtatttttagtagagatggggtttctccatgttggtcaggctggtctcgaactcctgacctcaggtgatctgcccgccttggcctcccaaagtgctgggattacaggcatgagccaccgcacctggcttttttttttttttttttttttgagatggagtcttgctcggtcgacctggctggaatgcagtggcacgatctcagctcactgcaatgtccacctcccggttcaagtgattcttatgcctcagcctccaaagtagctgggattacaggcgcccaccaccacgcctggctaatttttgtatatatatatttttttttttttgagacagtgtctcacctctcgcccaggctggagtgcagtggcgcaatctcggctcacagcaacctccgcctcccaggttcaaatgattctcctgcttcagtctcccaagtagctgagattacaggcacccgccaccatgcccagctaattttttgtatttttagtagagacagggtttcactatgttggccaggctggtctcaaactcctgaccttgtgatccacccaccttggcctcccaaagtgctgggattacaggcatgagccaccgcgcccggcctaatttttgtatttttagtagagacggagtttcaccatattggccaggctggtcccaaactcctgacctcaggtgatctgcctgcctcggcctcccaaagtgctgggattacaggcgtgagccactatgcccggcactatgtgggaagattctaaagtgcattccagaggacagggctcctggctggtctgcgtcttgtctagaggcagcctgggaatccggatgaagacgagtgggcagggcctgcagagaatccaagtgcatgagggcttgggcgaaagcagcgtccgggaagggaggccaggcggagcattgcagcatcttccagccctacaggcatgcgttccagggattgtgaacctaagccagggacatagtcatgaagagctattccctgcatccactgtggcttcaccccaggagggcaccgaaggagtaacactggtgctcagcaggctctccccatgtcacagaggatttggtgatcaaagccagtgtccctcagaatttttcttcacagtgctgatcatggtgggtgtgatggttaattttaggtgtcagcctgactgggctcagggatgccgaggtagctgataaaacatgatgcctgggtgtgtctgtgagggtgtttctggaggagattagcattttttcttttttcatctcttaaattcctttaccaagacattagcatttgaattaatctgggtgaagatccaccctcaccaatgcaggaggcaccatcccatctgttgagggcctgaatagaagaaaaaggtggaggaagggcgaatttgttctctctttggggcctgggatatccatcatcttgtcctaccttggacattggagctcctgattcgtagaacttcaggctctggacttacaccagtgacctcccctgcccacttgccatgggcttccctggttctgaagctctcagacttggcctgaattacaccaccagctttcctggctctccagctggcaggtggaagatggtgggacgtctcagcttccataaccatctgagccaattcccatagtaaatctcctatctatcatctatatatctatctatctatcatctatctgcctatctgtctatctatctatcatcatctatctatctatttacctgtcatctatcatctatctcctgtttctctggggaaccctgcctaatacagtgggattatttgagtaacaactttctcctcaacctggctggacgatccaaaatgatcagggccacgtctgttggacagtgagagcatttaggggagcatgcagcccggagtccaggttgaatcctggatctgccacttactagctgtgtgaccttgaaaaaaaagactgagcttcactgtgccccgaatcctccataaaatgaaaataatagtagcatctgctttagagagtgggtatgtagattagatgagatcatacttacaaagcacttagcacagtgcttggccatactaagaacttgaaaatgctaattgttattattattatttacctctatgcatatctcaaggtccaaaacaaaagctaagtcagaaaaggaggaaaaaatgccagatgccgggagaacatgccagcttctggagtgagatgcggagattgggggattagcaggaagaagaaagagccactgaaaccacccagttatccctgcatttatttatccaaagaccatcactgaaggtcttctacttccaagccccacctgggcttccagcctaataggagaaacaaaccttaaacaaacaatggtgcataaatcatgatttcattacaattgtgatgagtgaggcaacatacggtacagaggacttaagaatattttaacaggaaaatcaccatagcccagggctggaggttgggaactggggaactggggataagaatccagaaaaccaccctgcccagcatgcagaagggagttaatggagaagtcttgctgggtcggcctgtaagggatgagtccacacaagcatttacacaggcagaaggagggcaaggtcattacatcccttttggacacagtaaatgtccagttgtccttttccctgccactgtatagtaagatggtggtcaggacctgggggtgccaatgactgatctcaaccatacctctaagctgagaagggaaaggtcactgattattacttaagccagacttaaagaacagtcccaaagcttctgacagccaagacaatgtcctcttcgctttcaatgacaaaggcccaactgagtaacatatgaacattgagggagccaactgcacacagacacttggaccactgacccagggaaactccttaactgcttgaatgaagtaccagtcattcatggtcaatagattcttctgctgcatggaatttctgctgggctggtggaggcagctgagaaataatggggagaggccaggacaaagcatggaaaaacttcagttacgttttgttggttaacaatgggaccttcaacaagacactcattggcttgggtctcactttcttcatctgaataatggagataataacacctaagtaggcacgttcctggctttaagtaacaaacacccactaacaggggcttaaacaaatatatgttcatttttctgacataaggagtcgcagccagttgggtgtggacattggagaagcatctcagtaatgtcagaggttttggatctgcttctttgcaattttctcattctttccctcatggtcacaaaatggctgctgtagttccagccatcaagtctgtatttagtaaggcagtaagaagagggggtgaaagataggactgcctctctaccctttacacagccatcctggtgttgcctgacacacttttgcttttaactcattggccagatctctgtcctgggccatccctagctgcaagggaagctgacaaagtgagttttagcttttcttttctttttttttgagacagagtctcactctgttgcccaagctggagtgcagtggcgtgatctcagctcactgcaagctccgcctcctgggttcatgccattcccctgcctcagcctcccgaatagctgggactacaggcgtgtgccacctcacccagctaattttttgtgtttttagtagagacggggtttcaccatgttagccaggatggtcttgatctcctgacctcgtgatccgcctgccttggcctcccaaagtgctgggattacaggcgtgagccactgcgcctggccgagttttagcttttctaatctatagagcacatgaagagtgtctatctcagcatataaagcagagactccactaggcagtgaaggaaggtaggcaaaatggatgtgtgtttcatatctgtgccccacaccccatccagggtccgtctctccccagcagttgtcataaggactcattatcatttagccatcatgcagaatatcagagctgccaaaagggaaagcaaagtgaatcgtcctaaagcagcctgctttttcttttttctttttcttttcttttcttttttttttcctatttggaaggtttggatttgaagtaaatcatcattaagcagtctaagtatttcctttatttatttatttatttgtttatttatttattgagacaggatctcactctgccatccaggctcaaatgcagtggtgcaatctaggctcactgcagactcagcctcctcagctcaagtgatcctcccacctcggcctcctaagtagctggggctgcaggcacacaccaccacactggctaatttttgtatttttttgtagagagagggtttcaccacattgcccaggctggtcttgaactcctgggctcaggtgatcctcctgcttcagcctcccaaagtgctgggattacaggcatgagccaccacacattttgctttttaaagcatttactttaaaaatctcacctctttcaatcctcgttctgttcattgtttgctccaagttcgaggggcctgtcagttcttcctgcaaataaaatcagtgaacaaccctgtaggtacacttcaaggtatacaggggagcagagaatgccgcctgggtaggggcgagtgttacttcagcggcagggaaagcctctgtcaatatttgcgaggaagagacgtctccagaagtaagaaaggccacattatggaaatggcatgttttatgcagggagacacttgagaatcagggagagtcaataaaggggctaagaagggtcaagaacttgggtttgagaataaggcgagtctactagttgagaaggagaataaggcttcggtaagccagccccacctgccaccttgccacccctttttaggaaataagggacagttgccaggggctgttttgtgacataatctagaggtatttatgccaaaaggactgacggaaataccaccactgccaaccacgacagcatcctggttccctaaacggatgggcttctttgttttcctttgtcacaaggaattagaggaatgtggctacacccgcagcttctaacaccagctagcctgggttcacatcctggatgaatcacttactgtgtaacctcaggcatattgtttaacctctctgtgcctcagcatcctcagctggaaaatgggggtggcaatagcagcacctcccttgtgtggttgtcaggacaaaataagttaactcagggaagtaaggaaagttaattagtaaataagttaactctgggtaagtaaggtatcgaggacgggggctggcctctagaacgtgctgtgttagtgttggtgattcttacgtgtgaaccagcagcagatggaaggtctggccgttgagggatgctacttttttcctgacgatgactatgaacgtcttgtgtggtctaagacagcagtcctttttggcatcagggaccggtttcatggaggacgattttttccacggtcggggggtgaggggggtcaggatggttttgggatgaaactgttccacctcagatcatcagacattagttggattctcataagcagtacacaacttagatccctcgcatgcccagttcacgataaggttcatggtcccatgagaatctaatgccaccactgatctgacaggaggcggggctcagacgatgatgccagggataaggggcggctgtaaatacagatgaagcttcgctcacttgcccgcagtgactcgccccacttcctgctgtggggcccagttcctaacaggccacagagcggatgagtaccggtccacagcccagaggctggggaccccttgtctcagagacatcttgagaacctctttatttcctctttgttaatgcaagaagtggttttgaaagcaattcatgcattttcaggaaagaaggcaaaagagactagggaagggggtggggaaggcttaccaggtgctgtatacacgacaaagcagaaaggctgggaactacaactctggagtcagacacattttgggttgaactcagtcactgcccattagcatagtgatcctggagaagtcatctaccctcatgtgtgaaggagaaacaatgaatgctcctggaccctagagctgctcagaggatccaatagagcaaagatgtcaaaaggccagcgccatgcctggcacagaggaaggattcaatcagttaattcagccatgctgaagccaccatgatgtgacagaaaatcagcttgcagctgggggagcgggatttgcctcctgatcatctgccccggaatccaccaccttcctgaatggcagtcccagcagcgccagggtggaagcagatgctggctgaggagagaatcctgcccttccccgtccagccacttccagccgtctcccagcccctgggtgctgcacgggcagtaccaagacttccctggcccggaaggacctctgacaaggccctggaagcccagcagggccaggctgggctttgagaggagatgagtgttaggagtgcgtgtcaggtgggggaagggagctgtaagcagcagagactggccaaccttgcccatgagctttaggtctccatctatgtgtccatgcagaagggcccccagaggagagcagcatcccggcctctgtcaggagaggagagagttacccgatttaaggagctcaggagaaagagtgagtgtgctcagctcatccctcccctgtgggagccagctcccaccaagggtgaagagggtcaggccctggggttgggggtggatggaggtctgcagaggtcccccagcagcccctgtgaaggatgggcaaattcgtttgtgcactgcagtcttggcagccttgcacattgtccccagcttcccgttccccagcctacctctttttttttttgtttttgagacagggtctcactctgtcgcccaggctggagtgcagtggcgctgtctcggctcactgcaagctccgcctcccgggttcacaccgttctcctgcctcagcctcccgagtagctgggactacaggcgcccgccaccatgcccggctaatttttttgagtttttagtagaaatgaggtttcaccgtgttagccaggatggtctcgatctcctgacctcatgatctgcccgccttggcctcccaaagtgctgggattacaggcatgagccaccacgcccggcctcatccccagcctacctcttgtaaaaatgagctgccactttgctgtccatccctgggaccctggcaggctccatgagtaggcaagagaggggtgtggttcaccagccccacctccaacaatgtcgggaaactctgtgttccatctcctcctgaagctggcagccctcagtgtatactttctcagctgcaaatgctaccattttaaactcagaggattttaaaaaatatatttgagcctcacacaggaagacccaaaaattattaaaatatagaacatttagactgtggggcagagactgcatctgttctgttcacttacccctaggtcctaacatacatagtaggtacccaataaacataagcttagcaaatgactgaaaattaatttaagcagctcatatgtgaaaagagcatatacacaaagatgttcattgcagcattgtttataatggtagaaaattattttgtacaatctggttaagaaatctgtggtatatgaatgcaatgaaatggcatgctattattagaattaacaagaggactatcaaaccaggagaacaggtttacgggatgttgctaaatgaaatttaataatactgtgatttaaagaatgtaaacgtgtatatctacatagatgaagattgaaaggcccatttagagataaagtcattgctgtgtaaaattagcagcaattaagaaacacctttggtaatgttttacagtggattctagaatatgttttaaactcttttaaagaaacccctgcagtattttctaaacagatgagatggtggtttgctattttccagagtccattgagtgagctgtgaaaggccccattggatagggggcttctggaaatttccatctccccacctcctggtgggtagcaactcagagctggcaaaattattcttggcaaaggcaatctcatgtcagaaagagttctcagtgcaaagagcctttagcaacagaggtgctagaatctgtgtcggtgaagctttgcaaacagcagggattccacagaggccttttcaggcctttatttcccactctgtaccttctcctccttctttttttttttttttcccaagttttgtaaacatcccagggatgatttttgtactcccccaggtctgtgggagtcggatgagatggaaagaggcctcgcattgtccctgcagacctgtatcccttccggccacccctgctgccctcacactcccctcccaccacagcacccacctgtggtctgacagaggacaccacacctttgcccattctcacaccccctcccgctggacagcccctgtccttaatgaggcagcttgatgttttgtgggacctgctggtgtcctgcccagggaggggtgtgaggggtggtgggctggcctgctcctggaactgtagcatcaaactgttcaggctttcatttgcaacagccacacactgggacaccaaaataggtcccggcggagatgtgggtggggctggcctgggcttggccccacccaagtagggcgccagggagacagagtgccccagcaccaccaaggtgggcagaagccatgtggggccactgagagaaattccactgaggttcctgttgggccttccttccacccaaagttttggaccttctgcttgagtgaattatagtgggaattctgggctttggctttgggggctgccagatgagaagggtcttagtgttcaactggtcccacctggcactgcgggaaaagcagaagctgtcacctcccagctctgccatttactagcgcaagttgttgaaggccatcgattcaacgccatttaggtgtgtgctaagcgttacatacaccttatcctttgtcatctccacagctctggcatgggtgtactcttcagagatgacaaaactgaggcccagaaagggtgagtcactggcccagggtcacccagcttatcgtaggtgaagctaggatttaaacccagatctaattttcctcccaagcaggtgacttaatctttctcctgagctaccttctcgtgtcttcccgaagccaatttcccttgcaaagcagcagagcaacttgacattggtgcacatgttcccctccagaaatcccgcctgcaaaaactctgaaaatggaaagtttattcatgggaaaacttgccctgagctgccacaaggctcattgtggtcttgatttatctcacttattgtggacgttcacatgatttcctgaagaaatatgaatgagttagactgtggatctgttagacgttgctgggaatctgacagggtatgcagaaatcacactgtgtttctctaggaaatcctgaattctcaaacacatcaggtcccaagggattcagacaagggctgtggatctgtataaaatggtccactaatgctcacggcaggtggggggctgctcatacattcctcatagaaaatctttctgtaaggcaataactatcagcagtggttagcatgcacccgctctttgactcagcaattcctcttctaggaatttttcctaaggatttgaggataagaatattcattacagcagaaatctggtaccgccctaaaatctcaaagcagggaaatagttaagtaaagggtaatataccttccttagatggaacattatgtaaccattaaaaagggtgcttaaggctgacgtggtggctcacgcctataatcctagtgctttgggaggccaaggtgggaagattgcttgagcctaggagtgcaaggattcagtgagctgtgagtgcaccactgcgcccctgcctggatgggagaacaagaccctgtctcagaaaaaaataaaaaaggtgcttaatgtgtaagtttagtaatctggaaaaagtattcattatagctagtaagtgctggggggtgggggaagacacaaagttaccaaatagcatgtactatgtgacccaatttttgttaaaagggaaaaaaataaaatgacaacaaagaacactgtgacactgtgaatccgcttccactgctgaaaacaggtctcggttttgcaggtctctcttccacaaaaggcaggaccgggctaagaacagtagctggctgcactgctattgctctgccctgtaaaggataccttcagtccttatgtgactcaaagctggcctgtccccatcgctgcccctctgcgagggcaggggcgggaaggaggcctagattgccacagcagtgctacaatggattttagttacggccccttccatagcctgatttggggtcatttagggatattcatccacttatttaacaaacatgtgtcttatttaccagacactgtgttaaatgccaaggaggcagagatgagtaagacaggaggtggctagttataaattcctcggctgtgtcttattcatctctgcttgccttatttagggtagtaccaggcacctcctaggtaggggttccctaaacaaatgatgaatgaacagggtccctgtccttcgaaaactcacgggctaggaaagggaaactgatgagcaagtttgttatagcgttggtagtggcatgtcccggagggacacacaggaaggataatccattccagagggcagggtgaggggaagagtggagtgaattcagccttcattgctttcacaagcactctcttctggacggacgctcccattaagtctaacaaccaggctatttagcgcctcagagccgagagaatatgtgcaatgccattgaggagccaggacacagggctcttgtgttaggttcctaatgacggtgataaagaagacgatttaggcatctgactattgcatccagtatgttctctttccctttgctatctctcaagtcgaggcggcgaatggggagaggacccctgggggattcccaggtgcagccattttgtgtatggccattctgcttcctggttcatgacccaacaggaaggacacagctgggagggtcttgatcaagggcaggaccagagatgaggcagatctgggcactgatagatgacgataattaaaaaggtatgtaggtcgggcacagtggttcatgcctgtcattccaggactgtgggaggctgaggagtgaggattgcttgagccaaggagttcaagaccagcatgggcaacatagtgagacccccatctctaaaaagaaaaaaaatacaataattagctgggcatgttagtacacatctgtagtcctggctacttgggaagctgaggtgtgaggattgtttgaaaccaggaggttgaggttgcagtgagtggagattgtgccactgcactccagccttagtgacagagagagaccctatcaaaaaaaacaaaaacaaaaataaaaacaaagaaaacaaaattgactcattaaaattaatcatttaacaaatagttacaaagtacctaccctgtgctagaagctcagtcctggttcctcaacaatgaacagaagcatccaccctcctggggtggcctctccagtgagagccccgggcctcctcaagtgagaattcaatggaaagtgtagttttaggccgggatccctgaggaccccaggcactggggagtctgtctaagggaaaatgagtaggggacccagaaaggggaaggccaggggcagcctgcggcccccctgtgtcatcttcctcaccctgaaaagttccctcttgaccctttggaggtagccagagactgctgtctatccaccatccagaaaatccagccacctacagcttctgtaaccaccatgcgattacttccaatctctcaaatggggtttgcgggctcccctcctttcataattgtagctaacatcatcgagcactttctatatgcccagcactattctaagtgggtcacatgcagtaactcatgttcaattctcacaatatccccatgagatcagtcctgtgtcattcttatcatacccatttttcagatgagaacactgaggtacagaaagtagaaatagcttgttcaaggtcttacagctgataatctgtggagttaggacttgaagccagacagaccgaactcagcactcattctcctcccctctagactctgatgcctttgagaaggctataatacaagacacacagggtcctgtccctatggattacagtccaatggggacaacagagagtaaaccatagtgataccaatctgatgagtcttgtatggaaggaccaactggtcctggcttgcagagactttctggctttagcacagaaaacctcaaattctgggaacctcagtccttggcaaactagatggttgtactaacctagttgtgtgaaaagggaatcatgaagtactattatttctttgcctgattttgaaatttactaatttgacaggtgtcacatgggatttcactgctgtttttacattgcctttcttttgatcaccacggaggctgaacaatgttctcgatgctttttaaccagatttagtttgtagtttgtgaatcagtttctcctagaattcgtctgctgaggcagaggttctcagccttgagtgggcatcagaatcagaggagggcttctgaaaaagcagatctctgggtcgtatcctcagagtttctcattcagtaggtctggggtggggtctggggttgggcatttctttctttctttctttcttttttttttgagacatagtctcactcttttacccaggctggagtgcagtgatgtgatctcggctcactgcaatttccacctcctgggtccaagtgattctctcacctcagcctcccaagcagctgggattacaggcacatgccaccatgcccagctaatttttgtatttttagtagagacagggcttcaccaagttgaccaggctggtcttgaactcctgaaatcaggtgatcctcccacctcagcttcccaaagtgctggggttacaggcgtgaaccaacgcgcccggcctggggctgggcatttctaacaagctcccaggtgacactgaggctgccaactggtcaggaaccaaacctggagatgcgctgtatttgggtgttttttggaagctctccctttagtaaagtggttctcacatttgctaaatgtgcaccttagaatcacctgggcagtgttacaaaattcagatgctcaggccctaccctggaccagaggaagccagtcatggggagtggaacttgggctttgctagttcattacaaaatttctcaagtgatttcctcatctctgtagtgttaaaataaattaagatgaagaccagtgtgaagaatccctgagcagacaaagcccgttatgcttcataagtgaccttaatcttcttgatttgcaaacataagcaaaactgtatgcctttttcttttttctagcctgacttcactagctataacttctggcactatgctgaataagggtggacctcctggctgggcgtggtggctcacgcctgtaatcccagcactttgggaggcagaggcaggtggatcacaaggtcaggaaatcgagaccatcctggctaaaacggtgaaatcccgtctctactaaaaatacaaaaaaaaaaaaaaattagccgggcgtggtggcgggcgcctgtagtcccagctactcgggaggctgaggcaggagaacggtgtgaacccgggaggtggagcttgcagtgagccgagatcatgccactgcactccagcctgggtgacagagtgagactctgtctcaaaaaaaaaaaaaaaaaaaaaaagaatggacctcctggccttgtcactaattttgtgggggaaagcatttagtctttcaagcattaagtgtgttagctatagttttgtaagtttttttttttacaaatgggtgctgaattttgtcaaatgctttttctgcattaatttatatgatcatattatttctcttctttcacctgttaatatggtggattgcattgattgattttcaaatattcaactaccctttcatctgtggaataaactccagttggtcatcctgtacaatccttgagatatattgctgaattctatttgctaatattttgttaaggattttcatgtatatattcatgagggatattgatctgtaggttttttttactaccttggttttatttatttgtttgtttgtttttgagacagagtctctctctgttgctcaggctggagttcagtggcgcgatcttggctcagtgtaacctctgcctcccaggttcaagtgatgcttctgcctcagcctcctgagtaactgggattacaggcatgtgccgccatgcctggctaatttttgtatttttagtagagacaggatttcggcatcttggccaggctggtctcgaactgctgacctcaagtgatccgcccacctcggcctcccaaagtgctggaattacaggtgtgagccaccgtgcccagccagcagcctcaacctcttaagctcaagcagtcctctggcctcagcttcccgagtagctgggactacaggcacatgctaccatgcctggttaatttttgtaatttttatagagacagtgtctcactttgttgcccaggctggtcttgaacccctgggctcaagtcatcctcccactttgacctcccaaaatgctaggattacagatgtgagccactgtactcattcctatctgtggttttaatatcagggaaatactatcttcataaaatgaattggaaagtgttccctcctcttctattttctgaaagagaatgtagagagatggtgtgaattcctctttaaacatttggtagaattcttcagtgaaaccatctggatctggagacttcttttttgggagttttaaaattgcaaattcgatttccttaacagttgtaggcatactcaaattatctagttcacattgggtgagttgtagtcatttgtatttttcaaggaatcggtcctttttaactaagttgtcaaatgaatgtgtgttctcactagctttaaaaaattctcttccctccattagtttctctcacattgaaatgagatgctgattcctccacatgccttccctccctccagatcaatgacaaaacgcattctcctgtgccctaatccaggacagcattcttgacaggcagagcccaggatggggcagtcccgatgtaaacccacagtttcgaggaaccagttggccttggacctctctgaagagctctggaaccagaaggggctggcggtcctctaagtcaccttagcctacctggagagacctccgaggcgggaggtaggagctccgtccttaagggcaggtttgagaagtcaaaaacgctgggggccctgggtaccactaggtggcgctcaaaacatacagttgctcttggaggccaacagtggaccgaagaacctctgtttagctagatttggtctgtggggcatttgttctttaagtgagatgcactttagagtctagaagctgcaaggaccccacgagctctgggttggtggacttggtaatactttctctgacttccctactgacaaaggagggaaggcttgagaggtggtgctggttggaggctcctgcgagatgtcagaagcacctacctccgtgtgggctgctgagacaagcatgcc

SEQ ID NO: 453 - DNA, 51333 bp, Homo sapiens
cccattgtctcagcccaaaatctccttaagctgataagcaacttcagcaaagtctcaggatacaaaatcaatgtgcaaaaatcacaagcattcctatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcatgaaaatggccatactgcccaatgtaatttacagattcaatgccatccccatcaagctaccaatgcctttcttcacagaattggaaaaaactactttaaagttcatatggaaccaaaaaagagctcgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaaaaaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacagaatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccacaatgagataccatctcacaccagttagagtggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttggcccagccatcccattactgggtatatacccaaaggactataaatcatgctgctataaagacacatgcacacgtatgtttattgcggcattattcacaataggaaagacttggaaccaacccaaatgtccaacaatgatagactggattaaaaaaatgtggcacatatacaccatggaatactatgcagccataaaaaatgatgcgttcatgtcctttgtagagacatggatgaaattggaaaccatcattctcagtaaactattgcaagaagaaaaaaccaaacaccgcatattctcactcgtaggtgggaattgaacaatgagatcacatggacacaggaaggggaacatcacactctggggactgttgtggggtggggggaggggggagggatagcattgggagatatacctaatgctagatgacgagttagtgggtacagcacaccagcatggcacatgtatacgtatgtaactaacctgcacaatgtgcacatgtaccctaaaacttaaagtataataataaaaaataaataaataaataaataaaaagaaaaaaaatccaatatcacaaagaaaaagcaagtagaaggcgtatgattaaaatagattaaagatacataatttaaagcaatgcataaatttttattgctttctggttttgaaagatagcaatatgacatttggagaaaatggggaggatttgaatatgacttgaatgatagatgatattaagaaattattgtcaatttttttagaagttagagggatattgttgctatatgtgtaaatgtccttattctaggacctgtattctaaagtttttaggagtgaagtagcatgctgtctctaacttatttaaacagttcaaatatatatatatatatttaaatttgtgtctgtacatgtgtagagaaaagagagatggtatatttgggaaaatgttaatagatgttgataagatttgtgaatttatcttcactgtatttttttaatttttctgtttgtaatttttcatgacagtgagagaaatttctacttttgtaaaagactgattgcagcattaaagattgtgtagtttttttatttcaaaaaatatatatatatatatctccaaagattttcagtctaaaatcgggtagaattatggcagaaatatatgtttttgttgttgacatttcatttttcatgataggaaaaaacatgctattttttttgggaggggcagggagaaacattcattttatagcaagttaggtgggaaaaagcacctggggacaaaggaaaagcaataggtttccaccttgatgatccaaaagtgagttatgaaggctcatagaatgatcatcatcagaattgttaggaacctcagaaaaataagtccaaatcccttattttttaggcaaacaacagggacctgatgattgcagagactattttttcatttttatttttatgggcacatagtaggcatgtatatttttgggacacatgagatattttaatacaggcatacaatgcatgataatcacatcagtgtaaatgggtatccatcaccgaaaacctttatcatttcattccaattattctcttttagttattttaaaaatgtatgataaattattgttgactgtagtcaccctgttatactatcagatgcaaaatcttatttattttatctaactatatttttgtacccattaatcatccctctcatttccccaccaccaccccgactacccttcctggcctctggtaaccatcattctactctttacagagacgttttaaaaatttaatcaggacttcaggtagagaaagaaaaggcacctttccccttcttcactgtgcaaatcacaacatcctctgttttaagcagctctggctactatagcaaaataccatagactgagtggcttattaaaaaaaccagaaatttatttctcactgtcgtggaggctggaagtccaagaccaaggtgccagcatggttgagttctggtgagagccctcttcttggttgcaaaagggtacttctgtgtcctcacatggtggaaagaaggcaagacaattagttctctggggcctcttttgtaagggcacgaataccattcatgaaggatccttatgacctaatcaactcgcaaaggctcagcctaataccatcacattgggggtttggatttaaacatatgaatttcgggagaacacaaacattccttccattgcatcctccttccaacactgactcccacaactcatactgcacctactactaaatccactactttgaatttggatgggtgctggcaggagggactgagggggatcggagcgctaaaagggggcataagggagagggaagctgagacagtcagtacttgcagaacaggtgcttctcttttagatgtggaaattcaagccactgaaaaaaaatttagaagagacctgtggaacagtggacttctgggctgacccaagcacagactgtacacatcagacaatttggaaagcacctggcagtcactgtggagaaggatctctgatgtaaatattaagcagtagcattattactgtttatatttatagcatagtttctaaaaccagcagccaaagagttcagcggaactatttgagaatgaaggcaggaaatcaacttgtaagcatcatcaaaactttgtcagtttcctcttcctcttttaggctgacaacatggtttttgaaaggatgagaaagcacttagagcggttaggtactccagatgttagatcacctgctccaagatttcagctgagacttgcaaatttgtttcatctaaatttcttaagctagtttcaagccttggtccctgaggcagaattgaagactataaaaataacccccggtacaactcccaggctggaagacagatgctgcaggcagaagtgatttccatagttagaactgcttctactttggggctgccccagaatttccggaaatgattaaggagatctgagggaccacagagatcagcaggagcagttttttttcatttccctgaagtatgttttgggtatgttggtggatgatgggaagggtttgtgggacagttgccaatggcaccaggaagcaaggagccagctcccaagtcagtgctgcctggtgtgagaataccccatggctcccttctgcatggacaggcctggggttgagtgtaccggtgactgggaaacaccacaactccctctgccccgctctgcgagcagtcacacacttgcagctcaggaaagaactccagtaggtgttttcatcttccttggagcaatgagtgttcatgtcccatgcgcagctgtaatctacaagcatgtcaagtggggtgtgtgtgtgtgtgtgtgtgtgtgtgtgtgtgtgtgtgtgtcatgggagagatagctcatgtcatctgaggacactttgttccaactttggccttactttgttcttgtgtcaaaatgtatggtctaagaccccaaaacaccacctggtgaagatttatcccctaaccttagggaccttctgtacagtagcacatcagtaatttgcagaaaatattgtgagcccttgatccaaagggagcagaagtccgactccttccttgtcacctatcctctctctctcctccagtagcttgctgccggtccactgatgatgctcacctgcaggactcagcccacccaatttctacctggatcttgtactggggtgtgggtgccccccgcaggattgcttcccccaggggtctgtgctgaggtacaagatcaccagacttacctagggcaaatgaaagaagtacagccaggcaggatctgaactgtattgaccagggaagtgaaagtcaaaactgtagaggtggttccaagcatcaagtttggtgaaggatgaggtgagatgtcaacagcaagatgcatcagcagagcagaaggaagaaggaagcagaacccaaggcagcttgaggcaagttgaccagaagagaggatatgaaatggatggacgtgtcagaggtccatttctacttgacggagacaaatcctcaaggaggtaggagggagcgggtggttggtaaaccaattccttccataagcagctgcatcaacagcttccatcttgccccttgttgggtttggagttgaatcaggctcccagtcccagaactcgggggcatgactgtggactgtttcagctcccatgaagacccttggactctcctggctgccaagtagatccaggacttttctactggaagcaagctctgatattcaaatcttagctctcccagtgcctaagtggacccaggccatacgatggtcttctgtctaaacatcccctctaattctgagcctttgtgcttagtgtccagcaactccagccagcctcaacagggccctcctgtgatactcgacttccccattccctggggactggattctgcatttgatgacctgacttctgggacgtgtctttctgtataatttcaggttgagagtctttggctctatctcaatgactcctgagtaaatggcaagaatttcctgcaactgttcctcactcttctgttgggcagcttccagaatgggataaaatcattatatagtcatctacaaggcctgagtatcctctctggctggcttttaattagtaaccccacccatgctggatttattgagtagatttttccccattctcctccatctgcatgttgttgaaagtttaggatgccttgggcccaagcccatccaggtgaagtaatttatagcctactttcatctacttctttttgtaagcacaggctccaagcctcctgagagctatatgtttttaatatttcatggatagtagaatgagtaaagttctagctgtctggggtttcttctttgtgaaatccagctatcccagttgtagactgtggagagagtatcaagttagattaaattttaagcagtatccacatgctagcacctggagagtttgccagtaactacaactgagagagtcatacaaggagaacttcccagcagctactctctgccttaaaatgtagagccatcctagaggattcattattttacctccttactcaacgagtcatttcacagggctcaggaatctataggagggttaacattcactccctaaatccaaagagccctatgggaatctcaaaaagggaaaatagtccatggaataaggcaggtatgtatctgcttctggcctgcgtgtgtggaggatgacagtaggccctgaatttacctttctgtgatggacaccccttaggttcttatggttcataaatccatacaatctactgtggaagagtttgaggaatgggttgatggaataactccgactgtaaacttgcctctctctctgctcactcaattacgtagaaataggctatcagccaacctcaactgttcagaatatgaccccaaaccagagactaccacaaagatagatgtacaatcactttataggtagggattccaattcttcagtgagtttattgtttttctttccagaataggtaagaatcttttttttatttatttcatctagagacacatctaccatattgcccaaagcacaactggcaggaaacagagatttttctggatgatactagcagaattaaaatgcttcttttggtaatgtccacctattaaaaaatgtcagtagcccactcactggagccatctagaaaaagttgtccccttccacagaatagcctttgctttttaaaagtaatgctttttttttttttttttctgtttacagacattgtaatttcctttgaaatattggaaagcagcaatcatgtggactgtagagtaagacgggccaggatggaatcccagtcaggcttctctgtgacctagagctcctgcagcccattaaccttcctttaattttctttaacactgggataacaaccagaaagccatagagctattgagaggagctaacacaggtaatctggctctaggaagactcaaggattacttgtggaatttaaacaaagtgaaccagatcttaatcccagtgtattttaattccaagtttggtttgtttctccctgatgagttaccaccaaccccaatgagattgacagaaaatgctctttggttacttattcttccaaatatcctttccttctctttaaaaaatataataacacatctgggatatattatatggtggtatatatttcagtctatgtttctgctaatgccttagtaaatagaaaacgcatgaatgttgactgctcaaatacagtagccgctagtcagcctcaagtgaggctgaatatgaagttaaacattgcaagagtaaaaataagtgggtctatcaaaagtggaacactatccccagtagtatctgaatcactttttataattaagataatgctcttaacctcctcctactgcttagaataaagaaagttataaaagtctatgatgttcttatttatatcaaaggagagtgtatcagttagcaacacttctggatgttaatatcagtacatttaactgacagtggattaaaccaacagaagagtattttgttattgttttcatattttcttaaacagaaaccttagtcgagggccagcatctctgtgattttcttggttttccctcatggttgtagaaagctgccctggaaccagacatcaagttcaaatccagctgaagagccaggagtaaagagacaggaccagccacgtgccacattttttttgtcagaaaagccagactcttcccagaaacaccgaacggagagaaacactaaacatctcatggccagagctgtgtaacagggccacccctatctgcaagggagactagaaaattgaggttttatctattccagcctctgtagtggggaaagacaagacagaaaggggtgggcatgggtgttgggttagccaatctctaatatcttccatcatgagtcttataaaagcctttgaaggctgaagcctattgcaaatctccctaaactaactctgaaaaacaacaaaggcatcatgctatggaggaaagaaggagaactttggaatagactcacaaaagtttagatcctggctcagtcacatactgagttcaatagccttctctttgaacctctactccctcacctgtaataatcttgcctcatagggttattgtgaagatgaaagaatgtgaaagcactctttttaatgctgattatccctctacccatgtatattagtatagcaaagataatggtggagggtagtggtagtgatggcagggggtgtcattcttctaggtacctaggctttcagacaatgttccaagaaagtcacaggaaataaataagtcgaggagtagtgaaaattccagttctgtcctgtccagaaaagccaggcccaccagtccatgataacctggacttctctcctttggtccttctttcatgtaggtcattatttcacagccagccacacacaacctcactgagtctcactcacctttgaatctccagcacgtggtgcacagtggtagattctcagggaatgtttaatgcacaggtgaatcccccagaagggcagattaattggaaaaaaacgaaggaagttggaattcaaccaaatatatttaataaagacaaagttgtttggggaattatccagcagctatttaataataactagataaagaattctaagaggaatattttaaggaatttcagaagatctaaaaagtatgcttccactgcatacttcccacatgcagtggaagcatactttttagatcttctgaaattgtcacagatctactaggaacgaaaaacaaaacccatgggctgtatttgcaaaaaaaactaagcaataaggcatattctcaaaccacaaaaatacagtgggtgagaggaaaatgccaataaccacaagatctgcattgattcactatatgtgctgaaggagcaaaggaatccacaggaccaccaaggacctgagaacaggagaaccccagacagcccatggatgttctctgagaagcacagaggggtagtctgggaacagcagctgacaccaacatgggcttggcccactggaataggggtgaatacaaggggtctacagaaaggactgaaaatcctggggtggtctaccccctatgacatcttgaaactggcagccagttcttcctttcaggacagggtctcacattgaggaaaaaatgctgggagtgaaatcaaatttagcaagatcaagacaagagtgatgaggtaagggaaattttagataaaagtggaggagaggaaaaaatcaaacacaatttcgtaactttcatgtatctttatgttttcaataccacatgaaaattacagaagagtgagttctataaagttagaaatattatgtgaagagaaccaccttctaaaaattagcagaactcaattctgctaattttccacagaaaacaatggaggtcaattctacaaaaagttattttaagagaaaatggactaagacgtatgcaacatccccatggacgatgaaaatttgccagaaagacatgccatagaggagatcaaaactataatctattattttaaaatgagtaaaagacattaagaaaagtatacaagacatgtaagaataaaatcaatcagaattggaaaaactcagaactcaaaaagtaattcagaataaaataaaatattttagaaatgaggactaaactataagaaacacacaacaaataaacaccatatgatgccttcagagaaggcgggaaaaatgagaaacttttaagaaattaaaaccaaatgaagagctgaaaagtactccagggaacgtgacaaacattgaagacaggtaaagaagatccaatatatgaacagcaggagtctcctatcaagaaaactaaaaccagggaacagaacaaattccaaaaactataattctagaaaacttttctaaaattaaataacatacaaaactacatattgaaagaaaatattgtgtacctgagagtaacaacagagactgaacaataatgagaaatattctagtaaaattgcttcttccagcagcagagggcttttgctttgtatcagaaatgaaacttgggtaagggagagttttctgcttgttccatggtgtcaactgatcatcaccatgcactcctgcagggtccagagtggataggctgctcctagcaattctgtgctgcctttgaatgttcacaaaccctgctctccttcaccgtggagaagcatgttctcagatctcctaccttctcccatctttctcgtgagtagtcagcggaggcccatggagaagatctgtttaataataactagataaagaattctaagaggaatattctaagaggaatttcgagtacacacagtctaagtacacacacacagagtctgagtacacacagacttcccctgtctctgggactcccagcagttctacaccatcacattagcccacacttacatttaagaagttgataaaattttggttgttcttacctattttatgcctgcctcctcctcctcccacattctgtctaaggtaaaacattttggatgtcccattccttctcagaaggaataatcagtctttggaattcagtttaccttgttatgttaagacctgaactctctgttggactaaaataataagattttgtaggtgctatgactttgttgttgttttaaggatgggaatgtattcttttatggccttctccatctatcttaaataaaagtgaaactccaacttctttttaaaaaagctacttttagtaattataattggtaatagcagtatgagtattgttattctgactattgtatgtgtggtgtgggataaagcaaatgagcaataatgggatattttaattatctccttcactgtgtccttgggaaccacggtatttggcatggaaaaagcagatacatatatgacatggaagggataattaaaatcctccagctctgaatttcgattggaaagactagtatgaacttacgattgatacatataaatatgtttatcaattctatttactaaaaacacctggaaacaatgactaatcaagttacaataagcaacggtagtgcccaaattatgatcttcaaatgttatttcctccagcaagaaaccagggttttttggagaaattgctgtttccaagtctgtggcaagaaacgtaatgacaactggtgatgtgtgtgtgtgtgtgtgtgtgtgtgtgtgtgtgtgcatgtgtgtgtctgcatgtgtgtagctgggggaggtgaacctaggacatcttatcctaccaaatagaaaggatgctactaaagactattaagggcaagtcaaaacagctcagctaccaaccttaagagctttccactggccaaagatgggacactttgagttcactaaagataagaatgtactgtatttaaactcaaaatgtttaaagtcatgagttcataatgacacattaaaaaaaatctaattggtcacttttagagagtgatagggaaacaacccattatcttgaaaacaggtaagtaatgagaaggaatcaagcatttgtcccaacttttatatacacacaactgggtagcaaaacaatagatgagagaaggatctctttatacattattccagctaaaaagtaaaatgtgacatagaattagaatgtcaccatttttaagcctcaatggctgtgatataacaaaaagagagacagccagtcatatgccatctaatgaaagaacatgccacttcctgtgatcttgtaacaataactgagtcaatgttttgttggtctctggatccacaggctgtgatcttcaggtaacacagaggacagagaaacaggtgctcatggtgtactcatgtgcaccatgaatacacaatcagcaaaatatagatagtgggaaattctacaggtcaaaccaccaaggatcttcaacaaataaattataagcaagagcaagggatggagggaaaatcagtagattaaaaggaaattaaaaacaacaaattttttttaaagtgaataagaatacacagtgctaaggatgtacacttgagtaaaaaaatataaagaaatataaggaagtgattactataatagtcaggatagtggttatttttggagagagggaggtgacatgttctgggatacctcacaaatatctatttcttaatctgagtgggtgttagtcttataattcactatctgtttgttttgtatgactttttatgtctgttttgttttacaataaaagtttttaaaaacctgtttgactttagcaaaacctcttgatcccattcccaaaatggtgaattgcacatatccacgtgtaaaaatgaaatacaacataaaattgcttaaaaaaataaatacgcaggaagtaagaatatattttagattgagttatatttccttaagtgcctttattaaaacccatttcataaaatcttttccttcctttaaaaatcctttcagaagattctatgcacctttattctagacttggcaagctaaatagctagaaagtatttcctttcctaagtccaaggaacatgcaatcttccatataatgaaaaatatgtattaaggcttccaattctccactcttttctttcatttgagtggggaaaatatgtgtagaaatgcacatattcacatatttacgaaagctctgtgaatgctgtaatagaaatgtggaagtgacattaaaagggaagccttcttcatgcaacatgcaaaagataatgtctttttcagcaagagttagagggtaatagagttttaccaaaagtttaaacacattaaaggatttcatttgccatctgagctgaaatgtcaaagccaaactgtgaacgcaatatagggatttttatcagtgattgaacttgctgacttctgaaaggggatcccaggccttcctaagtcttttgaagttccattctgctttgtcttcaaatgtctcgacataatcaggccattgatgccttgtgctgtcctgtgaacgcaagcatttgcccacaactccatttcagggctggagacaaggagaggttcagctccctttgacactgggtcggctggtcaggaagttctcaagtgtgcaggattgtgaacttttggcagaacagctgcccagtgggatgccagcgttttcaattcccatcagctcagggcttcaaaggctgggggcatctgtacccagtgacctgtgtggctggcctggacacatctctttcccatgggatgttgggggtagagaggccagattgacatgcctgacataacttcatttctcaaacttgagagccagaacatgtgcgagacccaccaaaatcaacaagttcacccctgggttgcactggtcactgaaggatcacctgcttttagaagcttcactttccatccacactgattatgatggtaatgctggcacacaccatgtatgcacattgttcctttaaatcatttcaacaactacatagtaatcattctttccatattacagataaggacaattcacccaagatcacacatataattagtggcagcactgggattcgaactcagacagctcaggcaccccaggtttgtttatttaaccaccaacctatagcacctatgactggagaatatacatatagatagccctgtacagggtactgctgactatagctactacttattcaacccctcaatatattgggcagtagaccaagctttacaaacatttcatttaattatacaaagtagatagagatagagatagatagagatatgtgtaatatacttgcagacactgatatagacagattccagtacagatgtatagacaacaacatagatacataaaggcctaattattacagccagactctgctcagactccctaaatttaatcccagatccactccagctgtttgactttgagcaattgatttagcagccctggtcgactcatctaaaaacacctcccttacaggaatacagtgaggattcaatgaaataatatatgtaaagcatatatagttcctgacaaaggataggcttccaataagttagacattactcttattattataatatatatataataatagagtatgttattcttattactattagatagacagatgatctactttctaaaacaattcagaaagcttggtaaagaagagaagtgttctccaaatttatctggctcgaagtttaaaaaaaagttatgctgagctgtttcatcccccaagcagatcaatattttggcaagaaagcaccaaagtaaattgatgaggctacagctgaaaataagcctgagacccctagcccctcatgctgcacaaaagcactgctctgagcaggacaggtgctaacgctcagggcagtgagcactcaactcgtggcaccataacaggtgctgtctgtctgaggactcaaaaaaggtccggtgacccactcatcacaatcgatctttcaggccctggatgctggtccttctacagtcaaatctatttctgtcctcatgggccctgcaaaaggatttagtatccaaatcccatttggtgttcaaataagacatcctcatgcaaggtggacttgacggaatgataatacaaacaaccgtagagggtattgagtcagtgctttggaccaggtgccgcattagacaccagatgatcataatgcaccagcattatgatcgccttgaggttccatacctactgagtagcagaggagtcctcaagctcatccactgctagggctcttgctgttaattcctgcattctactccatccttgttcatttccaaagtcttgtacactttatttctcccttcaccaccaatcctacttaaggaaagttatcagtctaagccagctgcttctatgggaattaaaaaactaaaaaaaatagcttacgtgtcaattatttctctcctctgtgtatccatagttcttggtacacagcttcagtacagcagggagctgaacatgatctctctccatcattagacagtgactctttgaaggcaagaaccttgtcttattcgtctttctaaccctagcccttagcatggtgcctggcatatagcagacccttaataaatatttgcagggtctgcaaatatttgaatatttgaatatttaattcaaatattcaataaatttgaattatgaattcaaataataatgaatgagtgaatgaatgagtggacagttggatgcatacgtgaataaatgattcaaataacctcattcttttttgttgaaaagtctgcactgagtctcaggttcttaaacagcaagaagcgattgagttgctacaacagttagcgcaatatctgatacagagttggtgcccaatacgttttattgaataaaaaatattaatatataattcagtccttaaggcagcataaatcacctggaagatctatttaaaaactatttgttcttccagttctgaaatctatcactaattaaaccaggttagcaagatgctgggggcctgggttgcacccaacgagagctccacagattggcttttatggcagtaggctctgctgggctggcgtcagcctgtactgaaggaggcttcaggctgatgacatttgccatcatgtcccctgtcaggctgctgtagaggacctcattcattacacacagagttgaggtcctgtctgatttcaatattaaaaatagttcttctgacaaactggtcagtttttatgtcatatacttggtgaattgtctatatttcccttattaccagtttgtaatgtaatatacttggtgaattgtgtatatttccctttttgttttggccgctaaaacatgaagtcgagtttgtagccaatcatagcaaaggaaaaggctttttgttatatacttttccaatgtcagtcttggctctctttcatttatgtactctaaattcctctttccttccttccttttttctttttccttctttctctctttcttttcttttccttttcttttctttcttctttccttttctttctttctgctactaataattttatgtctctttattatctatgaatgatggtaagccatcagggatcatcaatgaaactaacgaaatttaaaacagcttattttattgactaactacagatgaagcaaatgtattcagcaaatatattgttattcagatacacagtgatttttatcttccccttgtgtatttaatgtattcaggactagaaccatctctggaagtcaacagaggataaagacataaaatattaaataaaatatgatattttaacaagtctgttaatatcattccctgagcgttgggaggctgagttatgggaggatgatcttagctctttttctggctcatgggaggtagtcaccaaatgttcattgcaggaggaaaagaaaaggggacaagaaacacgaagaaagagaagaagggatagatgaacaaaggggggaatggagagggaaagaaggtcagtggagatgtaggggtggggaaacaaataactgaaggtacagaaaatgaactaacaattgaatttaccttattagctaaggccaatgtttggacctcagttgtctctgataggttatctggcagccagaaataagagggaaggtcagagttgttatcactgcacttatggctttttgctaaagaagatgatgtttctgtcctattcaatttcaatacgagctaagtcgtaaccaaattttagaaccaacaactcatacttcctgcttagaatgaaccttctcatcccataatttcctatcctgagaaatacaagacaaagcttttctctcctatttctacttaagtaaaaatctggccagtttttccaaaaagtaaacttcaaattaataaaactattttgaaaaacacttttattatatttatttttttcttagaataatggtaaacaaattcattgtaaaaatatggaggcaaaattgtattaaaattatataaaattgtctttaactgttgttagcattgtcagttattttcatccagtctcatttattttcacatatatggggtagacatatatagttatgtgtacactcagtcctgcatcctttttatgtttttaactatatatgttcctatttcaagaaaagtcctcaaaatttgatttttttttttttttcctgagacagagtctcgctctgtcgcccaggctggagtgcagtggtgtgatcttaggtcactgcaacctccacctcctggattcaagccattgtcctgcttcagcctcccaagtaactgggattataggtgtctgccaccatgcctggctaattttgtattttttagtacagacagggtttcaccatgttggccaggctggtctcaaactcctgacctcaagtgatccaccctcctcagcctcccaaagtgctgggattgcaggcgtgtgccactgcgcctgattcaaaatttaccttttcttaaatgtatgcatcatattacatttatggaaattccattatgtattttgtcttgttatggaatctttagatagtttccaaaggatgaatattctatacattttttcagttcctctaatcacaaggcactcaagtaataaagttgtggtattagtgttaacagaatcaaacatcatgtgggaatccaaaaaaaaaaaaaacagggaccacagtatggttgggatttacatagatcagaataggattcaggacagcttttgtggtagagattttagctgttcatattatttctggttcttttccttccaggaacttggtgtagcttgtatttctgtacttttccatcctcttgaggtcagacatggccatgtgacttattttagccaatggaatgtgagaggaagtgaaatgagccacacccacgtggaaatattaatttttccgtgttcatgattctcacccaggaaggattggctgctaataactcacagctctcctcttctccagagaattgccttaaccacctctctcagaggaattacatgatctccccaccctgagggacagacagctatgaatgactaacccagtagtataattcatgttcacaagctccccttgggaccaggctgaagctagtctagaggaatccatatctttgcttaatttgcttttactatactagcccatctgcctcattccccttctccaaaaataactccctcaataaatcactatcacaagattccagatctcaggctctgcttctagggacccatctaaatctcccttttttgggtgatgtggtaatgtgatcctgaagactcagttggaggacagcactatggagtgtggtcaggacactccatgaaagtaaacctttgtgttatcaatacatgcagacttggagatctatgagtctctcctgacaaacagaatactggaagtagttcccccataacaggagtttctagatctagatttgtgtgtctcacttcactcatggcaaaccagctccctcttccttttctcttccctttacctactctacacaatcaaatgcctcttagatccagattggttatgactccttatgctttttagtctactttctggatgctatttattgcatcagtttcagttttacgggcaacctcattttctctgtgttttccagttcagattcccaaaagaaaaaatctgattggcaaacctcatttccgggcctcaggcaagtctacatcctggctaactttgggtggagttagccatagcctaagtcatgaggcacatgacatggttgtttagtgttttcccagatttccctgaagtaaaatattctgacatgggtctataacttgaaattgggccatgaatccaataggaagagccaaatggctttcaatcttatgtggaacacttttctctttggattactcctttgtcttcgaagtcatattcaaattggtggcacagtcagtggggtctggggactccccttgtcgctgaaagggctgattccttccacaaaaggccaagtgggaaccagacatataaaaagccatagcacgccctgctgcaaacacgggcatgtgtcctgtgtaagcaaaagaagtcctcatagctcacatgatacggaagagcccagataaaggtttaggaataattcccaagcgtctaaagtgtgcttagtgcatctctcccttggggactgcattggcaattggtgtctgagaaaacactccaaggttagggaccctgtccaggtgccttttaccagagatgtcagtaacaatcgttgtcatgtacatacatatactggtccatttgttccatcattcattgaacaaatatttgttgagcatcaaccatacatcaggtaccatttgacttcctgtggatatatcaattaacaaagcagatgaaatcttggctcttgtggcgtttaccttctatttcaggagatgctcaacaggcaaacatggaagtcttatgtcagttaatgataatgactatacaagaattcaggcagggtgaggggactgagagtgatggggttaggggtgatagtctagataggatggtcagagaaggcctcattaggaaaatgatatgtgagcaggcttcagtgaagtgagggagggattcggtaaaagatctggaaatgcaaggatccaggcagagaaacagaagatacaaatgcttggctggaaaaactgtgaagtggaagcataggaggcagaacaaaaggcctgtgtgaaggtcctgaggcaggaaagtacttggcacagtcaaggatcctaaggccagcacctctgagtgcagcccagagaatcaaagaagcaataagtgagaggtgctcatcagtgataggcagggccagaagactctgtaggccctttgtagtttccattacagatttcatgttctatcctacatgaaatggaaactggtaagataagccaaaagctattttttgcagttgagttcagagctaatggcttggtctgggggagaggagaggagaggagaggagaaacaatggaaatgggaaaatgtgtgtagggccaacgaacacttcaaatgtaggatggacagggcatggtgattgattgaaagtgagagagaggtgacaaaaatggctcccaggggtcattggactgctagctgggtggaggtgtcatttaccaagaagggggcctgtcaagcaggaaatagatttgggagaggatagagaccttagccaggtgtgtaaaccattataacagtgtagtatcattattattcatatttaataacaagtgaacagactcagaaaggttatttcacttgctcaagatcacacatctagtaagcagaggagcctactttcatacccaagtctacctgattgatgccaaaaactgttgtttctcacttcagttctcatacagcctcttaggaggaaagaagagaccagagcatcccatggagcataattaaaatagtgacacaggaaggccaatcagagaagtgccctgagtatcccctatatgggtcaagatagccacactgaggtcaaatgccaacacccagatttcccaagaccagctgtgccttccaagacctgaagtcaactgcctgtcccagtgattctggtcagaatggcttcttttctcaaaactttactgaaaactgttaacttagagctctggtacccgaatgtggtccctggacctgcagcatcaacatcatctgggaacttattagaatgcagaatctctggcacagcccagacctactgattagaaacgctgtggctggggcccagcaatctgtgtttttaagaaactttccagaagattctgatgtacactcaagcttgagaatcactgaattaaagcatctggtttcaactgatctaagtttctgcctctgtaaagcccttgcctgaagtgattgaggtataattccagtaacaggcaggggttgggctcatggggaagctattgctgaagttggataaaggctcaattttttcccctgtccaattctcttacataaattcctgtccaaaaaggaaattgctccccgccttttttgtaagaaaaaaaaatggggggggggggactgttgttttgtggcaaaaggaatgctttgctaattttaggaagatggcttcagttatagacaggaagtcttgaggggagggagactttgacttgaattttttaaaattgtgttcctttatgttttttctttagaaaaggaaaggcaacatgattaacaaacctcagctgactttagagttcaaagaaatctctgacttagaagacgaaccatatgggagccattcatagagtcccctcagtaacagttgaatacacgtagaaaacaatggccctcaagactttgctttgaacggagaatctttgcagtgtaaattgacttttggaagaagcagagcatctggcttcttggtaagatggatcctggagaatgctccacatccctgcctgctcagctccactcaccatggtgcacctcagattggtcccctcagggtatcatcctggtaaccacgtgctgaggagtgcctccaggattattgtttacagcaaacatggcagatcggccctttcacaagtgagaaaactgagacttacttaggaagaacatgggcctcttggatgataaaaaatggtgagccataggagttttagatattttatgtcatcaaattcttgaagagagaagtagtcttttttcatttcacagctaaggaaactgaagcctagaaagtagcagtaagttacccaaagtcactaagtcgggaaatgggggtacactgctcagaaccacagcctctgagaccaattcctacttgacaggtcagagaggagtgctttaaagtagccagtccaggagctaacatggacctcatattcatctccagaaaagtcaacgtttaaacataattgcttggttaaaattcaatttatcaatgtactagtcagcgttctccagaaaaacagtttttcagtcaatgatggaccacacatactatggtggtcccataagattataatggacctgaaaaactcccatcacctagtgatgttgttaccgggggtccttgctcccagagctcccaagatggtgtcggcggcttccaaaatggcagagggctccttccaagatggtggcaagccttatgttctctgacctggggttcttggcctcatgaattccaaggaatggaatcttgggccatgcggtgagtgttatagctctattagaagctgtgggtcacggaacagaaccgtggaacccagtgactagtgttcagctcaattaggatgaacctgggcacttagccatgcaggaacagtggcaagccttcagcccaattgggagcggcaatggatgccatgttggatcagaagcacagtggacatcctgtcggatctagaggggtggaagtcagcggcgggtctgcagtgggtctgctactgcggcaagtaacagtggtggatggtgagcgaaagctcagctccagccataacaaacacagaccagaagatagtgcagttgcaagatttaatagagtgaaaacagagctcccatacaaagggaggggacccaaagagggtagccgttgccggcttgaatgcctaggtttatatcctgatcattgtccctcccgctgtgctctcaggcaatagatgattggctatttctttacctcctgtttttgcctaattagcttttttagtgagctctctttactacctgattggtcgggtgtaagctaagttgcaagccccgtgtttaaaagtggatgtggtcaccttcccagctaggcttagggattcttagttggcctaggaaatccagctagtcctgtctctcaaggtcatagtctttgtaatgttgtagtgcaatgcattactcacgtgtctgtggtgatgcccatgtaaacaaacccactgcactgcagttgtattgaagtctagcacattcaattgtgcacagtacataatacttaataatgaaaaatgacgatttttaccagtttgtgtatttactgtatcactctaaaattattattttagagtgtattccttgtacttattttttttaaagttaattggaaatcagttgtggtcaggtccttcaggaaaggtattccggaagacggcattattatcttaggagttgacagctccgtgcatgttattgcccctgaagaccttccagtgggacaaggtgttggagtgaaagacagtgaaattgattatcctgaccttgtgtacgcataagctaatgtgtgtgtttatgtcttattttttaacaaaaagatttaaaaagtaaaaaattgtaaaaagcttatagaatagggacacaaagaaagaaaatatttttgtacagttgtacaatgtgtttgtgttttaagctaagtgttattataaaattaaaaaattaagtcataaagttaaaaagttatagtaattgaaggttaatttattactgcatttattgaagaaataatttttttataaatttaatgtagcctaagtgtacagtgtttacaaagcctaccgttatctacagtaatgtcctagggcttcacattcgctcaccactcactgactcacccagagcaacttgcagtcctgcaagcttcattcatggtaagtgtcctacacaggcatatcagttaccttttatactgtatttttactgtgactttttaatgtttagatacacaaatgcttaccactgtgttacagttgactacagtattcagtacagtcacatgctgcacaggtttgtaagcaacaggatatatcacatagcttaggtgtgtagtaggctatactatccaggtacacgctctgatgttcgcgcaatgatgaaatcacctaactacacatttctcagaatgtacccctgccattaagtgatgcttgactgtttcaatatacaagaagagattttttatgaaaattggcttacaagattagggaggccatgaaatcccaaaatatggcctctgcaagctatagaaccccagggcctctggtgtaagtccctgggataaaaaggctggagaatttggagttctgatgttcaaaggcagggaaagatggatgtccagctcaaggagaaagagagaattcctccttcctctgcctttttgttctatccaggccctggatggattggacgatgtccgcccacactgggagggccatctgctttactgagtccactgatgcagatgccaatctatttctgagacaagaattgtcaaattctcctgggctactcaaaaaccccaaccctgatcccctgaaaagtgtaaaagaaatgtgtcccctttctttttggcacagagccatgaccttgggctatcacctccatcccacagtgtgaggccctgtggggagaatcagaggcgatttggggagaagcttactacccacaagcatggcaccatcaggctcccttggcaagcctgaatcagactacaagtccagggagacaggcccattcaaaacaatctgctttatgtggatttaaactgctgtcccctgagggtatcttgattgctttgaccttctgtcagatttgacccacagtgaacgactgcgacctaaatgacagcctatcaccttctgcatagaaatatttgatgacatcccactgccttcaggatgagtccaagctggaatagaaattagaaattgtgaaatttacaagcagcaagaaatctacctctcaattgttaaagatttgcccattctctccttcatgattgatttgcttaaaacatccaccttcctaatgatgatgatgctgatgatgataatgatgataaaaatagaggaaaaaatcaatttaataaaacaacagtgctctagcagaaacttgaatataaaatggcttttactgggaagttctgactttttaggttgcaaggaacaaaatatctttttttaaaagaaatcaagtctgagtcaatcatctttgccatctccccatccctgggattggctcagaaataggcacgtgtctaagtcaggccaatgagacctcaggggatgttttgttggggcttctgaggaagaaactgttttgctcctaaggaagagctcctgaaagagatgctctctggtcccctggggttattgtgtgtggactgaggcagtcatctttttcctagctggaccccagaggaggacaaagtccagtgaattgcaaagaaatgacccaagatcacattgggtcttgtgatatgacctcttcccccactcaagtgtcactcacagctgtctggcatagtatgcctggcacagagtctggcactgtgaaagtgactcagcccaggaacaagaggatgagcaaatagatgccagctgaacctgaagatttctcaatgattttagtttgaactggtttaacctggtgcaggtaatatgcttcccagactgaagttcagggaaatataaaccaaatttttgatgaagagacttgggtagcatgttggagagaagagtggcaagagagaatggagggaatgagtgcaacaggccctggtttggtacagtgcccagccagaatcacatgtgtgaggctgtccaggccacggacacagcgttgtcctccaggtttgtgcacactgagccagtgaggcgcttgcagggagtctggaggaagcgttagagctttattagcttaactactttaccacagcctagattgcatccaaacctgggttttcaacagcaagcttgcagtggctttccaaaagcttgaggcttgtgtttccttcagtcagaaggcaaactgtgccaggtacagctgagaaccagaaaacaaccatgtagattttgaaacttgcattggttgagaattttcatgactttctgctatatagacattcagccgcactgtagagataggttcaatccaacctgcaggaagcctggctctatctgaattagtggctgccttatcttaagggaacttcaaagtccaattgaaaaatgctgggctagattgaacttgagcactaatttagcttggactaagttgcttggcctttctgggcctatagacccctcatctacaaagcgaaagaaagaaaaaaaccaacactcagattctttgtgttgagaaatatcattacctgaaatgaaaatcccaacagcatttagagaacaaagagcatgggatccagggagagcctgggatctgagtcccagctctgccactcactaaatgtatgacctcatttaactcactatccagctctgaatctgtttcattatttctaaaatagagatcataaaacctatgttaaaattttagaaggattaaaaaagatgatataggcacaggcacagagtagttcatcaataacaattctataaatatttattgagcatatcctatatgctgtgtactatgctaacctccagaaagggagtggtgagtaaatgaggcatcacccctactctcatgggggtagacagacaaaaccttagagtcgcatttatgagtgtctaactgtcatatgagataagatctaccatggacagtcatcagatgcttcagtacaggcataacaaaggctagttcctatcacaactcctcactcaacagtgtcaccaaagtcaccactcaccaaatgcctccctcattgtccttctcatgactcacaagggagaattcattgctccaaactatagttcccattaggttaattttctaacatcagaagtctttgggagatgagctgatttcgcttgcaaaccatgcataaaataattgaagactattcctgggagtgggaggtaagtctttgaactgatattgcaaccttgtgattgctcatccctgctaaaggtaaatttgattaatcaacacatcctgctacagtcatcttccccaaagctaactgcaaagaatgagggcttcctgcccagtctgacacccacctggcgccaggtagatgcgggggcctccagagagtaagccaactggtgttgaacgtgtcaaagagcaaaagaacaagggaaatctcactctactagcatgggaggttagctttgtcaggcaggtaatgtttggcagctgagggaaacttgaacataccacctctaatgtttgtgcacttattttctcattcacaaatggaaacaaccacagcttgatctgtgcatggtgcacagttttcattcagatcacatgatataaacatcctatcacttctttcaaatccatcacttcatttacacttctataatcatagtcctagtccaagtcttgtcatctcatatttggattattgcagtaacctactaatgaatctctcctctttcagtcttatttccaagtcccttctaattcagttatcatattgctttcaagtttaaaatatcaggggagtctatcaccttctgcttaaaaatatttgaggaaagcccactgctttcaggatgaagcctaaaatctttaccatgacttttgtggcacacactgtgagctgcccacatgcaagtgatgcttctcctcttccgtatcagtggaatccaatacgaccaaaccaagaggataaattatgattgttctaagccaactgtaatgatctctttcctctttggactaagggtgggactgtgacacagttctggtcaatgagatataagagaaagtctactgggacttcagggaaagacttttttcttcttgataagacagaagtgtttgaaaagaagaccagttttctgtatgtttggggctacagcagccatcttgtgattttaaggggagacattagggtagctaacttttcccagtttgcctgggacttccccacttttagcactaaatggcccacatcctagggaaccttcagtctcaggataaccagggcagtcggtcatcctaggagacatcactgacatactgagcatgataaagcaaaatggcatgaaaaatcttcatgaccatcattgagctgctatataaactctaaggttgtctttctcaagattttttgtgcaagctaactaaatgccttcgtcatgtgttttgtaacctacagttgacggcattcctaattaatatagcattcaaggtttttcatcatatgtcccaatatgtctgactttccagtctgagctcccaccattcctgactttctgccatatacatgcaatgtggattactccctattctctgggtttactgtgaatctgcacacctctgtgcttttgttaatgccatctccattatccaaaatttcttttcttcctttcatcactgaaaacttccaatacatccctcaaggccaaatttcctccattcttcaatgctcctatggttttagcaagcagagaagcttctagtatatatttctctctccttatactttgagtactgtgaggggaagggattatatcttagccattatttatctaaaacccttgctctagtccctgccacctttaccatactcaatgaatgtttatggaatgaataatagcatttatggatgaataattgaagtacagaaaaagtacatgtgttttgaaaaagcagagactcatggaaagcacaaggcatagtccttctctttttaagtctctgtccaagaaaccttctttgactcttttattcttattgagattttccttcccttgaattcactcaacacccatattgttactgagttcaccctagatgccacgtgcttctgaaagcattgctggcaattatagatggcttgttcttgtatgcctcttctctccctaataaaacagtaaggaaagaatggataatacctactatttgatagcacaacagggtgattatagtcaataatagcttaattgtacattttaaaataactaaaagcatataattggataattggattgcttgtaaacacaaaggataaatgcttgaggagatggataacccattctccttgatgtgattattttacattgcatgcctgaatcaaaacatctgatggaccccataaatatatacacctactatatacccacaaaaatcaaaaatttaaaacaaaacaataaggaaagtggcttccacttactacaaaggccacctgatttcaagtccagtattctgaatgaagtttgggcaccagaaatgttgtctgagcatagtcaataaatgctgtgttctgcttttaaatcgagaatgcctttggctgcaagtaatggaaaaactactaagtgactatggcagagggagctagctaaccattagatatttgggctccccttcgatggtatggagttgtttagggcttcctaggcagggatttcacttctcagccttcctgcattaacggggagctatatgtctagttataagccactggaatatgaactgaaatgaactatcacttcccaactaagaagattaagggggctttccccacactcttatcgtcttcaggggtgaccttggaggccacaaattgaagatgacagcaatcccaaggtggaaggagcatgactccctgaggaaccagttggagaacagcctcctaggagaacactcaactcagaaaagcctcactggattttgtttgagcaagaaatcaacaattattatgttaaaagactggaatttgggttttttttctttttttttcttttttttttttacagcatttagtctaagtacagtggccaaaacaaatatgatattattttacagcatttagtctaagtacagtggccaaaacaaatacgatattattttacagcatttagtctaagtacagtggccgaaacaaatacgatattattttacagcatttagtctaagtacagtggccgaaacaaatacgatattattttctcacacaatagaatacctaaaggtggatagtggctggcattgttatttactgaagacttttaagtctcaaacacttcttatgctttcacttgaccacctttagttctttgcttttcatcttgtggctgttgcctcatgatcacaagatggctactgctgctccagggtttacatcatcacaccagcaggggaagggtcaaaaggctagactttatcattttaactcgagtgggaactcctagccaagttcccttcctggatcatttaccagggctacgtcatgttgtcaaccctaactgcaataggtgttggtaaagggactattcatctcttgcggattctctagatgaagacaatatcttctagggaagatggtggtaagagaagggctttttggaccagacagccaacactgtctgccacagattttattccagtttccaaccattttatttataaaatgaccaaatcaggttagaatttcttctaacaagataggtgacactcatgctcccatttccctcttgctttttcctggtcttctttctccagaattcttcagaatcgttctcaatacaccactcccaggaatccttggctctccatttaagtaggctctccatgtgaaattgatttgtcaccgttgggctaattagatgatacccaggttctctttcagttctaatattctctaattttctctctctttctctctctctctttttttaaaatcagttgccctcctgatgttgctacaatgctataaatgacaagcaaatcagcaatatgtgcgtagaggcgctctccttaccaaaatatccagaatgagtgatttaaggctaataaacgaactaatcttacaatctgaatctgatctttagcaacagtcccttttcataaaggtaacagttatctcttgcaaatatggacataagcagtgactcctttacttctaatagtctagtttgaagggtcttgggccgagcagatagtgacctggatggaagttctgacaaagagagaagtaaaaatttgctaactatttgtagcctgttgatgaaaatacccagagaggatgcagaaatgtcttcaactctctgaaggttcttcttatagagaagggcatggaacgtttccatttgcctctgagagtagaactaagactgaggttggcagcactatgacagcagagattgaaaatcattggtgtgggggccacgttcacctcccagaaaatatttagaatgtttggtttggcctgtacagtccttaagacacgtttaagataaagctaacatcaaaactttaaaattgtacataaaaataaagatttccattgtctcttaaaaattaagcagattggaaatcccatcctttggaagagcaactgtggctgccaccctaggttctgcacttgggattggaaagaggcactccatcgagggaggtggttgcaccttactcctcttttcagaataccattaaaatccagtttttaattttagtatttaacaataccccaaatagcctcctttcaagtgtgattcttttgtgtactccacacaagttaaactaccctaggtccaaggaaagcgctggatctgttaactctgggcccatatttctgcagggcaataatctattggtgtgaatagcagatgcctgctttggaaaggcatctctttagaagttaactaccctcctccatgacgccttgcctttaccaggcccaggtcattcacttatgttacctctctctgtatgtgcctcagtttttgacctctgctacagggaaatagatatgggcttcatataagggaaaatgaattgttaactatctgaaatttcaaacaatgcaaaagctttaacatgagatagtgagttttcctaataccagaggcattcaaagagaagtgggatcaccactcataaaaggagaatcaatgtgaattgggtgctggcttagaagatattctttggaggcccccttcctttcatgcctaaatggcaccattctatgaataattggtagcaaaagcaaagcaggacttgttcaaggaggcgcaggcaggaagaggtctgagagctcaaagaaagtaattggcatgttattccaaggttggatccaaagcaatctggcagctttatccaaagcaggaagaaaaatgttagtgcacactagacttgaaaaataatcaacacttattccaggaaaaaatagtttctttcagttgctcagggctgtgtggtttgaagtgcacttttacaacattatcttggtccatctttgtaactccatgattgaagagccacacgggtaacagtaatccaattatatagattggaaaactgaggtccagggaaatcatcacttacactcagtagccagggcctctatttaggtgtcatctttctttggcttttactcttccagctttatctcaaatcacaaatcctagtcataaaatcaaagaagagtgtttagggaatcatctgccacaagcccccttcctaatgctgtcacatccaggggatctgctgataatctgccaagaagagcagccagtgcacacaggtcattccatctgtctcacttagatctttcctcaacaaaagcctgattcttcttccatttttgagaggacagacaggtggtcgccatcttccccaggacggcccctcatagacctgaagcctgttacgaagctggctcttcatctttttcatctccagacaaaataattgaattaacctttcccccaaatgacaaataccgtcttgaatatcaaacacccttttcatataaatggagaattccagagtggcccatttaacaaatgcctcttctttaaaagctcctcttcccaaaagcaggaaggctattagcaagctagctcttcaagtagcccattagtggcctgaaggaatctgcaagaaatacaattagacctctgaccccagatcccagcgagtgctttgaagagaagagaacgatcaagcctcaaagctggtcagtctgtgcggctcactctggaccctgggtgtgggccccagttgctcccctagaagagtaaagagtcagggtcccggattcccttgggaacctccttctgctctctggcctcatcccatttcacataccaaagtcttttgctggcagcaccctgaggacattacatttgcttgactataattctcgtagcacaaatacattgcttctttttctccatgggaggggcttgagaacttaaactattgtgacccaaactatttttcaactggcctatactagttcaacaattacacttctgagcttcaatctcctttaatataaaagagaacaatcattaccatatattcaaatgggtattgtgagactcacaggaaatgaagtctatggaaagcttttgtaaactgtgatgtgttggtaaatatacaggaatattaacattgccattttagacactatttttttgttgttgttgttccaagatggagttttgctctttttgcccaggccggagtgcaatggcacgatcttggctcactgcaacctctgcctcccgggttcaagcaattctcctgcctcagcctcccaagtagctgggattgcaggcgtacatgaccacgcctggctaatttttgtatttttagtagagacggagtttcaccatgttggccaggctggtctcaaactccagacctccggtgatccacccaccttggcctcccaaagtgctgggattacgggtgtgagccaccgcaccctgcctagccactcttactaaatgtctcctagcccagcagcttctccaggggaagaaagagacaacgtcttgttaaatttggcccaaactaggctgctagtgaaaaggccaggctgagcagctcagtcgggagcttgttgtatagctctcttttgttctggcacacctgccagtctgacatctgacatcagtgtaaataagcctcccataggaattgcttttatcattgcacctgtctgttccaacttacttgctatgatcacagcccacagctcttgacggctgtgcacagtcagaaggcacaaaagaaagcctttccctggggcccatttgtctctgcactgtgccccagtggctgcttatctataagtgggtattttgacactcccaacctgcctatccatctcaggcctcctccgagttactcagagtctgatgtctgaaccagaggttaatttattatttttttctttcattgcctggtctggaagtgggtgtttacctctatgaaatattcaggcaaggtcctatatcgatttataatagacctttgtaattaaaaagataattttttattgataagtcaagccaggcatagatacatatctctttctaaatacaagtaaacagagaaaaatctactggtgcctgtgataaactgatagattcccattcttcaccttaattctttagacttccttcatgtgtggctttggggttttccctataaaggcagggcatacttccctaccccatgcaacttgctttggccgaaacattgaggcaaaagtgagggtgtgtctaggcctcaagaggccttgtatgtttacgctggacctctttgggcttctgccattgccaggtaaaggacagtctgggctaattggtgggttaggaggggtatgagagatacctaaagcacagctgttgcagtccagcagccccaaacagaccccgctctgctgagtccactagtcacctgcagacatctgagagcttgccaagatcagccaatcaccagataacccacagacacataataataagtgactgtcattttaagctattgggttttggggttatttgtcacatggcaattgctcattgaaacactgccaatgacagatacctggaggagtcaaaggattcatctctctctggaataaacttgatgttaaaagaagaaattttttaaaatgacttatactttgttcttattaccgaaaattaattattcatagaacacttagaaaatataaataagaaaaagagaagaaaataaaaatcagccaacatctttttcccaagaaaattgacatccatgaatgttttggtttttcatattacctcaaaaacaaatggattcataacttccatgtttaaaaataatatcaattaatcaaaaagtaaaacattagtaaatttgagcaaacaaaaatgtaatatgtctgcatgtttgaaggaaatactagaaaacaaagagcaagaaaagtgcaggcatatttgtaacacatatgacaaagtgttgctgtctttggagcctgaagagttcctatacattgataagaagaatgtctgatcctaaagctagatagccaaggacccatgcaaaactgactgaaagagaagtacaaccaagaaacattatgtgagaaaacgttcagccttatcatcaaacaaggaatgcaaattaaagtgacattaaaatattactttacttttgacattacaaaacaacatttaaatcatgcttagggggaaaggtggttgagtacaataaatataaacacgattggtaaaatggtaaatatgcaacccattcaggaaataaatatggcaatttggtttttacatttaatattaagtaaaaaaaaccccactaaattatctacataaagtagcttatgtacagtaaaaatcttgaaataaataacatcaaaatgcttataaaagtttgtttagttttgcatgattgcaactatgaactgctttgtagtttgttttcatctttttcttaagcccaaattttcttaagaaaaatactcaagaaatgttatctttaagccatgaaacctctaagcatatacttcatattaaccttttgagtgtggacctgggtagcatggctcttaatgctatggtcagtaaaagtcaaggtttgctggcaaacccctccctagacagtgcttgcatcatgtcacacaatggtacctggaaattaaattactttcctaaaatgtattctcccactctgccccctggatttggtcctcagctgtttgctccttgtcctggcaagcgttcagcagagcctaagatggggattcttgtgaaaaacatttattgaggaactgctcttgtgaggaagggatgagggaagcaaggcaaggcaggggaaggaagctaagggaagatgggctcctgactgaagattggcttcaggctggtcccccaggagcttggaagcatgatctccagcattgcaactctgggcccagcttgcattattctggcggtccttcagtggtaggcatcccctatctgatcaaggtccagtctccagagaaggagatagctgaggtgtgctagcagcctcatgcacacccacagaagggaagggaaaggggacctgggggaacaccaacctcaacactgcagcacctccctccaatattccctgtggcctaggcatcactgaccttggccttcttggatctggaccacattcagggatgcactctttttctttctttcttggctcttcatcatcttctgcccacttccctctgacccaaagtatgatagtgaggacatcttacaagaatgcaggcatagacaaaaccaggactacatggttcagcaattgagcacatgcaattcgtttgaagatgtggactgtgttcaccacagagaggcccagaccagagggatgtggtgggatgggtcatgagccttaacgcagtctgagtgtcctcacttatacttgagcttaatgcaagggtctctaaaggctgccatccccaaacctgctaccatctcaccaggaaagtgacagcagctacactggctaaatagaataggtaaatgttatttgcaaaagcatgcaaagactagaaaagagctggtgagttagatatctgagttctctagccatctatcatctctcccaagtgccaccatctaatgatctgtgaatatttactgaggacagaaaggagagggggaaaggagaatgttctaagtcaatcagtcatgaatgaagatgaagccatggatgcacactgcgtgttctacaaactttgcctgggggcaaggagcatccagtcaacaggagatatcatttttggaatctccttagagtttagaatttatcctgcaattaactggaaacttctgatgatgtagacaggaccatgtgagatagagcactagaagccacagtacaggtatgttcttaggaatgtgtttgccaaatttaaaaaatccaaacattttaaacttatgccttagcctgtcaatagaggcccttcaatatctgatgccagattacctttctacctccttacccatcatgttctgctccctgactctaactccaggtatactgtttcttctgccctgaaagagttccctattcatcataaattccttctcatctgaaaaccctgataaaaagcacatctacaaaaatcaaacaccccatttcttgatcctttaactgcagtagtataactcattttacattgtattcattgatcttgttaggaaaatatctcccccattagattggaagccatgagagttgtcttatttatatttggattctcaactggcagtatatatttattaaataaatgaatgaatacatgaaatgaaaaattgttttccttctataacgcctcttccagaaaattctttcgttctgttttataccttgccctgccacatgcatacatcgtgtgccctttcgctgttgtgtcttcctttctctgggttccaatgtgctgaatctacctgatatttttagtcttgaattctaaagtctagctactgcttgacttgccaggtgagcccagtgggaatgctattcacgagggtttttgctgggctatagggcactagacctgcagttctccaggcagagtttctgtaatcatggcaatgatgcaattactggtatcattaataatattcataatgtttggtgaatcctttatgactcgcattgtgctaggtgctccacatgtattttctcatttaataactctagataacactctagaagtagtgttatcattatccctattttccagataggttttgataggtttggtaacttgcccaaggtcaaaagcctaggccaaaaaaagcagaagctagtcaaataacagagcaaaactttgaatccaaatccaaaagacagtagcactcaaatctttaaccacttccagtccctgtaaccatcactgacatgttcaaaaagcttcccagatatcaccatgatgatggtgcttaacataagttattgcatttaacccttcgaggaagcacaataggacagagaggctgaattgtggtgcaggtggcagccaaagggggaagctggagaaatggagttgagtgtcaggtacagggggacaccttggaccaccagaggatggtataactgcaggacccgaggctaagaagcttggaacaggctgggatatgagacataggatgagttggggtgagtagtttgggattagatcaagacaactccaagagtgttggaacccaccttcatgtattattgggtgtgtgtggaaggaagatggataaattcaaagagccaggctgcaccagcactacaggaacatctcttgccaaatccacttgtcatgttctttcctttccaggcttgatgcatagtacacaccctcactgtaaattcttcccttacacaagacctgcatggaaggggcgtgggggtagagcagatccaacactgacttggggttcagaaggccctaagttctttcctggctcagtgccctgccagctgtggcatctttgaaaataaactctctgaaccctgattccttctgttgtcagtggagaaaatgatacctactgcataggttggttaagggactgaatgaggtaccttataggaagcatttagcaaaatctgcacacagtaggcattaataagtgttaacccccttctccaactatccttctataactcccttcttaattttgtcatccagttgtttcatgtactgggttttacgtctccaactaagtggtgaattccttcagggcaagggttatgtcttttactgtcttggtttcttcattcagtcattcaacatgtacaatttacttgcagttgatattatggctttgagcacttgggagaaaaaatgaatacaaatggttgtttttctttaaaaaaaagatcctgcacgggcaatctatgtgtgaggctatgtcaaattcagtatatacatcaggaaaaaaatgttgcctggtaaaggccaataagcatgtgacattgtcagacgctgggtcagcacactgaatagttcaaaggagttattcccagaagatttctcacttccttccctcagttattgaatacattgccttaacctctacccttagcatcaatcatctttgctttttacacattttagagtaataaatagttcaatcagtttcatatattggcttctcatgttttaaaatttaaaaaatgttttccaattacaaaggcaattcatgttcacttatgaaaacattttaataaaaaatgagaaaaaaagaagatgtgttgaaaatcatttctaatttcaccatctaggggtacccattgctaatattttgatagaaatccttcagatttttataatatgtgtggagatatattataaatgcttaatagaattactatatgtaatgtcagtctttcatcattctaatttccactttggatttcatccatctctatttgtttatctgaaaacaaagagaagaagaatgtttctattaaagtgaagcccaggatggcagtgtttatgtgacttgagttcttggctaaagctgtgttagcaagtgtacatcctgtgtacagagaggaaggtgtgtgtggactttaaaccattccccaggtatggttccatggcttttccagcctagctcattcttatttctttctccctcttgtcctcactcttggcagtttcttctctggtggcctgctaagagttacaagttcattagcagcatcaactcaaagagagatcaaatctgtggagacccttgctctttgagcaccttgcctgcagcccttaagctgacatgcactgcagatggcccgagctgggtggagggcatactgtacagaaggaggatacaagccaaggacattgtgttctgtctctaatcaaaccccattaagtggcaaattcctctattcaaaagttttcataggatggtactttcaaaagaactccagctggttaaacttagggcctgaaataaatccagtctaataattcgatctggctctgggcctgccacatcctttcgatggaagaactcaatgcattttcattcattaggggcctcctctcaatgttgactcagaggtaggccacaaaattctttgcttgtgttggccttgagaggactgggtcacttaatgaaacaagtagcttccagtgtgtccctggctgttaacgcaacctcctcatgcttgctggtgcattttcagagcttgattgtgcaagaaatattgctatttttgtaaatggtttggcctctgcagtcattaacctggcatttctcccccgtggaggggaaacatcatgtgtccattgattccttcttttgtttgtaagctgtttgcaaaagaaagccctcaaaaaaagtcctttctccctgcatcttgtcattagtaccaacatggaatttcttctagttacttttatcaacttactaagtaatatttttcagaatatttagcagtattttcctggttctttcaagtctcttggctgctggagtacatcgctagtccttgatccttttattgcttagttccattcacaattacaagtcagcaaatgtttcagaaatgccttcagtgggcagagactctgccaggtacttggggtgaagggaggtagaaagaaatttccaatttcacagattaaaaagttgaccacaccaagcccttcctccactcctctaggctgaatccttggccccctcctacacttgtaccttgattatgatccttagtgatctccttctaggagctgggtatggcaggctttccatgtagtaatctcaagcctcccaacttaacagcaaaatagtacattttgatgccatgattacatacagagggcccagactaaaaatggataggttcaaatccaagctctacaatgtttcccagttacataaatttgttgtgccgcagttaacccctttggaaactataatagccccttcctcacaggggcattgtgaggattaaatgacataaggaatgtcaggcctcagtgcacttgggacacctagaagactcatcatcaattttgctatttattgttgttgttgttagtgatgtgttaaaacaggaaaatttaatgaatgtttgggattgcagagcaggaaggtggctggccactcccccagccccagaaggccctggaagctggctggggatagaattaagaacacagctgaaattaaaaccaacggtcccttttctgccctcatgtcccccggctttctctcagtttcttgtcattttcctgaaacctcaatggcctggaaaatgagaccacgaaggagatcagggtgaggaagagggagaggccacaaggaccccaagttggagggagaatgttaatagaaatggtctctgcaggttgagtccgtcaagctcggtgtgtttgtattaactccatgaatgcttctaagtcagcttgccatacaattgctagcctgctctattagaagggggctttcctgatgttgacttcaattctctaggccatagaagtcaggaaagctaaaaatggaaactggccaatcattcatcccccagggctgggacctcagcgctttctcgtcggctcttcctctttcacagggaaccacaaggagaaaaatctaatcagattgctgcattccaaaatttgctcaggagcgataaaaataaactccaagcatccacatatttgatcaatttacttttatcctttaatcgaataagcctcagccctgcaatcaggaagaaaaacatttcgctaagcatttcatttctccagtgattcatctagcagtggtctcaaagttgacaggatgagaataaggtatttaatgctgaaataatttttatgaccacatcacaagaggctggaatggcttttaaggtacatcatattttaatcacaagcacacatacaacatacattgctcaaaaactttggaaaagattgaattggaataccagaatcataatatcattatcaagaaaaggagggctggctttttttttttttttcagtctataattccttctgtgtttttggttggcctgacagacttggaagaaaactgttttagaaagaaagtaacaaaaagtacatccaaaaggaggtttcaaatcagcagatgcccacacatgttaaaattggcaatctcgctgttttgtgtactcatgagctggagggaaggcctccttcgaagcatcagaaagatacccagaaggcagagacatctgcagaaggctgggacatttcagggaccagacacatagccactgtctcccgctagcctgttccaggctccatacccctattttcagtggaaggagggaaataaaactgtcactgtggcatctactgctaaggctcaggtcaccctctttttaaaagctgccacttaggtccagggacccaggaagaacaaggcaaaaagaagtgggtaagagaagaaggaaaggtactaagagtgggaaggctaataagagttgttggtagtcggtttttttgtttttttgtttttttgtttttgtttttgttttttgtttgtttgttttgttttttgagacagtcttgctctgatcgtgcaccatgatctcagctcactacaacctccgcctcctgatttcaagcaattgtcatgcttcagcctcctgagtagctgggactacaggcgcccgccaccacacccagttaatttttgtatttttagtagagacggtgttttaccatgttcaccaggtggatggattgcttgaggctattaagagttttggagacaggatgatgtggtgggaaaaccaaaccacaagagcaaaagagagagaagagggaggtcccaagctttggaactagagaaacttgggctcaaatcctaaatctgctatttctcttggtgtgatcttgaatcagttacttaacctgtctgagtttctgcttcacaattgaataacaagggaatcacatctaatgtactagcttatcatgagcattagtgaaagctcttaggacagtacctgaaatataataagtacataatagttttcatatttcttcttgcccttcaaccccttcaaaggtaaggaaacagaatagagtgtgtcactcaattaaaatattgtccctcatctctgaaacccctccgtggttcaccactgtctacaaaatggagtgccaacttcctggcaaagcctgccagctgcacaatcgcacaatctggctccaggctggtataattagatacctcccctcctgcacgcatctgggtaccttacaccccattcaccaccagaccattttgttctctcacttctttgctcttacttatgttggtttcagcttgggattccaaactctacttatttgctcatggaaatcctacattctgtctgccttcccttctcctttattgagcaaccacagtatgccagcactgtgctgggaggcagaaacgaagagaaacacgactgggcttgatctgagagacttttcaaagactagttttaatatgatcaagggaacaatgaaatctgctggaagaatgtggagggtatggagaacggacacaaaaaggaggtagcaattgagctgggctatgaaggttttgtagaagtcttttcagaagggagaaggcagaggggcagtggtagcaaagacaatgaaaatgacaatattttgagggagtgaaatcctaaattatgctctgtagctggaggaaaatcgagtggggaagaaccaacaggagggaatggctgggaggtggtacaggtggtgtgtgttagtccatttttgcattgccttataggaatagctgaggctgggtaatgtataaagaaaagaggcttaattggcttagggttctgcagggtttttaaaacgtgtggtgccagcatctgctcggcttctggggaggcctcagtcaggaaatttccaatcatggcagaagtcgaagtgggagcaggaaggtcatatggggagagctggagcaagagagaaggagtaagagagagaaggggaaggttcccagactcctttaaacaaccagatcttgcatgaactaatggagcaataactaaattgtgagcaggggaatgatactagaccattcatgagggatttgcttccatgatcaaatcacctacacccaggcaccacctcccaacactgggaagcacgttgcaacaggaaatttggaggggccaaacatcctaaaccatattgtggtgcacacaaccctaagctggcgacatgcactatcttatgacatgcaccacaagctctgcccaccacttcacagctgtttatccctgagcagttccttcacctttttatgcttcagtttgttcttctataaagtggaggtaaaactagctcctagccatgagaacatgtgaggataagatgaggtgatccctgtaatattccttcccgcagaaactctgacaacataggaagtgctgagcacgcgttagtgattcattttttaaaaagtctaactaaaatgccagctcttctgttcaaatttccctgacatcctgagttaacactcactcctttgtcctttgtgctttcgtggcacttttgtaaacctctggttagcacttgttttacagccttttgcatcacagcgtatttgtttttctacttctctatctgacaaatgaaaccctgtgtcttattcattcatctgtggcattccctactttgaaagcacaatactttgactatggtggttaattactcaactattgttgaaggaatgaataaaccccttattaaacagtttatgatgatttaattttaagaaatattagagctaacaaaatatcctccaaaccagtatctttcaaactgttttatcaacccccagtaagacaggcattttacatcaagaccaggtgtgtgtgtgtgtgtgtgtgtatatacatttatgtaaatacacacacacacatatatgtatatatatatatataaatgtttgtagttaaaccactgctcaatgaaataaaagaggatacaaacaaatggaagaacattccatgctcaagggtaggaagaatcaatatcatgaaaatggccatactgcccaaggtaatttatagattcaatgccatccccatcaagataccaatgactttcttcaaagaattggaaaaaactactttaaagttcatatggaaccaaaaaggagcccgcattgccaagtcaatcctaagccaaaagaacaaagctggaggcatcacgttacctcacttcaaactatactacaagactacagtaaccaaaacagcatggtactggtaccaaaacagagatgtagaccaatggaacggaacagagccctcaaaaataatgccacatatctacaactatctgatctttgaaaaatctgacaaaaacaagaaatggggaaaggattccctatttaataaatggtgctgggaaaactggctagccatatgtagaaagctgaaactggatgccttccttacaccttatacaaaattaattcaagatggattaaagacttaaatcttagacctaaaaccataaaaaccctagaagaatacctaggcaataccattcaggacataggcatgggcaaggacttcatgtctaaaacaccaaaagccatggcaacaaaagccaaaatacacaaatgggatctaattaaactaaagagcttctgcacagcaaaagaaactaccatcagagtgaacaggcaacctacagaatgggagaaaattttcgcaatctgctcatctgacaaagggctaatatccagaatctacaaagaattcaaacagatttacaagaaaaaaacaaacaaccccatcaaaaattgggcgaaggatatgaacagacacttctcaaaagaagacatttatgtagccaaaagacacatgaaaaaatgctcatcatcactggccatcagagaaatgcaaatcaaaaccacaatgagataccatctcacaccagttagagtggcaatcattaaaaagtcaggaaacaacaggttctggagaggatgtggagaactaggaacaattttacactgttggtgggactgtaaactagctcaaccattgttgaagtcagtgtggcgattcctcagagatctagaactagaaataccatttgacccagccatcccattactgggtatatacccaaaggactataaatcatgctgctataaagacacatgtacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcatttgtagggacatggacgaagctggaaaccatcattctcagcaaactatggcaaggacaaaaaaccaaacaccacgtgttctcactcataggtgagaattgaactatgagaacacatggacacaggaaggggaacatcacacaccggggcctgttttggggtgcggggaggggggagggatagcattaggagatatacctaccgttaaatgatgagttaatgggtgcagcacaccaacatggcacatgtatatacatgtaacaaacctgcacattgtacacatgtaccctaaaacttaaagtataataataaaacaaacaagaatctaattcgacctcaaacttttggccaagaaatgtccttccatagcacctttaagagaaagaaagttggggaagaatttctcaatgaacaagacacaccaaagtcctaatggcagagctgaaattaatttaaatgcctttgaaatgctcatccttgagttcgtgtcctttgcagggacatggatgaagctggaaaccatcattctcagcaaactatcacaaggacagaaaaccaaacaccgcatgttctcactcataggtgggaattgaacaatgagatcacttggacatagggtggggaacatcacacaccacggcctgtcagggactgggggactgggggagggatagcattaggagaaatacctaatgtaaatgatgagttgatgggtgcagtaaaccaacatggcacatgtatacctatgtatcaaacctgcacgttgtacacatgtaccctagaacttaaagtataatttaaaaaaataaataaataaatgtttgtagttaagtgaaacaaaacaaaaatttcatgatacattaaacttactactacaatacattctgatatgttcccatctaatctttttaacaaacttttttattttagaagagtttcgaatttaaaaattgctatgaagatattacagaaatttgctatatgcctcataccagcttttgctattaacatcttacatcagtatattttttgcaactaatgaaccaatatgtctacactgtgaactaatggccatacttcattcagatttcctcattttttcccctaatgtactgtttcaataccatgaaaacctgatattgaaataactcagaactacaaatttaccctctttgagattgctccagtaacttcttttaaaatagtgggctattagaactgaatgagacttttgagataattccatcaagtttttcattttatttattttttaataagttatataatttattattattaaagcatgagttttttcccatatggatagattattattttcaatcagtatatgcatgcaattttaaaatcaactgtaccactattcattttattaaaaaaatagattgaggaggttcaagtgcagttttgtacatggatatagtgcatagtggttaaatctgggcttttagtataaccatcgcccaaacagtatacattgtgaccattaggtaatttctcattcctcacccctttcccaccctcctacctttctgagtttccaatacctatttccactctctatgtctatgtgtacttattatttagctcccacttacaagtgagaacatgcggtgtttgactttccatttctgaattattttacttaagcaatggtctccagtttcatccatgttgctgcaaaatgacatgatttcatttctttttatggttaagtaatattcctttatggctgaataataataatattattattatataacgtacttattaaaaatgaaatgttttgagagtttaagacaatgtatgtggccgggcgcggtggctcacgcctgtaatcccagcgctttgggaggccgaggcgggcggatcacgaggtcaggagatcgagaccatcctggctaacacagtgaaaccctgcctctactaaaaatacaaaaaattagccgggcgtggtcgcgggcgcctgtggtcccagctactcgtgaggctgaggcaggagaatggcgtgaacccgggaggcggagcctgcagtgagccgagactgcgacactgcactccagcctgggcgacagaacaagactccgtcccaaaaaaaaaaaaacaatgtatgcatttatttatttaagatataagtatgggaaaataaataattcagaagactaggttgaatgtccctagatttccacacaatcaaagactacatgtttttttcaaaagatgtgataggattcaaagagcaagaatgagttctaaaccctctctaagaaaaataatatacatatatacataccatgctgtagagaatagcaaagagcatggcatggtagtatacctatatatacaccacattttctttattcattcatccgttgatggacacttaggttgagtctataagctagctattgtgagtggtgctgcattcaaaatatgagtgcacatatctctcatcttagacctggggaagatatgtctcagcgaggttaggcaactggtaccagagctagtgagttttcgagccaagagtcaaactcaggaactcctgagaaactgtcctcatttatatttagtaaaaatactacttaaggaattccacttctgcttagaatgttagaagccccaagagaaccttgattccaccctaatgagagaaaaaaaaaccagattatttataaaatcatcacttttcttgaggccatcagacagctgagattgccaagctacccaataaacagcaatccagagacaagcaagtccctcaggaacagctgcctcacctttagcagaacatgggagaaagaggtggccactgacccagtggataggaggaaatcagctcagatgttaacaattctgaaaggctgatggggctggcatgtcagcttgggatggctaggaacccagggggcaaaggcgctcgctcacaagcttcattccagacacctccactgtatgtccacaggaaagatcagaggcagataggggaatggggagccccagatgtggcccagatgcacacaaggggacagacatgaggcctcactgcttcccagaccctccccctagaaagcgaactcttgaactctttcctgctgaagaggagaagtgaatcctctgtccaaaggcccagaaaaattcatcgcctctgaatcaggggtagaaacccaaccttctgcccgtaggaagggaacaggaagccaccttggaggcagcatggtgaactggcactaagcaggagctggccgttgatgcaggaggttgtaacagactcctacagccgctgtaacaaagtaccacaaatggggtggcttctacaacagaaatgcatggagggcagaagtccaaaatcagggtgtcagcagagttggctcattctggaggctctgaagaaggatctgttttatgcctcttgccttgcttctggtgtggccaacaatccttggcttaccttggcttgtaggtgcatccctcctatctctgcctctgtcatcacctagccttcttccctgtgtgtgtctttgtgtctctgtatctccctctcttttctcttataaagacatcagtcattagatttagggcccatcctaattcatgatggcctcatcttcactagtaatgtctgcaaggaccctatacccaaataaggtcgcatcctgaggttgcaggtagacctgaattttgagagagacactgtccaactcagtacagagggataggaaactcctcatgcccaagaccaaccagcaactcaaggcagaatttggctgccatgagaagatgcgacaggaatgctgaaaatacctatctcccaaggcccaggcacatatgacctgagaaaggctgaggctgggccatggcgacagactaagccctgcctccaccaggagcaagcaaccttgggaagagcaagggcatggagagagagaatgtattatgaactgaatgtttgcatccctccaaaattcctattttggagccctaacccccagtgtgtctgtatttggagaaggagcctctccggaactaattaaggttaaatgcagtcataagagtggggtcctgatcagaaaggattagtggccttacaaaaagagacactagagcttctctctctctctctctctctctctttctttttctctctttatctgagtgcatgcactaaggaaaggccatgcaaagatgcagtaagaaggtggctgtctgcaacctaaagagagccctcacaagacaccaccaactccttgatcttggactttcagccttcagtactagagaagataaatgcctgttgtttaagccacccagcctatggtgttttgtcacccaagcagactaatacagaactactcttgacccagggcctattgaaagc

SEQ ID NO: 454 - DNA, 40001 bp, Homo sapiens
tccccccttaattcctttggtaaaaataatttctcaacatctgctaaatagctttctccaagatggatgaagacatgctccatcaattggtacttgcctcaaagtcgagttttattcaagttaaactgaagtcactgcaaattcaagcaagatcccaatatcgactaagttccttctcagaagtcctcccccagggtcaggcagagggggaactgggtggtgtttcagatgtggcttttcaagctgtggccagattggcagcatcagcatcacctggtaggttacaaatgcagcaactcaggccccacttggacctcctgagtcagactctgcattttaacatgactgtgacttgtgtgcatgtctatagtttgacaagtgctgtcttagaaccctagagcctctgggaacagagacaagaaggcgatcttctccaagcagggtgatctctgttgccagcgtacctgccttggttcacccctcctgcatttgtccaggtggaagatgattaggaagggcagaggagaggcaggaacagcagatggctctgagacgagcctggggctggagggttgagtgaggtgggcaaagaaggggagagtgctggcatagctgatggatgactgtggtacctgagatggccctggggagttggatgagagcagggccagagtgattgatgggctggggtggagaggctgtggaacagctgtaaagaaaaaaaggctctgggtttgggagtctgctatgggtggcagcaaaacccaagagccatgagagagaaagtcctctttctgcagcagtgctcacaaagtcgagtcttgctctgttgcctaggctggagtgcagtggcatgatctcagctcactgcaacctccacctcccaggttctaagtaattctccttcctcaggctccctagtagctgggattatgggcacatgccaccacacctggctaatttttgtatttttagtagagacagggtttcaccatattggccaaagctggtctcaaactcttgacttcaaatgatccacctgccttggcctcccaaagtgctgggattataggcataagccactgtgcccagcctcgattctctttagaaggtattcttttatggcatcaagtacattcacatgtttatacaaccatcaccatccaactccaaaaccattttcatcttgcaaaactgaaattctgtacccattaagtactaactccccgttctccctcccccctcatccctggaaaccaccattctttctctgaacttggctactctaggtgcctcatgagtggaattatacagtctccagccttccgtgatctttccagcttcataactgccttctgacatggatgaagcaggaaatgttactgcctcagggagatgaggggagggagggagggttatgggggaagtgacttgccctgggtctcacatctagtgagtatatagcacactcaatagattcaggaagcccagagtccttcctgggtctgctgctgtgttaggtcattcttgcattgctataaagaaatatctgatacggctgactctcttttcagactcagcccgcctgcacccaggtgaaataaacagccttgttgctcacacaaagcctgtttggtggtctcttcacacggacgtgagtgaaatttggtgccgtgactcagatcaggggacctcccttgggagatcaatcccctgtcctcctgctctttgctccatgagaaagatccacctacaacctcaggtcctcagaccgaccagcccaaggaacatctcaccaatttcaaatctggaccccactgaaaattggactgttcaactcacccagcagccacttccagagcccctggaactctggcccaaggctctctgactgactccttaccagatcttcttggcttagcggctgaagactgatgctgcccgatcacctcggaagtcccctagaccatcatggatgccgatcttcagacaggaatgtcaggcctctgagcccaagctaagccatcatatcccctgtgacctgcacgtacacatccaaatggctggttcctgccttaactgatgacattccaccacaaaagaagtgaaaatggcctgttcctgccttaactgatgacattatcttgtgaaattccttctcctggctcatcctggctcaaaagctcccctactgagcaccttgtgacccccactcctgccagccagagaacaaacccctttgactataattttcctttacctacccaaatcctataaaacggccccacctctatctccctttgctgactctcttttcagactcagcccacctgcacccaggtgaaataaacagctttgttgctcaaaaaaaaaaaaaaaaaaaaaaaaaaaagagaaatatctgatactgggtaatcgataaggaaagggtttaattggctcacagttctacaggctgtacaggaaacgtaatagcttcggcttctgtagaggcctcaggaagcttccaatcatggcagaaggcaaagggggtagcaggcatcttacatggcaggagcaggagcaagggagggtgctacatacttttaaacaaccagatcaagaactcaccatcacaagaacagcaccaaggggaaatccacccccgtaattcaatcacctcccatcaggccccacctccaacacaggattacaattgaacatgagatttgggagggtcacagatacaaaccatatcagctgtggaacattctgttccacctaccctcaacccccttttcctcggtggtgtgttgaaaagagggcttgggctggaaacaaaaggaatgggatttaagggctcacataggtggtggaggggaccatctctgagattaagatccagacaggggaatgaaagattaaaactttgaaatatccctagcacctgccttgggacctataataaaaagatgcttggtcatttgagtgaataaactggactattttcttcttaatttcaactattgataagaaagagtttgctaaggcaagaaggggattctgttacagtaagatttataatagaaatttggtggctgatatggtttggtgtctccacccaactctcccaaattggaggaggggcctggtgagaggtgactggatcataggggtgaatttccttcttgctattctcatgatagtgagttctcatgagatgtgatggtttaaagtgtgtggcacttctcaattcacacattctttctcctgctttacaccatagtaagacatgcttgcttcaccttccgccatgactaagtttcctgaggcctcccaatcatgcctattaaacctgcagaactgtgagtcaattaaaccacttttcttcataaattacccagtctcaggtagttctttatagcagtgtgagaacagactaatacagtggttttagtaaagatattcagtgcaagtctagaaggcattcttggccctgagcacccaggattgtataagtgcattacaaaataggtgtttgggttaaccttgttatgccttgtgactgtttcatatttacctttttaaatagaacctctgaaatgtacctcagaggcagtgtcagttggggacttttatcctgtgctctgatcaagacactgtacattaattgccaatcacacgcttgtctttaaagatgggaatatttaatttcttcctacttctttcctctaaaaggcttatttttctaatcaaaatgcttttctaccagaccagagattggtaatttttctgtaaagggttagatgttaaatattttaggctttgggagccatataatccttattatgaggactcatttctgctattttattatgaaagcagccacagacaatatacaaatagacaagcatggctgggttctaataaaactttatagaagccgggtgcagtggctcatgcctgtaatcccagcactttgggaggctgaggcaggctgatcacttgagctcaggagttccagaccagactgggcaacatggtgaaaccccgcttccacaaaaaaattagctggtcatggtggcacgtacctgtttttccagctactttcaggggctgaggtgggaggatcgcttgagcccaggaggtcaaggctgcagtgagccaagatcacgcccttgcactccagcctgggtgataaagtgagaccctgtgtcaaaacaacaacaacaaaaaacaaaaccccaaaaacccagctttatagaaacaggtggcaggccagatctggcccatgagctatagttgctgactcttgctccagatcataaactgctttatattggtctacagatccccagggtttaaaatcaagtagggattccaatctctggaatcatgaaacatattctacttttgtttactagttgccttgaaaactgcttgatatgaatgactgcaagatctgctgttagtccccagagctgccttttacttctttggagaagctgggactgaggtagggactgatgcaatggcttcccctccttttatgacttccaggggagccctgctactggaaggcccagcaggaagtcagaggtaggagagagaggtcagggtatttagcctcagcccagccttctcttgctggctgggccactggttggccagtagctgctcctccactgtcaggcagccctttccatatggctctttcctctatgttcagggaactgcaccccacccctttccccttcataagtagggatgcagtttgccagccccaggacaattctctgcttccttttagtgtccctgcttactccctttccacacctttgagatgagtttaatgaagggattttatttgaatattccatctgctttctgctgggacgctgaatgctaggaattaaacagaaaacccaggccatgcattaaagacttcatacagctgactcataggtggggatgaaggagctgatgcatctcaggctctaagattctccccagtggtccctgtttcctggtgtttggggcccttgtcaaccttctttctcctccttgagtatgagtagaacctgtgacttgctcctagctgggagtggcaaaagggataggatgtcacttctatggttctaacaactgtcttgctagcaaacccctctccttgctgtctttgatgaagcaagttgccatgttgaggtggcccacatggcaaagaactaagggcagccttcagccaacagcaagaagctgaggtcctcaatcctacaacctgcaaaaaaccaacacttgccagtgatcacaggggcttggaagtgggtccttccagggaacttctggcagacaccttgattgcagcctcatgagaccctggttcaagaggattcagtctagtgatatgctgacctgacttacagaaactgagaaaataaatgtgctgttttcaactgagtttgtggcaatccattaagcagcaataggcaactatatggcatagtaattgcctctctttcacagatgaggaaaatagggtttggaaacatggactaagttgcccgagagacacagctaggaacctgcagaacatgatcccaggggtaacagccctggagctcactgcctctctcctgtgtttgtagatttctatcaagcagatgtcatcttggggctcactgtccttggtgaatgacttacatctgagcttcttcctgctctacccagtacctcctggggagcagcaggggccagggtttgtaagacagcgttcagctgtcagcactggcatttgtcaaaggaagtggctgctcttgggccctgccacccttcccaaagtggacactgcttttgaaaagtgctaatgtacaaacttgtcaggcccagccttcggggaggggagggctgcagcagggctctggtgctgggggactgataagaggcagcactgctacaggaggctgggcatctttccgttgctcacttctttctccaaagtactctttggctgggaggtgggtgagagctgggtcagggagaacagagaccacttcttcagatctttctattcttaagacccagagccaaaccagtgaggttctgggtgggagaagggagagacacctctctctctagtggagaccagtgttaagggaatgaaagtgcagagttcatctgctagatgattactttatgttacagggtaggggaagaatggggcttcattcgagctactggaagaattaggaccaaaatttgagaagcatgcccctttgaaagcaagcacataagtagttggctgcctggttaagtgtcaggatgttcccaggtcttgttttatattattgttcatctccacttattacagagataggcaattccagattaaaaacatacataagtagcctctaatcaacaaaggggcagtagttttgttgcctagaaactggaggtacaatggtgaacaaaacaccacgcctgcttgagtgaataagtggcttcaaccatctaatatttaaacaactaccaagtggcaggcaccatgctgggctcaaggatacggtgaaaagacagtccttgcatttttgaacttacatcctagtgaggggaaaaataaaattactgcataacaaagtaccccaaaacttggtaacttgagacaacaatgattgctcatttctcatattgcaggttgcgtatttgggcagggctcagctgtgtggttcttctaccctatgtcacctggagttaatgcatgcttacatttagctggtgattcagatggaacactacgatggcctctcaccccccagggtctctctgtatgtggcctctcatcattgagcggttcagcttggacttccttacagcatggcatctgggctgcaagaagggaaagatgcagctgcaaaccttaagggctgaagtctcaagacatcacctccactacaatctattggctaaagcaaatcccagggccagtccagactcaggagtaggagaaaatattaataacgcctcttgctatgaagagtggcaagtgtatacagggaggagaggaagtgccggtggccatttttggaaaccattaacatataattgcagatagtgatacactcagcaatgaatattaagcctagtaaagggaaagtctagaaggtgagtgagcaatgctgttcaattgaggtataggtatgctttgaagttttggtagaaattgatattttgaaatgacatattatgattattcaagtattaaataataaaagtattatcctcattttacacatgaggaaattgagagggaggcaaatgacttaagatgacacagctaagctggtagtggagctggggtttggaaccaggacatgacttcacaagtctcttgtaatattatcccagatgaaaatctgactcaattgaggtattcctttcttcaccaattgactgaagtagctaaagggacagacttgtcactacctttatgtgatccctgaacttctgatttataggcaaaagttttattctgatcagatgacagaatgagtgaatatctagattcaaagcatcctttaggtcctagagaagagctccacaagggacagatgagttaagcctcacatgtccatttccatgggtgaaaattatctgatgttggccctatttgcaatagcaagcaaatgatagttatagtttaaaaatagccactataccttgaacacactgtcaagatgacatgagactcctgggtcagagacaaaggatttttgttttttactcaaagcacagcaagcagaataaacattgatagtttgagggttcccccttgctgtccaagttttcccattcacctgggcacagagcaatccaggtgaatgctacatatgtggcaggttcacaccacagctgagctaccttgagcctagggaaccagacaaagaactgcaagtagtcctgtctgacctgcctgagaagcaacattgtctttattacacaggacaacaaatgaatcttccctctgctctgaggctgtggaggggggtggtgacagtatttaccaaggcagttgattatataaacattcttgaagaggtagtccagaacaaaatgtcagtgcttctgctcagaagacatgcaggaatgtaagtcgcctatagagaatagtctcccaacactatgtcccaggcactattctatggacttcaagtgtttaatttaaccttcacagcagtccaatgagttaggtactgttatcccactttctagttgagcaaactgaccttgggagggtcccttaacctctcttctccctagctagtaagtgccagaccaggttggtatcctctacatttggttttcacagcaatgttcttcaccactgcatcacatggtggataatgtagcatctgctatttatagtcaacttgctaagtatgtcatctgaaaatttaacaacaaccctttgaggtggccatcaggctccttttacagaagttttgggttactgagcaactcatgcaaggtcacaatagccaagctgggatttgaacccagggctgactcaagcctttcctaccaaatgatgttctattctccttgtccctgcaaatctactgtaatagaactggcaggtgatagagtatcatttgtcttttctattaaatacaaaaataaggcggtgatgccacaagggagtatgaacccacttgtataatattgtgtctcctgctagactgaatatttcctgatagtaaagtcatatcttgcatcttggccatgtacagattactatcactgaaccaggagccactaaaagatatagaacttgggggtatcccattcgattaaggcaactcatatacatgtatagatttctgaatgtatgggaaaaggcaaggaagtcaactccagtttggctatttccatttccattttctaagggctttcaggaggatttatcttctgggccggatcctgcctaggaaaggctcatgcatccttcctacaaaagaggcactgacacttctgattaaggtaggataagctgtcacttgttggtaaagtttctaccagtctctaacccattgaaggagaatattttgctttcttctctcagatcttgtggatgtgctgtggaaatggagaaccttaaccattgcatagaatggacttggggcaagttcctgagctataagttacatagctcagaagtagcagagccaggatccaacacctgttttgccatacatcaaatggggacaatagaagtaactgatattaacctagggctgaaataaggcatgtctgctgcttggtggttgcagtcacagtcacaggaagttttaaaggcactgtagccaagagtttggcttcctcctcacaggtctcttggggtggccctgtcctccctcttgtttccttggcacagcagggtctagaccctctactcagccatacacaggagccaggctgctggaaaacatacccccagccccaactgctttgtccagtcttgggggaggtgggaaatgtacacacctagaagtgatgatggtatttctcctgcaggttcccatgaaaagcagcatcccagtgaagtcaaagccctggaaccatcctcttcatctgtgttgctgctgagagatcagaagtctacctctggagatagaatccttgtctgctgctgggatggagggaagtgctaacattccactagaaagtgggttcttccatggagggacagaatttgattcttgctgcttatacaaagtaggtgttcacaaggcacttgtgaacagctagctctgcagaacaagtctccatcatctcgttgcaggctgcttacctgctgggagtggcatcctggggccttcctctctggccaccctagactttggttttaattgctcctgagtctcccttcttcctgccggctggccctgcggtctgtcacctacgggacggccaacgtcagagctgggtgacctttcaaagacaccaggatttgtttaattttcagaattcacctctcttcatcctttttatcagaggcagttagggcccagctggggaggctatttggcatttttccctgtattttgaaacaggtgggctggggccttctcaagtggagtcttttcaactgagagaactagaaagacagacaatgatagaatggggtgggggtggagtagaattaccaagagaaccaaacatacattaagttattttaacacctgactcattttcatgaaagtcttcattactgcatcttctgtctccaaggttttctacacacataattgcagcttgtgtttacaaagtcattaccacatgccaagcacgtcacatgtctcgcttcatgtaaccttcacagcagcaccttgaggttctgttatctccgttttacaggtaggtaaggttagttattgcccaaagccatacagtgtgttgaggggccagagtttaaacacagctctgtagactcagtctgtccacgaagcaagagtatgtgcaaacctcacctgatcctcacaataaccttggaaaagaaatgtatcctcccatctgatagagtccgagtagtctcagctgctataattgttattccttctgtgctcaacatttgttggctgggtgacttgaaagctgaagtgagaaaaacagtacctggaacatggagtaaaaaccctttaacatatgggaatctactaaaccccatcaggtcagtgaaataggtactattatcaccattttacaggagaaaaaaaggtaaggctcagggatgtgaagtatgtccaagatcaagtgctgatgagtggtggaagcagatttaagtgatggccatctgaccccacagcctacattcttgactgctgcattacctcccttcctatgcatacagaccatggttggctggaccaacacagaggtctttctctagtggggtcttctggggcttaaacaattctggatgctcaactgcaggtgctatggaaccacattttggtgtttaccttccttttcccttctgccctgaccaatctagatacctgctaaatcccccaataaagcgtagggatagtttgaggcttgtacaaatggtttcaattggaaaacttctttggaataagtgagtaattgtagcaggctattgctaccgaagccaggaagagaagatatttttctcaaagggatgcttcaacaaggtacttgtgcttgggaatgatgggcacagactcatctgcttttctgatggagaagaatgtgtcaagagaagcctgaggtcttgtcacctaggcccactcatgaggtagggatggtgtaaggtcttgttcagtgggaagataggagaatgaagttctcagcaagaagccgccaaagggcataacttgggaggacagatgagcaaaagtttcctcttttggcgtctggttaccttagctcagagatgtccagacttcttatatatgacctagagggtcgtatgaacttaaaaacacaaaaaagtaagactgagattgatatatttcatcttagctgattttagttttccagcttgactttataattgttccatttgttttctcttcatttcataccatttaccatcttaccattatgccatttaccatcttaggttgtgccttacataagttttatcttattcttttgtgatttttagtttcagaggcctcattgaataaaattgaaggtgggcaaaggaaaaacacttagtgagcatataccatgtgctaggctctatgctaggtgctggggatacaaccctgcagaaggcagacaccattcatatgttttgcctttcccatttgccttgggaaggttgtaaagtacatgtcaattaccactgtaagcagctctagcaagggagtacggggttttccaagaacacatatctaggggtctcaacctagtcgagggagttgttttacactaattctgttattttaaccttttctagttttatccatccctttaattggctttattttatcatttgtttggaatattgtccatttggaattttattcctgcttgatggactggcaggcaggaaatgtggatgtgagggtggctgccacaaggatattcctcactctaatcatgtattccttccagcaaacctcagcaaccccccacaacacatacactcctttcaaaatgtggctgtggatccgagttagaataaaactacctcaacatttataccttaactcctgggactaggttttccaaacatctttttggtggggagatatcttggtggtggtgggtggggggcgtgcaatgtggtggtggtgggggatgggcaacgtggtgggggtgggggatgggcaacgtggtgggggttgtggtggtgggggcaacgtggtggtggtggtggtgtggggggcaacatggtggtggtcgtggggggtgggcaacgtggtggtggtgtggggggcaacgtggtgggatgctacatattccaaatgtcctcataaaagcatctgacttttgactgcttaccatgtgccatgatctgatcttcaccacgactccaacagtaaggtgctattattcccattttcagaaggaagaaactgaggcccagcaaggttgagcaacttacccaagattaaaagactagctattaatggagttggcacttgactcatgcagtctaattttaaagtacaagctgttatttccagcccctgcattgcctccctagatccctaagcatgaggccagccttataatggtctacagttacagaagccacagagccataccaccgtactttgagaattgagtcaactcctataggaagagttattcttcacctacgggatatgtccttgtgctatacactctaggggattcagttgaggaactgaacattgaaggtaacaacttactgagaacaaggtggaaagtaagatctgaatctgccccctcccagtgtgacttgggtgagcctcagcttgtttatccattaaatggggggtcctataacctccccctcagagacacagtttgaggatcaaatgaacagaaaaaggggggtacaggtgtgtgactgaatgtgggaatttcttttaggtagacaacagttatgagaggtgtttgtcagcagacattctcatgtactgctggagtgtctagcctgctttggaaatcaggttgatatcatttgagaaaaatcaatgtaaaaacctctgtgctgtgtggcacagtagttccgccccaagccccaggagacaagtccaaggacacccatagcaacattgctcatgatagcccccaaacagaaatcaaattcccaaagtagaagagacaagttgtggcttattcatataatactgtaaagacctaattagaagaatcaaaccatatagtgtggtagattctggagtagggaagggctataatgtagacacactttaaaggttagcctaacaagagcatggtgaccaagatggatagggagtccttggcctctggtttcatactagggaggtaatagactagaccttttacatagaattaaggtgttaagcattgaggggtcattgatagaaaaatcaataccaggggcttgacattgacaatgttcccaataagcagtagctgagtccagcatctctccctggataccaccaaccaaatgctttttactccaacctgggtagcccatatgaaattgaataaggaaaaaataataaaaagaagtatttgtggaactggaaaaaaaggtgtttaagaaataattggagaacacaataaaacaaaacatgcttgtattttaatggatctgggcaaagtaaattgaaaatcttctggaaaggattcatattctagatgccattaagactattcatgattcacgagaggaggtcaaaatatcaacattgtcagagtttggaagaagatgattccatcccaaatggatgacttcaagaggttcaagattttagtggaggaagaaactgcagatgcggtaaaaatagcaggagaactagaattagaagtggagcctgaagatgtgactgaattgctacatctcatgataaaactttcacaaatgataaattgcttgttacggacaagcacagaaattgctttcttaagatggaatctgcttctggtgaagatgctataaacattattgaaagaatctgcttctggtgaagatgctataaacattattgaaatgacaacaaagaatttagattattacataaagttagttgataaagcagtggcaaggtttgagatgactgactccaattttgtttttaaattttcttagtcttttaaaaaagattttaaaattattatagttgtacatatttggaagcatttgtgatattttgatactatgtaacatgtaatgatcaaatcaaggttattggtatatccactacctgaaacgtttatcttttgttctgggaacattacaattatcttcttctagttatttggaaatataaaataaattattgttaactataaaaaaaagaaattgaataaggagaaacttagacgttgtaccagctctgatggcagagacctcccacccatggtcactcttagttctgctccctggagacacgtgggaagcttgaaggagtttccaagatggcggtcttcatctttgatgagcttttaccacctctcatctctccttgctttatcctcaaatgggaaggcaatatagtgtgatggttatagcccttcatctagagtcaagtggctcaagtttcacatagaacctacgttagttgtgtcattttggcaagttatttaaccttgtgaagcagttacttctgtctccccttatagatgagaaaccttcagagaagctgtcatggagattaaaggtagggtataatctatttggcacaatgtctggcatgcagctagggtaagagtttttactacaatggctcaagttatgctacacattagaattacctgagcagctttaaaaagccaccctgatgccctggtcacatctcatacaaaatcagtgtctgggattggaagccaagcatcaatactttaaaaaatccgagtgtgtagcaacgtttggaagacactgatcataattttcccaaagcaggttttaggtgccttgagttttcctgatttggggcactcagccacctgcctgcagactcctattcctttagtagctctggcttcaaatatttcctgcataggtgtgaaagatggactcagctgctctgagactgaactcagctgttcagtctcctttgccgcttggcaaataataataataataaaaacactgccagcctttcctgctgcagtcaatggtaccaccaaatgctcaaacttgggaggctaccttaacttttccatgtactatattcagtcaagttccttctataatccttcattgctgtctgtcaaggagagtgagagaagcaaatgtactcatccaaagccacagtgatcaaccatcgtccccccatctaggcaacttcagtaatctacttcccttcctggcctttgttcccaggtaccagccagccacatgggtcttttaaatgcacagttcatcactcctgtgccttaggtcctcgagggcttcccattgccatctggataaagaccaaattgccaatcctgtcctaaaagactacagggccagcttctctagactcattcttatcccttgaatttccagcctctaaagggagttgcttttaattccttgaatgcttcagcctcaggacctttgcacaggttgttctggccactgttatctctacacagctttctctgaagactttagttgtcaccccatagctgctgttaagtgctttcagtgttaactcatttgatactatgaggcaaaccttattaccctaattttataggtgaggaaactggacacagacaggttgagctgctttcattaagttaagggcacagcaccagggaactaaagagctataacttgaccttgagtagtctggttccagagcctgaggtcttggcacaaccttgcactgatggatacagaacgtcacaagttttttgcccctaagtcacaactgactttacccctagattcctagagccttgcatgcagtagacacttaatggtttctgaataatctcccaacaatgacagaaaaccacctctccccattcctacattagctcagaaaccacctcttcttattcctacattggctcaaaaaccacttctctgcattcctatgttggttcagaaacaaaaccaagtggaagccgaggtggtccaagctctcagtcaagggtcccccacccccgggccacagcccagtaccagtctgtggcctgttaggaagtgggccacacagcaggaggtgagctgtgagtaggtgagcaaagcttcatctgtatttatagctgctccccttggctggggttactgcctgagctccacctcctctcagatcagcagtggcattagattctcataggagtgcgaaccctattgtgaactgcccacctgggggatccagagtgcataatccttatgagaatctaatgcctgatgatctgtcactgtctcccatcacccacagatgggactgtctagttgacggaaaacaagctcagggctcccactgattctacattatggcgagttgtataattatttcattatatattacaatttaatagaaatgaagtgtaccatagtgtaatgcacttgaaccatcccaaaaccacccccccttcctccgagcctggaaaatgtgtcttctacaaaactggtccttggtaccaaaaaggttggggactgctgctgtaggtgacactggtgtgtgccagtaggaacacacccacacacgtgctcacacgcgtccatacagcatccccctcactggggccaggtcttccctgtttggaaggaaccatcccgccctcccctcgctcccttcccagccgcctgctcggggtctccgagcagaacaaccccaccaattcatcaggggacgacagcctctcagagctgtttgggggcataaatcaaatggccaggagaaaaggttttttttaaaaaaaaaggtagcggagagagaaaaatcaggaaaggggtggggagaaaaagcaacggcaggagagagaggggaaacgagatcaaagggaaaacttcagagataacagcattatttatttttcctgctcgcagtcactgggtctttgaggcctccacactgatgtatttggacgtcttggggccgtctgttaccagaggccaccctagcccctctgcacgggcccagcccccctataggcatgccagttccatcagcagcggctgctcctggagtcttttgaagtgggtcctggtggtgtttattcgccttcgtgtaagaaacgtgtgcacagtgctggcggctgcagctgccctgggtggaggtgggagagaagggggtcccccctcatcactcatgagcctgtttatttgggaaccagagcaggcctttctccagttattattcaacgtcctctacaggctacacccgccatcccccattccagaaggtggggcaggaataacaaacatgccgccacctctgccagaggctcccatcttgtctggccccatggtgtacttggctttcagagaagagatggagatgaagggcccgcgaggatgttcagctggtggtcccaagaagactcagaacaagatggttagaggcatggatccagcagccagaacaccagggctcaatagttctgcccctagttactatgactcatgtgcaagtgaacttactgaatcctcgaatcaactggtctttcccagatgggggaaactgaggccaaaagaagtcaacatatgcaaataactgagtattcaatacggcaaatccaaatgtcagtggttcaaaacttggcgaattgctgaagattaacatggttcatcttcaagtatcagctctctccatcctctaagtttttttttttttttttttgagacagtctcactctgtcgcccaggctggagtgcagtggcatgatcttggctcactgcaaactccacctcctgggttcacgccattctcctgcctcagcctcccgagtagctggaactataggcacccgccaccacgcccagctaatttttttgtattttttagtagagcgaggtttcaccatgttagccaggatggtctcgatctcctgacctcatgatctgcccacctcggcctcccaactccatcctctaatttttaactcaactggttgaaagcttaaggcattctctgttctaaaaaactagctaagttttgtgcttaagtttaaatggatagtattaaggttaatgaatagtgttggtacagaatgcaagattgtcatgttcaacggggaacaccactttcctcaagtcaccatcaaatcagttaggcataatattaaactgggtatatgagcaagactcaagtcagatggcagaagctgacagttgaggctggcacttgctgtgtgacctgtgaaacacagagtctagctcttattttcttctcagtaagacagatagttccttcctttgtgaggtgtttgcaagggttctatgggatttaaacacttgtataaacacgatgtgccaagcactgttctgagtgcctgctaaaacatttgctggagtctcagaacagtcctacaaaatagatactattatttccattttacagatgaaaaaactgaggctgacagaagcaaacaaggttaaacagcctaacatttctaggggtatacaatagatcagaggttgaccgcttaaagttttatctcatgttcataagccttgacagttcataattgcaacatgggctgctctgtgctgtaatctccgggacagggtactttggaacgcaaataagcaggtgtaagagatgactctcctggaagggatataggagaaaaataggaacatgctctcaggcagagacatgtcctgagtctcagtgagaggtggtagcccagcccacccacttgtttctcctacagagtcaggaaccagtcctgcaagagggattgtgggccagccagatcctggtggttggaccctgggcaccactgggagtcaggagcaagtgggttttcctgggcatgcagagctgagggaaggctcctcctgggggacagagggagggccatgctagcttctggtttgaggcaagagaagaagtcatccagcagaccacagagatgcttcaggtccctctgaggttagggtaaggagtctcccggagtcagcagggttgctggaatttatagtttgagtacagctggagcctacttcactccatcctgagtgctcctcagagccctgctgtcagacaccagcacaacaggaccatgccagttattcagcattaattaagccacctggattcacatttagccaatttagaaaaactgaagtgtatctttattctcctctgccatcgaggctgttctagaaatcacagtggcaaatgcttctcaaacttctcactctcaccctcccttcatctaatccaagccttggaataatcctgcagaaggtggcatagctagagtttagatagtagcccattcttgaaatggggccagaccggtggtcttcagtttgccttccgctctttggccctcaaaggtcctggctgggctgtgctgagaaggaaactgaagagcagttctctggaggagctgcttttagacagtgcagatgaagacccgagacccctgacacaagctcacaggcagagggggaaggctcttgctggcgaggtgctcattgggtaaggggagcagtctggttttgatgtaggagtcatttactcacatcaggaaaagggctcaggaaggcagttgttatgtgacccttggccagcctggaagccctgcagacccagaaaaccacgatgtagtcatcacatcgactttgtgcgatgcttctgacacagcagaagtcctcgctaaattcgtgtgatgttccaatgaaaacagacatacatttttattataggaccttattactcaggaaggtactgattgatcttcagaccaggtggatcactcagaacactgatgagccttctatcaatcacaaaaactgggacctaaaggcaaagattctagacttttctcaggttcaggtttgctattgctgcattatcttgaggttccacttagaagctaagtcagtaagaattacaactttctctcctcttttcctgtctcagccagagaacttctaagagtgtgtggttcaaggattttttttcctacttggtgtaacagtgatgaacatcagcaaatagtcttgaggctttaatttaaaggtcacttaaatcttacccaatctagagagaatcacattttacagatgagaaaacagaggctcagaccacctcatgcagcaggctttccccagattcatacagctaggaggtgttagaagtagggcacaggatccaggttggctggggtctagaatgcatggtctgagtggctctgcatgcctagaactccactcaggtggggaccttgcctctcttccacactgtggaacagcatctgggtgctggctgtgatcttgaggctcagaggtgaagggagttcccaatttcttcattgttaagacagaagtagtgaaacatctactctttggccacaaagaggcactgtaacaaacatggtagaggatgaaagatggggtcttgatctgttgcccaggccagagtacggtggcacaatcatagctcactgcagcctcaaactcctgggcttaagagactctcccacgtcagtcttcctggtagctgggactataggcacacaccgccatgaccagctggaaagtgggttcttttgtccgtgtttttcataaatctaagtacgttcagaatgaccttgagaagcaacagcttctgtggcaccctctaatggaggtgggaccactggaacagatgtgtctcaggttcttggccttgcactggggccagtctctgggtggctgccaggtctctgcaggtatttcaaggctttagggtcataccagacaccagacagaagcgcagtgggaacggtggtggctgcttctgagcagctgcccagatgcctccactttgaagttctcaaacatgctgagcccagagccagaaagcactgaagttggtgttcttgtctttaatcagaagtgtttcaagtgtccgatttaagagttaagaaaaacccagcactaaacttgtagtcttggaatatacttttactttggaataattgtaagtgtacagaaaagttaccaagtagagagagtcctgtatatccttcacccagcttcccctaatgtcaacgttttacattaccatgatacatttgtcaaaattaaagtgaatattggtatattgctactgactccagacttcatttggatttcagcaatgattaactattgactttttgttccaggattcaacccaaggtaccacagtgcatttagaagagtattaatttttaacataagacagggaatatacttcctaaagccaagtcacacacacaaaaaaggtcctctttaactcctggcttcctgccccagtgccattaagttccatctctagtcttctcaactacagattatagtcttctgtccaatatggtacccattacccaatgggggcaatttcaaattaaatcaaaattaacattcggtttttttggtcatactggctatactaagtgctcaatagtacacattgttagtggctatggcactgagcaggacagatatagaacacttccatacatacacaagctgcactgttctagactttctcatgtgtcttcctacaagtggatacttaaatacatactttttttaaacttggttttttaatgcagtacagactgctgcacataaaatgggaatttaacctaatgtgtttgagatcatcccacactggtttatactgatcttcctcattcatttcagctgctgcagagtgtgggtttctcattatgtaagtcaggcacttttgatgagcacttaggttatttccagtttcttcctaatgaaggctacaaggaacatccttgttcattctgggagccctacattgatttgattcagggtagaggggcttaggtcaggaataaaaatattgcctctaaaagctctttctgtgtcacaagaactgtgttcagactgatggccagagtggagagaaatcagcaaagctgccacatgggcaggaggccaggagccatccagacatgttttgggccactttggagagaagtggtctagagatgccatttgggcacccacagaacaacatgataatcggactggaaagttgcatctaaccagtccaaggggccaaactgtacagtttgattggcaaatactaactgcataataaaaatatcagtagctggatctaaagcagttatgtggcagctttgtacaagccctaggtaataccataatccttaactctactgggttgagttatattatcaccattttacagatggggagactggtgaaaggttagggactttcttcattctgttccctcaaaatattctagatgtaagtggcagagctgggcatgaacttgacagagcccatgattctaacatgtcactagtcacattcttgtgcatgggacagcatgtcaagatggtgcagagaatttccacatacccttcacccagcctcccctggtgtcccatggtaatgtaagatgtggatgtttgtcaaaagaagttaactttgtgcattactataaactatacgctggactttggatttcaatttttccacccatgtcctgttctcctcactgcccacgacagaaggaagactcatttctgcagctattgcctcctttttgttggggatggggcaggtcctgagggtgctgtgttctccaacccaggcctgtctaaaatcagaccgtgcaccatccttgctgagtgatctcaggcaggttgtacttgaagatttatgttctcgtttgcaatgtgattaagtgctcagagctatagaaaccaggcaagtcttggtagagtgagatttgaactgggccttaaggaatgggtacaatttgggggtgggttggaatagaagtcaccactggctctgaacacagacgtcatcttatgtgccaatgtttcagccctccctccgaggcagcagtttcaggcacagagaaacctagtatttaatcactgacaaatcgcaggctcagacgctttggataccccaaatcttgagtatttctgacccaattcagccaacgattcagccatgtgactttagtgtggggtctacaacccctgctgaggcagatttactgttggttgtacagcatgtgttggggggcccccccttcaagtgcaacatactgtgactcaacctagacagatcttctgacagccataggccatgggcccatctgtaagacttctatcccaagcatcctcagtgttttttcatagtgggagagcactgtgctgtggcttcaattctaccccttgtttattacagagggcctccaacaatgggctcttgaagaaacatcacttccatcacttcccctggaacattaagtatctagggacctaggctccacttccaaagtcacagtccctggggatagggcacaggcttcaaatatataatacattatatatatatatatacacacacacacacacacatatatatacatatatacacactatatatacacacatatgatatatatgtgtgtatatatgtgtgtatatatagtgtgtatatatgtatatgtgtgtgtgtgtgtgtgtgtgtgtgtatatatatatatatataattgagtgattggatcaaagccagattaaagagttacaatcctgaatgttttccaagattgttttacagccatcacttcaaggagtcgtttgtgaagaaggtaccacttatgataccttgggtgtgatgtgcaaaatccggcctctgctcacgttgtcattcttgtaccatccaaatcaagtccctcaacttttctcccactgagtgagtccataagggagtcaatgcaagccacttctcttaactgtattggtggaaaactgcattccagttattggataaatagtgaggattaagcaatagtttgtaataaatataatatctgagagattatactttgccagagctccccaaccaaattaagcttctttcaagtgtgtggtataagtagagaaatgtatgcaaccactttgtcttgtgttcagaatgtacttgtaccctgaacaaaaacttcaccagggctccatgcacatgttcccagcaaagaccctttgcgtagtaatagctccattgagaaactttaagtacattttctgaattttactggtttataaaagttatatttggttattaagtcagggtacctaataatcttcatctcacattaaaggggcccacctccaaagcaatacaacttaaatagtcaagtctcctattcatccttactccctgaattctgctacccagaattcactattgctgttttacatttgtatctttgtagactagtggttcttaactgggagtgatttttgtcccagggatggctaacaacgcttagagacatttttggttatcatacccggatggtccgactggtatgagtggatagaaaccagggatcctgctaaacatcctgtaatacataggacagtccccaaagaattatccagacataaatatcattagtggtgaggctgagaaaccctgttctacatatagtctgtgcatgtacagatatagtttgtgcaaatgtctccaattgcgcaaatctatacaattgcatgcgtattgtagtagctgttctgaatcttgttgttttgtacttagtattgtgtacttagcattgtacttagacatctgtattgttctgttgtatgcatgtaccatagagcatttagggaaaaatgggaaacctaatactggttactaaaatgcctcagtagctacatctttgcgcatttaccccatgacctgaagtcttgcgctattgcagatgtgttttctgtatctaagtgaaatgactcctaggcaccaataacagactgtcagcttgggtttgcataactgcactctcctggttgtgttagtgcctgcatgtgtacacacaatcctgtgaatcatttagccactggggccttggagggatcctctcttaaaaccagacccacgctgagagctcaggctcttgtagacagttgctctccgggtcgtaagcctggaagcacacccgtcatggctttgaaatccacctcagatgccagctgaaaacagaggctttgcataatcaaattgacggatgaagctgggcttgccctgctagggacagactcattcatatcctggtttaaaagaaatattgcatttttaaagaggaaagaaacatatttaagagataaagggagggggaaaaaaaagaaaagttttctggtcattagttataataaaacacagggggaaaaattcactttaaaggcatgctaaagccctgtaatcttcaaagaaacaggcggctcagctgcctgggaggagaaacttcaccagaagaccaccatttcccgttgattgcaaacagccaaggtgaagggctgcagctgtgggtggaacatgccaggttaggaacgagttattttcctacctagctaagatcagcttactctttaggtactgcttaaactaggtacagggggaaaggtgctgttttccaagcctacctgaagaccctaatgccaaaatgtccacccttgcttttttgggggagtctcaaactttgctgcctgttgggactccgtatgataaggtcaccgttccatttaactccatcagatcattgccatgtgagaatgtgagttcatggttgccagactttctcattggtcacaagcaaccccagtgctgggttttatgtcatatgtccccgattgcacacatcaaatagcatgcttgcaactgaagtgggctctgctgcagccagtttgccaattattggaggtattgaaagccttagactatcctgaaaggtgacaattaacaccactatattgatggtggaacatggctttgtttatcctacgaactcctggtgtgaccacccacagtgttataactacctttttggggtatgggtttggattagggaaatactttgctttcctagccccactagaaagccaattcctggacaacctaactcccatttccaagaacacttcttagggcataagacaacttaagtacttttgggaacaaaatctaaagaggggggctttgcaagcttttcaatgttaaagacagtattttctgcttatcctcccctcgtcccaattaagaaaccctgaatcaccctggaggaacgggagaactcctgcctctgaaccctccttccttcacattcatttcgctgcggcttgctctgccaagcaggacctactcccaacacatgccttttaagctgcaggttgcaaccacctgttagaggccttaaaatttagtggcttgagaaagggtttgagtagtgaaaacaaatagaaaaatcagtttcctaacaaggcagattagtaaagtgaggttgcctccaaatacttttgtttcagttacatatacacatgtggccacactgggttgggggcagtagtgtccttaagccaacccctactgtgaaggtctattttgcacatctcttcctgattctacattgtgacttaactagtggtttgaaatagtcaggtgtatttgtgttacagaaatcagaatacaaagtctttcccccaaagagctcgtctctgtgcaattagtggtatacgggtaaatgttaatgtgtcaaacttcagctcatgaggaaatcatgtaggtcgagttccctgggacctgtatgcaggtggcttactggggagaacactcatgagcagtacctgtggggtactggggaagggagattttgtttcctatgggagaaactgtagttcagctgcaaggtaactcagctgaccccatggagagctttgaaacagagactgcttttcagagctatctcaagttggagtgaagagagatgggctttatacccttcatagtcatggaatgtaggttgcccccaggaagggagcatgctagctagcagaggctgtcttcagcagagggtaattcctgaagagcatctgatgcatgagccaccagcagcccaaactcacagcacccaggggaattacatctcagttttgaaagatgagacctgggtagcacaccgtggtgtccccaattttagaatctagctgcaggaaagagtggaaaaagcatgctatcacatgtgaatgaacctaaggtggcctgctagataatagaccacacagcccagctgtcctagccaagaccatctcagatctgtttatagccagctgattcccaaggatgtgacaaagcccagctagggtcagcagagctctctctccagctgaccagaggagcactaaatgagcccagctgagaccagaagagccaccatgctgactcggactcagtaccaataatacatgctcatccttttaagccactgtttattattatactttaagttctggggtacatgtgcagaacatgcaggtttgttacaaaggtatacacgtgccatggtggtttgttgcacacatcaacccatcatgtacattgggtatttctaatgctatggagtttcctcaaaaaaagctagagctaccatatattctagcagtctcacttatgggtatatacaggaagttaggatcttgagttatctgcattcccatgttcattagagcattattcaccatagccaagatgtagaaacaacctaaatgtccaatgatgaataaacggataaaggaagtaaggcatatacacagatggaacattcagccttaaatgaagttaagccaccaagttttggagtaagttttacgtagtaatagctagctgatacaatgtctgaggcaatttttctgggtagagccacacagaaatgaaaggatgaaaggatgtttttagttgaacctctaacctgtttttgagccctttaagaataaacttgattctgaaggcaatagtgagctatagaaggttattgagcaaaagtatcccaaatactgtctttctggaattggacttttagttttagatttgggaatacgtgtgcaggttacatggatatattgtgtaatggtgaggtttgggcttctagcagatccatcacccaaatagtgaacattatatccagtaaccctcatcccctcccaccttccttagcttgagtccccagtgtatcatttccatctttaagttcatgtttacccatggcttagctcccatttataagtgacagttcggtattttagcccatttgagttgtttcactgaggataatggcctccagctccacccatgttgctataaagcacgtgatttcattttcatggccgaataatatcacatggtgtacatgtaccacgttttccttatccaatcaactggtgattaacacttatgtaggttccatgactttgctggaatcagactggtctaagacttttggctactagaaactgatcttctcaagtcagctcattagagttaccttaagcagtggttttaggggtgtagatctcaaagtctatggataggaaaaaagaggtctgggcctgctaggagccagaaggctgtcagtgacagaggctactttccatctctctgttcccacatgatctcttttctacatctctgtagctctgcttaattctgtttgaatgacagaagacgctagtcttcaagtatttggatacttactgtgtgcaaagtcaggactgctcttctagtcatttctctgcttgcatttacatcaattcctcatccttccttgctctgcatataaagagccctgtaggctatgtttcctaggctcccttgccagtggtatttgtttgtgagttcaacaaatagaaacccaagaaaaggagaaaccggaatatttctcctcggatgtggtctcatctggttttagctcgtcttgccagccacttctccccggtcatcaactactgctgggaaagcctgaagtatttccagctttagcacaatggcaccaacttccgggctctggtggtgctgcctcttccatttctccaacattaatgtagtagtggcttccagctgttgctaatctctgggtgatctcacatactgtttgctctagggatggcttaagggctttgaaactggctctccatgttagattccctttgaatttcctggcattttcccccatggctggggtcttcctcatcagccaccatgatgggccatataggtatacactgcacaaatccagggtgcctttcagagaacccactttgagacctgtcaaagacgcattgcactgggtaacccattctgttgttggggatatagcagcgaacacaatgaaatcccaggtttcatggatgaggttgtgttctatcttggaacacaaccaagctgctggccaggagactcagcacagaggggtactaaggcctggccatttctccccagtgcaggactcttctcataagcagtctttgtcagctccttgttaactgatgctgtgtcaggtctactctgcaggctgaggctctccctgtccagttctacttccatctttcagacattcgaggtatgctggtaagtatttaacaaccagttctgatttatcgcgtttaccaatttctgaggtgtaaatactcccatcgtgaccagttgagctccccatgtgacatcactgaacacagtagagaagtgataccagctccagcttagaggaattgcccttgataggccgctttcccttttaacactttgcatgttttctggaagactcaacagatctgatcatcctaatttgagctctccctcttcccacatctcatcccctcagcatgtcacgtaagctccatctcagatcctagatctgcccacatcctttccattgttctagagagaatgaaagcaaggaggccagtttacttcatgatactttaaaatcttaacacttctagcttcccattggcctaagaataaaagctaagcttctaaagagacttacatcagccagcctgctttgtcctttccaaaggtgtctcctaccactttcccccagccatatcagccttcttacagtttgacaccaagctcagttgcatctaaccactttgcttttattgttccctcaacctggatgtttttcacatctactgttggcatagctggcttggtgttcagagcttagtccagtcagctgcgaggccagagtgtttacgggtatcaatagggcattgcaatggaaagtgaatgctaaatgtacctgatagcagtaacttaagcatgccctgagaaaggccctgtagggcagatgcatctgaatgtgtgttccaagctagggaatccaggagcagccaactgggagattccttccttgtccatgaggaacatccaagtccccagcccatcctatgacacatagactatacaggggagtagaggccccaagttttgggttgaatgaagattgccaggtaggatgttgttgccaagtgaaagtgctgtataagctgcatgctttttgcaagcggtcatggttcttctgcccagcttgctgccattaggctatatataaggcagtccagcttgctgccattagactatatataaggcagttctgttcaggccactgccactggactacaacttgtatgtaagctcccaacaaaaccccaattctagcctgctggctctgggtctctttgatctcttgaacctggtatcctccccattggagtcaatagggggttcagcaccacagggcatactgctgttggatcaggagatttatggcacttcatgaaagtacgagatgttatctctgttcacttctgtatcctcagtagttgcagtgctggcacatggtatttgttggctgcattggcgaaggctcctgaactgacccaagcatgagctggaaccagatgcaagccagcaatctgtctcccacatccacctggcccacctggaggttcacctgcaacttcagtggacagttcttggcacatgacctttaggctgttggcctcccaccttgaaagcacctgagtctgagggtgttctctggccataggaacatctagaagcacacacagcaatccagaagtgcttacaggttaatacccagagggacgagtccacccccatgaaagatggggtcagtggttaaatattacccccacagcttctgcactccttggagaacaatcctgagatttgttctgagcaggctctcaagtggtccccccatcttggtccactgtggctgctataacaaaatgccatagattgggtggattctaagatttctcatggtacttggaagtccaagatcaagggagtgacagattcagtgtctggtgaggtcatgtttcctggtacacagatggacacttcttgctgcatctttgtagggtagaagaggcaaggtagctccgaggcctcttttataaaggctctaatcccattcataagggcagagccctcatgatccaatcgccttccgaaggtcccacctacactaccatcacattgctggcggggctaggttttcaactgttaatcagtttagcctaaagctgcctcaagttcagcctaaaggttgttctgtatattgtgaactataacaagtgggagttgcaaagtgaccgtagccacacctgtgccaattaccaagttttggccaaatgtagcccactgttcaaactgtgttcaaataaggcaaatgccaacctttaaccaatgcagctgtttctgagactcgcagctgtttctgagactcacttctgatttctgtaagtcatttcccttttttatctataattctaccacatagctgcgttggagtctctctgaatctactgtaattctgggggctgtccgaatcgcaaatcactccttcctcaattaaactcctttatatttaattcagctaaagttttaacataaaaatttggagtgggatgggggggatccaagtatttaaaccacagcatagaccacagcagtccccgatgggataaagaccaattgctgcctccttaacagcccctttcaactgggaggtcagcccaggaaaatacacaataaggtaggaaaatgagcgaagggaagaagatcaggcgggaagcttaagtggtacctaaattctcatctcagtttgagatctttcaaaagcagatactcagccaaagtcagctgagctggtcccaggatgagcaggggtgtgtgatacccaatataaagcctccatgtcaggcttaagagttatttagtcccaggaatttgtcgctggacagaagccatcagctgcacagacctgctgtttactgcacagcagcaggtgttttcggggctttcaaaggtagagggcccaccttgatccacttagcctgggcattccaggatggagatggcaggacctgctccacacgtggaagccttcaggggaaagtctggtctcgaagatttagaggttgtaatctcctgccttgatccgctttcccagaccctcccgttctgcattctctacctactctgaagttattggggcctggtgtgaatttagggacgataaaaccatcaaagggcttgtcctcagaacaatcaattgggaagcctgcaataaagagacatcctcctcaggaaggtgtgacttcaaggccaacccatgagacctggaaagggcctcctccgaggagtcaggcagggtccacacctgggaaagattaaggtgccatctgtcccagacataagtggacatacctccttagctgcaacacagatccatcttccagggtattgggagtgaggtcaccatcctccctgagacaccaactctagttgtcaatggctctggtactccctagaaattcagctgcccttttgccaccacatacctacagggtcaaagtctccacccccgggacctaggaacccaacatcatccaagcaagctccttcattccaccactctttggccatcctagcacacaatgtcatcttacatttttaccatctggcccttcttgacaatcttgacttgcaggaccaagtctctgaatgcatccagaggtctgtcctgcggggcagcaggcggtgggagggttgggatgttgaataacaaagtaggtgtgctccaaatctctgccctcatgaagcttctttttcatgggagagtactacctaccttctcatctttctatgacctgaggagagctgggaggcaaagcagggtgagagagggagagtaatagggactgcggtattagaaagtagcatcagctcagtgttaccttcccaggaaatttcataagacctgcatgagagaaagtgagtcatgtggtacataaagtgtgttccaagggtaagtgctcaagaaaggaacatgcttaggtcaaaggacagcagtgggtccagtgtctgctattttcttctttccccttacctgtgatgtttcctttgtctgcacattccttcttcctactatctttcatgtagccaagtcctactcacatgacctttggaactcagcacagacaccacctcctccaggaagccctcccatgccccatccctgcataccatgtttccttgtgctacatacccagatccccttcagctgctggctcacgctgtcagcccctcattgagatgcagagaacagctgagtctaagatcatgcacatctatgtagctcacagccaataacacccacacagaggtatgaagccttggccagaccacctctcaaaatgcctctgaggggccatcccagctcccaagctctccatgtggttggctaaggctgctgttgggcccacactgcagctcacctccctttttcccctcctttccacaggggttgagcccaagggcacccctaaaacacatcttttcagggtctcccaaaaagactcaacctgtgattttccccagtagcatttagagtatattaaaatagtagcgactacaaatgagaaggcagttacaatctccttgagacaatctatccagagcatctgacatgctagatactgaggacttgttggatctcatgagaaccaacgtgatcacaccattgaataacattcctgtttcacagatagattgtcatctcagagcccttttcccaaacagctcggccaaggtttcgtagcaggtaagagtcacagctaggacctgacaccaaacgtatgcccttaggcattagtctatggcagcctctgacttcccagcttgtctatctccacttcactgtcaatctcaagttgagtcattgatcttgcctccatttacacagccccaatcacattggcatctcaaaaggcacctgagtgcctagaatggacattcagtcccttgacagctattgctgagtcctcttgatgacatctcatttcttttaaactcccccatctgggggcatgattcctttctgtgcttcctagtgtagagactacagaccatcacctactgttccaactgaaaggcctgccctttaattagccagcacacacttttttaacaggagaccacaagatcttagagctgggggagggcgggctgacttgttcacaaccacacagcattggaatgggctgatttatatctcgaagatagtaaggtgtgtgtgcttacaggcacctcatgatacgagaaaagggggaactactctagggtctgagtcagcaaaaggtcctcatgctttgctcgcaagcgctgtagctgaaaaagtttgggacccaggacagaggtaagctgtatgtcatcagcagacccctgccacttcgtagtgggaagagtaatggattagggatcaggattcgaatccagaggaatttcaggatacagacttgtgccagcttctccccattttccagctgggaaaactaagccccagaagccaagcaaccccttccatctcctagccttcattagggataagtgcctctgatttacagcttttatgaactttacatccttttctcagcaaccctgcatctgtaactctttggggctgagcaactgtgaaaggtgatgcctcccttacagcaaggtgggatctgcaggtagggaggatctttcgtctctcatagattctatgtgtctccagcaaggattcctaagtattttttgtgctgagcatagagttgactgacctgcgttttggggagggtcatcctgaagacagtcatcacgttagcagcgtggaaaaaggcttagggtcagatctgtgtttgaagatcagtgtcaggcttctgagcccaagctaagccattatatccactgtgacctgcacatatacatccagatggcctgaagcaactgaagatccacaaaagaagtgaaaataccttaacggatgacattccaccattgtgatttgcttctgccccaccctaactgatgaatgtactttgtaatctccccaacccttaagaatgttttttgtaattctccccacccttgagaatgtactttgtgagatccaccccctgcctgcaaaacattgctcctaactccgccgcctatcccaaaacctataagaactaatgataattccaccaccctttgctgactttctttttggactcagcccaccttcacccaggtgattaaaaactttattgctcacacaaagcctgtttggtggtctcttcactcagatgcacgtgacattttgtgcctaagacccgggtcagagggactccttcaggagaccagtcccctgtcctcactctcactccatgaagagatccacctacgacctcaggtcctcagaccaaccagcccaaggaacatctcaccaatttcaaatcgggtaagcagtcttttcactctcttctctagcctctctcgctacccttcaatctccctgtccttccaattccagttctttttcctctctagtagagacaaaggagacatcttttatccatggacccaaaactctggcaccggtcacggactcgggaagatagtcttcccttggtgtttaatcactgcagggacgcctgcctgattattcacccacattccactggtgtctgatcaccgcagggacggctgccttggtcattcacccacattcccttggtggcaagtcaattgcggggatgcctgcattggctgctcacccacattgcagcccagggctgctccccaccccccttctctgtgtctctacccttctctttaaacttgcctccttcactatgggcaaccttccaccctccattcctcctcctcccttagcttgtgttcttaagaacttaaaacctcttcaactcttgcctgacctaaaatctaagcatcttattttcttctgcaacaccacttgtccccaatacaaactcgacaatggttctaaatggccagaaaacagcacttttgatttctccatcctacgagacctagataaacttttgtcaaaaaatgggcaaatggtccgaggtgtcttacgtccaggcatttttcacatttcattccctccctagtctctgctcccaatgcaactcatcctaaatcctcctttccctcccacctgtcccttcagccccaacgccaagcgtcactgactcttgtgaatcttccttttctactgacctatgtgacctctcaccttctcaccagactgctcctcctcaggtcgctccccgccaggctgaatcaggctccaactcttcttcagcctctgctccccgaccctataacccttctattacctcccctccccacacctggtctggtttacagtttcgttctgccactagctctcccccacctgcccaacaatttcctcttagagaggtggctggagctgaaagcatagtcagggtacgtgtgcctttttctctatcagacctttcccaaatcagccagcatttaggctctttctcatcagaccccactaaatatatacaggaattctgatatctaactctctcctacaatttaacatctagtgacttaaatgtcatcctaacttctaccctcttcccagatgaatgggaaagagttttttctctagcccaatctcatgctgataacctccagcttcatgagccagacctccagaaaggcattaaagcagtttcccaagaggatccccaatggagctatcaggcagattccccaggtatagctaggcgagattatatggtttcccgcctagttgaagggcttaaaaaggcagcttacaaagctgttaattatgacaagcttaaaaaaactacccaaggtaaagacgaaaacccagcccagttcatggcccgcttagcggcaacccttacacactttaccgccctagacccagaggggccagaaggccgccttattcttaataggcattgcatcacccagtcagctcctgacattagaaaaaagcttcaaaaattggaatccggccctcaaaccccacaacaggaattaacctcgccttcaaggtgtacaatagagaggaggtagccagacagcaacatatttttgagttacagctacttacctccactgtaagacaacccacaaccacgtatgtctccagcatacaagaacttcagaacattcaagccacagttcccaggggctccttcaaaacatcctcatggaccttgcttcaaatgccaaaagcccggccactgggcctcagaatgcccagagcccgggattcctcctaagccgtgccctgtctgtgtggtcccccagtggaggtcagactgtctgactcacatcaccgctgctcctaaagcccctggagcccaaacccaatgttccttggccgactccttcccagatctcctcggcttagcagctgaagactgacactgcccaatcgcctcggaagccccctagaccatcccggatgctgagctttgagtaactcttacagtggaaggtaagtccgtcccctgtttaatcaatacgggggctacccactccacattaccttcttttcaaggtctgtttcccttgccctcgtaactgttgtgggtattgacagccaagtttcaaagccccttaaaactcccccactctggtgccgacttggacaacattcttttaggcactgtttttttgttatccccacctgcccagttcccttattaggccaagacattttaaccaaattatctgcttccctgattattccttgactacagccatatatcattgccacccttcttcccaacccaaagcctccttcacatcttcctctcctatcccctgaccttaacccacaaggatgggacacctccactccctccctggcaactgatcacatgcccattactatcccattaaaaccgaatcactcttaccctgctcaatgccagtatcccatcccacaacaggctttaaggggattaaagcctgttatcactcgcctgctacagcatgtgcttctaaaacctataaactctccttacaattctcccatttcacctgttcaaaaaccagacaagtcttacaggttagttcaggatctgcaccttatcaaccaaattgtttttcctatccaccctgtggtgcccaacccgtacactcctttgtcctcaataccttcctccgcaactcactattctgttcttgatcttaaagatgcttttttcactattctcccctacacccctcatcccagcctctctttgcttttacctggactgaccctgacacccatcagtcccagcagcttacctgggctgtactgccacaaggcttcagggacagccctcattacttcagccaagctctttctcatgatttactttctttccacccctccacttctcacgttattcaatatattgatgaccttctttttagcccctcctttgattcttctcaacaagacaccctcctgctccttcaacatttattctccaagggatatcaggtatcccccttccaaagctcaaatttcttctccatctgttatctaccttggcataattcttcataaaaacatacatgctctccctgtcaaatgcatctgactgatctctcaaaccccaaccccttctgcaaaacaacaactcctttccttcctgggcatggttggatactttcgcctttggatacctggttttgccatactaacaaaaccattatataaacgcacaaaaggaaacctagctgaccccatagatcctaaatcctttccccattcctctttccattccttgaggacagctttagagactgctcccacactagctctgactcatcccaacccttttcattacacacacgaagtgcagggctgtgcagtcggaattcctacacaaggactgggaccgcgccctgtagcctttttgtccaaacaacttgaccttacgttttaggctctccatcatgtctccatgtggtggccgccactgccctaatacttttagaggccctcaaaatcacaaactatgctcaactcactctctacagttctcgtaacttccaaaatctattttcttccccacacctgacacacatactttctgctccccagctccttaagctgtactcactctttgttgaatttcccagttaccattgttcctggcccggacttcaatctggcctcccacattattcctgataccacacctgacccccatgactgttatctctctgatacacctggcattcactccatttcccatatttccttctttgctattcctcaccctgatcacacctggtttattgatggcagttccaccacgcctaatcgccacacaccagcaaaggcaggctatgctatagtaccttccacatctatcattgaggctgctgctctgccgccctccgctacctctcg

SEQ ID NO: 455 - DNA, 20001 bp, Homo sapiens
ttcccaggctgcatgcatccccacccacgctcagttcactgctgtgtctctctgcacccagcacatgatctgctagaggcctgacattcaagtacctgctggatgggcgagtcttttactttctgtaaatcagaaatatctttctggatttagagtgtcagagatctggaccaagtcacgcaaactttctatgcccaaatgactggttgctcaaaaacagcatcactggttagaaactacatctgtcagtacagattgtattgagcagattactctttaagccctgtccacgtaactgtcagaggcacgttcttcacaggaacaagcatcagcagctaagaaaagaaacttcatggaagcatcacaaatactttgttaatcagacattgttgatgaggcattttaaccaacaaaatattcaactttacctagaaaaaaacaccagccatttacaagcacggttgtgagtacacattcaactactctaagaactactgggaaaggacacatttcctggggcggggcgggggaggggaattaaacttgtatctggtaactttaagatgggtttttaaatattaaaagttattaaacttcaaattcagttttaacttactattttatactagggagaaggttgttcttttctctttttttgagacagggtctcaatctgtctgttgcccaggctggagggcagtggcaaaatcttggctcactgcaacctccgcctcctggactcaagcaatcttcccacctcagcctcctgagtagctggaaccacaggcatgcaccactacacctggctgagtttttgtatgttttttgtaaagacagggttttgccatgttgcccaggctggtcttgaactcctgagctcaaatgatctgcccacctcagcctcccaaagtgctgggactacaagtgaaagccactgtgcccagccagaaggctgctttttataactccctaaaaacaaaaaatctggtaaacattaatcacacttataattacatagcacttgctccctcccaccttctcccagagcttcacacattagataattttatgcttcataactccctctatgaggtggacaagagagataccactgtccccatttcacgtacaagaaaaagttttgagagatttaaaaattatttgcccaagatgagaaactccatgagtggaaacttccacggatatactctctgactgctcagctgctgtgtctaaagcaggatggtattgaagtagatgagctgacttctagctctgccgttctagaacaaaactgattgacatgttctactgtttcaggaagggtttggatatatagaaactgagtgacaaataattgccttatttgctttttgctattcaagccaagaaaacgtactttctcacgattccccaacatataaatttggctgtattttgccaaaatagtcacagctctcacgttcaatgacattgagctttttttttttttttttatgagacaatgtctcactctgtcacccaggcgggagtgcagtggcatggcacaatcatggctcactgcagcctctatctcctgggctcaaggaatcctcctagcttagcctcctgagtaccaaggactacaggtgcgagtcacacctggatagtttttttgtgcgtgctttgttttgttggtttttctgaaacagagtctctttctgttgcccagactggagtacagtggcacaatctcggctttctgcaacctccgcctcctggattcaagcgatgctcctgccgcagcctccagagtagctgggactacaggtgtgcgccatgacatccggctattttagtagaaacggggttttgccatgttggccaggctagtctccaactcctgacctcaagtggtccacccaactcggcctcccaaagtgctgggattacaggcatgagccactgcgactggcctcctgctaattttttaatttttttcgagaaacagtgtctccctgtgttgcccaagctggtctccaatacctgggctcaagtgatgcccccaccctgatctcccagactgctgggattacaggagtgagccacagcttttcttcattaaataaatacctgagctcctactacacggcactgaaagataatccatcgggcaagacaacacaactataatttgctgtgtttaagatgatattgatctgcggaacacagggaatatttgtccattaataaaaaaggaaaaatcaccgtgaagaaacttccttggaatgaatataaagcataatttccatgatcctaaggatgaaatcattgcctttctcaaccagagctcctcatctgaaccacagaacacagataatgatttaagtggctcttttctctattctcccactcgggggtacataacagctccattctagcagcagaggagagagaataattcattacatgcagtgggtgtcgtagggctgtgggccttagcacccctgttctgaggctgccaacaatttagagaccagaggctctatctgtgcacacacgtagcatgaattagtacctgtattgtaaagggaaaaagtcataactacttctgctggcctaagccgtcctgggttagacaagcttggaaagtgcacgaccatcactatcattccgctgtcactgcaccatgcacagtcctgtcacctttacacgtgtagaatgcatcgaaatccttccaaaatttttagtgacctgcttttcccttgctaaagtaaacagtaacttgctgtgtgcccggctgctgggcgcgtaaggtgcgttcagagtcaacacacggtcccagtttccaaagcaaactactgggagatcagacacaagctgctgttcgcgctcgccccaccccaagcacccagcactctaaggtgcccacatttcacacccatctgttgcctcccgcttggtgcacagtcctttgtgaagccccagggataaagcagcgaccaagaggacccggcctgctccccggggctgacgccagctgcggggaccccgtggggcggaccacagttaggccagtgggctccggctgggtaagcgccagatacaatccgccaagcggagtgacggacagggagccacgctcgaagagggggtcgaggccgggaccttccccgctccctcctcctgccccaacccgccctgaggactccgcccaggaagccctggggaccccgcccggagcccccaccctaggactcccgggacccccgccctggggaccccaccagcagtccccgctcaggactccctgagaccctgcccgcagcccccgccccagaacgccggagatccccgccctggggaccctcccggagccccgcccaagacgccccgagcccccgcccgccctccagacgccgccccggccgggcctgaaccgctacccgcggctgccgctcaccgccgtcaggtctggcagccggtcccgcatccccgccggccgggcagcgcgccccgccgctcaagcctgtcccgagctgcctccggccgggcctcgggctctccggtctccgcctcaggccccgcggtcccggcccggcgccagcagccctccctggagccggcgctgccacggcaaccgcgccccgcgcgctctgcgcatgcccggcccgcgccgcgccccgcacccacccacacggcggcagcgctttccagcgggagcccggaggggcggggcctgggggcggggcctaggcggggaggggcggggtccggccgagccccaggctggcagttccgctacacgtgctgtttgtcccttgatctgcttttatgctttcacactcattgttttatttatcaaaatatagagcattcaacgaatagtgacaaaagagcaaagctcccggaatgtgctgggtgcagctttgggtaatacatatgccgaaccttctctttaagggtccacgcgcagcctcgggtgtgaatgaaggagaagagatcgtgtaccacacatgatgcttacggagcataacacggcagggggcggtaacgggaagagcgtccgcaggcccagccctgggataccattctggcaggagaaacaggcaatacagacacagacaaataaatgatagatgagaaaagaaagtaagggcatgggcacggaactggcagagaggtcgtcatgaaggtgcaggagcttaggtgaactacccaggttgggggaacagtccccaagaccattatcacctctgacaccaacggcaaattctggcggtttccaaaaccaccttcaagttccataatttgctagaaggaatcacagaatacactaaaaactactgtactcacaactatggtttcttagcaggaaaatgatacggattaacatcagccaaggaagaagggcagagggggagtctggggattacggcgtgcagcttcaaggtcctcccgtggtcctctccctgtgtagtcaggcctcattacttgccctgcactgatgtgtggccttacacacgaagtactgccagccagggaagctcacttgagccacagtgtgcagaacgtttactgggctccattgcatgtgcatgattgattgattgtttgattgctttcatgcttgatctcagcctcttggttaagtgatatccatgtaaccctaagcccccaccataaatcacactgttactctctggctagccgaagactcccaggcaaacaaagattgccttccaggaggagaaggcaaggccagatttgtttttaaacaaggttaaagtctttactgcctcctggaggaggtggctttggtctgaccagaaggcagcgctaagaaatctgcttgagagcaacaggctacacattaaaaaacaggacgttttggacttggttctaggtgtgatgtggttctgttacccgatggaaggtcttgacagccagttgtccaggtgagtgtggtggcgggcacctgtaatcccagctactcaggaggctgatgcatgagaattgcttgaacccgggaggtggagcttgcagtgagccaagatcgcaccactgcactccagcctggacagtaaagcgagactccgtctccaaaaaaaaaaaaaagatatgttttttctctccatatcctgaacttccccaccagaatgcctcctggaccccgcaacaggcaagtgcttttctttcggccttcttgcctctgccaccaccattttaattctccctctctggtaaatactgggccctccctcgtttctccctctctcccagtggatttttcaaaaacatatgataatattggcagcagctggatggtgttgaattggcaaccaaaactttttgtttgtttgtttgtttgtttgagacagagtcttattctgtctcccagactggagtgcagtggcatggtcatagtccactgccgccttgaactcctgggctcaagtaatcctcccacctcagcctccaaaagcacagggaccacagacatgagcccaccatgcccaacctcaaaactttccttatcctgccagagaaaaaaaatgaagttgtgaataatcgttgtgggaattcagggaccctgaatggagggaccggctgaagccatggaagaagaacataaattatgaagatttcatggacatttattagttccccaaattaatacttttataatttcttatgcctgtctttactgtaatctctgaacataaattgtgaagatttcatggacacttatcacttccccagtcaatacccttgtgatttcctaggcctgtctttactttaatctcttaatcccatcatcttcgtaagctgaggaggatgtatgtcgcctcaggaccctgtgatgattttgttaactgcacaaattgtttgtagagcatgtgtgtttgaacaatatgaaatctgggcacctagaaaaaagaacaggataacagcaatgttcagggaacaagagagataaccttaaactctgactgccggtgagccaggcggaacagagccgtatttctcttctttcaaaagcaaatgggagaaatattgctgaattctttttctcagcaaggaacatccctgagaaagagaaagcatccctgagggtaggcctctgaaatggccgctttgggggtggctgggcatggtggcatgtgcctgtagactactcaggaggctgaggcaggaggattgcttgagcccaggaggttaaggctgaagtgagctgtgactgtgccactgcactccagcctgggcaacagagtgagaccctgtctaaaaaaatatatatatacacatacacacatgcactataaatatatagtatatacatactatacacacacatatagtgtatacatgctatatacacacatatagtacatacaagctatatgtatatacagatcgcagctgtagggatgaaataagccccagtctcctgtagccctcccaggcttattaggacgaggaaattcccgcctaataaattttggtcagaccagttgtctgctctcaaaccctgtttcctgataagatgttatcaatgacagtgcctgcccgaaacttcattagcaattctaatttctccccggtcctgtggtcctgtgatctcgccctgcctccatttaccttgtgatattctattaccttgtgaagcatgtgatctctgtgacccacaccctatttgtacactccctccccttttgaaaatcgcttataaaaacttgctagttttatggctcagggggcatcacggaacctgccgacatgtgatgtctcccccagacacccagctttaaaatttctctcttttgtactctgtccctttatttctcagaccggccaacacttaggggaaatagaaaataacctacgtgaaatattggggatgaattttgcccaatatctggctgaatttcccctgataaataataatgtgtaatttatcatttttgttcatattacatacatacatatgcagtcaaggtgtttttggggtcaaaacatcaaccagatcacaacagtgcgttcaaaacaccatcataacagccaaacactaaaattgaatgaaatctacatggaggctgaggtgggaggattgcttgagcccaggagttggaggctgcagtaagctgtgatcatgcaactgctctccagccgggtccacagagcaagaccctgtttctaaaaaataaataaataaataaataaatgtttaaaaaacttaaagaagaaaacgcgaaagaggcagaggaagaggaagaaggaaaaaagagaggaagaaggaaaaaagaaggaagaaagaaaaaaggaaggaaggagaaaaaaggaaaaagaaaggaaggaaggaaggagaaaggaaatatggaagaaagaaagaaagaagaaggaaggaaggaaggaaggaagaaagaaagaaagaaagaaagaaagaaagaaagaaagaaagaaagaaagaaagaaagaaagaaaagagaaacaaagggctaagttacattcccgagaaaatctgactggagcctgggcaacatagcaaaacactgtctctgcaaaaaatttttaaaaattagctgggcatggtggcatgtgcctgtaggttactcaggaggctgacgcaggaggattgcttgagcccaggaggtcaaggctgaagtgagctgtgattgtgccactgcactccagcctgggcaacagaatgagaccctgtctaaatatatatataatatatattacatatatatataatttatatatatattatatatattatatatacattatatatataatatatataatttatatatatatattatatattatatatacattatatatataatatatataatatatatatacacacacatccactgtaaatatatagtatatacatactatatgcacacatatagtatatacatgctatatacacacatatagtacatataagctatatacacccatatagtacatacaagtggtatacacacacatataggatatacatgctatatatactcatatagtacgtgctacatatacacatatatagtatatactatatagtatgtatatgctacatagtatatagtatatacacacatatgtatatagtatatacatgtagtatatatacacatatgtatgtatgtatatatgtatatatagtatatattgtatatatactacgtatatatagtatatattgtatgtatactacgtatatatagtatatattgtatgtatactacgtatatatagtatatattgtatgtatactacgtatatatagtatatgtcgtatatatcatatatatactatgtatatatagtatatatcgtatatatcatatatatactatgtatatatagtatatatcgtatatatgctacgtatatatcttatatatgctacgtatatatagtatatattgtgtatatactactgtatatatggtatatgttgtgtatatactactgtatatagtacatatacaatatatactatatatgtatatacagaatatatacatatatgtatatacacaatatatacatatatgtgtatacacagcatatattttatatgtatatacacagtatatactgtatatgtatatatatacacacagtatgtactgtatatgtatatatacagtatatactatatatgtatatatactgtatatactatatactgtatattctataatacagtatgtacatgctatttatcgtatgtatatactataatacagtgtatacatgctatttatcgtatgtatatactataatacagtgtatacatgctatttattgtatgtatatactataatacagtatatacatgctatttatcatatgtatatactatatttgtgtatagtatgtatatactatatgtgtgtatagtatgtatatactatatgtgtgtatagtatgtatatactatatgtgtgtatagtatgtatatactatatatgtatagtgtgcatgtgtgtgtgcatgtgtgtgtgtatatatgtatgttttttttagccagggtctctgttgcctaggctggagtgcagtggcacaatcacagctcacttcagccttgacctcctgggctcaagcaatcctcctgcctcagcctcctgagtagcttacaggcacatgccaccatgcccagcatatacatatagtatgtatattctgtatgtataatatgtatatactatatatgtatgtataacgggtcaagtgctccgtttaactgtgattctaggactttctatgctggcccaactctggcatcttgcaccactttcccatgattcttcccttagggtggcctgcccgcatgtgtagtgctttcttcatgctggggaagtgagcatgtgcagtatgtttagcaagctgtacgcatgcccatctgagactttcttccctttcctagcagagagccccacaggaggtcatactccgccattttgtctcttaatgcaaatgctcagactcccttgcccaatacctgagattttattagaatccctttctgcttctcctggcacttgccttcaattaacactctaatataaccgctgcagaccatcaggagattgtctctcgctggcgccagctgctgaattatcattttgagagaggcagtgtgatcattgttgaaccagcacctgatggtctcctgacattcctggtgggtcaggggagagccctctcctgccccactcatgcctgtctacctgtaacaggctgaagaatggaccccaacagaagtacaccctaatcctcagaatttgtactatgtcaccttagatggcaaagtctataatcacaggtcatagactttcctggagtattgggagttagctcagtctaatcacacaagccctcaaaagcagagcactttccccagctggaataaaagatgtagcagagggggaagtcagaccccaagtgtaaggatttgatgtactcttgctagctctgaaatgtaggggccccatgcaagggcccaagagagacctctaggagctatggatggacctcagtacacagccagcaaagaaatgggaacctcagttcttgagctgtgaagaactgcattctgccagcaataggagtgggcttggaagtgaattctcccttgtgcctcccaacaagagcccaggggctgcaccttgatttcagccttgtgaaacccagagtagagagccagtggagcccactcaggcttctgacctactgaattgggagctaacaaatgtgccttatttaaagttgctacgtctttttttgttttgtttcattttgtatgagacagagtctggctttgttgcccaggctggagtgcagtggcatgatctttgctcactgcaacctctgtctcccaggttcaagcgattctctgattctcctgcctcagcctcctgagtagctgggattacaggcgcccaccatcatgcccggctaatttttgtattttaagtaaagatggggtttcaccatgttggccacgctgacctcgagctcctgacttcaagtgacccgcctgcctggcctcccaaagtgctgagattacagacatgagccattgtgcctggccctagagttgctacatctttatcattgttacagcagcaacagaaaactagcagtcatttagtaaaattaggtatttagctcctgaagaatagggaatataggctggaggatagataatatattatgtaccccttgtcaagaaatgttacaagtgaatgaatgaacagggcaaggaaggtgatttattgatcttggtagccttccctaccccacacagctatgtttctggtggacatgaactgaataaatcaaatattcagttagtccccagggaatgagaagggcatatatagagttagaacagagctgaatgcattctgaaatcacaataggaaacagatgtgagagtttacaggctgcagactcatgggcaatatacacatcttctattcagtctaacataccccagcttttctctgtacagtctagggttttcctctgcaccattggttttatttctcctacttgactcacccatcagaaatggttgttggccagtggttcatgcctgtaatgccagtactttgggaggccagctgatcagttgaggtcaggagttcgagaccagcctgagcaacatgatgaaaccccgtctctactaaaaatacaaaaattagccgggcatggtggcgggtgcctgtaatcccagcgacttgggagtctgagacaggagaatagcttgaacccaggacttggaggttgtggtgagctgggatcacaccactgcactccaacctggacagagcaagactctgtttcaaagaaaaaaagaaaagaaaagaaatgaaatttttttttttttacttttaagttcaggggtgcacgtgccagtttgttatataggtaaacttgtgtcatggggggttgttgtacagattagtacattaccaaggtactaagcctagtagccattagttatttttcctgatcctctccctcctcctaccctctaccctccaaaaggccacagtgtgtgttgtttccctctatgtgtccatgtgttctcaccatttagctcctacttctaagagagaacacgtggttatttggtgtctgttcctgcgttcctttgctaaggacagtggcctccagttccacccacgttgctgcaaaggacatgatctcgttctttttttatagccgtgattcataagcacactgaagtttgagcccacactctaaagattagagcacattggcaacatggcctgcagatgtatgggattcttagattcatattcgtagtgtttgtgttcctcggtgtacaagcctggctgaacacctcgactatacagaataaggtttccagcaaataggcagagaagccggcagaaagggagatgggggaacaggggggcttagcatcgtgtttttgtttttgtttttgttttgaggcagggtctcactctgtggcccaggctggatgcagtggccccatctcacctcactgtagcctctacctccctggctcaagcaatcctcccatctcagcctcccaggtagctgggactacggttgtgtgtcaccacgacccactaattttgtttattttttctgcagacagggtctccctatgttgcctaggctggtcctgaattcctgggctgaagtgatccaccctcctcagcctcccaaagtgctgggattacaggcatgagccaccatgcgtgacccctggcctgttgttttaaaagcactgaaaccttaagaacataagcccttcattataaggaatgatgttgccttataaaagatgatgacaaatttgcttcataaaatgaagaaaagatttaaaaatactctttactgcttcctacaggaaatctgagaaagttaataaacactgagcaagggaggccagcatggtggcttacacctgtaatcccagcactttgggaggcagaggtgggaggatcgcttaagtccaggagttcaagaccagcctgagcaacatagcaagaccctgtctctataaaaaataaaaaattagcaaggcgtggtggtgcagacctgtgggcccaggtacttgggagactgaagtgggaggatcgcttgagcccaagaggtcaaggctgcagtgagctgtgattgtgacactgcattccaccctgggcaacagagtgaggccctgtctctattaaaaacaaaaaacagggccaggcacagaggctcacacctataatcccagcactttgggaggctgaggcgggtggatcatgaggtcaggagcttgagaccgtcctggctaacacggtaaatccccatctctactaaaaatacaaaaaaacgagcctgtagtcccagctactcaggagactgagggaggagaattgtttgaacgcaggaggcagaggttgcagtgagctgagaccgcactactgcactccagcctgggtgacagagtgagactccatctcaaaaagaaaaacaggctgggcatggtggctcatgcctgtaatcccagcactttgggaggctaaggcaggcaaatcacttgaggttaggagttcaagaccagcctggccaacatggtgaaaccccatctctactaaataaaataaaaaaaaatcagccaggtatggtggtgggtacctgtacttccagctactcaggaggctgaggcaggagaattgcttgaactggtgaggcagaggttgcagtgagctgagatcatgctactgcactccagcctgggtgacagagcaagactccatctcaaaaaataaataaataaataaataaataaataaataaataaaattaaaataaaaaacaaaagcactggtgagtgaagccattttgggcattctactgcaacccagctgccagcttaatgtagcaagtgagtggaccccaaccaacaccacctggagcagaagaaccaacaagctgagccctgcccatattcgtgaccctcagaattgtaaaccaaaaagtatctgagacaggtctcaatcaatgtaggttaaggacatgcctggaaaaaataaacacagactcacagaagcaatcatctgtggcctctgcctttctccaaagatgattttgagggcttcagtgtttaaaggggaaaagcaggcttcaggcgaaaagggagggtgtggtcatccacatgctgcgagagaaaaggagcaggtaggggaatcatcaattatgtattcatctagtgcccagtaaatcagcactttattttttatttttgtatatatattttaggcagggtctcactccatcacccaggctagagtgcagtggtgtgaactcagctcactgcaacctccgccctccaggttcaagtgattctcttgcctcagcctcccaagtagctggaatcataggcacccaccaccacacccagctaatttttgtatttttaggagagacggggtttttgccatgttgcccgggctggtctcgaactcctgagctcaaggcatctgcccaccttggcctcccaaggtgttaggattacaggtgtgagccactgcactttatgtagataaggtgaatgcagagtagcaacctgaggaggtgtttaacctttgatctgtagctgtctgcttcagaacaaaaggaaagacagtttcattcatgactcagctttcagcttaatgtttttcttttggcagagtgaattggggtccgagtatttatttttccttcacagaatcatgagaaattataaatcattgttgtattatgccattaagttttggggtagtcgattatgcagtagataactggagcaaataattaaagagaatcttgttcatttatgtagaaatgtgtatttagtacccactgtaaaccaaaaataaaattctaagccccccaaccatctgaatggacccctcttctcagccaagggcattccaaagtaacctgaaaaaccagttcaggccatgatgggaagtggggttggacatgcctcatgatgccctcctccctttggaattcaggaaaagcggaacagcattaacatcaacacagaccttaggtctgttgaaacatttacaatctattctctctgaagtctgctacttggaggcttcatctgcataataaactttggtctccacaaccgcttattgtaacacagacatttctttctatggacagtaactctttcaaccaattgccaatcaaaaaagtcttaaatctacataggacctagaagcctccccctccaccacttcaagttgtcccacccttccagatcgaagcgacgtaactcttacatgtattgattgatgccttatgtctcccaaaaatgtataaaagcaagctgtgccacaaccaccttgggcataagtcatcaggacctcctgaggctgtcatgggtgcattcttaagctcagcaaaataaactttctaaactgattgagatctgtgtctcagagacttttgggttcacatcagtatgtgccatataccgttctatgctctaggaatatagaattgtatagcatatagaatataaaatccgtgccttcacagagcttctattcaagggtggaagtgtgtgtgtattcatgtgcgtgtgtgtgagaatgtgtgtgcatttgcgtgtgcacacgtgtgtgtgcacgtgtgtgtgtgcttctattcaagggtggaagtgtgcgtgtattcatgtgcgtgtgtgtgagcatgtgtgtgcatttgtgtgtgtgcatatgtgtgtgcacgcatgtgtgtgtgtgtgtgtgtaagaaacaaacaagataaaagagaaaggccaggcactgtggctacacctgtaactgctgtgttttgggaggccaaggtgggaggatcacttgaggccaggtgttccaggccagcctgagcaacatagctgggatctacaaaaaatctttttaggctgggcgcggtggctcacgcccgtaatcccagcactttgggaggccgaggccggcggatcacgaggtcaggagatcgagaccatcctggctaacacggtgaaaccccgtctctaccaaaaatacaaaaaattagcctggcgtggtggcgggcacctgcagtcccagctacttgggaggctgaggcaggagaatggcgtgaacccgggaggcggagctttcagtgagccaagatcgcgccactgcactccagcctgggcgacagagcaagactctgtccaaaaaaaaaaaaaaaaacaaaaaaaactttttaaattagccaggtgcggtggcatgtgcctgtagtcccagctactcaggaggctgaggcaggagtattgcttaagcccaggagtccaggaggctgtactgagatctgatcacatcactgcactccagcctggacaacagagcaaggacccatctcccaaaaaaacaaaacaaaacaaaacaaaacaaacaaacaaaaaaacaaaacatataataagttctgggtgtgaagtgctccagagaaaaatgacgcaggaaaaggggacagagggtgtcggggcaggtgcagtttcaggcaggtcgactgggaaaagcatcactgagatgatgccatggagatgccactgtgggcctcccagatccttctggggcctcagggactccctgctcactgctccgcgtgttgccggagccacggcgttcacctgagtccctggctaagcactgcttcctgggggtggctgcatgccgcgatgcccactgctgtgaagtgggagaactccagcggcagcgcggatgtcagagctcagggcaggagcacctcagtgaggccttggtggtcaaacccacttcccaatcccactttcttctctcctccctgagtgtcaaccctcccaataacttcctgtttcccaggaactggacccaagacagatgggaatgggggaaggagactagccatgctttccacgcagggagaacggagaagggcaagggcggagcagagggctcagggagcccgcagagggttaggtggctcctccgcgccaacctccaagcaaaaccctgacagcggccgggcgcggtggctcacacctgtaatcccagcactttgggaggccgaggcgggtggatcacgaggtcaggagatcgagaccatcctggctaacacggtgaaaccccgtctctagcaaaaatacaaaaaattagccgggcgtggtggcggccgcctgtagtcccagctactcgggaggccgaggcaggagaatggcgtgaacccgggaggcggagcttgcagtgagccgagatcgcgcccctgcactccagcctgggcgacatagcgagactccgtctcaaaaaaaaaacaaaacaaaaaaaacaaaaaacaacaaaaccctgacagcagcagcggggcctgcgcactccgagctcagccagcgcctctcaggcctcatccctgctaccctggcatcctctgcaggaattgctctgtccccacagggaccagctctgtcccgtgccttcttcggggttttggttccatgacgtttctgtgaggcttcttcagacccatccggttaaaaattgccaccccctttgaactgctctatgcacagcacttcagacaagagactcgcaggcttttctaccccagcaacccagtctccagctctccagaccccagcagagtgtccaacggttccattccattctgccctgaactacctggaattggtccagaccccacaggtcagggactcagcccacaagacggccccgcacttcagatgccaatcacagatcggggcctccagtgcgtctgactgactggccattaatagaaggctcctacagcccctccctcctcaagtttgataatttgctagaatgcgtcacagaacacagggaagtgctttacttactattactactttattacaaaggcttcaactcaggaacagccacaaagaagaggtgcacagggccaggtaaggatgggaggggcgtgcagggggtctcaggaccagactaggcagcacctcttggcctactgaaatgctaaatctgaaaatgatcttgaagatgaatccttgtgtgtgtgtgtgtgtgtgtgtgtgtgtgtgtgtgtgtgacaaggtctcattctgtcacccaggctggagtgcagtggtgcaatcgtggttcactgcagcctcaacctcctgggctcaagcgatcctcccacctcagcctcccaggtagctgggactacaggctcatgccaccagccctagctaattttgtttttctgtagagatggggtctcactgtgttgcccaggcaacaatgcattgtccaggccttctccctaccagctgctcctctcactgcctcctggcgttcaccaacccagaagctcgcagagccccgtcattcagggttttatggagagcccattcgggagacatgattgctgtcattggccagtggtgattaatgcaatctgcaaccaccagagatcgagggtggagctgaaagtcccaaccctctaatcccaaggttggttcccctggcaaccagtccccatctaggggcaacctgggaccctccaggagtcacctcattagcataaacactagaacgggtgaaagggcctgttctgaataacaaaagccgctattgccccatcacttggaaattccaaggatttcagaagccctgttttgggaacccagaggaagaccgaaggcacgttattgcccacctgggagaccctcaccatcccctcccctgtgcgcttttcccgctgcacctgcagcctcctcaggctctgctcaacacatggacgtctgctgtttcttacctgccttcctcctcaaaaacctacgggcagggatttttgtctgctttgttcacaaattatcttccatacctagaatggtgcctggcacacttaaggttttttgtttgtctgttttttgttttctggttttttgtttgtttgttttttgtttgtttgtttttgacaaagtatcactctgtcacccagactggagtgcggtggtgcacgatcttggctcactgcaacctctgcctcccaagttcaagtgtttctcctgcttcagcctcctgagtagctaggattacaggcgcccgccaccacacaggctgatttttgtatttttagtagagacacggttccgccatgttgcccaggctggtcttgaactcctgacttcaggtgagccacacacagcctcccaaagtgctgagattacaggtgtgagccaccatacccgacacacatgaggtttttaatatttgctgagtgaatgaataaagaaaaaggttacactgcaaaatttgcttagtacgtttatccattcaaaagtaaatgggtgagtaaatgtggtgggtgagttatggcaaattacaagtttgtgaacttcacagccttcatttgcagagtgaatactttggttccgatcacattcgtggcttaatttaataagcgctcaccctgtgtgggtatcacaggctgcggattcttcttgcctgctgtcctggaggagccaatgagaacagcaggtgccacagcaaagaacgagttaatcatcagagggccagccacacaaggggaactgggagaaacttctcaagctcctctccctgcgacttggaggctcagatttttaaaagatactttgacaggcaggggtctggggaactggaacaactgactggctgggtatgaaatcccaggagtgtgtttgcacaggtgagtccgttcccaggaggggaaggggattctcaggactaggtggcatctcttggtctaccaaaatgcaaaatctgaaaacgatctcgaagaccaattctcttttttttttttttttttttttgagacagagtcttggtctgtggcccaggctggagtgcagtggcatgatctcggctcactgcaacctctgcctcctgggttcaaacaattctcctgtctcagcctcccaagtagctggaattataggcacccaccatcacgcccagctaattttttgtatttttagtagagatggggtttcaccgtgttggccaggctagtctcaaactcctgacctcaggtgatccgcccacctcagcctcccaaagtgctgggattacaggcgtgagccactgcacctggctgtcttttttctttttcttttcttttctttttttttaaagatatgttctcactctgttacccaggctggagtggagtggtgcaatcatggctcactgcagtctctacctcctgggctcaagtggtcctcccccatcagcctcccaagtagctgggactacaggcgcatgccactacacctggctaattttgttgtttatagagatggggatctcactctgttgcccaggctggtctcaaactcctgagctcaagagatccttctgcctcagcctcccaaagtgctggaattacaggcatgagccaccgcatccggcctcaaagaccagttctttaggattcacaata

SEQ ID NO: 456 - DNA, 20001 bp, Homo sapiens
cgtgtctgtttcctgctttgtagaatgggaatcacgtgtgcccgtttcctgctctgtagaatgggaatcacgtctgtccgtttcctgctctgtagaatgggaatcatgcgtgtctgtttcctgctctgtagaatcagaatcacggcgtgtctgtttgctgctcttcagaatgggaatcacccatgtccgtttcctgctctgtagaatgttaatcacatgtgtccgtttcctgctctgtagaatgagaatcatgtgtgtccgtttcctgctctgtagaatgggaatcatgtgtgtccgtttcctgctctgtagaatgggaatcacagcgtgtccgtctcccgctctgtagagtgggaatcatggtgtatccgtctcctgctctgtagaatgtgaatcacacgtgtccgtttcctgctctgtagaatgaaaatcatgtgtgtccgtttcctgctctgtagaatgtgaatcacgcgtgtccatttcctgctctgtagaatgtgaatcacgcgtgtccgtttcctgctctgtagaatgggaatcacgtgtgtccgtttcctgctctgtagaatgggaatcacgtgtgtccgtttcctgctctgtagaatgggaatcacgcgtgtccgtttcctgctctgtagaatgaaaatcatgcgtgtctgtttcctgctctgtagaatgggaatcacgtgtgtccgtttcctgctctgtagaatgggaatcacatgtgtccgtttcctgctctgtagaatgtgaatcacgtgtgtccgtttcctgctctgtagaatgaaaatcatgcgtgtctgtttcctgctctgtagaatgggaatcacgtgtgtctgtttcctgctctgtagaatgggaatcacgtgtgtccgtttcctgctctgtagaatgggaatcacgtgtgtccgtttcctgctcagtagaatgtgaatcacatgtgtccgttttctgctctgcggattgggaatcacggcgtgtctgtttcctgctctgtagaatgggaatcacgcatgtccgtttcctgctctgcagaatgggaatcacgcgtgtccgtttcctgctctgcagaatgggaatcacgtgtgtccgtttcctgctctgtagaatggggatcacgcgtgtccatttcctgctctgcagaatgggaatcacgcgtgtccgtttcctgctctgtagaatggtaattcacgcacatctgtttcctgcgctgcagaatgggaatcacccgtgtctgtttcctgctctgtagaatggtaatcacgcgcgtccgtttcctgctctgcagaatggaaatcacacgtgtctgtttcctgctctgtagaatgggaatcatggcatgtctttctcctgctctgtagaatgggaatcacagaatgcccgtttcctgctctgtagaatgggaatcatggcgtgtccgtcacctgctctgtagaatgggaatcatggcgtgtccgtttcctgctctgtagaatgcgaatcacgtgtgtccgtttcctgctctgcagaatgggaatcacgcgtgtccgtttcctgttctgcagaatgggaatcacgcgtgtccgtttcctgctctgtagaatgggaatcacgtgtgtccatttcctgctctgtagaatgggaatcacgtgtgtccatttcctgctctgtagaatgggaatcacatgtgtccgtttactgctctgtagaatgagaatcacgcccgtctgtttcctgctctgtagaatgggaatcacgcgtgcgtgtttcctgctctatagaatgggaatcaccacgtcatgacttgggtgtgtctttcactcgagtctggcacatatgcatctgatggtcagcggatccctgcacgcccaaaggccctgcagtcgggctgcaaggatcttgaaatccttaataaccttatgtttgaatttgaactttgtgagcgaagtccagtggagcatgccctgggggctcagagcctcagctctctcgactgcccctcctcacctccccatctcccaggctgcccatctcctacccttggacactagagccctggggctccagccctgcccagcctcccctcctgcgctgtgactgctgccaccctccccctatgcagtgcccaggccatgcccaccctccatccctggcaggggtctgggtcagacaccaggagggttggagttgtcatgtgccatgtggcagcagagggtccatctgcgccccacactggtaggctggtgctggtccctgcatctctcctgaggacacctgccatgtattcccgcctattaagtgccccccactgggctaggtctcctgttgccttgtcccatttcatactcaccctccaggggcacagatgcatctgcatgacaccagggacacctggggctcaatcccaggtttcccagactctaaagcccatgcatcaacctgcaccagacgctgcctctgagtccaggagggtcgagggacgaggactccagacctcgaggctctagcaatccgggggaccccacggagctgtgtcagttgccccagacccctctcatggtcctgttgccccaggcctcaggagggaacaggcaccacagaaacactgctgacaccgggggtgtgtcccctgactgcccctggagagggaccggctgggattaacacctggactgcgcagggaaacatctcctcgcaggaaatctccatgctacggtttgaatgtttgtcccctctgaaactcatgtgaaaatgtacttgccatcctcttggtgttaagaggtggagcctttaagaggtgattaggtcctggggctgcaccctcacaaaggaattgatgtcgttcttgtgggagtgggttacttatgatggagtaggttagttatggtgggagtgggttagttatggtgggagcgggttagttatgatggtagtgggttagttatggtaggagtgggttaattatgatgagagtgggttagctattatgggagtgggttagttatggtgagagtgagtttgttatggtgggagtgggttagttatggtgagagtgagttagttatgatgggagtgggtgagttatgctaggagtgggttagttacggtgggagtgggttagttatgatggcagtgagttagttatgatggcagtgaattagttatagtgacagtggattagttatggtgggagtgggttagttatgatggaagtgggttagttatgagagtgggttagttatggtgagagtgggttagttatgatgggagtgggttagttatgatggagtgggttagttatgatggagtgggttagttatgatggagtgggttagttatggtgggagtgggttagttatgatggcagtgagttagttatagtgggagtgggttagttatggtgagagtggattagttatggtgagagtgggttatggtgggagtgggttagttatgatggagtggttagttatgatggagtgggttagttatggtgggagtgggttagttatggtgagagtggattagttatggtgaaagtgggttatagtgggagtgggttagttatgatggagtgggttagttatgatgggagtgggctagttatgatggagtgagttagtatggtgggagtcggttatgatgggagtgggcgaattatggtgagagtgggttagttatgatgggagtgggttagttatggtgagagtgggtttgttatggtaggaatcggttagttatggtgatagtgggtaagttatggtgatagtggataagttatggtgagagtaagttagttatgatgggagtgggttagttattgtgggagtgggttagttatggtgggattgggtgagttatggtgggagtgggttagttatggtaggagtgggttagttatgatgggagtggattaggtataatgggagtgggttagttatagtaagagtgggttagttatagtgggattgggtgagttatggtgggagagggttagttatggtgggattgggtgagttatgatggaagtgggtgagttatgatgggagtgggtgagttatggtaggaatgggtgagtcatggtgacagtgggttagttatggtgggagtgggttgttatgaattgagcccagcccctcgtgctgtctcttctctctgcaatcactcaccctctcgttttccacccttccaccacaggatgaccacaccagaggccagtgtcatgcacgtggagttcccagcctccagaaacataagcagaagaaatgtctcgtctttacaaattaccgtctgtgatattctgttatagcagcagagaacagcctaagacactccatttctactaacgggcatttgatgcaacggtcatcctgaaaattcatggagaaagtctgctccaaaaccaattttctgctccataacatctgcctttggagaatctcatataaataaggaatgaggtgcagatgtagaaagacagtgggttctgacagcatcattctaaatggagaggggtgataaacgcccagtagaattcaaataaaatatgaacttcagagaaaggaaaaaagtgatgtgactctgcaccctcagctgaacatggtagaaattatcctgtagagaaacagaacagggataaaaaaagtcaccttccttaatttgcatgtatattataattcatttccagacatgaaagtaagactgagatttcagctgctgaattatacatcttgattcttgcatacagaggactcaaaacatttcccccaaaggcctaaataatgatgttcagccttatttttccttctacacacctcacacacaaacaaggatgggccatcctttctggaactctatccccaggacatgtggtgaatgtcacagataaagaaccaggctgaatagccaaaggcgtccaaaagcgcaggcttgtgacttgattgtgcagccgttgggaaggacagagccaggatggccgacagcaccgttccctctgggcagcaccaccagcagggaccactgtcaccatcttcactggagacagagatcgaggctctgcatggcgactccaaggagcacagaatggaaaaaggagaagtcactttacagtggagaaacctggcaaccaggctcagccaggaatcaaggtcaacgtcagccatgatgtccgatgcataacaggggccctcaatatgccgtgagagacagccaccttacctctgtacaccccaggctaatcaggagcaaagcactggacaaatcccaacaaagcgaccatgcacggaacacctggccagtcctcctcacaactgtcaaggtcaataaagcaaggaaagcctgggaaacggtcacagccaagagcaacccaaggagacacgatgactgaatgtcacctgggatcccgggtgggagcctgggagagtaaaaggccgttggagcaacgaataaagtgtgactgaagcgtggacatgggttaagagtgatgcatccgtgcgaactcattaactgtgacgaatgtaccgtggtaatgaaagaggttagtgacagggaaacgggacaggagctgggaggactctgtacagtcttcacaccttctcagaaaacctaaagccatgctaaactggaaaagtttattttaaaacataggaaacggtgggtgttgaggttgcagaatcagagatgaagagctgtaaccctaaaactttatttcccagctgaaattggatgttttacaaaagaggacgctggggctggtacggctggccttttcccaccctggccaaagtgctttcaccccaggacaacgtctgtgtgcactgagctctagggtctttttggtgttttagttttttgcttttatgtccccaaaataagacatgtctgtggtttaaaagtgtagagtataaaatacacagtggggaggaaaagaagtttcttctttgttattttggccacaatgtctctgtgttagccctcaaaggcagccgtggtcacctgctctaaaaggtctttccaaagatagtctctgctgggcagggtggcgtgtgcctgtaatccctgcgtcttggaaggccaaggtaggaggatcgcttgagcccaggaggtcaaggctgcagtgagtcatgatcgtaccactgcactccagcctgggagacagagctagactctgtctcaaaaaataaaaataaaaaactcaaagatagtccatacaggaacaagtgcacacacatgcaaacatacagacatgcatatgcacatatatgcacacacacacacatgcacacatacagaaaaatggtagcacacttttttatatagcatgattcttccaagttgggaccttacagaaccctcattatttttaatggcttcagcctgtgctactgtataggggcctcataatttatttaagctattcgctatcaacagacatttatcttagtcttttgttacaaatcacactgtaatgaatatctttgttcagacatccttgcccacattacagcattatttttaatgtctgtttgatatgcgatgagaatgatgtacaataactcatataatgcatcctctattttaaacgtctagattgtctccaatgttttccaccattacaaacaatgctgttacaatataaatcttcacacacacctctgattgcttttcttggatgaatttctggaaggaagtgctgggtgaaaacattttcactttaactttaaggttgcttccagcccttttataagggctgagtctgggctgttcgcatggtggggtaggggggcgcccaagaatgggcaggagaagagtcctgcgaaaagaggggaaaagaggggaacgccaagcctcctctccggggttggagaggggaggggagggcaggtgcctgggaccctcctggttgtcctctcacagcctagctaggccccgtttggggtcatttccctcacttttcagggtgatgctggactccaggattcctagagctttggctgttgtcaaggaagaaatgtccgcagaggcttctctaaagagagtccccatacgcctgggaggtgcagtgacgcatctgaccccgctgaggagggagaaccaacttgtgtcactaaaggcctgaggtgagttggacccaagactcgcagctcaggcccttgtgagtctcctccagctcaggtgcatgggaagcagcaccgccttcacgattccaccaacggctttcatctccacctgcccccgtgaaacacaccggatatcagctcccccaggcacagcagctgaatcccagggtctatgacgtgctgcggaggcggggagggggacaggaggccaccagatccctgacgtcacctgcccatccaggacaggaaaggacatcatcgtgcaaggagcctccgtggggtgtgctggagttggcccgtgagcttgcagagccggtcattagagctccgggaatgcacgagccgggcgttcaatgctgccattatcagaattgcatcagataaacttaccatgaagtaaattctattaaagcaacaggaatagttgcaagccctcagctcccggttattttactactgttgcagttagctgttgagtctgtggtagcaacgccatgtggtagagaccaccagcatctcccccagctccacgctcagtggcgtcagattgcagtgggaggtcagccccgggcagtgtttacaccacagaaattggcaaatgccacacatgcaggctgctttctttagtttacctgaagagctggctgttacacgcctgcccatgtccaccgagcctccatcgtccattggggtgggggctctgcgaggtcacctctgcccctctccccggggttctttccctccggaggatcacttggcctccctctgccactcttggggcacagaatgactctcacttgagcctggggggctcagccaggccctctctgcctgcacactcagcctccagctcgttctgggtctccctccctccctggccctccccaggggtgagtccaggtcctcgctgctctgacgccccttgagcctcatggaatatcccctccctcctgcctcctgccgggctcacaccaggcagccaatgcagccccccctcatgtgtcttccaggggcctctcactctgcaataccatgcccccccacgcacacctccacacttggagaatctcctgggtcccagctgcctgcgctgttggtagaagtgtggctgctggggggtggcactcagaggagcaggaagcaaactggaggccaccagtcctctgtcgttctgcagcgggcaggtgtgtgcaagtcaaccccagagtccgaggaagctgagaggctgaagaaagaggccgacatgttcagttccttaaaaagaaacatctaatagtgacttacaaacagaagccagctctgtgtctcagacgacagcgagatgagatggtagatccctgccccatcactcccagacccagggctcatggaccatagggaggggtgactcagaagggacaactgagggatggtaaccttaagactgtttgatccagtggcaggatttagagtaagtgcctgctgtcacacaagaaacaatcaataaactgggaatgttagaggccttctcggaacaggggttaatcagaagccaacatggcggactcatgtccaacatggagttgctttggcctccacagtcctccagtctcactgcctccccctatgacccccaaggtagggtccaagaggggtttgcagagaccatgtcccagggtcacaggccacagaagacagtccccagctgagacaccacagcccaaaaacacacacgcctaccttatggtcctgcatccccgggagagaccaggggcccactgacctgcccgccctgcagcagacacacccctttgaggcttctgatcccaggactgggaagtgaggagagggcacccgctgaaaccctttgacaatgacagtaggtgaggcagaacaggacagagcaggacagaaaggatcctgtaaaaaggccgtgcacacaagggggcccgtgcacagaggctgcacacgggctgcaaggagaggctgtacaatggaagctgcacagagaggctgcacacaaagacttctcacagaagctgcacacagaggctgcatacagaggctttacacagaagctgcacacagctgcctgtgcctggggaaagccagtgaagcctccactgtgagggtgagtggaatagtcccttccccatggaagtcattcctacaaagagtgcctgctccctgcacgcagactggaccatcggagggggctgtggggcttttcctggtctaagtgctgagctctccgtggtctccttgccagagctgggtgctttaaacacaattctgctggttcaaatcacgttttaaaatatttaaaacacagattgcaaagtggtggcctagcaggaaggtgtgttttctttgggctgctattccaactttttttttttttttttgagatggagtctcactctgtcacccaggctggagtgcagtggcgtgatctctgctcactgcaagctccatctcccaggttcatgccattctcctgtctcagcctcccgagtagctgggactacaggcgcccgccaccacgcctggctaatttttttctatttttagtagagacggggttccaccctgttagccaggatggtcttgatctcctgacctcatgatccacccacctcagcctcccaaagtgctgggattacaggcgtgagccaccacacccggactccaacttttttcttaatgggggatttcacataaaaatccatactctgagcttctcatcaggcatccccagctcgtgctcctgcagggtgcgaccggtgcacccaccctgactctcaccacctccacctctgcagcatcctcacatacaggcctggcccctggcggcacctgagcttaacacttctcgtgtagggaaaacactgcgctgggactcttgaagaatcgggctgtcttcacatgtaaacactttgaggttcagaaaagcggaggttggatgcagagcaggtcagtgaatcgggaacttggttgccaagaccgcctgttccttgtggaaggaaatcatgacggagttgggcttgatgtcttagggaaagaaaaccctttcccacttcgtttctgcctctgacatggaaaagcacctcgggtgtgggaaaggatgtccctgagtaacaagggcagttagatgccacctttccaacatggttctttcatgtttgttcaacccccccacacagatgtaacttggcaacagcagtaaatactgcatggcctcacaccaattctacaagtcaccagggtgtccacacacacgtaagtgattacacgtgtgcctaagttaaatccccccctcaacagagacgccgaatgcttttgcaatggtgtaggccacagagctagcactaaacacgttggctcacttgtcccgtggtcaccactccctgcccctggtgtccctccctggccccttccctggtcctggtttccaatcttgacactcacctcttcctccatcctttctcatttcactagcctaaaggtgacaacgttggccacgctgattagcaatagggtccctgggtgtggcccccacgtgtgaaaatgcccaatggcaaaacagtctggtccgaacaggcacacctccatggaaaagcgtggccgtatctcctcaagcaggacgtacgcccaccctccaacccatcagtcccacctgtggtatataccagcacaaaaacatgtgaatcgtgcaccaaaagacatgcacatggccgggcacggcggctcacgcctgtcatcccagcactttgagaggccgaggcgggcgaatcacctgaggtcaggagttcaagaccagcctggccaacatggtgaaactctgtttctactaaaaatacaaaaatacaaaaaataccaaaaaaaattatccaggcatagtggcaggcgcctgtaatcccagctacttgggaggcagaggcaggagactcgcttgaacccaggaggtggaggctgaaatgagccaagatcgcgccactgcactccagcctgggcagcaagagcaaaactccatcttaaaaaaaaaaaaaaaagacatgcacacacatgctcacagcagcgctatttacaactgccctaaagtaaaattactcaaatgcccacagactactaaatagacgatggtactatcataatgggccattattcagcagtgagaatgaacaaactagaaataactgttgacccaaaaggaagaaactgaggcaaaattaatacaagtagagagtttatttgggccaaacgtgaggattgtggcccaagagcacacattcaagtttcccgaatatacactctgattagcaaccgttacaagtggatttttaaaggcaaaaggaaacaaggagtgggctgataaaagttatgtcaagaattatctggccaggcgtggtggctcatgcctgtaatcccaacactttgggaggccgaggcgggtggatcacctgagctccggagttcgagacaagcctgggcaacatggcgaaatcctgcctctacaaaaaattagctgggcctggtggcgcatgcctataatcccagctacttgggaggctgaggcaggagaattgcttgaacctgggaggtggaggttgcagtgggccaagatcacaccactgcactccagcctggcgacagagcaagactccatctcaaacaaaaggaaaaaagaattctcattagtctacagaaataacattgattagtgattggctgtaccttgttacaaggtagggtatgggtcacagtgtccagtgtggcgttactaggttaatttacagctacttgtggcaacagcccacagtttgaagagacgagtacacagctcgaagcagggaggagcatgtggctgcccctcattctacggtctctctgggcctgatcattaaaaggacttgcatccctcagcctaaagttctttacttttctcataacattcctcagcctaaagttctttacttttctcataacattcctcagcctaaagttctttacttttttcataatataccatgatttgggaaaatctcacaaacataagtaaaagacaacagatttagaagcatgcatactatataattccatttacataaaatataaaaacaggcaaaaccaacttaccatgataaaagtcagggtaatagttacctttaagaaaaaaatcagcatatcaggtaatcagcatatcgtgtaatcagcatatcaggacatatgaaaagtccataacttttttgttgttgtttgtttgttttggagacggagtctcactctgttgcccaggctggagtgcagtggtgtgatttcagctcaccgcaacctccacctcccaggttcaagcaattctcctgcctcagcctctcgagtagctgggattataggcgtgcgccacctggataattttttgtatttttagtagagacagggttttgccatgttgcccaggctggtcttgaacttctgatctcaggtgatctgcccgcctcagcctcccaaagtgctgggattataggtgtgagccacctctcccagccgaaagtccataactcttaaatgggtaaaagattttaatagacacttcgccacagaatatatctggatggctaatgaccatagggcaagatcctcaacatcatcagtcattagagaaatacaaactcaaaccacagtgagacacacagtcactggaatggctgtacacaaaaggactgcccacaccaagtggtggtggggatgtaacatgtagcagccacctggaaaacagtttggcagtgcctcagaagcttcagcatggagttgccatacacactaatttcctattgctgctgtaaccgttgaaaacgacacagctttacttccttcccattctgaaggtcagaagtccacagtgagtcttcgaggagttgaaacccaggcgctggcaggactggttccgtctagaagctctagggcaggggtgcccaacccccgggccacagatgggtaccaggcctgttaggaaccagactgcgaagcaggtgagcggtcagcaggtgaagcttcatctgaatttacagctgctccctgtcaatcacatcaccgtctgagctctgcctcctgtcggatcagcggcattagattatcacaggaggccgggcatggtggctcacacctgtaatcccagcactttgagaggccaaggcaggtggatcacctgaggtcaggaattcaagaccagcctggccaacatggtgaaaccccatctctactaaaaagacaaaaattagccgggtgtggtggcacatgcctgtaatcccacctacttgggaggctgaggcaggagaattgctggaaccccagaaggtggaggttgcaatgagccgagatcgcaccactgcactccagcctgggcaacagagcgagattccatctcaaaaaaattttaaaaaaaagatgatcacaggaacatgaaccctactgtgaagtgcgcatgagagggatctaggttgtgagctccttaggagaatctaatgcctggtgatctgtcactgctcccatcactcccagataggaccatctagctgcagggaaacaagctcagggctcccactgcattgtggtgagttgtataattatttcattatatacgacaatataataatagaaataaagtacacaataaatgtaatgcacttgaatcatcccaaaaccatccccacccccacccatggaagaacagtcttccacaaaaccagttcctggtgccaaaaaggctgggaccactggtctaagggagagtccatttcttgcctcttccagctcccagaggccaccccacatcactccaacctctgcttctatattcacatgactttctcccgacacagacactcctgcctccctctcataagcacccacgcaattatattggatacacatgaagaatccagaatcatctccccacctcaagaccctcagccacatctgtgaggtcccttttgagtgaattcagagtgaatgtgtgtattctggttcactaatgagtctaacaaggaaagatgaaatgagaattcaagacagtagaagacaaaaacagtccatgatcaattgctgatggattgcacaaatagaacacattccttcttcttagtcccacagggcacatccggctcaaatgtttccctcccgaatgtatcatcatgactcgacagagattaaatagttcatgaacggtgctgcagagtcaaacaggaatataatgccaattagtgagagaaatgatgactggggacaatgtggtgaggagtgaaatagacacagctgcatttttaaatggcaaacttgtgcagtcagtaagggaaggagtgagaacagagcctccggtacaacctggctgagttaaacatcaaggtcaatcaattgatctacccagggtactgttatgaggagtaaaaattgccagttatacatctgagccaagccttggcccaggtgggaaagaaatgcaaagctgttttcaaaaaggcttcatcataactgtttacaagctttcactctgaacaccggatttcaaagaaacttagaagaaaggctaggtgaagaaatacattagctatgaaatcgcccaggaaaatgggaaaaccggagctcgtgctgcttattttgtcatcatgaagcagtaatcccaaaaaacttaaatacataggtttttgggtttactgtggggcttgacatccatggagggatggaccctgcaggccacttggccatgcagctgtgacatgattccaaacacttcgtgtgctacatgagtggcacatgctttgctgtgatgagaaaatggagaataagcccaagcccaggaagatcttacatcacaccttatcagaccacgtatgtgagtactggaccccaaaacacatatacatccgtaatttcaacagacacattgacagctcaggctgtggctgggctactctgtcagcctctgatctgttctttgaagcctcgtccacaagcaacaccactcgctagtgttgagggacctggtgcgtcgccccagatctctgctgtgctggtcaaactgtctctcccaataacttctcatagaaaggtgcacctcaaacttcagttagactctacgtccccagcagcctgcttccaccctagagcaactggactttaataactgaaccctagacaaaacgtacctcatctgttgagtgtattccctgagatatttgttctcatgatcctccccatctttgagcattgtgaaaaaaggagtctctttgtatggcaattaaaccatgttatttgtgaaatcacactttgatcatggccttctttcaaccatacaaaacacatatacatgggtcagcaagatggctgactagaagccccttgtgctcggcccctcgtggagacagccagaacaatgaacacacaacagcactggaatgaaagtaacagagagagagcggtggagtgcatcagaggagtcacagaaatgctggtgagcacagaaactcaggatggccacatcgggaaggaaatgctgggcctccaccaccccatgccccaactgggaccagctgggacccacgagaagtttctccctggggtgaggaggaaagcaagaggaccccagcagcccccaccaccaccatggacgcccacagcccccaccaccaccacggacgcccacagcccccaccaccaccacggacgcccacagcccccaccaccaccatggacgcccacagcccccaccaccaccatggacgcccacagcccccaccaccaccatggacgcccacagcccccaccaccaccatggacgcccacagcccccaccaccaccatggacgcccacagcccccaccaccaccatggacgcccacagcccccaccaccaccatggacgcccacagcccccaccaccaccatggacgcccacagcccccaccaccaccatggacgcccacagcccccaccaccaccatggacgcccacagcccccaccaccaccatggacgcccacagcccccaccaccaccatggacgcccacagcccccaccaccaccatggacgcccacagcccccaccaccaccatggacgcccacagcccccaccaccaccatggacgcccacagcccccaccaccaccatggacgcccacagcccccaccaccaccatggacgcccacagcccccaccaccaccatggacgcccacagcccccaccaccaccatggacgcccacagcccccaccaccaccatggacgcccacagcccccaccaccaccatggacgcccacagcccccaccaccaccatggacgcccacagccctcaccaccaccatggacgcccacagccctcaccaccggggtccctgtagtccccccaggcactaagctcagcagagggagctgcctggagtctacgtggctgtgctcccccagagaaggaagcaacacagtgcccacccccgtggcccacgtggctactgtgctctgccatcttggaactggaagcatggctggagtgtgtcatggtctggaacaataagggtggctcctgtggaaccaccccagcccaatggcccaacatccccaagcagaactggtgcagctgttatagccttcccggtggggccaggtggacgtgaagccactctgcctacccctccctctacccctttgggcaggagctgaagcagtgccctacatcccaggaaacagtgcctgggctgcccagagcagtcacgcaccccaggcctgagctgaagcagtgccctatatcccaggaaaccgtgcctgggctgcccagaacagtcacacccctcaggcctgaggtgaaacagcacattgcttcctgaggaatcagtgccctggccaagctgaacagcttcacatcccagagctgagctgagatggtaccccacattccagggaaacagcagtggctgagcggagacacctaccctacaggccaaacaactttagtacctgcttccctggagctggactagcactctagagtctcaggggctgagacagccctctacctgggaagtggaggcattgctgtgttattccctacccctcaagggcccaaatgacaaccttataccaccatctggggtccttgccatcactgcacctggcctcccagagtgtggggtactgccaagcctcaccatcccagagtctagtgtcactaccacctggtgcctgcctcatcccccgggacccaagttgccactgagccctactggctgaggttaccaaattgcagtcatgccctgatcctgaggcccaaacccccaggacaacccttcttccccagagttgggccggtgctgtgccctgtccccgaggggtagaatcacagctacaacccagacccccaggcctgagctgctagggagtgtctcagagtcacagatctatgggcaaccaacatccaaccctgccgcaaagaatgaacctagaccccaaaacccaggtgccataataggcttgtgagaccctgagcctaggaccctggatccatagctgctgcaagcacctacatctggaacccagcatcactggagctgcttataggccatgtcagactgatatcaagagagatgccctgacctaagtcccctattgtggggaaaacaggaataggaggatcccaaaacctaatgtcaaaatttattgtatcaaaaccaaatgtcctttgataccaaggacattaaccatctatgctggcaccactgctaccacaaacttctacagcctagacaactgaggcacctacagttactgctgatattcaacacagctgaagaagctgagtagggactatatcactgcacttatctggaaacagagtcaccacatcctttttaaccagcacattaaaaccaacccaactacatgtgaaagtctttctctatgcaaggcactctcaaaatttggaggaggtggtttttccaccagatgcacagacatcaatgcaagggcatgagaaacatgaaaaagcaaggaaatatgacacaaccaaagggatctaataactctctagtagcagacccaaatgaaaagaaaatcaacaaattgctagaaaaggaattcaaaataatgacctgaaggaaactcaacagtatacaagaaaatacagatacacaatccaccaaaatcaggaaaacaattcagaatatgaacaagaaattcaagaaagtgatagaaatcatagaaaaaaaaaccaactgaacagaaatccagcaactgatgaattcaatgaataaaataaaaacacaatagagagcttcaacagcagacctgatcaagcagaagaaagaatttctgaatatgaagacaggtcatttgaaattacctagtcagaggaaaaaaaaagaagaatgaaaaatatttaaaaacctgtaagacatgggacactattaagcgcacacacacacacacacacacacacacacacacacacacacagagtttgcattatgggtattccaaagaaaaagagaagagaaaagacatagaaaacctatttaatgaaataatagctgagaagttcccaaatctggaaatagatataaacatccagatccaggaagcttgaagtttcccaatagattcaacccagaaaggtcctccccaaggcaaattatagtcaaaatgtcaaaagttaaaggcagagagaattctaaaaacatcaagagggtgggcatggtggctcatgcctgtaatcctaacactttgggaggccaaggcaggtggatcacatgagcccagaagtccaagaccagcctgggcaacatggtgaatcctcatctctaccaaaaaacaaaaaacaaaaaacaaacaaacaaacaaacaaaatatatatatatatagacacacacacacacacaattagccaggcgtggtggcatgtgcctgtaatcccagctactcaggaggctgaggtcagaggatcacctaagcctgggaggtcgaggctgcagtgagctgagatcgcgtcactaaactccagcctgggtgacagagtgaaaccctgtatcaaaagaataaataaataaataaatatataaaaacaaaaacatcaagagaaaagcatcaagtcacatatgagggaatccccactagactaacagcagatttctctgcagaaatcttacaggctagacccagagaacaggatgatatatttaaagtgctgaaagaaaaaaaaaaacttgtcaaccaacaatactatatccagcaaagctatccttcaggaatgagagagaaataaagtcttttgcaggcaagcaaaaactgaggaaattcattaccactagaacagctttataagaaatgattgagggagtcctacatctggaagagaaaagataatcgtcactatcgtgaaaacatgcaaaagtataaaactcactggtagaccaggtacacaaacaagaaagacgaaataataaaaacttggttgggcagggtgattcatgcctgtagtaccagcactctgggaggccgaggaaggcaaattgcttgagcccagtagtttgagagcagcctggacaacatggtgaaatcccatctctacaaaaacaaaattagccaggtgtggcagtgcatgcctgtggccccaactacccaggaggctgagacaggagatttgcttgagcctgagaagttgaggctgcagtgagccatgggcatgccactgtactcagcctgggcaacacagtgagaccctgtctcaaaaaaaaagaaaagaaaagaataaaaacctgttactacagaaatacaccaaaccaaaataacaaacaataagcaaagaagaaaggcacaaaggatatataaaacaaccagaaaacagtcaatgaaatgacaggaataagtccttgcatattaata

SEQ ID NO: 457 - DNA, 20001 bp, Homo sapiens
tggatcttttattgactccctttatgaaccccaagtttctcatcagtggaaattcttcctcttctaaaacctgaataaaatcatcccttaattgtctggggcatttggtctttcttgagaaattttgtcgattcacattcaggggtaaactaaaacttgccccaaaccacacagacaaaatgtcttgtgtttggtttcaaaaggaaccctgggcattttccccatgggctctgttgtcctgtgggcattgctggaacccctggctggctttccagggagcagcttggaatagcacaacttgagtgagcgaggtctccaagcctcatgacccccagccctttgcatttatcccacattcttttcctctgcatctctcatgactttcagaagcaaacacttgggttcttcagaagcatcgatgctcttcagggttcttggcatgagttttagagtcttggcaggcagctggcaatagtcaggtgtgaaaacaggcagtgggcttgttactgagagtgagcactgcgtgtttgacactgtctagagggcttaccactgtgatgcccgaatgctctggtcacagtgatggggcccaatggaagaagcgtctgctttttattgttttttgttttgttttgttttgttttgctggcttctcatgccacagccctggattgtcatgctcagatttcttgtccaggacacaatgccctagaacttgtgtatactggatggaacaaagcgtgtacagcacatctccggatgtgttgcaaaggctgccaaccctgctgggaggtgagagctggcactgtgtgtctaccttgtccatgacttctggcagcactaaaaatggggcctttttctgcttccagggacaagtcagggaagatgctttgatgtgacagaagagtcttatcacaaaaggtattttgggattctgagtagaatttaaataaatttgtgatatatacatatatatacacattatgcaccatatatgtgtgtatgtatatatgtatatatgtatatggtgcataatgaaatcctccaaatttgttttcttaaatgacttttttctttattttatttgattatttatttatttatttttgagagagagtcttgctctgttgcccaggctggagtgcaatggcgtgatctcggctcacttgcaacctctgcctcccaggttcaagtgattctcttgcctcagcttcccgagtagctgggattataggtgctggctactgtttgcatttttagtaaagatggggtttcaccatgttggctaggctggtctcgaactcctgacctcaagtgatccactcaccttggcctcccaaatgacaaagaatccttatgtctattaagaaccacttaagaccttcatgaattaagttttgctgacctcagcgtgcagcctgaggcctgcccaccctctgtggagactcaagttgctcttctggagagggagggaaggaggccagtgcctgtcccagcatttggggccaccactgttgcacagaaccctgagcattagtgtgtacttactccctgtttaaaaacatgcatacgcttatcttggaatagatgaaaattctggaaaatgcttagctcttttctgtctgtgatgtgtttcgaattattatttccatctaaggccaataggcttcttatttttatagagcataatgcttttatttaatgtgcaagtatagtgcactatcttaagtctacttgaaccttacacacaagtagagataaaagatgtttctggagtctgagtgtattaaaaacaaaattgattctcaactcctttttcttcccaaggcctggggcttcaccttaaaaactagctcctttcatcaactgcatttaggaaaaacaaaaatcgtaagccacatcctttatttcaaacaccctgagactttaaaaaaatgtatttacagcaataaattcttattaaatgagaaaatggttaccaatggtattgaaatggcttattaaaggatatggtgatgaaaaggccacatcgccatctgtcctgcagctacctattccttccgcttggtcacagtttttacaaaataccaagcttctggaactcagctgcctggaatcaaatccccatactggcacgtataaaacgtgtgatgcaggttttgttacctaaccaacatgaactggttcctttgttttaaagtggggatatctaccatgtagacttttttgtggggggaataggcgtgggagtgaaattttaatgagaaagtgtgtgtacattgctcagggaggcctaggatttactaaggtttgtgctacttacggtagcaatgaacaatccctgctaatggtgaccaagtccattttgtttactcttttgttttcttttctctcttcttttcttttctcttctcttctgttctgttctcttctcttctcttcttttcttttctttgatagagtcttgctctgttgcccaggctggagtgcagtggcgcgatctcggctcaccaaaacctctgcttcccaggtccaagtgattctcctgcctcagcctcctgagtagctgggattacaggtgtgtgccaccatacccagctaatttttgtattttttagtagagaaggggtttcaccatgttggccaggctggtctcgaactcctggcctcaagaaatccacccacctcagcctcccgaaatgctgggattacaggcgtaagccaccttgcctggcctggcctggcctgtacgatttttttttttttttttttgagacagagtctggctctgtcacccaggttggagtgcaatggggcaatctcggctcaccacaacctctgcctcctgggttcaagcgattctcctgcctcagcctcccaagtagctgggattacaggtgtgtgccgccacacccggctaatttttgcatttttagtagagacagagtttcaccatgttgaccaggctggtcttgaactcctaatctcaggcgatccacccgcctcggcctcccaaagtgctgggattacaggcgtgagtcactgccccccaccaccacttccctttcttatgatgagcacagatagcggccagcctctctttcctatcgtggttgtggctgtggcttcccacactggccatcctgccccagcacgtcgcactccagactgtctggcacatgaactgtgatgatgtttttccttcctggatatcagcagaatcccgcctttctatactgagcctggggagcagggagggaggagtctgcattccagagtacgtcctggacctcactttgatttctaattctggttctgggtagtcacggttttgtggtcaactgtcatgagaataaccctctttcccaatgatggcatctctttaataaataagaaaacactggaagattaaaagtaaaattcaactttctggtagcattatcatttgtgtttggctttcctgagtttgtggtaagctccttgaggccagggctgcctttaggcaggttaatgcccccagcgtggagaacgggaggtccttgaatgaagaatgcttgggggccgagtccaaggaagacaactctgacctccagcatcctccaacagagacgtctgggcccagacagaggcggccaaggcgaggagaggaaaagctattttctgagagtgtgaacgagagcctccaacttaacttcagccataagaaagctgtttatcgaggctcaaatatctgacaggcaccagagaacacccagaaaagctccctggaggcatggtttgaaggcagctacagctgcatgctgtcagagagaaaccacattgtgcacgtggatcggatcccagggcctcagtgctagcatccagctccggtgctggccggtctcagaaggacactgtgaatttctgaggcatttccagaggccccgtgatggataggagatgagcaattgctccgcaaagggaggcaggctgaacattttgtgcctaacttgaacacctccctgatgtgagagacagcttttgagcgcctgggatacttcggtatctgatttaattgggaaactcacaggcagctattagacgttgaccaccaagccactgggggtaggtgtaaggatacctaagatccttgtagctcatctacatgttcttttacatcccataactttcttaacacttttgtcagacataccaattacactttgttactattttcaatgaaaaaatgtacagtctgataaagctcatcaaaatgacccccagtgcggatcttcatggagatggcagagctacctttcggcagggtagatatctgcacttcacaggagggttaagtaagacctaaagagatcaaatcacttcagttctgtgtaacaaatatgtactgatcagctgttgcatgcccccaaaaatctaaagccatcaccttttaagtaatgggatgtgctgacttctcactgtatttgcacaaggacgacatatcaaagtaaaatagaaatacatagatcctgctttatcctacacttgtacagacccatgcccacacgccataacacacacaaacacacacactcaatacacacacgagtaactcttacagagaagctgttgaaagattttaggaagtaggttgtttgaaatttaaaaaatgctgtaggaatttttacgtcatatgatgtagctacttctatgcctataggcctcagaaatgtctaggctgcgctcctggtaacatgaccttttgcagataaagttaggcatatataaaaaaactttctaaaactaacttttgttagagtattggcccaaatcttttttccaggcattgtcctctggcagctaatcctgttgtgaggtctttattgctgtgctgtgactcacctagaagcaagtttctctgaggaaggacaaatccttgtagcttttcaaagcacacctattaaactctttagtcgatatcatgtcaggatgcatgtggtcaggggaaattttatctatgattgtcaggcacactcagaatttcgtttttgtgacgggtgcctgcggtcaaccccagatcctccagaaagggctttaaattcagtctaatctcgtcatgctgcttggcaattgatttgagtcactttgacatttctgagactgcagatttcccagaaggagagcaagagagaacgttttataaatactgcgaccttgaaataaaaaagagacttcactttcctgctccagatcttaccatgtgctctcctgaaattcaagtaagaaaaggtaatgaagttagaaaacgtgaatgtattcttgtaaaccctcattgggcaactcagacttaccaatgagattttgcttcacgtctatggtaatttgctagatgtttggactcagctgttaatgagggcctgagggattataatgtatggcttttttttttttagtggatttcaagcaaaaacatggaccccagggtgacatatgagacttaagcataggcaacttgaaggtgcttaggggagtgcgtctgtatagtggcagacagggaaggtgggagcatcttggagctaaggtagaaagctaattacaggtagaaattaaggtagaaagctaattacaattctccctgttgcccaggctggagtgcagtggtgcgatcttggctcactcacatagttttacgggaaaagaaactatgaaaaaaaaccccacaggctacacaagatggtaaagagtttccataatcaggcagcaagaaaagccccgtgctgatgtggacattgcgatgagctgggcattggactacggggcccggacaggagccaacacagaagaccagaagactgtgtgcactaagagtgccgggagggtctgcatgtacttcgaggggccctgccttgtgggcagaagacataatcctggataagtagccagaaccaagtggtccatggcaagatctcttccattcatcagtacccaaaacatcacatcaaatcagcatcagcacccagggatgtgtgccattcctggctcttctcagtttgtagacagctctatagtcctgggacttgggaggagtatgtaggaggctccgggggtgagtggtgtgatggtggtagtgctggtggtggtggtgacgaatctaaatgaaaatgaaaaatttcaaagaggtaagtggtaacttgacatggttttgtcatgagcactatcacctttaattttacgttttgaaaataattttcccttttagtgtaatagtggcataattcattgttgacaatcttgcatcaagaaacaaaattaaaatgatatgtaattgcattacccagaaatagataacattttggtacaaattttcttgccttttctctgtatgtacacacacagagaaacaaactttttccaaattgggcatccagtatacatcctactcaataagctaaaatcttcacttaaaattagtgtggattttttaaatgtgatcaaatattttcataacatcttttgtaataggtgtgtatttttttaatgcatgctatatttggtttcaatgatcccttattcttgggcaatttggttgctttcttgaatatgatttatagatggatatttctatggaaagttgacttgggggaaaggtgtgcttcttcttcttttaaacacaaatttcttctaaaattgttcgatataatttgatggatgtttaaattgaggtgtactttacaaagggtgaagcgcacatatcttaagcgtgcagtgtgatgagtttgacaaacgtgttttctccgatcaagtcagagatcatttctattgccacaggaagttctcacgtgcctttctaagtcgaagctcaaactctctacacttgtgactacaggtctgattctatcaacatagtttagttttgccttttctagagcttcttatagattgaaccatacaatatacacttttttgtatcttggtttttttctttcaacatcatgtttttgagattcatccatatcgcttcaggtctcagtagtttattctttttttattgtggaatagttttctattacatatataaatacaccataatttgttcattcatttccttgttgatggacatttcagttgtttccaattttgggatataaagacactataaatgtccttatataggcttgtgtttgcttgcttatttttgttttgttttattttttcaaacatgttttagtgggtaaatacctaggattagaaatgctgggtcatagggtgaacgtatgtttagcttcataagaaacttccaaacagttttcaaaaatggttgtaccgttttactttgttctcccaccatcaatgtatgagagtgctgtttttttccaatttattaaaacattggtattgtcagcttttaaaattttagccattttagaagacaatgtgacacttcattgtgttctctctgcatttctctgacaaccatgctgaacactttttcacatgcatattggctattcatatatcttctgtaaaatggctgctcaagttcttagcccattttaaattgggcagttgtctttttttttcaaaaaaattaatttttttatatttgaggtatataataggatgttttgatatgcatatacatacttatcttaaagtgattactacagacaaatttacatattcatcaccttccatagatacctttttcatgtgttaagggaacctaaaatctactcttttagcacattttcagtatacaatattaactatagtcctcatgctgtgtgttagatctctagacttattcatcccgcgtgactgcaacttcatatcctttgaactacatctcctcgtttgccctccaggcccctggtaaacagccttctgttttttcaactgtttttttttttttttttttttttttttttgacagaatctctgtctgagctcactgcaacctccgcctcctgggttcaaatgattcttgtgcctcagccttcagagtaactgggaatacaggcatgcgccaccatgcccagcgaatttttgtatttttagtagagatgagttttaccatgttgtctaggctggtggtcttgaactcctggcctcaagtgatccacccaccttggcctcccaaagtactggcattgcaggcgtgagttaccgcatctggccatctatttattcaacttttgtttttaagattcttcatagaagtaagaccatacaatttgtcagtcttatttctggtttatctatgtctggcttatttcacttagcatgctattctccaggcccatctatattgtcacaaatggcaggatttctctctttttaaaggctgaattatattccattatgtatatatactacacttgctttattcattcatccgttgatggatactttaggttgtttgcatagtgtggctggaatgatgccatgcacgtgcgagtgcaggtgtctttacgaggtgctgctgtcatttcctttgggtacatactcagcaaagggattgctggaccatctagcattttatttttttcttttgagatggagtttcactcttgttgtcgaggctggcgtgcagtggtgtgatctcggctcactgtaacctccacctcccgcgttcaagtgattctcctgcctcagcctcccaagtagctgggattacaggtgtgtgccatcatggccagctaattttgtatttttttttttttttagtagagatggggtttcaccatgttggtcaggctggtcttgaactcctggcctcaggtgatccacccacttcagcctcccagagtgctgggattacaggcatgaaccaccgtgcctggccagaaccatttagtattctattttcagtattttgagcaaccttcatactgttttctgaaatggctgtatcaatttacatttccaccaacattgtacatggtttccctttgttccacatcctcaccaacacttgtaattttttagtagcccccctaactggtgtgaggtgatatctcgttggggttttgctctgcatttccctaatgattagtactttttccatgtgtctggtgtctattttttccttttatttatagttggcatgtaatagttgttcatattaatgggatacagagcgatatttcagtacatgcctacaatatataatgatccaattggggcaatgagcatatccatcccttcaaacggttatcatttgttggtgttgtgaacactcaaaatcctctcttctagctttttgaaaatatgcaatgttattattaaccatattcaccctacagtgctgtaaagcaccagacccatggctcctctgtaactgtaattttgtatccttctactaatttttccctaccttccctccccacaacactcctcagcctctaataaccacagttctactctctttcttttttttctttctttttgtgagacagggtcttgctctgtcacccaggctggagggcagtggcatgatcttggctcactgcaacctccgcctcctgggttcaagtgattctcgtgcctcagcctccctagtaactgggattacaggcacctgccactagacctgtctaatttttgtattgttagtggagacaggatttcgccacgttggccaggctggtctcgaactgctgacctcaggtgatctgcccgccttttcctctgtaagtgctgggattacaggtgtgagccacggcacccggccaattctattctctttctatgaactcatttcttttaagctcccaaatatgaatgagaacgtgtggcatttatctttctgtgtctgacttacttcatttaacataatgtcctccagactcatccatattttgctggctatttttatatcttccttagaaaaaggattattcaggtcttttgcccatttaaaaacatttttttttttttttgctgttgagttacgtgagtttcttatatattttggatattaacatcttatgagatacatggtttgctaatatattcttccactccattggtgcctgtgcattttgttgattgtaccttttgctgtgcagaagctttttagtttgatgtaggcccacgtgctcacttttgcttttgttgcctgaactctttggtggcatcgaaaaagttattggtaaggccgatatcaaggggctttccccttatgttttcttctaggaattttttggtttcaggtttatatttagatctttaatcccttttgagtttatttttgtgtgtggtgtaaggtaaagatccagttttttcctcaaggccgtattgacttgttaccattgctttataataaatctcacaatcagaaaatgtaattcttccaacttgtttctttccccaagtatgttctagttattctaattgttttttggcattttatatatataaatttttttaagaaactgtcaacttctacaagaaaaaaaaagcttgctggggttttaaaggagattgtgtcaaatctgcagataaacagaattggtatcttagcaattttgggtgggtgtgcaacctagaaatatggtatatgtctctatttaaatcacttaggtctttctttttatatttctctaagatgcattttacagttttccgtgtgcaggtcttgtgcttattttgttaaatgtatccctggaatttttggttatgaatgtgattttaactgctattgtattttaaccatagtttcaaattttcattgttagtatatagaattaccattactattttttatagtgaccttgtatcttgtgatattacacttattcactctagtagtttttttaaaataaggttttatgaattttctacatagatattcatgttatttttgaataaagccatttctattattattatttaatctttatgtgttttactcctgtcttgctgtatgcagtgactaagcctccagtacaatcatgaaaagaagagataagagaggacattcttgccctgttgttagtcttacagacagagttcagtgttttactgtgaagtatgatattagcagttggttttttgtagatgttctttatcagactgaggggaattccttctattcctactttgttgagagttgtttgttgttttgtgttgaaaatatgttgaattttgtcaaatgcttctcctgcacactcagatcatctgatggctttttgttttcagtgtgttgagtgtcaaacaaatgccatgttcctggcctgagtttaactgatatattcatatcaagtcatgatatattatcatttatatatacattttgggttgatttggtttactaatgatttgttagggatttttgaacctatgctttttaactatactggtgtctttggtcagggatgggtcatctttttgtttgactttggtatcaggatgatgtcaatttcataaaccaaaccagaatgtgttcccttctccccaattttatgaaagagtttgtgaattattgacatgatttattctttaattatttggtagaatttaccaacaagtaaatcagtgaatcctcttttatcttctgttttctcccttcttgaaccagaatgtatatgacccttatcctatgcccttttcatcatcacactttggaagaagataactggcttattaaattttacaggctcacagttggagaagaatcatgcctcagatggattatacataatgccttgcccataccttatttagatcatgagattcaggacttttgaacagatgaggtttgaatgagattttggattttgatttgatgctgtaattggttgagtcttttggggaactctaagtgggatagatatattttacattgggacagacatgtattgttgggaacaagaggaagatgccctgtggtagacagaataatgaactccttggagatgtccatgtcctaattcctggagtctgaatgtgttggtttacttggcaaaagggaattaagattgtcattggaatttagaatcctaatcagctgaccttaggatagggatattatcctgaattatctgagtggttctatgtaatcacaaaattccttaaaagtggaaaagggaggcagaagaatgggtgagagggatgtgatgtgagaagaacttcacctatcctgcaacctttccacatactcttccctcaacctggaagactcctcctgttctttacctggataattcttacatagccttccattctcaactcaaatggtgttacttcaaagatgcctttgctcattaccaaacgtatattaggcccctctcttacttatttatacttcctttgtaagcagcgacatggctcttttgctcaccctggtaagcctagtgcccagtatatcatctgacacacaattggtggtcaactgttgattcatgagtgaattttattggttactgttgatcgccagtgaaataagtgcttagaaacacttataggctgaataggaagaattaaacaaatgaatgactagataataggtacgtgggagtcacagggattgacatcttattttattcagttttgcctacattggctcttttcttacaaatgtcctgatgcctattgagtatatatccataaggtttctttgagttttctggaagaaatggctgttgttgatgttgtttttagcagctcttttgactcgaccatcctcacaccagcgttaggtaatttagacagattagaacatcagcttcttctcaggaacccacagaagtcttggaatggagacagtccagaaatatacccatgtccacattactcaatccctagaaatcgctatatttaagcagaatgagctagttttttctaagtgcaatttctaccttgttactagagaattggatttatataggttgccatctcttataccaagatactttcagggaaaggaaagtacaggaggtgttttaagtgcagtaggaattgtgagttagaaaacatgcctaacgtgtggatttcaaacaaaatttgattattaatttgatccaaatcttacttttcagaaaggagaaagattttaaagacagggtaaggagattcctccaaaatgcccaaagtagacttaagcaatacaaaatttatcacatctacttaccaaattttataattaattcatcagttcaacaaaattgctaatcatctcctatgaaccacccattgtgctaagggctgtgaggccaccaagaccgatatcatcagaaggcagcttgcacttcctgggagaaggcatgcatccccatagctgaagtcaaagtggcaagtgttccctggctggtggaccagagagctccatgggacccaaaagagggagggtgcaggcctgactgggaggaaatctggtagcaacgggtttccgtttctccttggataaatcaagaagacttttccttcaaggacatagtaagttcagttttacaaaaaattttattttttcttgatacataatagacatatacatttttgttcagttttgacaaggtaaagcacacacttcctctttctttttttttttttttttttttttttgagacagaatctcactctgtcacccaggctggagtgcagtggcgctatctcggctccctgcaaactccgcctcccgggttcacgccattctcctgcctcagcctcccgagtagctgggactacaggtgcccgccaccatgcctaatttttttgtatatttaggagagatgaggtttcaccgtgttagccaggatggtctctatctcctgacctcgtgatccgcctgccttggcctcccaaagtgctggtattacaggcgtgagctaccgcgcctggccaacaacttcctttttctttttcactcctgtgattctgcagctagagaaaaaaaggagaaagttcagtcagagaaggatgtggctccaggttgcctcatgggtgtgattttgagtggtgggcagttcctcctaccttcgctttctccccgtagcctgaatacagtgagccatagtgtcgaggcctcaggcctcttaatcctcagctctgtagagaaggcatggcccattgtttccatggcagtgccctgcaggacagtgacctgctcaagtctcgcctactagggacgacttcctatgaactgattttttttttttttttttgagatggagtcttgctctgttgcccaggctggagtgcagtggcgtgatctcggctcactgcaacgtctgcctcctgggttcaagggattctcctgcctcagcctcctgagtagctgggattgcaggtgcctgtgaccatctccagctaatattttttataattttagtaaagacagggtttcaccatgttggccaggctggtctcgaactcccgacctcaggtgatccgtctgcctcagcttctgcctgccttggcctcccaaagtgctgggattacaggcgtgagccactgcgcccagtctttttttaatttttaatttttttaatttttgatttttgtaggtacatagtaggtgtatatatttgtggagtacatgaaatattttgatacaggcatgcaatgtgtaagtggggtatcaatcacctcaagcattcatcatttatttgtgttacaaacattccacttgtactccctcagttattctagactggacaataaattattgctgactgtggtccccctgtcatgctatcaaatactaaatcttattcactgtatctaaccatatttttgtaccattatccatccccacttccccactgtccttctcagtctctggtaaccatcattctactctctatcatcatgagttcaattgttttaattttttagctcccacaaataagtgagaacatgcaaagcttttctttctgtacctgtcttatttcacgtaatatcatgtcctccaattccatccatgttgttgcacaaggcaggatctctttctttttcacagctggatagtgccccatggtgtgtatgcagcacattttccttattcattcatccatctgttgatggacaattggattgcttccaaatcttgactgccatgaatagtgctgcaataaacatgggagtgtcgatatctcttagacaaactgatttccttttggatgaagtttcaaagctcagtgcagttttgagattctggaagtaaatgtcccaactcacactaacagcactggttgatagggaggtgggcagtcggcccctcttctcagtgtcctccatgttttctgtaacgagcatgcactatagtaaaacctcagcagacttggtgggaccttagaagtcgtcttatgcagcattttcatttttcaaaaagaaaaatgaaggtgggtttcccgtggtgtctttcccaagggcccctgactggcgtgttctctgcccattcaacccttccgggagcacctccacaggcctgagctaggctacaggagccctgacaagtgagagacggcatctgtgcctactgggagctgtccagtaggggtccagacacccagtccatgaagtgcaactcgagccttccagagcagagacttgtgtgaaggacctgcagcaagctggagagaatggggaattcagccccaggcaggagggatcttccctttgctcgcttctgcctcatttgctgtctttatgcccagccttcgatggcttcagacttccttcctcctgcccttttcttgccgaccccattcctcttcagaagcaggtagtgagagatgaaaagggctgtaaacagcattctacggtaatggacgggcagggagctcagagggtggagggactgggatgggcagagactgtttcgtttgatctgccttttacagcttcccccaggatcccacaaagtcactaactttgaaatagttaatgaggggaaaaaaaaggcatgttattaaggcagtttaataagcctgagcattcagagggctgtgtttctagcactaggagggcccacattatcttggattttgtgttcagtgctctgatagctaagcatcattcctgaaatgaatgcttttgaaaggaaaaagtgcgcaagggaaaatacaccgttgggttgcagtgttctcctgtttgatgtgaattgggctctccctgtgcagtgccagtcccttgcagcagaccagtccttctcacgccactcttggagagaatgccagggcatatcagagacttaatgctcccctcatctgcctgacagctggtttgagtgctcagctgagcctcaagcacacttctgtgctcaccagcacacaggaggggctggcagctgggaggaaatgctctgtgctgtgtctggagcctggacatcaagacatgtcaagagagagcccaatatgtgctgtgaggccttagggatttctgatcaagagaactgtttgctatttgggagcacgcagcttggaccaccattctcctgcctctcctgcttcccatgtgatctgagacacctgcattcacctgaccagtcggtcccaaagcctgagcaacaacccagctcctccctggccgtccaaagcgttcttggctacacagtgtcttttatgatgcctgttccttgaattttctgttgaaaatattcgtaaattttctgttgaaaatattcatacattttcttgttgttagtatttgaaaaaacatctctttaaaatggtcataatgcttgagcccttcagtcagggccagcaggtgagaagttggaagagtgtgtcttgttctgaagtagtttgtggaggagagatttcagggaaagaagagaggtggaggagggagaatccaagggcgggctggagacagaagctgtggctggaacgtgggccactccagaatctgggtgcaggaaggcaagagggcttcctcagctctcacctcgctgaggccaagcctgctctggccctcacaagcacacttcatgcccagctgggatttcaggcctgctcccagtccttctcaacttgctcctctgctccaggagaaggcagagtgatgtcgctgtgcttctgcgctggccccatttctgggtagcgccacactgaatgctcactgtggtctcacatgtcttctctgaaatggataggaccttctccagggttattctgacttgtgcttctttttgcaccccctctcctagtaatgatatggaagggaagtgctgggaagggaagggcgtggtccctttaaataacacataatgggaaagtgttggttagaggaaggcatggtccctggctagggctctacccccttggacctaggtgaggacaggcatttcctgaccaaatgttgcatttcgcaagatcaccctggcctgccatgcccccatcctgtgcccataaaaacccgagagaccctagcaagcagacacacgggtggctggatgtggagaggagcacatcagcagaggaacacacgggccgctggatggaaccggcatgctggcaggccactgaccggcagagcgacatgaagtttgactggggcagttggaggagaactcgggccaccgagtagcctgactccaggggaaaatcttcccactccatcccctctggcttcgcccatctgctgaaagctacatccactcaataaaaccttgcactcattctccaagcccaggtgtgatccgattcatcctgtacaccaaggcagggataaagaaagccctctgtccctgccacaagttagagggtctaattgagctggttaacgcaagccgcctatagacagcaaaactaaaagagcatcctgtaacacacacccactggggcttcaagagctgtaaacattaactcctagacactgcagtggggtgggagccccacagcctgcccgtctgtatgctcccctagatgtttgagcagtggggcactgaggaagtgagccacatcccatcacacaccctgcgagggggacaagagaacctttcctgtttcagtaattatggtgatggtagtagtaatggtaataagaacggaataggcataggttacatgtgctggcagcttctaggcaccaatgtggagtgctggagtgcttatggacttgcttaatcctcataaacacactgctgtgagatggcaggggagcctgctcaggatcgcacacctaaccagggccacaccaggctgcctcacttcaaagctcttgtgttgatccagggggaaatgaacagaaccaaacgctggaagttctggacctgagacaggaaatggattttgtgaatgagaaagcgagcggtggtctcattctggcttcactactgtgaccatgataggatgtgggcatttttaaagacctgacaaccctggacctgccattctgcccagatgagttggagggactgatctgttggaggaccgagtccccgcatggctggcagcagtcttctgccatttgttctgacgaggccgagcttcacagctgcagtgggtgacattgggagctaaggaactcaaagcagataacacaaaacatgccagcaatcgaactctagcctcaaccactgccagctgtttaagggcaagatggatgagctaagagtgctccgagttactgcccggcagtgggagcctgcctgctgtggcccacaatgcctcaaagctctggtagaataactgcccacagggatgagttcctctctctcttacaccaacccctccccaggtcctttcttttcacaccatgctagtgcacagccacagctatttggaggcacagagactgagtgcccactgcatacgtttctcacggacgtagcgtccagagatgtcatttgcagactctgactggggttgtctctctgtggaagagacaccccgtggggctgcctcaggtgatcccaccatgcaccgtctggtcactgtggagtggctagtgctgtgtgcccttcctgttgacataatgaattataggttttgtgtccagagacctggtctggaataactatatctggctcatttcaagtcacgtggcttccttcttgaagcaggaaatataatattgactatgtgggtgatagtttcgctaaattaatatgggattagttttaatagttacgtagcaacactaccaggtcgtatctgcgatgtgccagcctgtgggatctcatcatgtagtttgagaatgaaaagcatttttctattataatcacatatataatattaaaaagcaacagtaatattcaagatgtcctatctgctcatctcaccaggtctacagaaagttgctcccatctgcggggagatgcctttgatggtattgatcggctgtacctctgctattgatctgccttacttcctgcctttagcccacacaatttatggttgtgtccactttgtcccccatcactagggaggaccatggtttatttcgtgagcaattctagcacagagtaggtgcaggttagaaggtatccctgcattctattagacattatcagtttcagaatcgccatcattattacataatctgagggctggaagagaccttggggaccactgtgagactggttctatcccaacaaatttgacattattctttttagtctttgctgtgcaatggagggacactgaagctggtattaacggtgaggcatggacagacaggagtcacactagaggcagcagtgtggccagggcctgctgcctggccagaagttcgcacatctgctgtggtccccgccacaaaacctgccttcgggaggctgctgagcctgctgaaggtggagctgaagttgggtctaatccggctaacaggcagccactaagcccacgtgcactaaaatgcggctggtccaaatcaggatgggctataaaatgacaaatacacactggatatcaaagcattggcttgaaaaaagaatgtagaatatcccatcaatgttgtatgttgcttacaccttgaaataataatatttgggatatttggaattagataaaatagattactaacattcattttatctgtttctttttactttttaaaatgtggttcctcaaaaatttt

SEQ ID NO: 458 - DNA, 112862 bp, Homo sapiens
gtccaccccacatggcttggggagcagctttggcacatagggagggaggaaggggtctgcagcatttgtgtgtgagtgtgtgtgtgtgtgtgtgtgtatgtgtgtgtgtgagagagagagagacggagtctaactctgtagcccaagctggagtgcagtggcatgatctaggctcactgcaacctccgcctcctaggctcaggtaattctcatgcctcagcctcctgaggagcagggactacaggcgcacgccaccacacccatctaatttttttgtattttagtagagacagggtttcacccatgttgcccagggtggtctcgaactcgagctcaggagatctgtctgccttggctccccagagtgttgagattacaggcatgagccaccatgcctggccagcattttcttttttaaaattttaatttaatttacttgttaattaatttattttttagagacaggatttcaccttatcacccaggctggagtgtgatggtgtgatcatagctcactgtaaccttgaactcctgagctcaagcagtcctcccatctcaggcttttgaagctaagactataggcaagtgtcaccaggcctggccagttttttttttattaaatttttgtagagatggcatcttgctgtgttgctcaagctgatctcaaacaaccatccttctgcctccgcctcccaaagcactggggtaacaggcgtgagccaccgctcctggctagcaacattttctaatctttctgctgtaaatttcacttgtcactagaatgtaaacttcacaagggtggggattttgtctgtttattcactaccattttcctgacactttgaccaataaatgcctaacatgcattggacactaaggaaatgtttctggaatgaatgaagccatttgaagcttgtgtctctgggaagtagaattctttttctttcatctcaaaggaaaacaaatttacctagtcttttgcttattctttcagcagcacagagacatattgagagatcaaggagagacacttcatttaagaaattggaaggaaaaaaattatcctttatggtgtaatacttatttaatggaaggactggcttcgtggtagaggtccctgttatgttccctctctgttttgtttgttttttttttttaacctagacaacttgctatacatgttgctcagaataagagggtacgtaagtcatcagatagccacaaagaaggacgatgtagactttggtgacactctgggtcatgtctcagctctggcattttttagtgtgtgactttacttatgttacagtttccttaccttaaaaggggatggtacctggcttgcagctctgtaaggattacatgaaatgagaagggagagcactcaataatataacagtgcctgccacaaagtaaatgttgcttctcacttccaaatgaagcctcatttaagtctcctttaagaacttgacattactagacttgctaatttaactgcttttcttaaaaacatatatgcagtctttttcttaaaaaaaaaatatatatatatatatatattcctccttcagaatagggcatattaaacagagtcctgtaagaaagtagagctgcttgagttatagcctggcactgtggatcgtgtttaggcatttacataactgcactgatctgaactagtttgttaatgaacgaacatttcttaaatatggaacccacgtgagagaccacgggggaaatctaaactaagtttttgaggtctcccaatccagggcagctctctctttggagtttaaaggaatcgtcaggtctctgtaataactaaagaacacgaaagaattatattgaaaacacttggctaattataagttctaagaggcatttcagttcactcaagcgttttaacatccaccaggacatacagatacacttctcagtccatcaagtcaaaagctgtgtgtgtcttttaaatgttttagttgtagttttcttctttcctctttaggagaaattatcagggcaggttaatctccacagactattatagatgtgcaaataatatgccacttacagtgcgtttttaatagactgcttgtcagaagagctcatgttttcttctgcttcatgtagaagcagttcttgtatatgcattcagaaaacaaagtagtctttcatttaggaagaaaatgccctcttaaagaaacaatgaatcttaatagaagagggtatcaggactcatcttccttctcaaaggcaaacataacaaaattgatagtctatgaaactcactaatttgtcctagctccgtcgcgatttttcatacctcatgcatccctgtaccttgtattatagttatttgtgaacagacattatttccttactgggctgtatgcttcttcagtggtgtaatccatgtcttattcattcccaatattatttggcaaagtgtcttacacgtaatggggatccataaatacttggtgaatcaatgaggattttctgagcaaagtacagagggctgggttcattgtttgtggttctcatagttttaattgggggtgatgtggaagagttcatgtcctcgtcaggttcctgctgagccagtgtgctgtattgtatttaggatggcaagagaagcctgccagaaaatcacctaaggtaattatttttgacaaagtgggaagatattcaaataggcatgaacaatatagagtttctgacaataaagtcaatatcacttgaggtttttttttggttccttggattcttcttggttccagtgcaaatgagaaggtgaggatgagggtggagtataagtttttgcctcccagatagagggacacagggcataggagctctgattttggatttctcagtgcaaaggaagagggaggggagtagtccaaaggcaaaggcaagaggatctctagaaatggggctcagtgggatgtcaggcctggattcgtctagaggacactgaggataacttattgtgattttgtacctctcccccttgcctatcaatttccgctgcatcctctgtcttgttgtggctctggcaaattgataaggagttggcagggtggttttgcagggaaggcctcatttcctttcctgtgtggcctagttcttccatctgtgactctcttgatagcatcttcctagactttgtttcatcttggctttttcagcacctcccgggcccatctcctggctggtctcaagtcttgctagggcactgtccaaggaaaccatgcagcagccctgaagactgatgctgtctcagagttatacttcctgatgctggatggacctcacatagatgcagcctctgggcgccaacgttatgcaaagctcagacttgggaggagagcgggaaggaggggagtagctaggcctattcactgtcacaggtgggcttttaccagggctttctgccttggccaggctcagccctcctgtcatctgacctcactatacacttatctgcaggataatgccccgatttcttagcaggaatataagacctgtcccacactctatgttttatccacatttcctgtcacaccctccttttctagttcagggatatatatatatatattgaatgcctgctttgtgataatcactgtgccagatgctgagaacgtcaaaaggaataaactttggtttctgctttccaagaatttactatctttccaagaatttactatctattggtatagcccaatatacaaacaacttcaaaaaaatagtttaaaggaatgttaatggggaaacacagaggtgggactcacaagccccttttctccatccttcctaagccactcatggttcatatgtattggggtcagccaatattggtttgattgtgatgttttatatctgtagtattgtatgacaataattgctgttctgaaaaatagtgttagataccctaagaatgataatagtcaaaaggattacattatacgataaataataaaaacaaacttgttggaatgttagtggtacctggtgtgtgagtggtatctagtgtggtaggaagagagatgaatatttcagaagtattttcagtaacaaggggtgtgattattgagtttcaaagaaaattaacttagaagagtctttcagtaaacattcccgttatcactttataataataattgatatttctagccccaccctattccctgccaatcccgctgctgttgacgaggagatatttttggctcgaatggtctcgatgtcaacctacaaggatttgcccactctcccagtggacatttggcaatgtctggagacatttttggctgtcataactggggacactgtgccactagcatctaacagataaaggccaaggatgctgctcatcatcctgtaatgcataggatagttccccacaaaggatcttaccaccccaaatgccagtagtgccagagttgagaaaccccagtctggatgaatagcctatattgctgcatggtcttcttataacagccttgttatgatttaatccatcagatgaatagtttcgatgatcacttagcatgttttggagagctttactaatgtatccccagtgtctagcacagaccctgtaacctagtccacaattcatatgtatttgtttgttaaatgcataagtgcatatattcctgaagatagtagcattttatttgttttccaaacactcctcttgtactttcagagttagataaatggaaaatatgtgccggagtttatgagagttatttcaaagattcaaagcaagtgttaggtcagtaaaaataagacacctggatctctaagagggagaagatagaaagttatcaactctagcatcagcttttttgcagagctgaacaggcaaaaacacagcagaagttcatgaaagcccagttggtctacagccacagaggaatatgctctaagcaaacagctgcaccaaaaagcaaactcaacacaaacctctaataggaaaataagtgggcatcatacagagtccttagaggaactagaaactgagcttcacagcagcactacctgaggctaggggcacagacagatataactacagccagctcagaaattaccttgcactgccccatggacgccatctgtgctggctttgctgggaaagccaagtgcttgacttcccaatttctctctcaccgttttcctgcttgaaccctttgctccagccagactttcctgcttctcctctaaacatgccttgtgctgcctctctctcattgcccatgacgttcttctgtctagaatgctgttttccctctcctctctacctctgagttttccaagactcagctcaagttcagcagcctgtatgaaacccttcccaagtttttcctgcataaaaagtctttaacaatcttatttggccctctcttaccccctccaaatccaggaaacaaggtagtgtcatgttttatcagattccattctatagaaacctcaggtgcttcgaaacgatgaatgggacaaatgcagcttttcatggttggtggaacaggccgtaaggatgggagagcatctccctttggttcatcagggcccactggatggacgcctgtcacaggctgtacacaacagtctgctcgttggtataaggtcctttgaaggttctgatagtacttacctggacaaagaaagagacctgaaggagtacttttatattgtccgcaaactcaagaaatagacaaaaatgtaaatgtcatcctgacattagacagatacattcccctctgtatagggccccatcccagtttttggacagccctgttttctcagggttcagatacaacatggaaagtgtgtgtgtctcttgttgtgctctgatcttggctcgtggcaagttcagggagaggggccaagcttggctaattggccagcgacagccctgctgggctaggcattctgtcagtctcaccaggcaccctctctctagattcaacccagaactttgcaatattgtgtagaattcccagcagcagtgagttctgatcaactctatttacaagagcaatattaaaaacataaattgcccagagggtatgcttaacattaaggtgttaaacagtagagggagaagggacttgtgaaaatgaagtttaattttgatacagagaactttcattctttgtgcaggatgtcttaaggatgtctctaaaccatcctggagactggtctttagacagttgattcattttctagcaaaactcagacagatatattaaaattaaaatctcatggtgggtataaaatttcattattatacctgttcttattacaatcacttgttttctattcatatgagatcattgggtagagaaaatttaccttgatttttgcattcagaattcagttgcctgtttaccatggtttcatttatttttagatgaaaatttcccctttttgtgtgcagctgagtgtatctctcgtttgccagaagggaggggaatatcgctgttaaatgaggatgatcatttatttgcaagttaaaacatattctgaaaaggatggaagcttgttcttgcctgaagctgtttgttctgtgaggctttgaggtgtctctgagggctgtctctatgctctattttgtcttgtttcttagcagtaaagcctttacttatgttggtataggaagtagagataagtgataaaaatatctggagtggacctaagagaaataagagatctgtaacattcacataattcaaatgcaggcctggtgattctgaaacattcaaaattatgtttttaaatgccattatgtaagcacatacatttgtccattgaccgtgatggaattcattgtaagtgaccagtggttcccaaagccatggcattggctgatctacaaagaaaaggaatcagagtacctgtttcaaaaacaaatcatcacatgtatatgcaaataattaagaaaacatgtactgagtgactacaacatagtgggcactatgcagatgtcagagatacgaagatatatatgatatggttcttgccctccaggcacttagagtctaagaggaaatatagatgagtatagatccggtacttctggtacctgctgacaaggactctgaccagggtcctgaagcacgcacagttccagaggccctccttaaaaaatatacaaaattactaaaggagcacctggtagagagatgaatgtgtatgttgaaggggcttgtgcaagtgaggatccccgaagtgtcagtttccgccccggccctgtgggatgtatctgagtgggtaggagcacttgagcaggacttagcgcccagcttggcctggggcaccgcttcctggagcgggtggcattgtaggtgtgtgctgtttccactcttccctcctggagtctactctccacacagtagccagcgtgagtctttaaaacctaaatgagatgatagcactctcatgttcacacttgctttccatcacaccgggacttgaaccccacatctatctccctccccctcgctcctgatgcctccttgctgttcttagaccttcagtcactttcctgtctcaggggttgcacttgctgtgccctctgcttgcaggattactccctcctatttagcacagggctggctcttctccacctgctcaaatgtccgtcctcagaggggcctcacctgatcacactatctggtgcccctctgtgttccctgccctctttattctgacttattttcttcagagcattctccgtacattacatactcctttgttcatctgtctctccagttggattggaagctctgggaggatgactgtatggctcttattctccgttatttccccacaccttggatggggtctggtatacaggaggcactcattaaatatctgttagaaaaaaaagtgagtgaaactaatacagacatggtgggacagtagctgggaggtctgtcttcaacagtttgtgaaaagggaggctaatggtcttccaggactctattttgagaggctaaaaatatatttgtttctgagcaacactaacttacagaattttaaaattccttggaaaaaggctgggcacaatgactcatgcccataatcccagcactttgggaggtcgaggtgggtggatcacctgaagtcaggagttcgagatcagcctgggcaacatagtgaaaccccgtttccactaaaaatacaaaaattagccaggtgtggtggcacacccatgtagttccagctactccggaggctgaggagggagaattgcttgaacctgggatgcagatcacgccactgcactccatcctgggtgacagagcgagcctctatcttaaatacgtacatacatacatacatcctgggtgacagagcgagcctctgtcttaaatacatacatacatacatacatacatacatagcgagcctctgtcttaaatacatacatacatacatacatacattcattcattcattcattccttggaaaaaactttcatgcaagattcctatggatggatggcatctgatgatctgaaaaaggtctgagattgtattctaatcaacagttacttaaatgttctgttgtcttaaatgccttcatgttggatctggttggaagagatttaaatctcgaaaagtgggaaagggaggggacagttcaatgtatgaatgtgtggtaggcggggagtttaattttcaagaggtaaaaagtcccatctaaaatgttttctccactgatgatatatttgttaactttatgaaaatgtattgatcctgaaagcagcagcacattgaattgttaaagtgatctcttgttctccatgttcctactggttacatattcctcttctctagaacggcagtggccggagtggatgccttggaggctcctaaaattctgctgggggtggctgatgagacagaaactaaggttttattatattttgctataaggactgacacagatggcctcacttgggcaacctgtaaggctctgaaccgaggtgtcttgaggcagctggtggaagttccattgtgtggagtggaaacagtgacaccttcatacccttgtcctttttgctgcatatgtgtatgggattaagtagatttacaaattacattatctagttataaccaaattgaccttcacaaaatacagaagtggcttaaaaaccagagattgaccatcatgttaaaaagtaaaagtgcaaatgagcatcaaagaggtggcagaatttatattccttctgctactgtttgtgtgagaattgccttagccaaataaaaacagatgataacttaatactactatataagaagttggccaaggagttcaagatcatcaagaagattatttgaaatatggattcatagctagtattataacagtgtatcttgtgctatctgtataggatggcttgttatagtagttactggtcagaatacatgtaatctacaatgcatgaataaacaagtacacttgtattgggggatgcatgctcaaagcttcttacagttaggggtgtccactcaagaaagcttagtgtccactgcttgagggacttgctattcaaagcgtggtctgcaaatgaggcatcagctgggaacctttcggagatgcagaatctcaagacttaccctagacctctggaatcataatctgcatctcaacaagaatcccaggtcatttgtatgcacattacagtctgggaaacactcctttagggaatattttataaggatgctgcttctgtgcatctgaaaccaggaagtcatttctctccacaagaaattgtggaactaaagatgtctgatttttacttctagttatgttgcttacaaacttggccttgggcagcttaatgacctgctgagattctgttcccacatctgtaaaacagagacaacaatccttgcctcccagaagatttataagggttgtctgaatgtgaagccctctcaggaaccaccgttcagttttgccttttcccctctgcgttgttagtccatgaacacattgagggagggatagctcttctctatctttgtatttcccagcacagagatctttaaacttttgctcatgtacctcttaaaaagccttgaaaaataatatatacccgcccatttttaaaagttcctttggtttatcataaattttaaaagttacaaagtaatccctaggttgttgtaaacattgacatttaagaaataaaaccagctatattccgcttttcagtctagccagtagaatctgatcactgggtaatttgagaggctctcagtgggaggagccagagaatgtcttccctcccactctctgacttccgtggcgtgtccagtagcagcttagtatcctggcagttctagctcccactggatgggctcatggtggttccatctccctcctggggatgctctggtgacacatcccctccttttgtccctttagctcaggggtggtgctagcttccagcccttacttatcttggtgtttctccgaggttcccagctggtttaccagctcttccttcattggtttagtcagttccctgcagtaattccctctgtgccaaataaagtagactcattcttttttggttagatcccaacagataaatataccagtttttattgatatgccgatacgaattgtgcttttgtcactggaaggttttttttttattttaatagattattctttagtagcataattctatcatctcacaggcactagtcatttttttaaattaaattaaattttaagttccaggatacatgtgcaggatgtgcaggtttgttacataagtaaacgtgtgcaatggtggtttgctgcatctgtcaacccatcacctgggtattaagcccagcatgcattagctatttatcctgacgctctccctccccctagactgccccactactgacaggccccagcgtgtgtcgttcccctccctgtgtctgtatgttctcattgttcagctcccacttataagtgagaacatgtggtgtttggttttctgttcctgtgttagttttctgaggataatggcttccagctccacccatgtccctgcaaaggacatgatctcattcctttttatggctgcatagtattccatggtgtatatgtaccacattttctttatccagtctatcattgatgggcatttgggttgattccatgtctttgctattgtgaatagtcccgtactgaacatacacatgcatgtatctttgtaatagaatgatttatattcctttgggtatatactagtaatgggattgctgggtcaaatggtatgtttggttctaggtctttgagggatcaccatcctgtcttccacaatagttgaagtaatttgcattcccaccaacagtgtaaaagcgttcctatttctccacagccctgccagtatctgttgtttcttgactttaataatcaccattctgactggcatgagatggtatctcattgtggttttgatttgcgtttctctgatgattgtcactggaaggttttataccgcacatctatgtaccctggaaagattcaggatgtgtgaggggtattcttctctttaagaaacagaagaagggtagttgtgagagaaaagatgttcccaggcagaacaattttaggaaaaagtacaaatagaatataaggttctgtaaactaattcccttaaaatgagcacctttgaaatgtgtctgtgtgctccagtttgaagactgctgccttgcaaagctggacacattgcacatttaggcacactaagtattgtttgagtaaacggatggctgcatatgtagggaagtcccagattgtgcataaaatcttttttagcagtggtgaggcccaaatgcagccaacaatgtgggatgcatgctcagtctgacacatcctgagactgcagttcatagctggtcagactgggtgtctccgagggcctggcgcttggctgaacagatagagccactgggaaagcaggcaggatcttggaagcccaagcgataatgggccatcagctggaaacagggcttctgttgtcactttgccagcaacaacagcagtggtgctgatgtttgcagttgtgtgcatctgcaaatttgcagaactctgccgcttatctggggaaatctctctgacagatttgtttacggaatatcaagttgtgcatttacggctggctagccaacaaaactgaaaatggcctaaggaggatttaaaaaatgactacttttcattggctgtagaacagaagcctccctaccccgccaaaataaagagtcctatttcgcatctttgtttgctttttgctgtgattttgttaagttgcagtatatccgtacaacctctcccacaagaaactccactaaaactccaaaccaaaaaagcaagacacttgtgcagagagagactcctgtcatttatagtgttgctaacacaacttcgtagccactgagtcaaaacatctgagcggttgcgcacattcaccccagacactctaaggaagtgaggagctggtgtttcctgaaggggctgattgcccatttgcctggtttacctggcaagggaagacctcggcattgagtgtattaagacaggttaaatttaatttacagtagctattaatactgtttcaaagagccatctcgagtatagaatgggtggcttcttacagggaatgttgtaccaactgagaaaatttatgaagatgatagatctagaagacaaaggcaagccttcttaaatgtagaaacttgaccatccaactagtgattcgtctttttaaaaatctgaaaggctaaagtcatagggtccgtgaacttcctagagggatggaagatcagagatcagtctttaggaagatatcatgtgggaaatggagtagagactcagataagaacaaaattggctcctgaaagaaaaggtaaagatactgcacacgtggagtggggtatccaggaagaaagagggttttcatatcaagaggcagcaagtgccagagaacaggctgcctttggggaaaaggcagaaatagataattaatggttttgaaagtcaaactacagaactgcccttttcaagtgttttaataaatactgaagggaatggaaatacatttgacataatatggaagcagtgaaggacatgttaatggaactttgatgatcactatgtaagaaagtacttagggaatcagaatataaacaaatcaaggtcaggagagatgcctacttatgttcaagtttgctccagtgttctgcgcagaatcttaccttacgggttcacttcggtatttccagcattacccatcatcatctatccatccatctacctttccattctttccagagatccttttgagtctctgctacatgccctgagtcctggactgggcactaagaacactgtagtgtataaagccatgcttggcccctgctgttttaaatctcattaaaagcacaagtgtacgattgcaacagcactgggtaccatgcaggagagcagtgtggtgctctggatataaagtagagggatttgacctaattgaaaaatgagaaggaaaaagcccttgagtgggaatgtgcctttcccttagaggctaggtcttcatatgcttgggagtttcaggatgtgtagatcttcccttaagttgaaattatcttataggaaggattcttgaatgaaggtatctaggattgaaagacttttctaccttgcatcagatttttagtttatgtaagtgtattatactggggttatggctcaggaattaaacccatgtctaaagaaaaaagcatggaattgcaaatttgtctttttcactgacctgctggagaaaactatattaattgcatagcaattaatagttggctgagttctttcatatagttatttaaacttgtatctctactctgtccctggctctccttcctcccattcttcatccactacctcccaggcaggtaggacaggcagaacattgttgtcattatctatggcaacatcaaatgtgttttgaaggtttgctgcattggaagttgacaataaaattacagcacgtgcccaccatctatcccccaccctcaaacttagcacttagagaggggacatatactttaaaatagaatgcattaatttctccagaggcatgtacaaggcttgttggaatatgaaggaggaacccctaattcagactgttgtgtggagaggggacagggagtagggtgtatgtttgtcggggagcttcctgcaaaatctggaagaacagggaagatttagctggatgagtgacagagtgggtggggatgaagttcagataaggggtgagctttgccagatgaggaaacgggacacctagagttgaggccagatctgtcagttccttctccagtgcacactccctgaactgagctgccactcaggtggagagaggagtgggaaacggtaaagacagccaataagttgggtaacccaggaagggaagcaagaataatttggtagcaggagacggcaggtactcaagacaggctgctttttgggaaaggggcaagtagataattacatgggaggccctgtgcagtcatcacatttgctctctccataacatcctgaattaggtgttgctagctgcattttacagaaggagaagttgaggcctagtggggctagaaccaggttggacttgaccctgtgttgccctgttcagtggtcagtactacaggggtggctggggcccagtgggaactgtgggctgcttgtggcattgtccctggttggatgtctgaggacaatccccatagtgggcaggcatggctgggttcttcagagatgtaatgaacaaaagaactttggggactaactcatggacctcatccttgcggtccagtgacttctgtggaaaaatgtgtttacatccccattcgtaagctggccctatctgaatcctcctttactttctaggactggggaattaggcatgtgctggctgcttaggccctgtgtgtgtgggcatctgccagctttctaagctacagtaatgaaggctctcatgactttgcagaactcagtgtcgtgtagagtagaagtatccattattagacttaaggacagaggtacatttgtatttttgcaaaacatatttaacttatgcaggatgatggggtagaccatcctgtgactgatttaagaaaggctgtgtttatttaaggagctgcacagagaaacatacaggagaaagggtagaatatgggagatttgtatgttgttcagggacaaagtttgtgagggatgaccaggatccacagacgggggtgggtggaggcccttcctgtagcatcttcccctgaggcctgacgagagagagagaggcagattgtagggttttatttcagaattaatcttactgatcagtacactccatcctgcctactttcattgcagaaccttgtgcttgggttgaggcagtgttgaaaggagggattgatttatattacatttagttgtgatcagttagacaaagtggtagataatctttggcaggatggatttagaatttgcttaattgccatgtgctatgatgttctgccatctgcagggagagcttccatttggagataaaatcaaaatacaatttctagattttattgagggtcgtcctcccttaaacaaatactgttgtttcttttttcctgataactattttcattttctgtgaaaacatgcaaatgactcaattgctagaggagaaatgaggcagcatttctaatagtcactcttttgccagctttttgtaggaatcaggttgtttgactttcttccccctaagaggttagtatctgaagtgatgtgagcagagaacccctgagatgtcaggtaccatcaccaggccggaatgtgggatttggaaaggagacctaggtcttggctttttcagactcctcatgtgaaaccagtggagaaatccagtgtcatgtggaaaatgcggctaggaagggggctatctggccttcagtcaaggcagtggcggcagtggagtgcaccttagcaaaacatcgccacatgctgcatgtcagcctagtgggggacatgcacgaggcttatccctggatgtttggagtctgactgaccgcaccctccttgctcccatccacctcagatgtttccctgtgtgtgctggatattggaggaactagggcaagtcattcttacagtgctttcagagaaaattcatatatatgtcaactctcctcctgtcacgctcagtttttgcaaacacttggggttacatgtttggtacagtgtgacagtgtatgtccctcgttttgcattgtacctgttgtagggctgtgctggacacccgtggcttggcctgagaacagaacctcgccagtgtcaggcagacagtcccttgctagttccatcagtaacaaatgctgttcttatcatgatggtaaccagtctgttagggaatcttatcagcctgctggggagagccagcaggcagagatggttaaacatctgcagggcagggaccaggctggtagagggcagggcagcttgctggacagtgtctctgtgggacccttacaggggcagtttcccagtgttgtggcattaagtagagaaattagccctctggagttaggatggtacgtacaatgggaagtcctatgtgatagaatgtaatacttttaaaatgttcgtgtgagagtatatagattaattgtccatttaacaatgattgctggagttagagaatgaatcacaggtagtcagcacatccatgttaatctctgcaaaattattgctctgcatgtagttgaaggctgtggggcccgacaggcctggcatgggtacagttctgtcatttaatgactttgtgtaggcatgtagcccttctgagcctctgtttttttcttttttttttttttttacccttaatggtgttaacatagcccagggattgtcttgaagattaaacgagatgattttgcatgtatgtgaataaagaagcaaaatgcctggcatttagcagtcagtcagtaggcaatagttgcagttactttaaggccacaatgtaatctttgggaatatttgtcaccaatcaggagtctagggtctttgttcagtggtgtttttaccgagcctacaacagtgcctggcacatggtaggcacttggttggtacttactggctgtgtggagcaatagggaaagtgaggcagatattccccgtatccagcagcctgaggagtgcctgtgtgaaagggaactgctctggaggcgtgagtggaggtggcgaccctgtggagtgtttgagtgggaaatgccctcctgtgcctggtttccctgacccgtccctaaagattccctgggaacccccatacgctccttcccttcaatttttgctgcaatcttctaccccatatatacccaactcccaaaaatgtgtgggaaagaaaaccctttttagttttcacccttaacataggagagagagaggctaaatttataaaggaacttggaagctgaccctaacacatgcatgtgtgtataccccttgtctatagatacccccttggcctcacacatgaatagaaaatgtgtgcatgacaaaggaaatagcacagatcaatctgaatgggcttattcaacaatattgtcacatggttggtttgaaatttgggaaacatttatgtaggctgatacctgataggatatacccaaattctgcatgattacatagtaaattaacagcaggaacgcaatcaaacattagaaaagccagaagaaaacagaatttaaatggctgggcatggtggctcacgcctttaatcctagcactttggaaggccgaggcgggtgcatcacctgaggttgggagtttgagaccagcctggccaatatggtaaaaccctgtctctactaaaaattcaaaaaaattagccaggcatggtggcgcacacctgtagtcccagctacttgggagactgaggcgggagaatcacttgaacctgggaggtggaggttgcagtgagcagagactgtgccactgcactccggcctgggcgcggcagagcaagactcccactcaaaaaccaaaccaaaccaaaccctctacacacaagttgttgattgtagctttatttattgtagtggaaaattggaaacatcttatgtgctcagagattggggtatattcccttggtgaattctccagtcattgaaagtgatcattttgaagattattataacataaaaaattgaacatgatagtaaaggaaaaattagaataaaaattttatatacaaaatgacttcaattaaacatgtatgaaaaagaagaaatacatcataatagatatttcccagtagagtcatggttttgtgagtgattcttccttttctctatttcccaaatgtgcaaaatttttgttgttttatattttcagacattatatacttaagtgattacctttagtctgctgagggagatcaaaatgaagaaattatagaaaatgcaaacatttgaaaataactcacatgctgtctcatcttttgtttcgaaacattccagtaatgtgcaggagagctttggtgattaagcttcatctttatccagagaaagttataacagagccacaagctcatcaaattcaggaactttcttctgcattctttcctacttctagctttccttgtgtttcctaagcagttggcttccagggctctcagaagctggtctacaggctttgtccccaggaaaatagattgttccttattaaaatccagacgcttttctgtttcaaacctttcaggtcctctgctagcctcccactcggttacaatttgttggttcccaccatgagcctttatataaaaacacacagtgtcattaaaggtgtgtcaagccttgtcaacgttctcatatagcccgaggctgaggaattctggccttagacgtaagagggtattagtaaacaccgtttctttctgctccttgcctgcgagtgagctttgtatgcctgtcttcctaggtttgcctggaggaggcttaccagtgaggaaaaaacacatcttagcagaagaatgtctcacaggtgctgcaaagtgcttccgcattcttctgaaaatagatgtttttaaaatttattttaaaaattaatttatatttttgtatttaaaaatgtttttagagataggatctcactctgtcacccagactggattgaaatggtgtcaccttttcttactgcagcttcaaacccctgagcccaagtgatcttcctgccttagcgtcctgagtagctgaaactacaggcatgcaccaccacacttggctaatttttattttttatagagataggttctcactatgtcacccaggttagtcttgagctcctgggctcaagcgatcctcctgcatcagcctccaaaaatactgggattacaggcacgagtcactgcgctcagccccagatgtgttttaatataagttgattttcagtcctctgcctctgtgctgttgcttttctgggattcagaagctgtgggctaggaatcactaattacatccctgcaaattgggttctcctcttctacccctttgcctacttgaaaatctatgaagattcattcaggtgaatttctaaccatctgtacctcctcccctacacattagcaaacacaggatgctcccttagaaacataccaattgtgagttcatactataaaggttgttaactacatgctcatcatagcaagtatgttataagggtccatgaaaaataaaaggaaagtgggattgttctctaccctattttatggggtaggcaaggttgacctgatttcaggatatcatgttaggccatagtgtgggaatgtgttgtggcaagagactgacacctgcagctcttgaaattctcaggcctcctggctcatcatgtcggtgagggaggagcaaatgaacaaatttcaaacaagtcataattaacagaagttaaaacacattaaattaatagctgaagaccatgaatttaaaaaccctatgatgatagcttaacagtggccaagctaaattaagaaggttaaaaaggtgtgggcctgagactgtgcttgatcaagaagttgtacggttttaagtttactaaacaaaaataccccactcagattcttcacacctaaaatgctaggtcattacttagttctgttgggcattttcacttcagtcctcccttggggaaaaattgggtgttttcccagagagggagacccatacattggtgactggtaaatgtgaaccttggttccaagtctgtgatcactagcttattttcatgagtattgtccttttttgtttttttaatatttgattttgctcccatatacataattgacagctttcaatagttgatgttttttgtttagtagagacatagcagctcgctcttgaagaatatgaaaccatatttgtacttttgacttaaagtttgaaataacatctaaaattctttcaagtgactgcaaatgcatgtgtgtctgtgtatatgtgtgtgtgtctatgtgtgtgtctgtatgtatgtgtatatgggggtgtgtatacacacacgtgtgtgtgtctattcagctgatctacctgtctgggaagtagatgacatgtatggctcctacgacccttgagattctggttgagtagctctgggctggggttcaggattctgtgtctctaataagcactgttaaagattgggctgcaggtggtacagaggtccatgatttaaagaaacatcgcttcagagtaatgagcatggtgctaatggagtcctttttattttcatggtggttctagctctttccccagttctttgggtcaggcctgcactcatatgtcagaagcaaattaaagtgataaaacacccagaaaatacgaaatcatcatattaagttggcaaattgccatgcttttctcagccatttgtgcttccaagcgtgactttatgattcctctgtaagtgcttgataatgagaggccgagcttagttatgcaaattgttttagcatcaagtatccatcatgggctgcacattttaagcagggagaaaatacaacttgtcctgtgtaacagtcagggctttggctgatggtggaatcttctgcaccatggatggattatggcttgtctgggggtatttctcttgaaattagcccattgattgaaccagcagagaaggagcagtattattgggagccagctatcgggttttccctatgatgacattctgggttgactggccacactagagtctcttgcaggctcagctgttgcaggtctttgtaattgcttttctcttatgatttccttgatgagtgagacaaactgttctctggaaaacaatactagaatcaaaccatctgaggcagttggagaaatctgcctagagtttggatttctacttttcttcatttcaaaagcgaatagaatgttttttaggtttctcacttgtctgtaaaaggccaagtattcatacttgggggagggctgttcactgatgctgtatttaaattttcatgaggacaggattttcgtgcctccctgggtaggtggttctgatgctaattagcgagaaggtgtttgctctatgcatgggagcacatgtgagcacggagcttgtgtctggtacgacacggtgccacatttctggtgctgattactgcactatctcgttgttttgaccctgtgagcttaaatgtcagttgaaccatggatcaccataagctgtttgactttttcttctctcttgtgaaattcaggtatcagagcatccttttcctgactttcaagtagttggtaagcacaaatgcttatacaggtgtccacggagagcatgatagtagcgaagagctgtgtgccgcctcgagcttcttgttgtgtggtctttgtgctttttattattggtgcttatggcatctgtgcttcttgggttagaaatattctgtatctaaatactaaaatgactgattcttggttttaagccaggtttcagaagttattctgaaatggtttgagataaatacttacatttattatgaactcttttcatgtagttatcttatcttaaagatgcctttgtataagatttagagcacggttgccaagaatgggttttagataaagtatatgtaattttcatgttaacttgtagtagtttgaattcagcctttatttttggttgagtactagacaggttcctctgtcttgtattgtttgattaaaggatgcccttctgtatatgtctaccatacctgcattttaaagtcactacatcctcctcgaaatatatatatttaataatatattatgaggattgactaaaattataaaatgaatttaaaaattctgataaagtttttaaggacagcagtaggatcgtgaataaatcacaatgcaacatcttacacttgctacctcaagtaactgtttaagttgcataaataattcctaaatccctgctgaaccataaaaacattagggaagttttaaatcatacttaccctatttcactggcagttggtagacatggaagggtggaatcatggtgagagaatgtaagctggtctaatcttgtgcaagagagttgccaagaatggcaacatttttagcttctgaaggaaggacctgtgctctttaatgttaagcaaatacttctatcattcttactactaagcaaaacttgctaatggctttagcccttgggaatatgtaaccaaagctctttttttcttctctgtttcccctcatacttgatttaatatagatttttaaatgtaagaaaaaaattataagaaaaaatatggagaagaaggcattgtattaaccaataatacaaagtgaaatttctagacccactgaatgtactaggggcttccggagaagaatgtaatttagaacctcagtaaatctcttgagcaaagtttcactgctggttttcttttctgccaaatatcagcttgtattgcttaaaacatatccaagggagggaaagattaaagcttttcatattagaagactcacatgtttaaactctattacaactcttaatctgtgggtatgggttttcttctgtaataataataagaatattggaagttactatatctagcagagagtgcagcattttattgtaggtcatgagtctaggcagtgtgacttggctcagccatcatgaggatgttggcagctttcacacctgcatcccgtgcctactgtttgccaagtggctgactgttgcagctcctgttcttttttctgaaatactgtacaaggatccagggcagtgattgcattgctgagccttttctgcacagccatcatccccaagatgtgttgcttgctcagactctagggccctgatggtttaatgtcctgagatagctgtgattctttgggaatcctgaaaacaccatcacaaataattagacaattgcattgtttcttgtctacttctaaggaactcagaacactttctggtcaaatcattcatctttatctgcttataacaaagatgaagggattacagggctgctttaaagaaaaaatgggaggaaaaagatgtcagcagcactttctcaccaattcagaacctagaggattttggatgtgcattttatcctattcaggtgaaaattcacatcgtgatatagtaattcataatttattaccttataatagtgttattcttcgtgataggtttatccatctgtttcttgccttggaacctttatttctgcagtggtttagctctcaccctgagttatcagaagtatcatagtcagtggcaacactggtgttttttcttcgttagtaagctctttctcagcctgctgggttggcgccacagcctccatgttatattgcagattctggtcacatctgcccagggtgttccttttgtccagtttgtgtctgtttatggtgctcctctcgacggactttcatcagcaggagaattcaggccttacaaagggagggatgggaatagatgaatgcatccttagatttttggatttcaggaaccagatcttcctgggaaaactaccccaaatttattttgacaatccagtggttttaaaatagcctcagtatcacctgccaccatcagtgtcattctctccacgttttgttgcccatagttcataaaagaaaagacattttaactccagaaaagcaagagaactataattttagactatcagtcctttagaaatggaataaattcagttttatataaggtccctatctgccatcttttaaacatttcaccgtagcctgagtgataaaaagttcatgtcagactagactttgggaagcattgggctgagtcagatcccttgtgctcctctgagtgatcccattccatggcttgtgtgtgtgcaggaggttctcagtctccctttactcttaggtgcaagcacgaaggagaaggttggcggacatttaacttgtatccagagcattgccagaaacttctctgggatttcttttgaaaccactcacctgtaatgtttacacagggttgatttgataatctgcaccccattcacaaagaagaaccatttggagctgttgaagagttctttgaaatcttgaccctggcttccactcctacactcgttggacctagctcttttaacctgctgtgggtttctgagttcttaaagctaagtaattaaagttggctctctcaggttccactgaatttaactagataactcattgttcaaatgacttcacattgacctcgatcatagggccttttcaaagcagttaaatgccaagtcatttttaccgttatttaaagtaattctacaagggatagattttggtccatttgtaaatcagttattattatgaagaaagactctttttcctttcaggaatattcgtaaagctttgttaaaagtaggtagtaaaggccaggcacagtggcttatacctgtaatcccagcactttgggaggctgaggtgggtggatcacggggtcaagaaatagagaccattctggccaacatggtgaaacccatctctactaaaaatacaaaaaattagctgggcgtggtggtgcgtgcctgtagttccagctacttaggaggctgaggctggagaatcacttgaacctggaaggtggaggttgcactgagctgagatcacgccgttgcacaccagcctggtgacagagcgagactctgtctccaaaacaaaacaaaacaaacaaaaaaagtagtaaaaccaaaagcgaagtgagcagacccctatattttatgtgtctgtcttctgtgtaatacataaatttttgttactgtcagatatttaaattaagatgttaacttttaagtggatgcagactcttaatttctttcttttttgaatgttatgtataaaattcttttatatgcattttctgtatttttaaagttgacaataataattgcacatattcatgggtatgggtcatacagtgatatttcaatatatatcatgtatagtgatcagatcgtggtaattagcatatccatcacttcaaatatttattgttcctttatactgggaacactcaatatcctcctaggtatttgaaactatataacacattgttggtaactatcagactctgatttcctcatacatattagtaaaaaggtgtgtgaaatagtattagattgaaaattaatgaaatttttactttaaaataccttagatcttaagaaggaatcccaatgaaatatctcttactgtttcagtagtaaaacaacaacaatcttgatattatattcattatccacctggctggacaaacggctttgcttggtaaggcaggcagatgacagagtatgggagggggaaggagacccattggagtgggactccatgtcacagcctctcctatcattttttcagtgaagttctctggttggcccattccccatctccttacattgactgcccaggttatggatatctgtgcttctggtggttaagcttgttgattagttgataattattttgtttgattaaatttgcagttgatcaggtgtggtagttagaaaagagtttgtaggagcaggtcctgagagagatagtaagttgttttgaagccagagactaacttggatagtctggctggcagtggaagaactgcagagctataatttgtttaagtatgggagaccagtaaagtcactggacttgttgattttctgagaggagaaagtggattgctttgaaatccccctctcttcctcctccccatgaatgacacccagttgttcagttttagttcttgccacagcttgcacatggaaagaattctgcctctatttataaatttatgtcataatttctatcatgttctagttgcttttgatagcaaaggagggaattttggtgcatcattatcaaatatctactgagcactgggctaagtgttgggaatagaaaggtatgagagacatggccccacctacattaatgatgtaacacatgtttattaagcaccctcaatgctacaactactgtcatgtgctttatcttgtgtaatccttatagcttcatgccagataagttaaataaaattaataggacacagtatttatttttaatttttataattattaaatatttcttaacttctggaagaaaggacacagtgttggtagcactgacccacaagcccttctatctccttatgttatttcagctggagtgaaatttttatgtaagtgggaggggaaagaaaaagctggaaggttttgacgtgtcctagttatgaggagcttttcatgtcaggtgtgggcatctggactttattctgggattatagtggctcagtgaagtttttgaataggggctcatagtaatgagcacttattttataagatgataatggataggagagaaatagaagaatgagagagaaattacagtgggcatctgtttcaatgagattacattcattcatttaccccataaatgttgagtgcttactatataccaactactctattaatcactcaggatatagtagtgggcaaaaaagacaaaacccctgtccttgtggagcttttattttagtggtaggagtcaatcgttaacaaatagtcatgtgaaaatattttatgtagtaataactactattaagaaagtacagcaggataaggagataggattgctgaagtggggggattactttagagtggttaaggaaagcctctctgtagagttgacatttgatcagagacctgtgtcatgcaaaagagcccaccattccaatatctcaggggaggagtggcccaggtagacagaaaagcaagtgcaaaggcccggtggagggatcaaggatctacagactggtgagtttggccagaccaggagggaggaggccgagagggaggcaggaggcagatcacaatggcttgggacctcatgctaaaggatggagtttattccacatgtggcaggacattggagctttgtaggaagagagggaagcatgtgagctgactcatgttttaaaatgttgaccatggttataagtgggtattagactgtaaggagcccagctgggaggctcctggagaaggagtctgggtaagagacagtggtatggaccttggtgctggtggctcagtggaggaggagtggataacttagaggatgttttaaaagatatgttgatgaattcatggggggtgtaagggaaagagaggaattgaacagcactcctaggtttttgtcctgagcatttgagtagatacgatggcttttacttcattgggggaatacttggagaataataggtttttgggaaaaaaccaaaagatttgttttggatagactgagatccgtattaggtgtcttggttcattttgagttgctataaaggaatacctaaagctaggtaacttataaaggaaaaaatatttatttggtgcattattctgctggatggaagactgggcatctggtgagagtctcaggcagcttctccacatggtggaaggtgaaggggaactggcatgtacagagatcacatggcaagagaggaagtaacagagtgggtgggagggagctggtttagcaatcagctcttgtgggaatgagtacagtgagaactcactcacacattgcctcctctccccggggagggcattaatctattcatgagggatttgcctaacatctcccattaggccatacctccaacatttgggatcacatttcgacatgaggtttgaaggggacaaatattccaactatagccatccaaggagagaactctggggcataagcaatgtttgatgagattatggctgagaattttccaaatctgatgaaagatatgatagattcaggaaaattacaaacctcaaatacacaattccttcaacagactaacagtaaatctgacagctgacttctcaggagaaacaatgaaagttagaaggcaatgaaatgatgtctttaaaactaaaggaaagtaactgccaaactaaaattctatagccaatgaaaatatcattcaaggatagaggcaaaataaatatatttttagacaaatgaaaactgaaaagctgtatttcccacagacccaaatggaagtgtggagatgtgggattgaataatatatttcggtgacacatgtttgagttccttgaacataccatgggggaaaattttcttcctgccaagagtgtttgaggcacattctgtttactctgtctgatgtttttctcacatctctttgagaagttaacccactctcatcatttagatagaagcacaaatgccacttccctgaagccttctctgaaccctgtctagtttagaactaagtcaagtcctcttgtaaagggtgtcataaatatccaaatattactagagtgttacacacaacattgaatagggcagttaccataacatgaatatttgtgaactgacaacatataaaattagttcccactcagactttttgccttaacactagtgtttatcctgtcagtgtcttgtatccattaatctctagtggatagttggatgtttacaataatgcaatacaaatgggtttcaaagtaaaatcacacatattgccagctatgcagaatttcttgaattttggtgacagtgatgttgaactcctagaatcacatgcattggtaatgactggtaaagatctggcagagttattaataattgaagaagccagagtggacatttaatagacaataatttggaaattaaagaattacaaagaggcttttgggaaaattgattatttttacaaaattactcttttataatcctgtaaaagttccaagtgacaataagtattttgtgttatactatcatttggtaatgttatcctgctctctaatcaacacttgattaatattttcattttaagaatgattttcttaaatattcttaagtgttggatgagatgaacttaattttttctttttttgagatggagtctcgctctgtcgcccaggctggagtgcagtggtgcaatctcagctcactgcaacctccgcctcctgggttcaagcaattctctgcctcagcctcccaagtagctgggattacaggcacccgccaccatgtctggctaatttttgtatttttagtacatcttggccaggctggtcttgaactcctgacctcatgatctgcccccctcggcctcccaaagtgcaggattacaggcatgaaccaccatgccccgccacttaatttcatttttagccatctttcaagataaactattcaatttatttaattcagtataataaatcctacaaaaacttaatagcttaaaactatgggaatcttttgttgtctctcatggtttctgttagccaggaattcaggaaggacttggctaggtggctcgcttttaggatctctcagacagttgtaaacagcagtcatctataggtgtggctaggctggaatggctcacttatatggctggctgttggcttggggcctcagttgcttcccatgtgtgtctttctgtggggctgcttgagggtcctcaaggcatggttgctggctccccagagagcaaaccgtccaagaggccaaggtagaagctgcaatgacgtaacatcagaagtcacactgtcacttttaccaacttcagttcacacaaggagcaaccctagttcactgtgggatggagctatgtaaggacaggaataccaggagtcatggatcattgtgaataatcttgagggttggctgccacataagttatcctttctttttcatcatttattatgaaaattttgttttgtttgaagtagattccctctaagaggtcttgatttggtatcaattatcatgagagaagtaggatctcctacaccagtcttttgttcatattcttaccacagttgtagttcatgtatactgatggaggtattttgttgtctcccctttagaaaaatggtttgtgaaggctggtccaaggcagcaccagctagcacagtacttggtacataatggatgttcagtaaaaatgtgttaaatgaatgaataaacaaatctagtagataagctattggttcttgattagagaacctccaaacttagataaagcaccagatagcacagtacttggtacataatggatgctcagtaaaaatgtgttaaatgaatgaataaacaaatctagtagatactgttggttcttgattagagaacctccaaacttagataaagcaccagctagcacagtacttggtacataatggatgctcagtaaaaatgtgttaaatgaatgaataaatgaatctagtagatgctattggttcttgattagagaagctccaaacttagataaagtggatttgttttttgtttcgttttgtttattatcctggctatgcccttacattgctgttgtagtcaacctatgtcttcagtgttctgtattcatgttaatgtttatttttaaaagaactgttagtatatgtgctgttgtggaagggaaaaaacagcccacataagtaaatctgcactgttgaattgtatggatttagcctcttcccagggagaaagttattcagctgaattctgtaattgatcatttggtgtttctcaagaatattgatgaccattttcaacagcttgggatgagtaaggaagataaaattatatctttaaataaaaaatggtttctatttattgatgttaaggatatatgggtaagaattattcttactaaaaagacaacagttacttaagtgatcattttgtaggtttgctatttgtaatgttctagaatttgttttattcatgatttattttgtctattaaaacccgtttaaaattttcttttaatttaaacattgatgagacttggctgggtagcggaatgccagaaagggccaaattcctgcagctgcctgcacaccattattctgaaatgctgctatttaaatggcttagctaatagctgaaacatgactctctgaggagggtggtagctcctctaattttctgcctttgcctctgcctttcttcttttcctcttcttggaagttgtatactgagtgttagtcagtgcacaatttccttatggattcccagttggagatgagtgaataccctggtgagttgtggacacagcatcacagagagcctaatactgaatattgggttggggtctgtgttcctccctagattagagattctgaagcaaagagaccatgtataaccttcagaggttggtttcagatgtttacacagcatatccagtaaagattggttaaagaatgagatttattggcacacataaatatggacactgagcagtacggcagggttcccgcatgacatcatctggtgggtccagattcatttccatgtgactgtcctggctctcttctccacatccccaagccatcctaaagatggctgcagcagttccaaaactctcttctcaacacaccgtctagaagaagagagagttgtttcttgaaagctgcagaagatcgaggaagatcttttccaaaagtgtccatgaaagttatcaccctctttgtgggtctttggcctaggttgggccacattcctgaacccatcactagtgatgaatatggaattacccttggatcggtcagacccacccatggagtgaggggaagcactagaggagaggtgaatccctgaacagaatcagggtttcattaggaaggagggaaaacacgctgggtaaatgatcaaacaatgttccttatcctctttgttatgtcccccatacttagaacaatccctggcacataataggttgttgataaatatttattaaattaattttttatcttctgatttaatttctgagttctatgattgctcgtttcctgagagataaacatttatacgttgcttattgtctacttttaagtgaactttaaaaaatacttatttaaggctgggtatggtggctcactcctgtaatcccaggattttgggaggccgaggtgggcggatcacgaggtcaggagatcaagaccaccctggctatgatgaaaccccgtctctactaaaaatacaaaaaaaaaaaacaacaaaaaaatacaaaaaaaaattagctgggcgtggtggcgggcacctgtagtcccagctactcaggaggctgaggcaggaggatggcatgaacccaggaggtggagcttgcagtgaggtgagatcgtgccactgcactccagcctgggcgacagactgagactccatctcaaaaaaaaaaaaaaagaaaaacagaacttatttaagtagcccgttgttatttcgctattaatggaattattaaaaataatttataataaaacaacttggtaggtatatattcagataactttgcttgcatattacagtccaagggtttatccttaggaaaactaagaaaggaaatctgattcattatttataacttgtaagacagtagaagtataaccgagaatgtcatattatagtcatggcatatggtaggagccataaaacctcacattactcatcgaaacttgttcagttaaaagaagtgaatttggtgtgagattactataaatcctgtgactaacgtagtgatgatgatgctttgttaaatgaatccataagaagatactcagaagctttcatgctgatccatagtaatatgggatatgtatattttatctcttgatgccataatctgtaattaaattcttctattgctggtgccatcgttggtttacattgttggtttaaatttatgtaaaataaatttagcatctggattccttagctgattctctatgctggtgtttattgttctgcaagtagttcagaactcagaggtgctggcttgtttgttttatcatatccgaaaaatgtgttcttttgcatttggaaatgaagctactgacctcctgagttcagggcatgggctgaggtattttcttccattatgatgccaagttgagcgtttgagtagtggctggtggattagggtgcatgctttgtaatctctgtagctttaattgatgtgtatgaagatcaaactttttggtgacgtttagtctaatttggtgacatttcgtctaatggccccaaatactttcaaacattgagctttgtggcttaaaaaagaatatatatatatatgtgtgtgtgtgtgtatatatatgtatatatgtgtgtgtgtgtatatgtgtatatatgtgtgtgtatgtgtgtacacacacacacatacacacacatatacattttttgttttttcttcaactcttaagtcctggggtacatgtgcagtatgtgcaggtttgttgcatatgtaaacatgtgccgtggtggtttgctgcacagatcaacccatcacctatgtattaagtcttgcatgcattaactgttgttcctgaggctctccctcccaccactgtacttataggccctagtatgtgttgttcttctccctgtgtccatgtgttctccttgttcagctctcacttacaagtaagaacatgtggtgtttggttttctgttcctgcattagtttgctgataacagcttccagctccatccatgtccctgcaaaagacatgatctcattcctttttatggctgcatagtattctatggtgtatatgtaccacgttttctttatccagtctatcattgatgggcatttgggttgattccaggtctttgctattgtgataaatgctgcagaaaacatacatgtgcacgtatctttatagtagaatgattgctgttcctctgagtatatacacagtaatgagattgctgagtcaaatggtattctggttctagatctttgaggaatcgccacactgtcttctgcaatggttgaactacttacactctcactaacagtgtaaaagcatttctttttatttgcaacctcaccagcatctgttgtttcttgactttttaataattgccattctgactggcatgagatgtatcttgttgtggttttgatttgcatttctctggtgatcaatgatgttgagctttttttcatgtttgttggctgcatgaatgtcttcttttgagaagtgtctgtttgtgtcctttgctcacttttaatttttttttcttttaaatttgtttaagttccttgtagactctggatattagacctttgtcagatggatagattgcaaaaattttcttccattctgtaggttgtctgttcactctgttgatagtttcaaaaaagaatatgttttccttaagtgcctgctggtggataggaaaactcaagtgagaatgaccttttcctcaatcatttatgaaaccagtgggaagcaatttaattactaccctcttttaatgaacctgaacgtaaggtcatagtatgtggtagggcagggcctggtgggggggctccattttactttttagaaggtgtatttcattggttgccaagacttctgacctattattttgtgagctggttatgtgaacggctgatgttgaaatcttgacctggggcctctccttgtttgaaaatattcttgaaacatcattgctgtaaatttgagagagtgaatttctcctgaataggatattttgctctatctgctttaagagagagttttaaatgatttccatcaaataataaagccccttgatgatctagcagaggttgcaaattgatgggagggaaaactctctaaagtgaggtcaaagaatttccttttagggttgagtgtgcaactgatactgatattagagatgtatctaagtgtgattggcacagttacatggctttcagggtcaatgttcagtaacccaggtagaagtggttgaattgatccaggtcagagagataaggaagcaagaagttgagggtatttgtgctaataatatctgaagtcgtgaggttgaggcaaagaaataaagctagaaaggacctgatatattgagagaagacaagagattcagctactgaaatactccattcaccatttcattacgtatcttgtcaatttttgttgatacttcttttcaccaacatgttgtctcactgttctattcaaagcattttggttaataatgtgatttaaggaagaaatctgtattcattatgctgaactcacaccaactctctgaaaaacatgaaaaaagcatttactgttggtgaagttgaaatctcatttccttcctgtctactggttattgtttcttatttgcatatcactccaggctaatgaggaaaaaaatacattttattaagatcagaacaaatcaagcaaggtcgattcctgaatatttatgaaacacagcagtaaatgaataaagcaaagcatgaatcaagtttgttgttctatcttggattttgtgaagtggaaaaggaaagtccaggactcgtggtaaacagtggtgtattcatgctaacaacttagatggtaacacagtgtttatccatcaaaaagcaaaggttataataaaaggaaaattaaacattgaagatcaatgtacttagaaaaaacaagtcataatgtaacatatgcatactttggaaaatttgggaaactgtaaaaaggaaaacctagtcatcactagtcacactactcagctgtaaccacaggtaatattttgagtataccagattttgtttttccatgtacatattattttccttttattaagtgttagggattatttttagtaggtttcagctattcctgtcacttgaaaagatgaggcagacacgattttacccatggttaacagtacagcatggtctctttttgagagaaatcttataaaaggtggagttctagaatagattatagttaatcatttgtttttatgagtatttttgatagaactatgtatgtaaatatgaggtgtttatggaaacacagaggacctagaatcaccaagatacttttgttttcatttctttatttttaatttttagacttggggggtttgttacgtggatatactgtgtagtggtgaggttttggcttctagtgtacccagcagccatgtagtggacactgtacccaatagataattttttaagccctcactgcccctgcctcaacttggagacccccagtgtctatcgttgccattgttatgtccatgtgtacttactgtttagttcccacttgtaagtgagaacatgcggtatttgattttctgtttctgagttatttcacttaggataatggcctccagttgtattcatgttgctgcaaaggacattagtccgttctttttagtggctgcatagtattccataatgtatgtaccacattttttttttctattcagtcatccattgatggacacttaggttgattctatgattttgctgttgtgaatagttctgcaataaactatgaatgcaggtatctttttgataaaatgatttcttttcctttgggtaaatgcccagtagtgggattgctggatcatatggcagttctatttttagctctttgagaaatttctatactgttttccaaaggggttgtactaatttgcattcctgccaacagtgtatgagcattcccttttctctgcatccttcaatatctgctgttttttttatctttttaataatagccattctgactatttaaaaattatagctcattgtggttttaatttgcatttctctggtgattagtaacgatgagcattttttcatgtttgtttaccacttgtatatcttcttttaagaaatggccaagacagttttgaaaaaagatgacagttttgaggacttacgttactgaatatggccgtagccaaaggatggacataaagatcaatggaacagaatagaaagtctagaaatgagcctacatatttatggccaattggtttttgacaaaggtatcaaggtattgcaatggagaaaggataatcttttcaacaaatggtgctaggacaataggatatccatgtgcagaacattgagtcttcaatccttccctcacaccatgtgtacaaaaattatttcaatttttttttttgagacggagtcttgctctgtctcccaggctggagtgcggcagcatgatctcggctcattgcaacctctgccccctaggttcaaacaattcttgtgcctcagcctcctgagtagctgggattacaggtgcatgccatccacctggcaaatttttatatttttagtaggggcaggttggccaggctcatctcaaacttctgacttcaagtgatctgcctgccttggcctcccaaagtgctggggttacaggtgtgagccaccacgcccggccaaaaattatttcaaaattgatcatagacctaaatgtaagacaatgtcttagatataacaccgaaagcatggcccataaaggaaaacattaataaaacagacttttggagcttggtgcaatggctcacacctgtaatcccagcaactcaggggctggggtgggaggattgcttgaggacaggagtttgaggccagcctgggtaacagagtgagactctgtctctacaaacaaaacaaaacattacctgggtgtggtgacatgtttctgtagtctcaattactcaggaggctgaggcaagaagctcacttgagcccaggagtttgaggctgcagtgagccatgattgtgctattacacaccagcctgggtgacagggtgagatcctgtctctaaaaaatttttttttaaatagacaatcaaaactaaaaactgcttttcaaaagacgtcataaaaaaatgaaaaggcaagccacagttagaaacttttgctctaaaaagcaaaaagaggatgaaaagacgagctacagactggaagaaaatgtttgtaatccatacgtccaaaaatagacagtatctagaatatataaagaactctcaaaactcagtaataaaacaatccaatttgaaaatgggcaaagacatgagcagactttacagacatttcagtgagtaggatatacagatggcaaataagacacgaaaagatgttcatatctttacccattagggaaatgcacattaaaaccacagtgaaatatcactgcacacctatcagaatggctagaataaaaatagcgagaataccacatactgctgagaaatcagaaatcctggatcactgatgtatttctggagtaatgtaaaatagtacagccaccttggaatccagtttggcactttcctgtaaagctaaaaatgtactaactacacaactcggcaattgcactattgagtatttgttccagagaaatgaaaacttattttcatacatgaacctgcacgaaagtgttcatagcagctttattcagaatagaaaaataatggaaaccaccaaagtattctttaatgagtggataaacaactgtgatacatccataccatggaatactatgtaacaatgagaaggaatgagctgttgatacatgcagcaacttggatggatctccagggaattatgtggattgaaaaaaagccaatataaaaaggttaaatactatatgattctgttaacataacacttttgaagtaacaaaattatagagatggagaacagatagtggttgccaggggtatggaatgggggagggtctggctataaaggggtagcaggaggaggcaggagatttgtggtgatggagcagttcagtatcttgattgtggccatggttacatgattctaactaaacatgttatcagattgcactgaagagatgcttaatatcactaatcattaggaaaatgcaaaccaaaattgtagtgagatacttcttcacacccattataatggcaattatttagaaagttagggaagttagggaaataaaaagtgttggtgaggatgtggggaaattggaactcacgtgcattggctggggggaatgtgaaatggtgtaactgctatggaaaatagtatgatgtttcctcaaaaattagaaatagctgctatatgatttagcagtttcacttctggatatatactccacttctggatatatagtctgaatggaaagcagggattcaaatagatatttgtacactcatgttcatagcagcattattcactttagacaaaggtaaaaacaacccaaatgtccattgatggatggatggataaacaaaatgtggtatatacatatgatggaatattatttagccttaaaaaggaaggaaattctgacctatgctgaggtatgaacgaaccttgaggacatgatgcaaagtgaaatcaaccagtcacaaatgcacaaatattgtatgattctacttacatgaggtacctacattaggcaaattcatagagacaggaagtagaatggtggttgctaggggctgggaggagagaggaatgggtatagactttggcaagatgaacagagttctggggatggatggtggtgatgtctgtacagcagtgtaaatgtacttaatgccactgaactgtacacttaaaatagtttaacagcttaattttaagagtattttaccacaataaaaattgcatagatctacacacatgagtacacacacggcacacacatatacacacttgggagcggggaacgggagtgagtgcatttgaagctagtgaaatctgaatgaagtttgtagatgtaccaatgcagttttctggtttgatattttactgtagttaagcagggtgttctcactgggagaagctgggcgaaatgtacataggaccttgctgcattttttgttacttcctgtgaatgaatgtatagtcatttcaaaataacacaaataacacattttttttgtttatttttgagacaagccacaaattttcctggtatacaggaaacagaaaaaactaactgcagttattgggaaagtttaccaattgttgggagagtttatcattttgtcagcgtcctcacctgtgtgtgtgtgtgtataaaaattaattgcaccttttaagttttttttaaggtaagggtccactttttgaaatttatcatcaatcattttgactcctggtcattaatccccccaagtaaataaataaatttctgaatggtagctttatcttaacagatttgatttgggtgttttaggaaaagcatcattcatactttgctttttatcttgctctgcagtgattctattttgttttatacatcatctggtaaacattagtgagaaagtttggcgagaatacagacatatgtgttcaactagatttaaaaacgttcttggcaactcgataccaagaggtcagcagggaggagtggctgggcaggggttacttctgtggataaagggaaggaaaagaagctgacactgattgtcaacatttatggaaacctgttctgcaactactgttgtacttttatacgtgccttatttagggggattaagtgttctttacaagggaaaattgaagcctggaaacactgagtacctttcccaaggttagacagctggtgaatgcccaagttaggatccagacttattttggagaggcatcaaagtatggaaccatgagttcctggggtcaaatttaggaagacgccaattttactacctttgttgatctttagctctggatggccatggtttataagcaggaagtgtttacaacacatgcttgtatggaccaatcttaaaggtgaatattcaacactatttctgagagtgaatagctgttgatttgatatatatccaacaaatatttattgagtttttaattatcccaggcaatgttttagggactgaggatatagtagtggacaaaacagatcaaaatcaaggaaaacaagtaaaatatatgttaagatagtgataaggtctattggaaaacctttagaagggaaggctgtaggatgtagtgcagtgggttgatatttcatcagggagagcctcacagggtgggtgacactgggccacctggaggcagtgaggcttgtggagcagttggggaagggcattcccgatagagggaatagtgagtctccaagccccagattggaatgtgcctggtgtggcacagaacagcagaggccaatgagtctgggcagagttgctggtggggagaggggtggtcaggagtgaggtcagagggatgtaggggccataccaagaagggctttgtaggccattgttaggacttttgcttttactttgcgagatgggaagtggctagagggttttgagcagaggagtgctgtcatctgacttaattttgaaaggatcactcaaggggtttgctgagaagagatggaagggggccagcaggggagcagggaggcaggttcaaagccatcacagtaatgcaggcaggagattatagagacctgggtctagggttagtggtggaggtggggagaagtggtcgaaatcggattttactttccaggctgagcccacaggaagtgctgatggattagctatgaggtatgagaggaagagaggattgagaaggactgcaagttgtttggtctaagtagggaaagagatgaagttgtgaatgctgtgtgttgagatggggaagagtgtggcagggcagattaggggctcagttacggattaagtatgagagtgctaaggggaaatgtgtgttgcctatgtgcaaatcatcatggtagcacttttgagcagacagaagtgtaaaatactctccaggaatgtgctctccagaaactcactgataagtaaggggggataaagtatgcacagacttacaaagtacacgacgtttatggatgataaaccattcattcattctcaccattgagaccaaagctgcttcagcacttcagatgcagaatgatggccatgggcacagcagtttaggattaggtgaactgtgatgagcagttggtgcttttccttgattttgaagcgcctgtagggcttggcaggttggagcgctaggaggccagtgtctctggagtggtgcaaggtacagagcaaggtacagagctagtgcaaggtacacaataaattgtgttgacaacgtgaggttcgagttggagatcagcggaggttaaggttggaagtacatcctgcttgaggaaggctctgggtgctggctaaggaagttggccttcattttgtggataattggccatgattgaaaggggttgatttgggtagttgacctgattgaactactgccttgggaagtttgatcattccctcaggtttcttagaagtaggcctctttggtgtataatcatgcttattctctgggcagctttgacatggctgactgctgtcttccagataccctcgcccctttcggctccctggacgctactcgtttctgacgcacctcccatgtctctgaccacagctgccccatcattgactcaggagatacttagtgagagtctgctctgtggcagccctcatgctgggcacagcgggtgaggcaggcagggtctagtggagagcagacattccataaatggtcacacacaccactgcatggttttgggtttcctaagccctgggaagggaaactacagagaacttaaataagggctttgaagctgaggaagaggcttgtaagctgagctctggacttcagtgggccaaagggagggaggaagagcattctggaccttgcaggcatgtgccaaggtgggatgaccttcatgcactcgggcaagagcaaaggcccatatggctgcacatgtgaggagggtcccttgaggtctgctttaggacctttttcttctcccatgccactccctggggctatcatctcttcccttgatctcagctatcctctgggcagttagtttctcttcttacctccttcatgacatctagactgcctctctgttacctctgcctggaagtcccaaaggcatggttaacttcctctgtcctaaactctaagaagtatcttcccactttgccatttctactttccttcaagcttttctccttgtctcagacaccttttctacctgctgttggccatccagtcgcatagctctagtaccactcttctgtgaaacctttcctacctgtttattcctgcctgtctccctggcagaacagtttaatcctgggaccctataaaacactgttcattcctctctgtccattatttgtttgaactgttgactattgtatatttgtctgagttcttaatggattgaatgcttctgaaccatgtattgctggggctttgcatgatatttgggtctcagagttttactaaatagcattttatgaatacagtaaaaatagctattgaaacactggtaaaaatgttttaaataggacagtgaaagtagagagaacagaaagagtgatgcctcatacagaatgagaatatatcagatggagaagaccccatctatctggttttcctcttggcatctttttttttttttttttgatagatggagtttcgctcttgttgcccaggctggagtgcaatggcattatcttggctcaccgcaaactttgcctcctgggttcaagcgattctcctgcctcagcctcctgagtagctgggattacaggcatgggccaccacacccagctaatttttgtatttttagtagagacggggtttctccatgttggtcaggctggtctcgaactcctgacctcaggtgatccgcctgcctcagcctcccaaagtgctgggattacaggcatgagacaccgcgctcggctcctcttggcatcttaatcaagggatgctgttgattattattctgcctgcaaaccccatattgatcttgtaaaatctgaaaaacaagagatatttcgagagagagaattggtcccttgagatattgcaagcaacctttgggttgcatcctttacatttagaattgcattgtcaagtgtccagggcaaagggtaagggacaacccaaatcatttggaaagattaaaggataagaaataaaattgtatgctagcatgaaccatcccctccacccctctcccaggaaaagtgtaattgatattgaagttccgacaaccaagtatctacttggaagtaattagcatttaccgagggtgcttcatagaatccatttgttttaatttctttttaattccttgtgatgatggtggtgacaggttcattgttcatttgttctcagctgttccctggaggtgtagctcttcacctgctcctggttctgtgtggcaggcttcagaaaaaaaagaaaggatctcatgttggttccattgaaggggaaaaaaagttggaggcatttcgggttcacttacttgcaaagatgaattaagataagcattgcctaccccagagtaattaaactcatttccacagtagcattttctcttctgtgctcgtgtcacgcttgcaggtacatgttcattatttcagactttctaattatagcagtcatcacagactttggtgagctaccttgtcattaggtaataactctctgtgtcgttgggcttgcatctgaagttgtgatgaaggggaagtgtgcactgagcatgggtgtgtctctttttcaaggattccacgtgttcccttggtttctgtatctcttgcaaacacttatagagtggtgctttatgacgcatgctgaaatatgcatttcaaaagaagagggatttttttttcctcttagaaggtagccatgcctggggaaacatggacaaaacactaaactctgagatgctctaattttgtgattctaagtgattccataataatcaatagcaataagggtaagagtccctaagagtagcaattagagacccaggcatgacccccataagctcccacttagtgtatgcatgtgttttctgctcttaagtggagtttgggcatgagagggcagatctgttccactgtaatgcaggtgtgtgaggctgaggtgaggggatgcaggatgtggggtgccccagtgatactcggttaaggtcttggctacatttgtccacacctgcattccagtgtttgttttggagggcatagcaagaaagtttctatgcaacatagcaactttttattagactgtaaagtgcagtgttgtccctggaacatccttattttggcagtgtagcttcacttgtgatggtttgtactccatgatcacagaactgcatgagttattagagctctcagtgattacatcataattctataagatggctcggaagggaccttactgaaacatctagacaagtatgtttcaaacaccagtgatttgagtgttattatagccatgctttttgctgtatataagaactaccattattagttacgtctctctggattctatcctgtttggcttagcctcatctgaagcatactgtttggatttgataatgttgcagctaggactctggagccagactacctgggttcaaatcctggctctacatcttcctggtgtggcaactgggagcacgtcactacatttctttgtgtctctgtttccctgggtgcaaaatggagacaataataatctctgtctcctagcgtttttatgagaattaaatgaaaaaagtaaaatatttacagtagtgcctagcacatagtaagtgctcacagaatgctagtcttcttagttatatatttttatatatagaaatatgcataaaaccattgaaataaaaagttactttcatgctacttacaattagattttattagtgggatatttttatgctacctaaaattagattacattttattaatggagtatgtatttttctgtgagaagcattgatcctgtcatctagtctcatggctttttggtgtttaattgttgcctacattgccctagaccgaggcctccagggattccacttcatttgagccagctgtgtctgttagaatagcttttcatggggcaagctccatggcttccttccatccattgcattttaccctttgacatcagagaccaactctaatctctcttctccattacagccctttgcataattgaagaaagctgtcatgtttcccagagtctcctcttcatcagccctacaaagtgtcagttttcccctctggacgagcccctgcctgccttgcttgtataagtcagccctttgcagggaacgaagctatgggagaagagatttgtctgaggacatgtgggatacgttttgcttgtactaattagtgctcgtaaatgctatgagcacctggaagctggaagcagccaatgtcttctcagatgcaaaagttgcaggtggaaccagtggatccagccagtatccctgtaaagagccagaaacggtaatttaaagaaggcttggaaaactggtgcttgtggttgcctcttgaaagggaactgggtggcaggtgaaacttacttttcaccatctactcttttatgtttcacattttacaccatacaatgtattgcctattcaaaaaatcatacacacacatattgaaaaaaggcagaatcgtaggccgttgaactgaaaggcattaaaaaatagtatgagggaggagctttgtaaatgttaagttcctaagggaacaaaaagataataggggcaatgtgctgaaaggagaagatgaaataaataagaataacaacaggctgggcacggtggctcatgcctgtaatcccagcactttgggaggccgaggtgggcggatcttgagatcaggaggtggagactaccctgaccaacatggtgaaatcccatctgtactaaaaatacaaaaattagctggttgtgctggtgcgtgcctgtaatcccagctactcaggaggctgaggcaggagagtcgcttgaaccagggagtcggaggttgcagtgagccgagatcacgccactgcacagagactctgtctcaaaaaaaaaaaaaaaaaaaaaaaagaataacaacaaaggacaaaaccttatctctaggcttttcccttccctgatatactctatttggtctagcttctcccctaagatccggctcagctgctattttccccgggaagccctccttaaccctctaaccccttcaccagcctggctctagggcttcccttcctgtttctcagcaactcccacagccttctaggcttgtaagagtctacttaatacagataccattattcatttacttctcagcctttttcactccatattcctggactccttgagggatggactgtctccttagtatttatataccctgtgttatgtcagtgagatgcccggcatagtgaatgcgtgggatgtatctgtactgaatgatcacatgtgtgcgggtggcgcttggggctatgggtgaggtataggaaggcttcctggggcagctggtgctggagccatcctgaggtcttggtaagcatttgccaggctgagaagaaagagacaaccccctgggcaaggtgaacagcaagttcaagggcacagaggcatgactgaggttatccttttagaacaacccattctaaaagaaaaatgttttaacccaaaacacacctaacattttatagcaagacatacctaatatttacccacattattaaaaaaatttgtgctattttgctttttaatttttacttcagattgaagatgactctgggttcattgagtgcattttgaatcacctggtggggttggatgagaggttatctggattgggcattttttccttcttgacacttctctttctctccttctcattcttctctttcccttatctcctgatttctgtaagaatctactatgtaaaacacattgcccagcatgtgggggaccttggtgaagagcttatggccttgcaatgaacctcaggtacaagactctaaaacaaggcagaaagtgatgcaagccacaggagaaaacctgttggtgtctatgagagttcacaggaaggaggacttctttccaatgcagagaagaccaaagaagtcttcatggtgggaatgatttttttttagcatgtggaatttagatgtgaggagtcttggggtggtaggcattcattggggagaaaacagcagaagcaaatgtctgcagacaggatggccttccacatggttggagaggaggagcagcaagaaataaccttggagggttcattttcaggtgtatatggaggttcttactgcaagtggagaagtttggactttcttctttaggtagacgggagccagtgagatttttgagcatgcagttgatgtatcagagctgtaggcagagtcaggtgtcctagccagacagaaaaaccagcttgaaaagctatttattaagccagctgggaagaggtattcatgtagggaaagaaaaccaacaaaatcagaagggaaagtagttctggcacatggtgctttgacgagatcattaaggattcattctgtctccagtttaatacagaaagtggcacagggcaaacatagacgggaagtggccaaggaaacaataagaatgatgtgatcttttcctgagtgccgaaggtaaagccattggtcaactgatgtgatttgtggttagaagaatcttggagctgccaggcacaggctatattattggttcgttatgtacgtttctattgggattggaatgtctagtaattatcctaaggtttcatcatgagtaattctgaaactttctgaaatataggaacagaagcatcccatgaagatactgtgctttgctggttccctggaggagctgggattttagcaacatcagaagcaacattgagataccctccacgtggtttttaaagctacagctgactaaatgagaagacaggttaaacagacattccatatgaatagaacatgattataattattcttatccttgagttgtgagtcttggtttctgtcatgtgcagatttgcaaatttttatgactcaaagaaatatgttgtaaagctaggcaccagatcgacattgttttggttttgctaaagatttgagattttgcatgtacagcaagtaagtcacactttgttttatagtgatgggcaaaaggcacatagagtgagtttgttgttgagaacttagagttgtatcattttgctcttcagggtctgccaggctatcccacgctgtttaacttccctcttcatctctttttctgctatggactgaattgtgtacccactccaccttcaccctacaattcatatattgaagttccagctcctaacatgatggtattggagatgaggcctttgggaagtaagtaggtttagatgaggtcacatgagggtggggcctctgggatgggattaatgtccttataagaagaaggagagttggtgggggggggggagagagagagagagggggggggggagggagggagggagggagagagagagagagagagagtgagagtgagagagagagagagaacagagctcactgtctctgctatgtggggacacagcaagaggttgaccatctgcaagccgggaagggggtaccctcaccacaaacaaaatctactggcaccttgatcttggacttccatcctcaagaactgagaaaataaatttctgttgtttgagccagccagtctgtccactccgtggtgttttgctgtggcagcccaagctgaccaatacagtgctaccatgtgcaaaacttaggacaactgagggtttaaggtcatgtgtttattacatagaaatgctataccattccttagactgtattatgtaatgcattttggcatataaatgtctgatagagacaggccaagatgaaaaactggggtgggtttgtgtgacaaattttggtaaagggtagggcatactttgcttaagaatcagtaaaatctttgcagccagggaaaatgtatgctctaagtatggactcttggagccttttgtgtgttttactagcttcatgtagaaatatagaagttcttggatgtatagtcagattaatgaattggctaatttatgattaatatcaattttggggaccacagtagcaataaaagaagtacgtaagatgaaacagtttaaaacagaaaaaggattaaagaatgtatttcgaagatctcgaaatccatctgtcagttttagctcttctaaaaatcatttgttcacagtggctgaaggccagcctcatatatgccaggttatatttagaaaaacaaaaggggaaggggaagctcgtatctatttgtggaagtagtcccagctatgtttttatacctcccagatccgaaatacagtgggactcccttagaatgcagtttcatgggcctctgagacagcatccctcttggaagagagcatgtcctctaagcattttattgtactaggctgatatagtggcagtatttcatgggttttacttgacttgtttttcatgctaatttgtgtaataatgaactgtgcttgtgatggacttttaggatgtagaaaactattttgaggagttctgtaagtcaaaaaaattatagttgagtattgtgaatttggaaccacataactccccaatattaattcagacaattagagagttacattcattcttttagattaaatagtattattagatagtgtgtatctaccaggcatagttcaagcagtggggagatttagtatataatctttggaaaacttgtgcccttaaaatatggttgaccgtctgtaggtccatgaagatgagtattaagttcttgggaaatcacaataactgagttgttcattgtacacacatctgcaccagtgccatggaaactgcagagaagcagtagccctccactgttggatatggtagccactagcaccagtgggaatttaaatgtaaatgaattaacgttaaatacaatgcagaattccatttcttagttgcacagccacatttcacatactcatttgccaaaacagctagtggtaattctgtgagatggtgcagatgtaggatatttccaccggctcaggaagttctattggataatgtggtgtgggaacatttttttctgcccctgattaattttaaatctattttaaatctggaatagaaagatgtgcagaaggagaggataaaagaaaacataattaacatttttatcggcagtgtctctgggcagcatgtgattgattattggagtaattgtatagataataaataatacaagatgttagactgagatgattagggaagagttgtaacttttactggattttcaaataaccagtgggattccaacagcagtgatgaagtgggaggcactctataatcaatgtgcaaaaatcacaagcattcttatacaccaataacagacaaacagagagccaaatcatgagtgaactcccattcacaattgcttcaaagagaataaaatacctacgaatccaacttacaagggacgtgaaggacctcttcaaggagaactacaaaccactgctcaatgaaataaaagaggatacaaacaaatggaagaacattccatgctcatgggtaggaagaatcaatattgtgaaaatggccctactgtccaaagtaatttatagattcaatgccatccccatcaagctaccaatgactttcttcacagaattggaaaaaactactttaaagttcatatggaaccaaaaaagagccctcattgccaagtcaatcctaagccaaaagaacaaagctggtggcgtcacgctacctgacttcaaactatactacaaggctacagtaaccaaaacagcatggtactggtaccaaaacagagatatagaccaatggaacagaacacagccctcagaaataatgctgcatatctacaaccatctgatctttgacaaacctgacaaaaacaagaaatggagaaaggattccctatttaataaatggtgctgggaagactggctagccttatgtagaaagctgaaactggatcccttccttacaccttatacaaaaattaattcaagatggatttaagacttacatgttagacctgaaaccataaaaaccctagaagaaaacctaggcattaccattcgggacataggcatgggcaaggacttcatgtctaaaacaccaaaagcaatggcaacaaaagccaaaattgacaaatgggatctaatgaaagtaaagagcttctgcacagcaaaagaaactaccatcagagtgaacaggcaacctgcagaataggagaaaatttttgcaatctactcatctgacaaagggctaatatccagaatctacaatgaactcaaacaaatttacaagaaaaaaacaatcccatcaacaagtgggtgaaggatatgaacacatgcttctcaaaagaagacatttatgcagccaaaaaacacatgaaaaaatgctcatcatcactggccatcagagaaatgcaaatcaaaaccacaatgagataccagctcacaccagttagaatggcagtcattaaaaagtcaggaaacagcaggtgctggagaggatgtggagaaataggaacacatttacactgttggtgggacgtaaactagttcaaccattgtggaagtcagtgtggcgattcctcagggatctagaactagaaataccatttgacccagccatcccattactgggtatatacccaaaggactataaatcatgctgctataaagacacacacacacacatgtatgtttactgtggcactattcacaatagcaaagacttggaaccaacccaaatgtccaacaatgatagactggattaagaaaatgtggcacatatacaccatggaatgctatgcagccataaaaaatgatgagttcatgtcctttgtagggacatggatgaagctggaaaccatcgttctcagcatactatcacaaggacaaaaaaccaaacaccgcatgttctcactcataggtgggaattgaacaatgagaacatggacacaagaaggggaacatcacccactggggcctgttgtgaggtggagggaggggggagggatggcattaggagatatacctaatgttaaatgacgagttaatgggtgcagcacaccaacacggcacatgtatacatatgtgactaacctgcacattgtgcacatggaccctaaaacttaaagtataaaaaaaaagaacaggttgaagttttgtttggggggctggggagtgggcagtataagatgtgtttgatgcaggaacagctgtataatttggaggacccagtacaaaataaaaatacggggtttcctgttaaaaaattcgtaggtatttgtagtccatgacagaagagctttaaaccaagcacagaacccttccaaatcatggggtagcatggcatggtttaaaggctggtgagtgagccaaattggctaggttctgatgagttctgaaggtgagtagtaagagatacatggccaaaaacactatcacaacctaaaaacctttcttgtctcagcttcaccatatcagagcatggtatgttcctcgtgggttgttgtttggggccagagccctgctctttccacagtggtttgtctttccatcctgaacatcacaccgaagatagcattatttttctgaatccattgtaaagcaagagtacatgatgaactaccgtatccctgctgattgtgaacattatctcttcaaataaaataaatgatgtggtttagaaagtaccatctgagtgccacactagctgggggcttggcattcattagtttgttagctgacaattacaccagaactttctctttcattttgaatgtctcaatgggaatcattactgcaaataaaaaagcaaaatagaaatcattgtggagacattaatatttttattttagacatacttagcaaataatatcatgtaatgggctgcgaatttttggcatttaaatgctgatttcacatgagctatgatgtgtggatcatctttagttaaatgtgtgattgaactgtgcatagtgtttgcctgccatatgggtgcttaaggaaaataaaataacacaaagactcgatgaagatgcgtaccttttatttggcaaataattcaaattccctttcctcccaccttttttcagtgtctaccacaaaccacgctggcttggcaaggaggatgtctcagtttttcttcttcaggcaataaatacatttacccttgacattatttagttttctgttttgaggtaattgtagattcacatgcagttgcaagaaataatagagatctcacgtaccgttttcctcaataataatatcttgtaaaacaatagtaaaatatcacaatgttaaatcaagtttagcctgaaactgcctccttacatattttaagttcagccaaaagatttctctgtatatcgtgaactgtaacctaaatgaacttgtaaacagagtgtagccaactcttgtgccaatcaccaaattttggccaaaggtggccagctgttcaaataaggcaaatgcgaagctgtaagaaatcgagctgtttctttttctttttttttgagacatagtctcactctgtcgcccaggctggagtgcagtggcgtgatctcggctcattgcaagctccgcctcccaggttcacgccattctcctgcctcagcctcctgagtagctgggactacaggcgcccaccaccacgcctggctaatttttttgaatttttagtagagacggggtttcaccctgttagccaggatggtcccgatctcctgatcttgtgatctgcccgtctcggcctcccaaagtgctgggattacaggtgtgagccaccatgcccagcacaatccagctgtttttatatctgacttccattttctctctgtcactttcttttttctgtccataaatcgtcttctaccacatggctgcactggagtctctgaacctgctaacgttttggaggctgcccgattcatgaattgttctttgctcaattaaacttttttaaattttattttattttactttttttgagatggagtaaaaaagtactccatcacccaggctggagtgcaacggcaggatctcgactcactgcaacctctgcctccagggtacaatccattctcctgcctcagcctcccaagtagctgggattacaggcatgcaccaccatgcctgactaatttttatatttttagtagagacggggtttcaccatgtcggccaggttggcctcgaactcctaacctcaagtgatttgctcacctcagcctcccaaagtgctagaattacaggcgtgagccattgcgtgcagccccagttaaactcttttggctaaagtttttcttttaacaacgattacaatattggcattgatacaatccacttaccttgttcagattctcccaccagttttacctgtagctgtgtgtgtgtgtgtatgtgtgtgtgttccatgcagtctaatcagtgtgggttcatgtatcactaccacaggcgagattctgaattccttcaccaccaggatccctcatgttgcccttttataaccacagacactgttcccccaacctgctctctgccatcatccttaatcccttgcaactgctgatctgttctccatttttataatcttgtcatttgaagacaaaataaatgtaacaatacagtgtgtaaccattaagattgactttttcccctcagaataatttctgaacattattccaagttgttgtatcaatagtttgttccctttgactgctgagtagtagtaatgatatagaggtaccacagtccatctaaaggacatctaggtggtttctcgttctaggctgtcacaaataaagctgttacgaacatacattgtattagttgactaggctggcataacaaagcactacaaactaggttagacaacagacatttaggagttcagcatatgaatctggagtgtgagactcaattcagcgcttaacattcatgtgcaggttttcctgtgaatatcacttttcatttctctggagtaaatgcctaagactgcagtttctcagtagtattgtgattgcatgtctaggcttttaaaaaagtgccaagctgtgttagagaggctgtaccagtttacattcccacagtacaagtgaacctgtttctccacatcctcagcagcatttggtggtgttgctatttcctatttttgccattttgataaatggtatcttattgtgattttgatttgcatttcccaaatgaagaatgatgttgagcatcttttcttgtgcttattgcatctaaatatcctctttggagaagagtctattcatgtcttttgctcattaaaaaaaaattttttaagtcttgacttttgagagttctttatatattctggatagtaattcattttcaaatatgtggtttgcaaagattttctcccaatgcgtagcttctctttttatccccttgacagcgtctttcactgagcaaaactttttaattttggaaaagtgcaatttaatgttttcttgtatggattatgcttttggcattaagcctaggaactctttttgtctagccttagatcccaaagattttctcctattattttttaaataaaattttcaggtctcacatgtaagtagtccatgatcctttttgagttaatttttgcaataggatataaggcttaggttgaggttctttcttatgcctattgatacacaacagctccagcactgtgtgttaggaaggctctctgtcttccatcgaattgcttttgctgttatcaaatattagttaggcatatttttgtgaatctatctctgggttctctgctgtgttccattggtctgtgtgtctatgcctctaccaataccatactattttgattactgtagcaataaagtaagtcttaatagatagagtagttcttcctattgtgttttttcccaagattattatggtagggtttgtgcctcttcatataaattttaaaataagcttgttcatctgcaaacaaacaaaaaccttgatgggattttgatggtaattgcattagattagtttgagaataattgacatctttactatgttgaatcttctatgaaaacaatatgcctttttatttagatctttgatttcttttatcagaatttaaaacttttcagcttgaagtttccgtatgtgttttgttaagtacacacttaagtatttcattttttgtggagagattataaatcttgtgttttcgattttggttaatacttgttcttataagcatatagagacatgattgatatttacatgttgatcatgtgtcctgtgaatttgctgaacttattatttccaggagattttaaaaaatagttttcttgggaaattctatgtagcaaattatatgcaaaccaggatagtttcattttttgctttctaatccaaatgtgtttctttttcttgccatattttgctggctagaatttctagtactatgttgaataaaagtggtgagagtggatcaccttaacttgctcctgatcttaggggaaacattcaggcattaagaaatgcatttcacttaaatataatgtcccctgtaggttttttgtaggtactcattcttgaacaagttaaggaagttcctctttactcctaacttgctgagagtatttgtcatgagtgggtgttggattttgtaaaaaaaaaaattttaacattaattgatacaatcttgcttctttagctaatatatatagtggattacattgattgattttcaaatgtggaaccagccttgcatacctggattaatcctagtgtgtgtaattctttttatacactgtttgactcaatttgctaatattatgtttaggattttttgtgactaacttcatgagaaatattgatctgtggactgtcttttgtattatctttgtctggtttggtcagggtaatagtggcttcttattaaatagaatgatttgggaagtgttttcttattttctgttttctggaagatattgtataaaattagtgctaattctactttaaacattggtggaattctccagtgaaatcagctgggcttggagattcctttttgggaggtttttacctgatgaattaaactcttcagtagtttatagggctgttcaaatgatttctttcatatggattgagttgtggtaatttgcggtttttgagaaattggaccatttcatctaaaattccttctatttgaagaacttcctttagccactctgtgaggataggtcttttagaaatatattattttagttgttcttcatgtgagagtgtctttatttccctctttattcctgaatgagagttttgctggataaataatttgcagttgacagttcttttctttcttattttattttattttactattattatgctttaagttttagggtacatgtgcacaatgtgcaggtttgttacatatgtatacatgtgccatgttggtgtgctgcacccagtaactcatcatttagcattaggtatatctcctaatgctatccctcccccctccccccaccccacaacaggccctggtgtgtgatgttccccttcctgtgtccatgtgttctcattgttcaattcccacctatgagtgagaacatgctgtgtttggttttttgtgcttgggatagtttgctgagaatgatggtttccagcttcatccatgtccctacaaaggacatgaactcatcattttttatggctgcatagcattccatggtgtatatgtgccacattttcttaatccagtctatcattgttggacatttgggttggttccaagtctttgctattgtgaatagtgccgcaataaacatgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccaacacctggtgtttcctgactttttaatgatcaccattctaactggtgtgagatggtatctcattgtggttttgatttgcatttctctgatagccagtgatgatgagcattttttcatgtcttttggctgcataaatgtcttcttttgagaggtgtctgtttatatccttcgcccacttgttgatggggttgtttgtttttttcttgtaaatttattggagttcattgtagattctggatattagccctttgtcagatgagtaggttgcgaaaattttctcccattctgtaggttgcctgttcactctgatggtagtttcttttgctgtgcagaagctctttagtttaattagattccatttgtcaattttgttgcccttgcttttggtgttttagacatgaagtccttgcccatgcctatgtcctgaatggtattgcctaggttttcttctggggtttttatggttttaggtctaacatgtaagtctttaatccatcttgaattaagttttgtataaggtgtaaggaagggatccagtttcagctttctacatatggctagccagttttcccagcaccatttattaaatagggaatcctttccccatttcttgtttttgtcaggtttgtcaaagatcagatggttatagatatgcagcattatttctgagggctgtgttctgttccattggtctatatctctgttttggtaccagtaccatgctgttttggttactgtagccttgtagtatagtttgaagtcaggtagcgtgatgcctccagctttgttcttttggcttaggattgacttggcaatgcgggctgttttttggttccatatgaactttaaagtagttttttccaattctgtgaagcaagtcattggtagcttgatggggatggcattgaatctataaattaccttgggcagtatggccattttcatgatattgattcttcctacccatgagcatggaatgttcttccatttgtttgtatcctcttttatttcattgagcagtggtttgtagttctccttgaagaggtccttcacgtcccttgtaagttggattcgtaggtattttattctctttgaagcaattgtgaatgggagttcactcatgatttggctctctgtttgcctgttattggtttataagaatgcttgtgatttttgtacattgattttgtatcctgagactttgctgaagttgcctatcagcttaaggagattttgggctgagaaaatggggttttctagatatacaatcatgtcatctgcaaacagagacaatttgacttcctcttttcctaattgaatgccctttatttccttctcctgcctgattgccctggccagaacttccaacactatgttgaataggagtggtgacagagggcatccctgtcttgtgcctcttttcgaagggaatgcttccggtttttgtccattcagtatgatattggctgtgggtttgtcatagatagctcttattattttgagatacatcccatcaatacctcatttattgagagtttttagcatgaaggttgttgaattttgtcaaaggccttttctgcatctattgagataatcatgtggtttttgtctttggttctgtttatatgctggattacatttattgattttcgtatgttgaaccagcctcgcatcccagggatgaagcccacttgatcatggtggataagctttttgatgtgctgctggattcagtttgccagtattttattgaggatttttgcatcaatgttcatcaaggatattggtctaaaattctctttttttgttgtgtctctgccaggctttggtatcaggatgatgctggcctcataaaatgagttagggaggattccctctttttctattgattggaatagtttcagaaggaatgctagcagctcctccttgtacctctggtagaatttggctgtgaatccatgtggtcctggactctttttggttggtaagctattgattattgccacaatttcagagcctgttattggtctattcagagatgcaacttcttcctggtttagtcttgggagggtgtatgtgtcgaggaatttatccatttcttttagtttttctagtttatttgcgtagagttgtttgtagtattctctgatggtagtttatatttctgtgggattggtggtgatatcccctttattattttttattgtgtctgtttgattcttctctgttttcttctttattagtcttgctagcggtctatcaattttgttgatcttttcaaaaatccagctcctggattcattaattttttgaagtgttttttatgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttagtttcaaagaacatctttatttctgccttcatttcgttatgtacccagtagtcattcaggagctggttgttcagtttccatatagttgagcagttttgagtgggtttcttaatcctgagttctagtttgattgcactgtggtctgagagacagtttgttataatttctgttgttttacatttgctgaggagtgctttacttccaactatgtggtcaattttgggataggtgtggtgtggtgctgaaaaaaatgtatattctgttgatttggggtggagagttctgtagatgtctattaggtctgcttggcgcagagctgaggtgatggggagaatggaaccaagttggaaaacactttgcacggtgttatccaggagaacttccccaatctagcaaggcaggccaacattcagattcaggaaatacagagaacgccacaaagatactcctcgagaagagcaactccaagacacataattgtcagattcaccaaagtagaaatgaaggaaaaaatgttaagggcagccagagagaaaggtcgggttacccacaaagggaagcccatcaggctaacagcagatctctcggcagaaaccgtacaagccagaagagagtgggggccagtattcaacattcttaaagaaaagaattttcaacccagaatttcatatccagccaaactaagcttcataagtgaaggagaaataaaatactttacagacaagcaaatgctgagagattttgtctccaccaggcctgccctaaaagagctcctgaaggaagcagtaaacatggaaaggaacaaccggtaccagccactgcaaaaacatgcagaattataaagaccattaaggctaggaagaaactgcatcaactatcgagcaaaataaccagctaacatcataatgagaggctcaaattcacacataacaatattaactttaaatgtaaatggactaaatgctccaattaaaagacagagagtggcaaattggataaagagtcaagacccatcagtgtgctgtattcaggaaacccatctcacgtgcagagacacacataggctcaaaataaagggatggaggaagatctgccaagcaaatggaaaacaaaaaaaggcaggggttgcaatcctagtctcggataaaacagactttaaaccaacaaagatcaaaagagacaaagaaggccattacataatggtaaagggatcaattcaacaaaaagagctaactatcctaaatatatatgcacccaatacaggagcacccaaattcataacgcaagtactgagtgacctacaaagagacttagactcccacacaataataatgggagactttaacaccccactgtcaacattagacagataatcgagacagaaagttgacagttcttttctttcagcacttaaaaaaccattgtgtcacttccttctggtctccatggtttcaggtgagtaatctgaattgtgtttccctgtgggccgtctgttatttatctttggctgctttcaagatttttctttgtatttagttttgagatgtttaatcgtgttgtgtcttggtgtgaattttggggggtttatcccatttggaatccactcagtttcttgattctctagatttatgtctttcaccaaatttgggatattttcagcaactatttctttctttgtttttttattatactttaagttttagggtacgtgtacacaacatgcaggttagttacatatgtatacatgtgccatgttgttgtgctgcacccagtaacttgtcatttaacattaggtatatctccaaacgctatcccttccacctcccccaaccccacaacaggccccggtgggtgatgttccccttcctgtgtccatgtgttctcattgtttaattcccacctatgagtgagaacatgcagtgtttggttttctgtccttgtgatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacatgtgcatgtgtctttatagcagtgtgatttataatcctttgggtatatacccagtaatgggatggctgggtcaaatggtatttctagttctagatccctgaggaatcaccacactgacttccacaatggttgaattcgttttagacatgagtccttgcccatgcctatgtcctgaatggtattgcctaggttttcttctagggtttttatggttttaggtctaacatgtaagtctttaatccatcttgaattaatttttgtataagatataaggaagggacccagtttcagctttctacatatggctagccagttttcccagcaccatttattaaatagggaatcctttccccatttcttgtttttgtcaggtttgtcaaagatcagatggttatagatatgcggcattgtttctgagggctgtgttctgttccattggtctatatctctgttttggtaccagtaccatgctgttttggttactgtagccttgtagtatagtttgaagtcaggtagcgtgatgcctccagctttgttcttttggcttaggattgacttggcgatgcgggcttttttttggttccatatgaactttaaagtagttttttccaattctgtgtagcaagtcattggtagcttaatgggggtggcattgaatctataaattaccttgggcagtatggccattttcacgatattgattcttcctacccatgagcatggaatgttcttccatttgtttgtatcctcttttatttcattgagcagtggtttgtagttctccttgaagaggtccttcacgtcccttgtaagttggattcgtaggtattttattctctttgaagcaattgtgaatgggagttcactcatgatttggctctctgtttaaaactctcaataaattaggtatttatgggatgtatctgaaaataataagagtcatctgtgagaaacccaccgccaatatcatactgaatcacaaaaactggaagcattccctttgaaaagtggcacaagacagggatgccctctgtcaccacttctattcaacatagtgttggaagttctggccagggcaatcaggcaggagaaggaaataaagggtattcaattaggaaaagaggaagtcaaattgtccctgtttgcagatgtcatgattgtacatctaggaaaccccatcgtctcagcccaaaatctccttaagctcataggcaacttcaggaaagtctcacgatacaaaatcagtgtgcaaaaatcacagccgttcttcagcaattgtttctttttattttttaatttttgtgggtgcatagtaagtatatatatttatgggctacattagatattttgatacaagcatgcagtgcataataatcacataacagaaaatggggtatccgttccttcaagcatttatcctttgtgttacaatccagttatactcttttatttttaaatgtgcaattaaactattactgactgtagtctgtctgttgtgctatcaaatactaggtcctactctttctatttttattttatatctattaaccactcccatttccctccatcccacccgttacccttcccagcctctggtaaccatctttctactctctatttccacaggtttaattgttttgatttttagctcccacaaataagcgagaacatgtgaagtttctctttctgtgcctaacttatttcacttaacatgatgatctccagttccatccttccattctttttttgttcttattctttttttgttcttatttttttccccaccttttaagttccagggaagatgtgtaggatgttcaggtttgttacataggtaaacgtatgccatggtggtttgccgcgtagatcaacctatcacctaggtattaagcccagcagtcattacctgttctttcttttcctgatgctcttcctccccccagccccccagcaggccccagtttgtgttgttcccctccatgtgttctcatcgttaagctctcacttataagtgaaaacatgcagtgtttggttttctgttcctgtgttagtttgctgaggataacagcttccagctccattcatgtccctgcaaaggacatgatctcatttctttttatggctgcatagtattccataatgtatatgtatcacattttctttatccagtctatcattgatgggcatttgggttgattccatgtctttgctattgtgaatagtggctgcaatgaacacacatatacatggcttttttttttttttttttttttttttttttttttttttgagatggagtcttgctctgttgtgcagactggagtacagtggcgtgatctcggctcagtgcaagctctgcctcccaggttcacaccattcttctgcctcagcctcctgaatagctgggactacaggcatctgccaccacgcctggttaattttttgtatttttagtagagacggggtttcaccgtgttatccaggatggtcttgatctcctgaccccgtgatctgcccaccttggcctcccaaagtgctgggattacaggcatgagccactgcgccctgctttttttttttttttttttttcagatggagtcctgctctgtcaccaggctggaatgcaatggcacgatcttggctcactgcaacgtccacctcctggtttcaagtgattaccctgcctcagcctcccaagtagctgggactacaggcacgtaccaccatgcccagctaattttttgtattttagtagagaccaggtttcaccatgttggccaggatgatctccatctcctgacctcgtgatccacccgcctcagcctcccgaagtgctgggattacaggcgtgagccaccttgcccggtcatatttttataatataataatatattttcctttgcgtatatacccagtaacgagattgctgggtaaaatggtatttctgcctcttagatttttgaggaattgccacactgtcttccacaatggttgaactaatctacactcccatctacagagtaaaagctttcctttttctccacaacctcagcagcatctgttgtttcttgactttttaataattgtcattctgactggtatgagatagtatctcattgtggttttgatttgtatttcgtgatgatcggtgatgttgagctttttttcatatgtttattggccatatgaatgtcttcttttgagaaacatctgttcatattctttgcccactttttaatgttttttttttttttttttgtaaatttgtttacattttttgtaggccctgggtagtagacctttgccagatagatacattgcaaaaattgtcttctattctgtaggttgtctcttcactctgatgatagtttcttttgctctgcagaagccctttagtttaattcgattccatttgtcaatttttgcttttgttgcaattgcttctggagtttttgtcatgaaatctttgcccatgcctgtgtcctcaatggtattttctaggttttcttccaggttttatttttttaatagttttgagttttacatttaagtcttcaacccatcttgagttaatttttgtatatggtgtaaggaaaggttccaatttcaaattttttgcatatggctagccagttctcccagcaccatttattaaatagggaaccctttccccattacttgtttttgccaggtttgtcgaagatcagatggctgtaggtgtacagtcttatttctgagttctctattctgttccattgatctatgtatctattcttgtagcaatatcatgctgttttggtcactgtagccttgtagtatagtttgaagtcaggtagcgtgatgcctccagctttgttgtttttgcttaggattgtcttgactatatgggctcttttttggttccacatgaattttaaaacagttttttttctaattttgtgaagaatgtcaatggtagtttaatgggaatcacattgaatctttaaattactttgggaagtatggccattttcatgatgttgattcttcctatccatgagcatggattgtttttccatttgtttgtgtcctctctgatttccttgagcagtggtttgttgttcttcttaaagaggtcctttacttcccttgttagcttagctgtattcctaggtatttttattctttttgtagcaattgtgaatgggatttcattcatgatttgtttctctgtttgcctattgttggtttattggaatgctagcgatttttgcacatttttaaaaaaaattttgttattattatactttaagttttagggtacatgtacacaatacctaatgctaaatgacgagttaatgggtgcacattgatttttgtatcctgagactttgctgaagttgcttatcagcttaagaagcttttgggctgagacgatggggttttctagatataggatgatgtcatttgcaaacaaagataatttgacttcctgtctccctgtttgaataccctttatttctttatcttgcctgattcccctggccagaacttccaacactatgttgaatagcagtggtgagagaaggcatccttgtcttgtgccagttttcaaggggaatgtttccagcttttgcccatttaatatgatattgtctgtgggtttgtcatatatggctcttattactttgaggtatgttccttcaatacctagtttattgagagtttttaacatgagggaatgttgaattttattgaagtccttttctgtgtctattgagataatcatgtagtttttgtctttagttctgtttgtgtgatttattacatttattgatttggatatgttgaaccaatcttgcgtcacggggatgaagctaacttagttgtggtgggtaagttttttgatgtgctgctggatttggtttgccagtattttattcaggatttttgcagcgatattcatcagggatattggcctgaagttttctttttcttttgtatctctgatatctagtttggtatcaggatgatgctggcctcatagaatgagttaaggaggagtccttccttttcaattgttgggaatagtttcagtagaaatggtaccagctcttctttgtacctctggtagtattcagctgtaaatccatctggtcctgggcttttttttggttggtaggctatttattactgcctcaacttcagaactcattattggtctattcagggattctgtttcttcttgattcagtcttgtgagggtgtgtgtgtctagaaatttatccatttcttctggattttctagtttatgtgcatagaggtgtttatagtattctctgatggttgtatttctgtggggtcagtggtgatatcccccttatcatttctgattgtatctattttattcttctctcttttctattagtctagctagcagtctattttattaattttttcaaataaccagctcctggatttattggtttttttgaagggttttttgtgtgtgtgtctgtatctccttcagttccactctgatcttggttatttcttgtcttctcctagctttgcggttctctagttcttttagttgtgatgttaggagtttaatttgagatgtttcagcttttcgatatgggcattcagtgctataaattttcctcttaacactgctttagctatatctcagagattctggcatgttgtctgtttgttctcattagttttgaagaacttcttgatttctgccttaatttcattatttacccaggagtcattcagaggaaggtagtttattttccatgtagttttgtggttttgagtgagtttcttaatcttgagttctattttgattgtgctgtggtctgagaaactgttatgatttcacttcttttccattttctgaggagtgttttacttctgattgtgtgatcaattttagagcaaatgtggcaatgataaggatacatattctgttgtttttgggtggagagttttgtagatatttatcaggtccacttgatctagagttgagttcaggtcctgaatatctttgttaattttctgtctcgatgatctaatattttcagttgggtgttaaagtttcccactattattgcatgggagtctaagtctccttgtaggtctctaagaacttgctttatgaatctgggtgctcctgtattaggtgcaagcacattttgggtagttagttcttcttgttgaattgaatcctttaccattatgtaatccccttcttggtcttttttatttttatttttttaatctttgcttaaagcctgctttgtcagaaactagtattgtgacccctgcttttttttgctttccatttactaggtaaatttcctccattcctttattttgagcctatgtgtgtctttgcatatgagatgggtctcttgaagacaggataccaatggggctcgactctatccagcttgccattctttgtcctttaaatggggcatttagtccatttgcatttaaggttaatattgttatgtgtgaattgaggatctcattcttttttaatggcagaacagtacttcattttgtatgtgtaccatattttctttatttattcatctgttgatggacacttaggttacttccaatcttggctattttgagcagtgctgcaagaaacataggagtgcagatagctcttcaatatactgctttcctttgttttgaatatatactaagcagtggaattggtggattgtatggtagctctatttttagtttctttgaggaaactccaaactcttctccatagaggttgtactaatttacatttcaaccaacaatgtatgagggttctctttgctccatatcctcactaggatttcttattgcctgtcttttggataaaagtcattttacctggggtgaggtaatatctcattgtaattttgatttgcatttctctgatgatcagtgatgctgagcaccttttcacaagcctgtttgttgtttgtaagtcttcttttgaaaaatgttgattcaggtcttttgcccattttaaaatcagattattagattttttcctatacagttgtttgagctccttatatattctggttattaatcccttttcagatgggtggtttacacatatttttctccgattttgtgggttctctcttcattttgttgtgttttgtttgctgtacagaagctttttaacttgatatgatctcatttgtccattttgctttggatgcctgtccttgtgggttattactcaagaaattttgcccaggccaatgtcctggagcatttcccatatgttttcttgtagtagttttatagtttgaggtcttagatttctaagtctttaatctatttttatgtgatttttgtatatgacagaagataggggtttagtttcattctcctgtgtatggatatccagttttcccagcaccatttattgaaaaaaaacttttttcccccattgtatgtttctgacacctttgtgaaaatgagttcgctgtaggtgtttgggttgtttctgggttctctattctattccattggtctatgtgtctgtttttatgccagtaacatactgtttttgttatgatagcttggtagtataattttaagtcgggcaaagtaactccttcagattcattctttttgctcaggatagctttggctattctgggtcttttgtgattccacagacatattagcgttgttttttctgtttctgtgaaaaatgtcgttggtattttgataggggttgcattgaatctgtagattgctttgggtagtatgggcattttaacaacattgattcttctaatccatgaacatggaatatctttccattttttatgtcctttttaatttctttcatcagtgttttatagtttttattgtagagatcatttacttctttggataatttttagatgttttatttttggctattgtaaatcagattgattttaaaatttctttttcagattgttcaaatactggcttttgtatgttcattttctattctgcaactttacttaatttgtttatctgttttaatcggatttttgtggcgtctttaggtttttttcaaatataaatatgtcatctacaaacaaaaataatttgacttctttctatccaattttcatgctctttatttctttttcatgtctgattgctctagctgggacttccagtactatcctgagtgacaatggtgaaagtgggtatccttgttgcattccagatcttagagaaaggctttcagtttttaccctttcagtatgatactagctgtgggtgtatgacatacagcctttattatattgaggtatgctctttttatcctcagtcttttgagggtttttatcatgaagggatgttgaattttatcaaatacatattcagtatcaattaaaatgattatatgatttttgtccttcattctgttgaaatgatgtatcacattgattcacttaggtcgaaccatccttgtatctcaggaattaatccgacctggtcatgatgatgatctttttaatgtattgttgaatttggtttgctagtattttgttgagtatttttacatcaattttcatcagagatattggcctgtggttttctttttttgttgtatccttatttggttttggtatcagggtaatactgtccttgtagaatgaatttggaagtgtcctcttatcctctcttgtttggaatagtttgagtaggattggcattagttcttctttaaatgtttgatagaagtcagcagtgaagccactgggtcctgaacttttctttactgggggactttattgcagtttctgtctcattatttgttattggtctgtttgggatttggatttcttcatggttaaatcttggtaggttgtgtatgtctaggaatttatctcatagtagccactaatgattctttgaatttctatgatatcagttgtaatgtcttttttttttcatttctgattttatttgttcgggtagtctctctgtttttcttcattagtctcgctaaaaatttgtcaattttatttattctttcaaaaaaccaagattttatttcgttgttcttttgtattgtgttctccatttcaaattcatttatttcgctttaatctttgttatttagtctactaattttgggtttggcttgctcttgcttttctagttctttaagccatattgttaggttgtttgtttgatgtttttcttcttttttgaggtagttacttaaagctgtaaacttcccttttagtattgcttttgctgtatcccataggttttggtatgttgtgtttctattaccatttgtgtcaagaaaattttcagtttccttcttaatttcttcactggtaattcaggagcatgttgtataatttgcatgtattttttatagtctccaaaagtcttctgttattgatattaagttttatttattttcgaacgctgtaagacttgttttgtgacataacatatggtctatttttgagaatgagccatatgtttaggaaaagaatatgtattctgaagcctttggattaaatgttttgtacatatctgttaggttgatttgatctacagtgcagattaagtcagatgtttctttgttgattttctgtttggaagatctgtccagtgctgaaaatggggtattgaagtctccaactattattgtattgaggtctatctcaatctttagctccaataatattagctttatatatctgggtgctctatcactgggatatttgtaaatgttatatactcttgctgaattgaccaccttatcattatataatgacctttgtctcttcttacagtttttgtcttgaaatctattttatctgatttactggctcttgttcttttttggtttctgtggacatgggatatttttttccatccttttatttattttcactctgtgtgcatcttcataggtgaagtgtggtttttttgtgtgtgtggggaacagataattgattcttatttttcttgcatccattcagccactctgtcttttaattggagggtttcatttactgacatttaatgttattatttataaagtaagagcttactcttgctattttgctgtttggtttttgttttttgctttgtggtcttccttctttccttccttcctgtcttttagtgaaggtgatgttctctggtagtatgatttaatttcttgctttttaatttgtgtgtatatgttattttctgatttgaagctaccataaggcttgcaaataatatcttatagcctatcattttaaactgatgacagcttaacactgattgcataaacaaacaagcaaaaagaaaactaataaaaaactttatgttttaactgaatccctcccatttttaaactttttgttgtttctctttgtgtcttattctgtgttgtaaagtttttgtagttattatttttgattggtccattgtttagtctttctacttaaggtaagagtagtttacacagcacacttagagtgttaaaatattctatgtttttctgtgtgctattaccagtgaatttcataccttcagatgattcattattgctcattaatgtctttttctttcagattgaataaccccctttagcatttcttataggacaagtgcagtgttgctgaaatcacatagcttttgtttgtctgggaaggtctttatttcttctgcttttttggtggatattttttgccagatatactattgtagggtaaaagttttttttcccttcagcactttaaatatgttatgccactctctctcgccctgcaaggtttccactgagaagcctgctggtagacatattggagctccattttatattatttatttttcctgctgcttttaggatttttttctttattttttacctttgggaatttgattattaaatgccttgaggtagtcctctttggattaaatctgcttggtgttctataaccttcttgcacttgaatattgatatatttctctaggtttggcaatttctcttatattatccctttgaataaactttctacccctatctctgtctctactttctctttaaggccaaaaaactcttagatttgcctttttaaggctatttttgtagatcttgtaggcatgcttcactgttttttattctttcatttcctctgactgtattttcgaatcgcttgtcctcaagctcactaattctttcttctacatcaattctgccctaaatagactctgatgtactcttcaatatgtcaattgcattttcagctctagaatttcagctttgttctttttaataatttcaatctcttggtcaaatttatctgatagaattctgaattccttctctgtgttatcttgatttctttgagtttcctcaacacaactaatttgaattatctgtctgaaaggtcacatatctctgtttctccaggattggtccctgatgccttattcagtttgtttggtgaggtcatgttttcttggatggtcttgatgcttatagatgttcatcagtaacattgatgagttaggcatttattgagttaacatgtctgggcattgaagagttaggcatttattgtagtctcacagtctgggcttgtttttgccagttttccttgggaaagctttctagatattcaaaaggacttgggcctcaaacccaataacactgtggttcttgcagacacatagaggtgctgccttggtggtctttgataaaatcggaagaattctctggattccaggcagagtcttgttcttttcccttactttctcccaaacaatcagagtctctgtgatgagtcacctggaactaggggtgaggggacactgtgccccttggctaccaccactggaattgtgttaatatggacctgaagctggcacaacactgggtctttcccaaggcccactataaccactacctggctaccacctatgtttactcaaggtcctatagctctgtgatcagcagttgataaaccgagctgggtttgtgtccctttcttcagggtggtgagtttcctgatgccctgagtgggtccaaagatgctgcctgggagctagggattagagtcaaaaagcctagatatttagttctgttctactgcggctaagctagtactcaaaccacaagacaaagtccttcctgctcttcccttccctttccataggcagaggagcctcttcttgtggccaccagcaacaccaccacaagggagtttctctcaggccaccaccggtgttctcttaaggcccaaggactctccagtcagcttgtggtgaatgctgccaggcttgggactcaccctttagggcagtgggctcccctctggcccaaggcaggtccagaaatgctgaccaagggcctaggcctgcactcagggaccccaggggcctgcttcattccctactccactgcagctgagctggtacctgaggtacaagacagagtcccttttacatttccccttgtttttctcaggagtcttaaaccatagctcccacagctgagaatttgcttggttacacctgaagccagcacatctcagagcccaaggcccatggcctatcacctgggtatggctgctgggtatttagggcccaagggctctttaatcagcaggtgatgaacctgccagggctgggtccttgccttcaaggcagtggttcccttttggcctattctgtctctagaaatgtctgttatgagctagagcctcatgactgcctggtgccctatcctactgtggctgagctggtatccaagatgtaaggcaaagtcctctttgctcttcactttcctcttttcaaacagaaggaaggggtcttttctgttgctgtgagctgcactgcctggagttgagggaggggtggtgcaagcacttccttagccactctgtctagtgtctcttaggtcatgtgccaccctagtctactgtctctaagcccagctcagcataggcgttacctatgaattgcagtccttgtgtcctagactgcctttcaagttcactttggaccttagagcattttggcctgtgctagtgaggcttgttgagaaactcaggttccacctgctgggatgggtggttcctctctggctaagtctggtccaaatgctccctgtgtgtgtgggtgctagctgagcccagcatgtctttgctctccaatataacaggacagcactgagatcaaagtaaagtctcatgattacggtgctttccctctcccaagtgcacggatttctccacaccatgcagccactgccaggggatgggggagaggtggcacaagcacaacctggctggttggtgtctcagtagggcatgtgatgtggtttagctttgtgtccccacccatatctcatgtcaaattgtaatttccacgtgttgggtagggacctggtaggaggggattggatcatgggagcagatttcccccttgctgttttcatgatagtgagtgagttctcatgagatctggttgtttaaaagtgtgtagcacctcccctttgctctctctcctgctgccatgtgaagatgtgcttgcttccccttcacgcttccaccatgattgtaagtttcctgaggcctccctacccatgcctcctatatagcctgtggaactgtgagtcaattaagccttttttctttataagttacccagtctcaggtatttctttacagcagtttaagaacagactaatacattgtgtggccctgccgaggccactggctctgaatccagctcagcactaggacttgcctaggaattgcagtccttgtcacctagatttctctttaagtttacttagggtcccagagccactttagcctgcactgtcaaggcttgctggaactctggctccatttgctgggatggctgattcccatctggctatgcctggtccaaatgctccctctctgggtgggcatctgctgggtgcgctcctgttatgctttctgctgtgacagagaagcattgagttcagtttaatgtcccccagtcattgcgctctccctctcccaggtgcgtagattcttcaaaccaggcggccactgtcaagagatgggagacgggtggcattggcacttcaagactgtctttcctaccccccttcagtgcctctttcagtgatatgaagttaaaaccaggtactatgagtgttgatttttggttgttgtgatagtgctttttgtgtgtagttagttaaaatatggtgtttctgttgggggaacaaatcgtgtagacttctattcggccatcttgctctgttccaccaacatttcttaaaatactcttttagcccactttccttttcctttccttctgaaactccagcgatacaaatgttggacctttttctgttgtcgcacaggtgctctgttcctttttttctggtttatcttttctctattgttaaaattgggtaaattttattgatttgttctaaagtttatgtattctctcctttgtcatttctgcttccttatcgatccccgaattaaaacaaattctgctgttgtgtttttcctttttatttgttttattagaatttttaattatttgttgaaacatttttatcatgactgctttaaaatccttgtcagagaatgctaacatccgattcatctcagtgttggtgtcagttgtcttttctcattcaagatgtgatttttctgtttcttggtatgatgattgagttctgattgtgttctggacattttggttattccattgggagcttctgagtcctgtttagatcttccattttagaaggcagtcaccctgtataagtttagtatgcaggacctggcctacatttgtgggttgtgattccaaagataatttaatctttaagactgtttggtgtatctcatgccattgatgctccctctggtccctgctggtgctggccgatggggtggaagtagcttcccacaggccaggacgccttgcccctctagacggggaagactgtctgctgaccatagaagagtcagtgaggctttctgtgtccagctgcttgttgtgttgagatctctcttagtggtgctgtccagtgcttcttgatgggataggggagtctttggcacctaggaacatagcagcttcccaacctagttcacttgtgatgagctcaccttgcctgtggggtcctagagcaccttccaggctggttacttattgtgggaggatcctcttgccggtgctgcaggtctccctggtgcctgtaggtccttagggtcagaccctggatactttctgtggtagaattccccttgttagagctgcccttctccaccctccccaccgtgattctcagtggaggttaatactttttcccaactgggagcagagtgattcccctagtcacttattgtctgcaggaatccccatcagtcccagtgtggctcatatgtattgtcagtaggattccagtttgattcaggggaggaatgagtcacttctcttgcttggttgaggatcagaaaatggcaggcctgggttgctttctgcttttgggaggggggtcctaagccaccgtgctgcttatacagtcctaggtaggtccctgactattccaccattctctttacacctttcagaatcctgctttggctaacttttgctttatttccagggtttatagttgtacttagcatggaggagcagggaaaagtgagtctgtgccgttttattcagaattgtgtatttgttgctgagctttcattacctttctggatttgttttcatttcccttgtcttgaaaagctttgagaatgatcctgcaatcaagcagtatcctcccgctcttgagtacagatgtacagtgctctgctgtgtctggccaaggtcaaagtcccaataggctgaattaatgttgctggtgtggagtcatgtcattccattaatataaaacaaaagtttaaatctacgtgcatagggaataaaggcggggagctgctgctgcccctctgtgtggatgatgcacagagctggcactgccctttcctctctggctgtgtgactgtggtcagcgcttgtcccggctgatggggagggttctggccatctggcctcccagtttcaatcccttgaagcagtgcccaagaccctcagtcaaggaactatctttggattgtctagaggttattcctgtattttaggcactgaaaaggaatggaaaaagtgtggaaatcactttaagattagtgagtattagtagagaagcagatgagatctctactagatggcggtttttcctttggaaaagggtacacacatcgccttctgcttggaaagataaaccagcatcaaattcgtcttgtcaggcaagatgtgttccattagtaagactgattccgttgtacactaaattgcaaaagaaataatttaattcctgctccctgtcttagatcctttctctaatgctaagaggacagtgagatgccctgtttgcctttaggccgtggaatggtttgggttaagcaaggcagttttggatcatttcacttttgcattttacctagaattggaatgttgctcttaattatctgacacaagaagctgttgatcatttctatcttgcaggagtcagtggaatttaagtttacttaaagaacttgaaacattgattctggttctcctcatgtaatgattgaacaattaacgaattcctggttaagttcctgtatttttctgttttatgtaggactaatattttcattgagtacatgaaaatgaatttgatgctagtagatatgtggacatgtaatcaatttaagtattttaaactaatacttgattatcctttatgaagaaatactaatcattagctacttttaagcagtttaaacatttactaaatttctagtactatcttttgaaaatcttaagtgccatttgattgacttggtggggctcacatttctctgtggagtggtcacattggtgagagaaactctacctcatggttaaggacccagggctgagttcactacgtgtgtttgtatcctggctgtaccatttacaaactttgggccgtgggcaagttaactcacctctggtgtctcaaattccttatatactcactggggaaatacagtaccactgtacgaggtattgtgagtactcaatggaacaatatatgcagagcatttagaacaatgcgttgcttatggcaaacacataatagctgttagcgtttcttgtggtggatggttgctcttattatgaaaccaaaagaaagtagatatgactatgggaattagaatacacacttaaaaataaaacaaccttggcattggtatctatcaccagggtcttgaataccctgtcctagtaataaaaatgctgtacgcttatatttagcttgaggcaacgttaccctgtttgaatgaacagtgctttgcttcagcctcttctgatcaccccctcttccttatttaatcccaaggatgggaattttcctcagcttctcattattatgttcttcatggcagtcaaattggaggcaagctattgaagacacaaatcccaagctaatctgtttccaaaaggtatggacttaaaaatagtctgcatttgtgttgggtaattttgttgtactttgttattaagagaagatgatgttaataccagatgagtaataaaaaatcaattaaaatcctttagggaaattaaagcgctgacaaattcataatagcttttctggttgttaaatgaggttgacatggattaacaattggtggtggacagaaatttgctgaatttactgaagtatatacccattaaaatgacagctgtgtctaagagcctgcaccagggcatttagttccaggacctgagtgtgaaggagagagctaatcaaataagacaacttgtacttaattttaattaagtaaattccccgtcacgttttaatcacataaactcagtcatgggtactgcaggagaaagaggccagccattttattgtctaactctgatttctttttcaaacttatttattaaaaataaacgtacaggcttaattttggtagttgattgtgcattctgatttcatctctttattgagagtagtttatcaatcatcttttcattattagaaaattttcccataaatccccacaaatcatttttataaaaatgtatttaaaattatataatacaatttgctatgtagtatgtaatttcatgcaagggacttgtgtcagtgaagttgtttagttgctgaaataataatagttaaaaaataatgaattttgaagaccattaaagcctttttattttgatgtgtgtttgttcttggattttttggccaatgtgggcataaatgggactctaatatttgttagtttgttagattcttgcttccctggggagtcaggtgcagaaaggtagcacagcatcaagattttgttacacttgtgggatataaccaggtgctatagcatttatagtaatcagattttcttctacttaaacgtacagtgtgtatagcctaaaattatttttttggttgatgtaaatagaaacataatttatgaattttgcagcagcctatgacacttgattcaataaacactttttattcattgctgtttgcaaaatgctgtgttcagcacaagaaagatacaaaaaatagcttgtatttgcagtgctttgggggtttgaggtggaagaatcatttgaggttgaaggatcatttgaggtcaggagtttgagaccaccctgggcaacatagcaggaccctgtctctaaaaaaaaagaaaagaaaaaattagtcaggcatagtggcatgcacctgtagtcccagctgctcaggaggctgaggtgagaggatgtcttgagtccaggagttggaggctgcagtgagctgtaattgcaccactgcactccagcatgggtgacaaaatgagaccttgtctcttaaaaaatgaattacaaacaaaatgcctgcttttaagttctctacaatggaagagatagacagccaagcaataatcctagaaaatcagttctaagtagagataaaattatttcaattgatgttatacacagaaatttacagattcaatgaaatccctatcaaaataccagtgacattcttcacagaaatagaaaatacagttaaaaatttatatgtaaccacaaaagactctcaatagccaaagcaatcctgagcaaaaagaaaaagccggatgcatcacattacctgactggaaaatatactacaaagctacagtaaccaaatcagcatggtactggcataaaaacagacacatagaccaatggaacagatagagaacccagaaataaaatcacacctttacagccaactcgtttttgacaaaggtgccaagaacacacaatagggaaataaatggtgctgggaaaactagatatccatacgcagaagaatgaatctaggattcctatttctcaccatatgcaaaaatcaaataaaaatggaataaagacttaaatctaagacctgaaagcatgaaactactagatgaaaatgttgcataaatatagcaggacattgacatgggtaaaaaaaaaattttgtgtaagacatcaaaagcagagataaccaaggcaaaaacagacaaacgggattacagcaagccaaaaagctactgcatagcaagggaaacaagcaacatagtgaatacataacccccagaatgggagaaaatatttgcaaattacccacttgacaagggattaataaccagaatatataaggaactcagacaacttaatagcaaaaaacaaaatccaattaaaaactgggcaaaaaatctaaatagacatttctcaaaagaagacatacaaatggccagcagatatatgaaaaaatgctcaacattactaatcatctgagaaatgcaaatcgaaaccccaatgaggtatctcacttcagttaaaatggcttttatgtaaaagaaaaataatgctgcggagaatggggaacccttatatgccattggtgggaatgtaagtacggctactatggaaaacagtgtggcagttcttcaaaaaactaaaaatagaactaacatatgatccagcaattccactcctgggtatatatccaaaacaaaggaaatcagtatatcgaagagatatttgcattcccatgtttacggcagcattattcacaaaaaccaaagtatggaatcaacctaagtgcctactaatggatgaatggataaagaaaatgtgatatatatgtatatcacctggagccccacagatatgtgtgcgtatgtgtgtgtgtgtctgaaacacacgtgtacacatgcacacatacatatatacacacaatggaatattattgagttacagaaacaaatcctgttatttgtagcaacatggttggaactggaggtcattctgctaagtgaaataagccaagcacagaaaggcgaatatcacatgttctccctcatacgtcaaaaccaaaaatgtggatctcatgaaggtaaatagtagattggtggttaacaggagctgagaaggggtgggggaagggtgggttgaaggagaggttcattaataggtagaaatgtacagttagctcaaagaaataagagctagtgtttgataggccagtagggtgactatagtttattataatctattgtacatttcaggatagctagaagagaataatttgaatgtttccagcataaataaaagacaagtatttaaggtggtagagatcccaatgacactgatttgatctttacaaattataagtattacattatcacatgtaccctgaaaatatgtacatctattatgtatcaataaaaaacataaaaatatttcacttgaaaaatctgagaaggcctgaaacttgatatttgagcttggcctgaaatatgaaatttgatgggtaggaagtggctggaaccatgacttcaagcagagagccagcttgagcaccgctatgaaggggagagtccacactgcattcagggaatgactggagacctttggcaaaatccagggtgaatgagggaggactttatttagtagggaatgagtccggaaacctaggtttatttacccaacagcaaacacttcttagcacctgctaagtgtcaggtgtgtgctgcctgcttggtctaccttggtggtcctggcagtcacagcccctgctctcagcaagagctgagtgtctggaggggaccccactgtgtagtatatgatcatttttgaggatgagagttacacagtctggcaagtgttttaagaagaaaactctggtgacctgtggaggggagggttggatagaggaggtggggctgaggctgcaaggagggaaagggaggcctgaggacatggagatgtgcaggtgaggaggagagggcagaatcccagatggcactgggatttatttccaaaggtctggctcagtcatgagacatctcttttttatgtgataactttttcaagaaaaaaatgtaggccacagtctttcattttcccttcttcagaattattctttagcctcacatagtaaaattaggtatgctcataatcaaaattatcttttaaatagaagattctctatcagaaaaatgatgttatgttttcgccactaaaatgtgattgttcaggcataattggtcatcggcagcctcgaggcagctctcctaccattttttccaaaggtaaactgagcaccttccccagaagctgcatggtgggactgcccgggtgcttatctctgggtcggcttgtgtgtggtggggtggaaccctgcctgtcttcctctgttccattgggctgggaatgggagccaggcattggtcctccatagcacttctgtttccttactgggtagatttaaatgtgtgggtccctctcttttggtgtgaatagaaggtagaggaaaagtgtgtagaactcagtgcatagggcagtggttagcatttcaacaagaacatctcacatatctaagatttgtttagctcttcaggcactgataggaggttttaataagatcaatgatttttagtttaattgggtactttccttgttcccctggtagaatcccacctggaaaatctactatagcagagtagaatttggaacattttttcttggtctgatacacttaatggtggttagtgttagtccccagcacaccagagggaggacattcctattagtaaccctagagctgttacgtataggatttgtggggtattgggatgggttgaaaaaagtacaggtaattgcaataactcctactagtggagttgagaataattggccttttatagctgtttgttttagaagaattagaatagtggagtgggcagacctggagtcaggtggacctgggtcatggttttaactaaccattccatgactttggacaggttccttgttacagattgaatcattgagcctagtttttcaccctctgttatggaattctgttccctggccctggcctcacgctcattggagcacacttccttgactttgggcatggccccgtgacttgctttggctgatgtctgtatcctcgggttctgcatccgtggattcaatcaaccaccaattgaaaatatttttgggaaaaaataaaaaatagcaatacaatgataaaaataatacaaataaaacaaaatacagatgatatggttaggctttgtgtctccacccaaatctcaacttccccaggtgttgagggaggaacctggtgggaggtgattggatcatgggggcagtttcccccatgttgttcttgtgtgagtgagtattcacaagatatgatgtttttataaatgtttggcaagttgttcctttgcttgctctctctctcacctgccaccctgtaagatgtgcctgcttccccttccaccatgattgtaagtgtcctgaggcctctctagctgtgtggaactgtgagtcaattaaacctcttttcattataaattcctcggtctccagaagttcttcctagcagtgtgaaaatggactaatacagcataataatgactgtttatattgtattaggtatttttttattatactttaagttttagggtacatgtgcacaacgtgcaggtttgttacatatgtatacatgtgccatgttggtgtgctgcacccattaactggtcatttagcattaggtatatctcctaatgctatccctccccgcctccccaccccacaacagtccccgttgtgtgatgttccccttcctgtgtccatgtgttctcattgttcaattcccacctatgagtgagaacatgcggtgtcaacctacacacatcttcccatatattttaaatcatccctgcattacttataatacctaatgtattataagtactgcaggtcacctctgtggtgaatatgcatacattcccatttcattagttcaaattgactaacagccatctaagcatgaagtcaaggaatcataagtcattttccaacagagaatcccatataagctgcagctcactgaccaatggctattctcatctaggaaatggtctcccttgagaggcagcacagagagtggaaatagtaaggtctttggaacggacaattgtgtgaccttagttaaataccttatgaccctgagcgtttgtttccttgtttgctgaatggtgggaaataaggttcatcttaatgtattaggtattgtaagtaatgcagggataatttgaaatatgtgggaggatgtgtgtaggttacatgcaaatactacaccatttcatgtcagagacttgagcatctgtagattttggtatctgtgggggtcctggaaccaataccccacggtactgagagacaactatattagcaaatgtgatgtaagaggaggcttgattctacttgtgtgcctgggcttgtgctcaggtgattcaggctcaataaaaatgtgccctggagttactgtccctttatccagggctccacggggtgagaaacgggacagacctgaacccacctcaacctggagccctgcaggtgagtgcagcctggaccagctgagcttcaacccatgtgcagactcatatgtgagaaaaataaatgtagttataagccactgagattttgcatttgttatgtagcattgtggtaatagagaactaacactgtgcttgtcttcccttctgtaaaacaggaatctgatcttcccacagggggttctgttctaaggcttaaaataaaataatcctgttagtgcagtgcttgactcttagaagatgatatgatataaataaattgcagctattttaaataatgaaaatatgggatatacatccaaaataaagggcatagtttctgcacagaagggaattagccaaataaagaggaaaaaaggtaaggttctcacattgtgttgtgtgtctcctggaaatttgttattgttctgagtgctttctgtttactcattcaatgtatatattagtgtaggttctctggagaatcagaacacacacacacacacacacacacacacacacacacacacacacagattgattgatctgttaacttatctatttatcagcattggcccacatgattgtgagggctggcaagtctgagatttgtagggcaggctggcaggcttagaaactcaggtagagtggatgttgtaatcttcagtctacagtctgcaggccaggaaggctggaaactcaggcagggtttctctgttgcagtattgaggcagaatcccttccagattgggaaacttcagtctttgctcttgaggccttccactgatcggataaggccaacccacattatgaaagggtcattagctttacttgaagtcaattgatcatatgtgttaatcccattaaaacaataccttcacagcaacatcttgactggtgtttgggcgctataacctaatcaagttgacacttaaaattaaccatcacaacatatattaatggggttgcctgctctatgattgggcgggcccacagtgatgacatgatatagactttgcccttgtggggcttagcgtccagtgactgttgttttgttttatccttacagaagccctgtaaagatgaaccttatttcccaccattcagcaaacaaggaaacaaatgctcagggtcataaggtatttaactaaggtcacacaattgtccgttccagagaccttactatttccactctctgtgctgcctctcaagggagaccatttcctagatgagaatagccattggtcaatgagctgcagcttatatgggattctctgttggaaaatgacttatgattccttgacttcatgcttagatggctgttagtcaatttgaactaatgaaatgggaatgtatggatataaattttaattgcaacaaattctgaaggactttatatgtgcacattttatattatcagattacacttcccaggagtggagttaacagaattagttctcactctcctaccaactaccacaattaagtgaaggctcttgccagaaaataaagtaaatctattgtacatgcttgtaaacaatagacaaattgcgtagtgtaacacaaaagtcagcctaatgtttgtacatggtggagatattgattagttaaagtttatttcatgtatccctactattgcattgggttttcatatgtttccttcttcttcttgtgtgtttgttattcttatgtctggttccagttaatacttctagagaaaagttcacttttctagattcactcactgttacataaataagtgtataagggcttaggtactgtttactaaaggccatctctgtggtgaatatgctgtgtgatttactttatttttatttttttacctcggagaagttctcagaatgatatgcttttttaaacgttcactttattttatttattattattttttgagacggagtttcactgttgttgcccaggctggagtgcagtggtgcaatctcagatcactgcaaccttcccctcccgggttcaagcgattctcctgcctcagcctcctgagtagctgggattataggcatgtgccaccatgccttgctaatttggtatttttagtagagatggggtttctccatgttggtcaggctggtcttgaactcctgacctcaggtgatctggccgcttcggcctctcaaagtgctgagattacaggcatttacttttgtattcagttataacttatatacactaagcatacatatcttacatgtataacccaatgaaattgacacacatacaatactgtgtaaccaccatccccatcaagttatataatatttccagcaccccagcagctccctggtacccctgccagccctttccacccgtaggtgaccacttgtttcatctccatagcgtttttttttttttttttttttttttttgcccatgcttcttgtttgtgcagatgtaatcattgatcaggtgcacttgtgtgtctggcttcttttgctgtacactgtcacttcagcacatgacattttgtagttcttttcttcattgctgtgaagtgtcctatagtatgaatagcccacactttatccattctactgtttagggacattcgggttgtttctaggtttttcagctattctgcatgatgttgttatgaacatttttgtccatttcttttgttctaaacaggagtaaaattgctgagtcataggatgtacatatgttgagttttaggagagattgccaaacgtatgttgagttttaggagagaattccaaagtttttgcaagtggttgtaccaatttacactactgtgagcagtgtttgtacttctacttgttctacatcctcaccaaagccttttttttttctcctttggttttgaaatattgcagacaagtcctctggaacacatttatagttccattatacacatatgtataagtgactgtactgacagcaataatgattacatgctgtcctctcgtggttactttctgggattatatgctgctcctggcaagccccatccttgagtctccatggattattgtctgatgagcctggtcttagggcactacccagaaggaaagcaaatgcaattataaacattttaactcagcctcagggtgcaaacattccaaagaccaggctcatttttttttttaagagacagagtctgtctgggttgcccgagtgcagtggtgtgatcataactcactgcggcctggacctcctgggctcatgatcctcttacctcaacctcctgagtagctgggaccacaggcttgtagcaccatatctggctaatttttaaactttttgtagagatgggatctcgctctgttgcccagactggtcttgaactcctggccttaagtgatccttccgtcttggcctctcaaagtgctgggattacaggtgtgagccaccaggcctggcccagactcgttttttgaggcaagattttgtattagggaaataaagaggtactctgaattgaaatcatgcctcaccatgttcttttacaggccctgagcaggagggacttcgttagttgccatgatgtttgcatgattatgtgatgttagcgggaaagcaggtgtcatgccagcatgctggtacctttgtcacctcgaactagcaccccctacccctgcaccctaagcctttgaaagtcaacttggtttataagttttcttccttttacaattgtaatatggatttattttgactgcatgttttacttggagataaaaatgctttatctgactttaatcctgacctagttttacagggccttcaattgctccttatctctaggagtctctaggggtgcctgtggctcacagctaaggcagcggtggtgctggcctctttgctttcctgcggtgcctgtgccttttggtgagctcgttggatgggactgagtgtctggtgtggcttgggggaagaacatggagtgccttcctctggaacctgcagctactccttcctggcttccccttccacctcagtacggagaatctgtcctgtctggcagcgttggaggagggcgtgtggggtgtgacaagttagcctttttctcatcaggcatttccggtgtcccctgaggctttgaaacccaaaagccaagaattgattgggttgtcttctgctttcttctgagatgttgatcctgaagagatggtgccgaatgctcagttgcctgaatgaagaccttgtggtggaggaaagtgtgcagtgggcaggggaagcctgtctgttaatattcaaaatggtgtgtggcttctgctacttgggagttccggtttgttcctttgtgctgtaacaacatgatgtgaccttctgtatgggatgtactttttacttcttaaagagaactgctggggttgtggaggaaataggggcagaatttgatttgaaggattattaggggagtcagttcttgtggctatagactgaaataacagtgatgctcagaaggaggagggtgattttgagaggtgaagccaactggacttcctgggtcgagtgggaacttggagaacttttctgtcttacaagagaattgtaaaatgcaccaatcagcactctgtagctaggattgtaaaatgcaccaatcaacacactgtaggtagctagaggtttgtaaaatgcaccaatcagcactctgtaagatggaccagtaagcactctgtaaaatggaccaactagcacactgtaaaatggaccaatcagtgctctgtaaaatggaccaatcagcaggacatgggcaggggacaattaagggaataaaagctggccaccccagccatcagcggcaacccgctgaggtccccttccacactgtggaagctttgttctttcgcttttcacaatagatcttgtgctgctcaatttttgggtccctgctctctttaagagctataagcgaaggtccctggcttcattcttgaagtcagggataccaagaacccactggaaggaaccaactctggacacagtttcacaccgcctgatggacttcctagctctctgtcatggctgtcatcctggcacaaagcccaggtttctggccactttgggacagtgtaggtgggtcctgcgtgtcctcagagcatagcctagagtgtccctgagtggggtgcagtgaccttcttggtgccatggtttctgttaaggggacagtgactggctcctgtggctggtggggccagtatttgggtcagctgacctctaggtctgaagacaaagacttgaagaaggaagacactgagcctaataggccggagctttggtaccctcactcctttaaaagaagagcaacttatggagattcctaaccactgacccacactttcccatttatccagaggtcctgcatgcctcggaatgaggatgcttccctaatccaatcccttgtgcatgcaggctcctgagaatataacaaagtgtaatttattgttaaacatcgctgactttattaaaaatgtcttggccgggtgcggtggctcacgtctgcaatcccggcactttgggaggccaaggcgagcggatcatgaggtcaggagatcgagaccatcctggtcaacatggtgaaacctgtctctactaaaaatacaaaaattagctgggcatggtgtcgcgtgcctgtagtcctagctactcaggaggctgaggcgggagaatcacttgaacccagaggtggaggttgcagtgagctgagattgtgccactgcactccagcctggtgacagagtgagactctgtctcaaaaaaaaaaaaaatagtctttttgatttcctaaagaatttgctaaaaaagaatatatatagtcttatgattattgttgtgttaatcagaatgataagaatattttcttgccctctttcaaatcagtagtggatatatactgcaaagaaggttagattttttaggggttatagtctggaggaaacattttatattaaaaataattttgcctaatttttcttgcttactaacatgtggtacccaagtatgagatgcccccaaattctctgtatgggatcttttagttttagaaatagaagggaacttattggagaaattgagattcacacaggcacaaaaaggacaaatgttttactttaactctaccagtcaccttccttactaaagactaaataagccagcgagttaagtgcttcgggcgtactgagactttaaatttaagacattgtaaggcatatgagatagctgtatttactttaaaatgagaatccataaaagtgaacatcgtttaatactgtgcttttcaaatgaactctctgcccttaatagcataggtatgtgatagtaggtggactgtgcaatcagatttctacacttgtaatttcttcattctgcttcacatttctagacttttcaggaattaaccaaagtaatctgatacttcagcgctgtaaccactttctcttctttgttgagcaagtctatttttgtatttccatttcagtttcctctcaaactttacaatgtttcgctttttacattgagctttcctagttcttaagctcagttttctcttttgggccggaaatttgggttgcttctgcccaactgctgctcttccttgtattgaaacattgtgtctttcctgtcagatgctaacttttaaaagccagtatctttacagccactgcagaacgtttttagtgtgggagcaacaggtagctaaagactaggggcatttttaactggagaaataaaaggctaaatactcaagactgtttgtttatattttgtgtgtaaaagggaattttcatgttttaatttgtgtagcatatgtctctggggctgaattgctttttgcaatactaattgtttctgtatttaggcctaaggaaagtttgggtaatatttaagaagcatcaacaaaacagtttccaaatgtttgccatgctacataaaattgagtgtttgctttatgctccaaaataatttttcattagttattggttcaggatcaattttttgctattgcaatttttccaaataaaattttaattttagtgttacttctggagatggtggactggtttcttgcaaaccagttcacctgctgaaaaaactaggaaaggtgaaaaacaaacaaaaaaaaaactaagagaacgtaagtgtcttagtccgttttcatgctgctaacaaagacatacccaacgctgggtaatatataaaggaaagaagtttaatggattcacagttcccatggctagggaggcctcacaatcaatggtggaaggtgaaggaggagctaagtcatgtcttacgtggcggcaggcaagaaagagcttgtgcaggggaactctcctttataaaaccatcagatctcatgagacttactcactatcatgagaacacaattgaaagacctgcccccttgactcagttacctcccactggttccctcccatgacacgtgggaattacgggagctacagttcaagatgagatttgggtgaggacacagccaaaccatattaataagccaaaataacacagaaacctatgtttgtgcagtcatgttcacagcagtgcttaaccacagccaaaaggtggaaacaacccagatgttcatcaacagaaaaaggggtaagtgaactgtgttgtgtacatatgatggaatattattagctataaaaaggaattaggtactgatacatgctacagtgtggcttaacctgaaaaagatgctaagtgaaagaagctggaaataaaaggtcacatattgtataattccatttatatggaatatacaaaataggtaaatccatacagacagcaaattggtgtttaccagggtttgtggggagaaggggcgtgggaagtaactacttagtgggttggaggttaccctgttactggagttatcaaacccagactttaaaataactttgactactatattcaggcaattaaataagatggagaattggactagaaatagaactataagagagtagaactggaaactgtaagagtataaatattcgaatattaaaaaaaacagaaattgagagttcaatagtgagtttaagtacagattagatataggtaaagaaggaaatagtgaactagaaaatagattaatgtccagctgaagcatggacataaaaaggaattagaaaactacgccaaacaaatcatgagagacacatgggacatggtaaaaagatctgtggtaagtgtatttagagttccagaaaatgagtgggggatggaggctgggaggagagagagaagtaatgtttgaagagataatgtctgaaaacatgtaccataaaaacattaacccaaaaaaagctagggtaactatactgttaccatctaagttagactttgaggcaaggatcattactggacataaagagggaatgatagctatactaaatatgtaggtaactaatagattactacaaagcaaaaaaaaaaattcaaaatcatagttgtagatcttaacacctcctcttcagtcattgttagaacaactataccaataattttccaactttttggtcttaggtcccctatacactcttaagcatttttgaggactacaaagatcttttgtttatgtgggttatatttatatttactgtattcattaatgtgggtatattctgtctatatttactgtatttacatatattctgcatatgcttactgtatatatgtgtttatacactgtaatgtatatggataatacactacaggaatttaagttaggaatttaaaaacatttatgaatataatacgtaaatatttagaacaataacaaatcaagacatgcttatgttaatttctattttataaacaaaaacttaaaaatatctttttatatttttgcaaaatttgcaaaatttgtcttaaaattttagtattttatatttttaaatatttttgaaaatttggtgaatgtttagcttaacagaagatatagcaatagaagacaacatttctgttttgatatgttattttggttgacgtatatgaagaaaattagcttcacaaaagtgtatagttagaaaaggaggactattttaatagcttcttcaatcattgtgaatattctttggtacatcaaacttggaaagtggtagtttcttaagcttacctgcaaagtagaatctggaattataccgatgagcttttagtgctatattacattaaaattcattgggctatcttgcactttaaattattttttactagtgcatggttttctaacactatgcattggtcatttggaaaatattcattcactgagttatgcagatctttcgtctttcaaatgttgatgcatttcattgtatgatataaaaactcatgaacatcaatctcatcagaaaatattggactacattaaagtgaagaattgtttatcaggaaaacatcactgagtatgaaatggcaagataatgatgagaaggtatttgtaatacatgaaagtaacaaagatcttacatctataatatttaaataactcacttaaagcagtaacaaacaattcaatagaaatatcagcaaaagagttgacatgcacttcacaaacgaggatatccaaatggccaataaataaagatgctcaacctcattagtcatcagggaaatgcaacgaaaccacaatgagataccagcaccctgccactccccaagaattactggaattaaaaagatgaaaatagcaatattgacaatattggagaatattataactcatactctattgatggaatgtgtatttgtacaccagtttgtaaagctgttagttaaatattatttgcatgccttatagactagtaattacatttttaggaatataactaacaaatatggcacatattagcatcaaaagacatatacaagaatgttcatgggaccagtattcctaacagctccaaactggaaacaacccagatgtccttcagtaagagaatagatcagcagcctgtggtgtattcttacaatggaatcctatacagcaatcagtagagctgttgttacatggtgacatggatacatctcagtgttgagtgaatgcagctagacacaaaagagtaatgtagtatatgatttcagtttttatcaaggtcagaaacaggcaaaacaactctggtgtgttaaaggtgaggttagtggttatctgtagagaggacagcagggaggagggaagatgggagagcacacaggaggctgccagggtgctggtaatgtgctgtttcctgattccagtggtagtttcattaaggtgtacttcatgttgattcatttaattatttaatcatttttctgtatattttaataaaaatttatgaaacgatatattaatactaagaaaaaatgtgagttagaaggttaccatatccttatcacaaaaagcttgaaaacatagttaaaagaacacagtccctcaagctgacattcctctggcattatgcttagtatcccttctcagacattcctatgaatgtgatctggggcaagttgcttagttccttaagttcctcatcagaaagctaaggaatgtaatagtgcttatttcatattgctatttttagagctagttaggtaatatatgtaatgtgcccagcatagtcttcggttcataattagcaccttaaattattcattggataaacatttactgagtttctgctcgtgtatctggcattgggctagtgatggtgataccaggaaaaataagacaaagtgaaccccatcaggattactgtgctgtctaacctggtagtccttagccacagatggtaattaaatgaaaattaaacagttcagtttcttagtacactagctgcatttcaagtgctgagttgccaaatgtggctaggggtgacatgttagactgcacgtttacagaacatttccatcattgcagcaactgtttctggacattgttgggcagggcaggcgatgggtgacagaggtgggcattgcagggtcctggtagagaggtgagacttgagctgctcagaaagaggaattttcaggtggaagaatgaagagttggccattccagttgagtgaaaacacagtgaaccagggctttgagcttgactcagctggagattgtaagcagttcaatatggcaagagcaccggatgcatagggaggaagctggaggggtggctggaaggcacagtgggcctgggctctggagggcagggaatgccacattgaggagctattctaggggatgctcaggagtgcttttatccattacttgcttacctcttaagacttaatgcttctttttaaaaaaatcaatttacttaacaaaaataaaacaatcatatttgctaaaaatattttttcctagttttttgtttgcttttttttgtagtgtattggtgttagatttttacgtaggcaagtctgtggtttttttagaatttctaagcatagaagatgttacttctagagactaattttctttttttaatatataatatacatattttgggggtacatgggatactttgatacaatttgatacattcatataatcagggtaattggtatatccatcaccttaaatatttatcttttctttatgctgggaacatttgaattattgctttctagctattctgaaagtatgacagatcaatgtaaactatagtcacttgactgatctatcgaataccaggtcttatttcttctaagtgtatagagaaattttcaattctgttttatttttttctacacttttatttttatatatttaagtataaaatggtgtcagggtaacttctgtgtgcttcaaatggattgtctaaattttaggtatagatattacagagtgctagctagtaagtcccaaccatttgttcaatgtttcccattctttgtgatgaatcctttgtggtcttgtatataatgacatttacttctgagttattagttgtattctattgctctttcttatggtaatgtaacattgcttatttatgccacaacatttattaagtatctgtgttttgtaaattaaaacttgtgatgacttagttcctctttttatatttgaaaattggaactcatccttgggctgtgggagtggtctgaacaggctaaatcacacagcttgtcatcgaagtccacactaagcactgtatttactataaacaccattcgtgataggtacatcctttttctcttttactgtcttataacaaatttgtattaaggggcacaagtgcagttttgttacatggacatactgtgtagtggtgaagcctgatcttttagtgcaaccatcacccgaataatgtacattgaacctattaagtaacttcttattcctcaccccctcccacccttaaaacccttctgagtctccagtatctatcattccacactctgtgtccatgcatacacattatttagctctgagtggtgagaaatgcagtatttgactttatgtttctgaattatttcacttaagaaaatggcttccagttccatccatgttgtaaaagacatgattcgttgttttttatggatgagtagtattccattatatatatatatatacaccacattttctttatccagtcgtctgctgatggacacttaggttgattccatatctttgctattgtgaatagtgctataataaacatacgagggaaggtatcttcgatataatgatttttttttcctttgggtttcaacccagtagtgtagagtatttgggtagataccagtaggtagttctatttttagttctttgagaaatctccatactgttttccacagaggttgtactaatttacattcccactggcagtgtataagtgtttccctttctccacatccttgccaacatcttgttattttttgacattttaataacatctgactggtgtaagatgatatctcagtgtggttttaatttgcatttctgatgattagtgacgtccaacattttttcatatatttgttggccatttgtatgtcttcttttgaaaaatgtctgttcatatcctttgcccactttttaaaggggttatttgtgttttgttgttgttgttgagttgtttgagttccttattgattctggatttgaatgcatagtttgtaaatatttttacttactccataggttgtctcttctttctgttgattatttcagaattgactatatagaaactttatagtgtgagtcccatttttctattttgtttttgttgtgtttgcatttgaggttttaatcgtgatttctttgcctaaggcaatgtccagaagagttttctggtaggtactcttttgaaaatgtatgtagtggtcttttaggactctgaaagacagctttacctcatggatgatgatgtattcagtagtgcatttagcacacagctatagatatgtaaaagggagtttgtgtagcagtgttgtaatcttttaaacttcacagttatatagtttaatataacaatggtaatctgtaagtattagctataggaaaaagttctcttactgacattttgttaattggaagactcagaaagctagaagtaactagcatgtagaaggccctttaaattcaccagtctagcaagcatttccaatggtgcttttacttttcctggtatctctctttctgtctgcgtgtgtgtgtgtgtgtgtgtgtgtgtgtgtgtgcgcgcgcacatacctgcgtgcaagtgtgcatgtacacacacacatgtgagttcctgctaaggagtgggattgaggggtgcaagggaataggacttttggaagctgaggtaattcacaaatgtaatttttcggtagatcctaaggaaaaagtcatggcataggtgtttgagggagatggcttgatcagcatcataaatgctcatcagatatgcccaataacaacaactattatgtaacatcatcctgggggttcctatgatcttccttcaggcatatcaacatggatagaaccgaaagttgtttttcagaggttgctttaaagaataattagtaattttctcaaacaatttgaaattcagatatcacttagcttagatggactggcattcacaaaaattagacaacagggttttttttttctttttgtggagatggggtctcactgtgctgcccaggctggtcttcaattcctggcctcaagtgatcctcctgccttggccccccaaactgcttggattccaggtggagccaccacacctgaccagtcaccagtttttaactcttgctcttcattcatttgatgtgaactatttccatgtagaagtcattttcctttgtagagagctttagcattcccaaagcacctttcatatttcgtatatgatgcttacaacatacctgtgaggcaggtattcacattagccacagtttacaaacattacagcccagatgtagagagtaagaagggcccccaggaaagaatatttttacttaactgtgctctttattgtggttgagttcactctccttactgtggcttacataagattttatattactttatccgactgcctcaatttgagccttgaatttactaattaaagttttactgggcttttatgttttggctgttaagaactgcagctgaaaagagtgtcgctgcttgaaagcaggggatgctttcaaaggtctggtgcttagtaggtgctttgtgatggctgtgcaacctggaactgaattaaagattaggggctggaccattgctttggaatgcatgagcgagtgtttactttagaaaagaataatgcttgagaaagcatttaaattgaattttatacttttcttttgatagacattaacttttttgtattaatacctcaatatgtttgcgaatgacatattcatttacacggggtcttcaaagtgtctaccaaagccacatgagatctttcggcttttgcaaaaaaaaatgcttattgctgttaatggaaacaaattataagcgagctcctcttttagacccaaagcagcttcgtaattataggtattgacttcaccccactcagtatgtaaagaatctaactgtagcacttgtatctccaacacctttcaggtcttacccagtgctagttaattcacatttaaaatgttacacttaaggaaaatataagtcattttttagtctaattttaattttcatgcctttcctcaaagaaaggaaaataagtaattgtgtgtatgctactctttctttgataaatatttgaggatgcttttagaaatagagcccattaaaactttttaatacatgggatgtttggccacatggttattttttgtggttgtcaatttcagtggcttgcttgagactgtaattggttttaagtatgttgtttatgctttgaaggaaattttctttagaaattcaaaccaaaattcacaggttgtctttttcttgttcaaagatgacagatcattttcagagctagcatatttatgcaatcaaaaattactgaacacgatgtagctatttttcactagcaaaataattttgctgttaatctgacttccaaaatctaaactcatttagggtaggaactttgtgcctaagtgttcattagccagctgtttactcacttgtgtgacttctgtattcctccaagcaaataatgttacctcaggtggtcgataaatgtgttttcaaatgatcctaaatcacctacataattttagataatctctcaattttaagaaactaaggctcaggcccacaggtagaagttacaggaggcatttattggttctgtataagaaggagctttataatcctttagggctgctaaaaaatagaatggactattttgctaggcagcgacattctctgcatttagaaatatgcaagcagatggcaggcacctgcctgtctgaagttctgtgcgtgaggttcctctattacttagaaaattagtcttcttgatttctaagatttttcccccttattccaatataggttatttctaccctctcataaaatagatgcttgcaatctgttgaaatatcagaggaggcttaataaccgtgttggcaacatattccagagcaccgtgatggagttataatgtatggtaatgttcgcattgcttgtttcacaggtatgtgtgtggcagcaggggaacaggggtggggaaaggaaacagcatgtcttgggcccccatatggctgtatacactataacaggtgtccactcccccggtcttataaactcagttcagatctcaagtacgggttggtggtcttccctactcccatgttgggtgtccagtgggtccccctttggacttaaggttgttctgggagggctaccaatttgtaaatctcagaagttgcttaacatctctgagcttcattttttcttttaccatatccagtgtattttatatgtagtatataaaagggaacatgtgtatgtaggagaacataaatgtttaaatttttttttccaaattaagaagaaacttgtttttcaatctttgttgcacagaaagggattcttttgctcattttatgggaggctgaccctccttagggaaaataaacatctcttctcccgttcattgagccaggctttgactttgagccacaagaatcggtttttctgttgtgtatggtttgggcaccagtttaatgggcagctagtttaccctgaatggtagccagtggcctgccttggggctctggcttttagaatgcttttgggtttgcttacttgtttccagcttctctctgtttccagcacagtttcttaccattacttcgcctatcttgctatcttttaattacaatatccaattctcataatgttttgaaaatattttaattgtggtaaaatacacctaacatttaccatcttaacaatttttaactgtatagttcagtagtgttaattaaattcacagtattgtgtaaccaatatctagaactctttttttcaccttgaaaaactgaaactatatccataaacaacaactccctattttcctcccagcccctggccaccaccattctactctgtctctatgaatatgactgctctggtaccttatgtaggtagaatcatacaatattgatccttctgtgtctggcttatttcacttagcataatgcccccaaggttcatccatgttatagaatgtgccaggatttccttcctttttaaggctgaatgatattccactgtaaagatataccacattttgtttatctgttggtgaacacttgcactgcctctgcattttggctattgtgactaatgctgctgtgaacatccatgtacaaatatttctttaggactttgctttcaattcttttgaatatgtatccaacccagaaggggaatttctggatcatgcagtaattctattttaaatttcttgaagaactgctgtactattttccacaatggttgctctattttacattcacaacagtgcacaagggttccaatttttccacatccttgcccacacttgttattgtctgttttttgatactagccatccttatgggtacccggtgacattttatggttttgatttgcaatttccaaatgattagtgctgttcaccatcttcatattcttgttggccatttgtatatcttctttggagaaatttgtattcaagtcctttgctcatttttaatcaggttatttgtttttgtttgttgttgagctgtggaagctctgaagggcattcgggtattaatcgtttgtcagatatgtgattcgcaaatgttttttcccattcaataggttaccgtttcactatgttaatgacaatttttgatacatagaagtcttttagtgtagtcagatttacctatttttacctttgttgcttgtaattttggcatctgtccaataaattcttccaaatccagtgtcatgaaacttttctgttttcttctaagactttagccttacatttaggtctaatttcgatattgttatgtctcagggaatagggaagcccaaagcgagagagaaatatggaaaatgaccagtcagtggagcagtcagaacaaacatatttatcaattaagtttgccatcttatatgggcatggttcatggtgctcccaaaacagtataatagtaacatcaaagatctctgatcacagatcactgtaacagatatattaataatgaaaaagtttgaaatattgtgagaattatcaaaatgtgacatggagacatgaagtgagcacatgtgccattagaaaaatggcaccgatagacttgcacgatgcagggttgccacaaagcttccatttgtaaaaaacacaaaatctgtgaaacgcaataaagtgaaactcagtaaaacaaggtgtacctgtaaaagacatctaaattgagaaggaagtaaaattatctatttgttgatgcaatgatcttatatctaggaaaccctaaaaactccacttaaaaattgttagaactaataaattcagcaaagtaccaggatgcaaaagaatcacaaaaaatcagctgcatttctgtacactaataatgaacatttcaaaataagaaaattccatttacaataacaccaaaaataatacttagaaattaaccaaggaggcagaagacttacacactgaaaactattttgatagagattgcattaaagctgtagattactttggatagtattgacatcttagtaatattaagttttccaatccatgaacacggaatgtcttttcatttatttgtcttttaaaatttctttcagcaacattttatagtctttcaccactgagtatggtgtttgctgtgggcttttcatatgtgatcttattatattgaggcagtttccttctcctcctagttttgtgagtgcattctcttaattaaaaaaaattaaagtcttgaggctgggtgcagtggctcacacctgtaatcccagcactttgggaggccacagtgggtagattacttgaggccaggagtttgagaccagcttgggcaacatggtaaaaccccatttctactaaaaatacaaaaatgtgctgggtgtggtggtgcacgcctgtagtcccagcttcctgggaggctgaggcacgagaattgccagaacccaggaggtggaggttgcagtgagccaagatcacactactgaactccagcctggatgacagagtgagactctggctcaaagaaaaaaaaaaaatttaaagtcttgcattttatcccaagcacgatgattaggaaaccaagatgaagcatctgacttggtatgatatctgttagtaggtgatgccaggtgacagagcttctggtactggccagggcagggtggcatttgttgaagggcagggctggtgatagagtgcctgtgtgcagcatgcccgcataacccatctttgtgtggaagtgcaccagtggcaaatgcctggatgacctttgaaaaaaaattcatgatgcatattttatttcctgtcacaattattactgtttctccttttctaaaaaagaaaatttctttatttgatacttttagttacggaagtaatatatatttgctttactaagtgaagcagcttggtacaaagatacgtaggtaaaattagtgatgtaaagctctttccaatccaacacaactccctgagacagtcagtgttaacaacctcacacataactttccaaaacattcttgctccatcaaatatatgagctcatttgtacatacactgatattccatttttatttgaacagaataatatttttactcattattctgcaatttgcgttttcagtttaacaatggatcatgtacattcctgcaaattagtagatgcagatctaactgcatctcttttttcctaatatcatatgcatgggaatcatacacatattgggtgttctttcagatttttttcgttttcccttactttctcttctgtcatcttatctctcatcatgcttggtaacccacgtgaattacttggtgcatatctttttatgttttcctctatccccaggtaaccatatgtgaacatataaacataaggggttgagaatatttattaacttttattaaatggtatattaaacacacttttctgtatcttagttttttcattaaacaaaacttcgtagaagcatctccaactcaactggccatagctcacattcattcttttatggctacatactgttccatggtatggacctcttattatttattcaactgtcaccttttgttttcttttttgccattaggaatagtggtataataaacgtatttgtacattctttttgtactggtatttttactttaaaaagtgttacagtgggatctcattaaaatgtacctttagcaatagctattgccagattgcttctaaaatttttttaacagttgccattagcaatttgtgagaatgcccctttcttgacatctctgttagcaataagtgctaatctttatgatttttgcatctggatggaaatgttgagtttgagcagctttctatacacttggtctttttgttcttgactttgctgggaatttcctattcattttttttttttttgcacatttttctactgagttgcttttctatcaactaagagctctaggctgggcgcagtgtctcatgcctgtaatccctgcactttgggaggccgaggtgggtggatcgcctgaggtcagtagtttgagaccagcccggccaacatggtaaaaccccatctctactaaaaatacaaaaattagccgggcatggtggtgtgcacctgtaatcccagctacttgggagactgagaatggagaatctcttgaaatctggacgtggaggttgcagtgagccgagaccaggccattgcactccagcctgggcaacaagagtgaaactctgtctcaaaagctctattgatatcagcattttatttaaaaatgtttattgcaaatatttttaggccttttatttgtctttcaactttgcttgtgatatcttttgcttttgcaaaattttaaaatttccatatagccaaatatgtatctttagtattatgtttatatgttttgtgggataagctctccatgcattcctaggttgtacatatagtcccctccctagattttcttcttaagagcctattggcttatttttgacatctagcctttccttttatgtattttagtaaaattactttgtgtaatttttacatatggggcaagtaagaggaccaaattaattttgttccaaatagacagccaaaggtgtcagcaccatttatttgagtcccaaaaacatactgaagggggcgttaaggcttcccttgtcagatgttaaaacatactataagggctactataataaaatcaatgtgatagacaaatgtgtcaatggaacagaatggagactccagaaatagatctcagtataagtaaaagtttaaaatatgacaatgcggtatttaaattctgttgttaaaagagtagtatatttaaaatatatctactttttaaaaatttcaggggaaaaaagaatttgcagagtgtgttcatttttatcaacaatgcagataaatattcatggcatttgcgaataaattccacagaaaaatgcagaatctttgctgaagaatttctcagtggcggctcattttggtgtatttcagtgactgtgacaatgacagtcaagtcatttgctgacctcacaccataagtgctgacaagtctgagggaatatcccagtgggtcacttcttaatttcaaggcactacagatgacacagatggtacaagattaattacctaaaaacaaaagaaaattgtgaccttccattagtttcttctctcattagtccatgcacacggggcatttcctaaccgaatgcagctgggcagaattaggagggagggtgtgttcctttattcaggaatgtattcatagtggcccatatggggagtgggtgtgggcagtgctaagagattctgaggaggaaggtggtggtgtgggagcatcattgaagtggagccgtgaagcagaggtaggattttaacaggtggaatggaaaaggtggccttccaagaacgtgtgtgacataagcacacacgcatgtgcaatagtttggtgaagtggatatgtgaggagagaggggaatgatcaggttaggagtgatcagccctacatgatcagaggtggggcctccagcatgggagacttacgtatagggctgagtttgttttggaaaggtcacttcgaggggtggttggagtagagtccattcagaagtctcttcataaccatgaccttatttggcctgtgctctgttgactgcccccagacagttaccatttactgagcaattccagatgccaaggttcattaggcacttcccatgcaagaacactgtggagtcagcaatcgatcctggtcttacaggtaagaaaactgagtaacgagaccagttttcactgggttatgtttattggcagagctgctattcagagtctggtctgataggatccaaagactttgccctttctaacctatgacactgtcttttacccacatgttacatctgcgcccctgccacctgcccacagtaataccagcctgacattgcacgatttctgtgaagttttgcgtaatgcagcttgcattatggttaatgcaccccatgcataattgaactgactttaaagaataaaatataaatacaaactaaaagcagatttataagtatctagaggcagcttttgtgtggtacagcatttaaggaaagcctttatcttgttgtcagcatattgccacattagccagagccagccagatgggaatgtggtggcccacttaggtcctctttaattgctcactataaatagcttaatgatgccgccataaaaggtctctgatgtaagtgaggggctcagtgtgacccatatatgtgatggttttctaggtgtctgtgtctgggaaaatggatggccgtgtctgagatggttttcactgctgaaatgaaagcttcatttgtaagccaatcctttcttactccccctcccttcagatgccattgtctccctcattcctttctgctgtcatctatggggaggttgaggttgacactttatcactctcacatgccagatagaattccagcacccacttgacctggcaccagggagaagtgcctgcctgagccagtcctgatctaagaggggccactgcaggccttcatggcatgcccctttctgcttggaccatcatgggaactttagacaccttgctttgctccagacatggatgaattttctttttttaaaaatttccagaagttattgggacacaggtggtatttggttatgtgagtgagttctttagtggtgatttgtgagattttggtgcacccgttaccccagcagtatccacagcaccatatttgtagtcttctgtctcttgcccccccccatcctttcccccaagtccccaaagtccattctgtcattcttatgcctttgcgtcctcatagcttagctcccacataccagtgagaacatacaatgtttggttttccattcctgagttacttcacttagaataatagtctctaatctcatagacatggatgaattttcttgattcagtcacaagatcatttccgccatggttgtcactagcttttttcagtccccaccctcaccctcactcctatccccagcaccgggtaggagtctcccttaaggttctcgcctgccacaggttgtagatggtgccacatcagttcaatagggcggcagcaacccagtgctccttctggtctacctgctccacccccactggaggttggcttcccacctttgtatgaaacatcccagtaaaacttggttggcttccccaccaaagcctcttttttcaaaaaggatagaatcctgtagaattggagatatgagaggtcaggagggttgcactgaaagcagagggggctactgggtaaagaccatacataataaagacccaaacttcaggggagtgtgtatagctggaagaaacaaaaacaccaatgaaacaaacactgtaacttggaggattaaagggagatagagggagtgagggagcagtgggaggcagtcctggggaggttgtatggataagctggtgggaaggaagtgtggcggggacagagggaagaaggctgccctagagatgggtgagctggcggaaaggaagtgtggcggggacagagggaagaaggctgccctagagatgggtgagctggtggaaagaaagtgtgatggcgacagagggaagaaggctgccctcgagatgggcgatctggtgggaaggaagtgttgggggacagagggaagaaggctgccctagagataggtgagctggcgggaaggaagtgtggcagggacagaaggaagaaggctgccctagagaaagagcaatgctttcatagtctggagcttgcacctgcctttccacatgtgctaaaagatgtatcacagtgtacaaagagctctggacgtggagataatggttggattctcactggaatagaaacaacttggtactttggcccattagcatgggtgctaatcagttggtgttagtgtctggtatcctttccctttatgaagaggtgatcttttccttacacataaaaaaattaataccagtgatgacatttgccattcattcaatacccatgtttcctttgcaccatggttcttctctccaaagtttatcataagtcagtaaagcgggggatactttcct

SEQ ID NO: 459 - DNA, 20001 bp, Homo sapiens
tggaaaaagattcaaaaaataaaaggaaattaaaattttagaagaagtccagtttcttaaggctgggcatggtggctcatgcctataatcccagcattttgggaggccgaggcgggggggatcacctgaggtcaggagtttaagaccagcctgggcaacatagtgaaactccatctctactagaaatacaaaaattagctggtgtgatggtgcatgcctgtaatcccagctactctgaaggctgaggcaggagaatcacttgaacctgagaggcagaggctgcggtgagcagagatcgcgccaccatactccagcttgggcgacagaacaagactccatctcaaaaatatatataatattttaataaacgcctggaatgggcacacacttccacctagaaagtcactttggtaaagcaggatgaacagatctaataagtgcctacccctaattagagtgggagagagaaagaagaaatgcaattaggttattgcaattatttgggggaaagatagagtcttgaactaaatctgttgttctagatagataaggagagacagatttgaacctatataagaagaattgaaatgattttgtaatggaatgggaattgcaaggaggaatcaaaatttctagcttaggccatgctgttcactgaaggtagacaaggaagaagagcaggtttgtgggagatgatcgtttcatttctgtctagttaaccacggaaagcttgaaggagttcttagatgatatgtataaagggtcaagaacaattggctatacaagtgtggaactcagcaaagaaactgggtgagataaagatttggaaatcaacaaaatcaggctcagggactagcagaagaaatgtggaagataagcacttacagatagaattaaagcctagctgtacaagttaactggttatagcaaacacaactgtatacaaataagaaaaatttaaaaatacttacttgaactttgacttcctgatggctcagaaggggcacaagaaagggcacaactcctgaatcaataaccatctgtatctgttcattacctccatctgtcaagtatgacagagcccaaacagtgtctacaagaatctacaggaaacacaaaagaaaaaccattttacatatttgtttgaatgctttacttgttcaacacacctcaggagtagtgacagaaaaagtaaccaaatttcaagttttagcttagtggcaaaaatatctgcttagctgattaatctattaagtagaaagtaccttatctttctttcagtgcctacctcagatcattcttcacagaaaatgagacacagaagtctgggaaaacttctattccaacttctgcatttatgtatcagacagatgaatttaaaaacaggcagaaaagtaattctccctgccctcacaaattagctacctaataatcccacagaaaaacactatttacaagaatgaggccaacacaccatactgtttcaagttcagaagagaacagaaaggtcatctatttactctactggttttccaacatatttagcaatacaatttttcaggctactaaagtaaaccaataaaagaaatgacttggcactttaacttcatctggggaaaaaactgtttgaaaatctcctgaaatgtgtccccaactgaagtataaacctggagtataaaccatgccctaggcctatcctaactttgcaactacatagaagaaaacaggcttagcgatctggtgattcattcaaggtcaaagatcttgtatgtggcattgcttggtgtcgtcacagaggaatataagcactggttgtagcttatgcaaaatcaagatgtttcctattaggtcatccaaattgaagacatcacatctttttgccctaaaataatagcaggcacctgaattcacatacccttcaaaaaaggatatagatgaataaataaaatagaactacacatataacccacaccccttcagcattactaagagtcagagaacactaaaaatttccattatctgtaagaggagaaaaaattaaattctagcttttgtctggacctcttgcctcaagactgtgtaaaagagaggacagaagctgggcctaagagctgagcccacctaccagcccatttcccactctggaagtgaggaggcctccctgctggaggtgtctgcagatgctgggtctgagaacaaagtctggctactgcccaccctggcagtaacagtaactagatttacctagaaacaggggtctcaaagcataacaccaatatgtgtaggctacaatggaaaataacccttcataccaagatccaggaaattctcaaaagagaaaagacagtcaacagatgccaatattgagatgacacacatattggaattatctgacaaggacttgataagattttaaagtaactatcataaaaatgcactggtgaacaattatgaacacatttgaaacaaatttaaagtgggaattctcagcaaaaaaacccgacatgatagaagggggaaaaaaaaataaatgaacccaaagatacatcaatagaaatcatccaaactgaataacagaaaaaaaaaaagattaaacagaaattaactctcaggaacttccagcacaataacaatagatctaatatttgtgtcttcagagaccctacaaggaaaggcggagctgaaaaaaatatgaagaaatatgttccaaatttggcaaaatagataagtctagaatcagattaaaaaatgggaggttgaggcaagaagagaaaatagaataagctcatgcatcattgcacaggtaagagacagaagtaaaaaaatatatcatttaaaactgtcaaaacagatagtaagagagcattaaaaaggtgtaagaataaaggtaaccactagaacaaaaatacaaacttccccaaataccaaaagaaaattgagaaagacaaaagtatgcttagcagagaaaaaaaaaaacacagggacattatttcacaaaatgacagttcaaatcaatctatcaacctatgtgaatgggcctaactaacctattaaaaaaaaaaaaagattttcaaattggccctggctctcaaaacaaaacccaattccacgctgtatacaagagacacacataaaacaaagaatttggaaaggctaaaaataaagggatgagcaaaagtatgccaagtaaatgataaaaagaaagctgaggttgtaaccctgttaaaagacgaccagtagaatttaatctaaaaagaattacaaagaaaaaaggatactttacaaagttaaatcccacaatttatcatgaaaatacaacagttataaacatctattaaccaaatagccctgcaatcactgttttaaagcagagaataaacacacacacacacacacacacaaatatatgtaaaaacatactaataataggaggttttaacatactactgtcatatgagggaagtcaaataggcaaaaaataaaggtataactcttatgaatatatattgaactttataccctgataatggcaactacaacttgcacatgtacaaatatcatattaggttcaaagaaaacatcaataaattacctaagtcagaaacattataagcctatcacaaggcaaaaaacttatacattaataaaatgaaaaccaaaaaggcttttctatatagaaatttaatagccttatattaaacagctcttaggtgaaacacacacacacacacacacacacacacacacacacacacaaaacagaaaaacccaacaacaaaatttctatttttcttttctttttgagacagagtctcactctgtcaccccggctggggtgtagtagcacaatcttggctctctgcaatctctgcctcctaagttcaagtgattctcctgcctcagtgccccatgtagctgggattacaggcgcgtgccatcacagtcagctaatttttgtgtttttagtagaaatggggtttcaccatgttggccaggctggtctcaaactcctgacctcaggtgatccacccgcctcagcctcccaaagtgctgggattacaggcatgagccaaaacgcctggcctaaactcaacaaaatttctaaaaagttaaaacaaaaatgccacacatcagaatctatgacatttatttaaaacagtgattaaaggaaaattcatagccttaaaaatttatacaaatttgtctgaacccatagaatgcacaacagcaagagtgagtgaacaacagtgtaaactacggattttgggtgattatgatgagtcaatgaaaaatacaaaagtaatgagataaagaatagaaaaatcatagatctaactaataaactgaaaccctggttctctgaaaaaaacaaaaaacaaacaaaaaaacaactaagaaaaagtcctacctaacttaattagaaaagagcagggagggggcacaaatacacaaaatcagaaatgataaaataacccttaaaataataaattagaacaaaaaactaccctgcacactttaatgcaagtaaacatagatgcaatgaataatttactagaacaatagtttataaaaactgaccttctttagaaagagtgcttaaacaagccaacttccatatcaaaaataaagaaaattatcatgaaactaactccacaaaaaagtaccaaatccccaaaggatttaagagggaaactatcaaatcttcaaaggtcagacagacttgatgctatataaattgttccagagtacagaaaatgaaggaagcataacattaacacctcaactttaataaaacaatagaagtataaaacttaatacatcatgattatagcaccattaactaatggtattaacataattaaatttaatattaatatttgtaattaatgtaaattattgcctaataaattgaacaaaagctaaactgcaaaccaatatcacttacgtgaatgctgatgtaaaaatctgaaataaaatattattaacagaatcacatactacattgagaaactaacatataatgatcaagtgagatgattcaaagaatgcaaggatggttcaatttttaaaaatatcattaatataagttttattaatagatttaaggagaaaataatagaattttctctacagacactgaaaaattcattacattttttcagtgtccttgatagaacacccaaaaaaggaatgtatagatatttctctaacataaaacatctatagttcagacaaaatgtagatacaattaaaaaaaattgatgaatttgattatatacaaaaagttcacatggcaaaacatcatagtcaaagacaaaagacaaactagggaagtattttaagtatggcagaactaatatccttaatatataaagaactcttaaaacctaagaaaaagaccaaaaatcctacagaaaaacagacattaaatatgactagtctgttcgcaaagatacaaattaaaatggcccttaaacaaatgaaataatgttcaacgtcattcataaaaagtaaaatgcaaattaaaactgagatactgtttctcacctatcagatgagcaaaaattttaaatgtgacaacacactctattggcaaggatactgagaaagtcactttcacttttgaatgcatactgcatacactacataatagataaaggagtcgaaaaatgtcatttaaaactatcaaaacagtaaaaaagaaaagatataagaataagggcaaccacaataaaggcaaccactagaacaagaatacaaaccttcccagataccaaggcaaaatggcacaacccttacagcagggaatttggcagtatgcaacgaaattacaaatgcatttactctttgacccagcaatcctgcttctaagaatataccctgaagatatacctccaataatatgaaaacacacaatagtcattggtataatacttttacatttgcaaaattcaggaaatggcctaaatgcctatccataatagtgtgtttaaataaactgtgtccacaaaacagaatcctgtgcaaaacaacatgatgccttaagatgtttctccattacatggtcactactattagcagaaaactatttttttttctaactaatataataatgaaattgtagactgagctcaactaatggttttcagtggggtctccatgacaatatctcaaaggctgggagaagataagctacagctgggtgttaggcaccctgaaactgcaaatacttgtagtctctaattttttatttttagagatgaggtcccagtatgttgcctaggctgggcttgaactcctgggctcaagcgattttcttgcctttgatctatattagcctttgagctatcaacctaaaaaaaaaatttgaccatttattctctggctccttatctactacataaaaagggtatgtagttctttagacaagactatatgatctagaacctattaaatctctgccttattttttccccactatttgttccacattttatgcttctatcacactttaattttatttaattatttttttttaacacagcatctcgctctgttgcccacgtgggagtgcagtggcgtgatctcggttcattgcaacctccacctccccgactcaagcgattctcctgccccagcctcccaagtagctgggattacaggcacgcatcatgatgcccagctaatttttgtatttttagtagagacggggttttgctatgttggccaggctggtctcaactcctgacctcaagtgatccactgtcctcagccttccaaagtgctaggattacaaatatgagccaccgtgcccagccatcatcatactacttttaaaaactcctttgttggttcttcttcccttgctgccattcctgaaacgccaggaattcctaagttacatttttagccctccttccgaaatacagcctcctccaggtgatctcattcaatgcccaggttttcatcaatcccttaaatactgacgaatccaaaatctgtattgtcttttgcttttggaaaataccgccactgaggaacaacaagttccaagttctactcactttatttcctaacactcaaagttttttctcccttaacgattcctattattgcaatttagtaatagtccatgccttcatcaacttccctaaacctattatgatagcaaaatacatctacctacagtcaaactttccctacttcaaaccttccatatttgtgttatttgtctgttacagataattttatctgtataaaacaaatatcatttctcgatttaaaaaatctacaatgactctgcagtcattacaagataaacttaaaactctttaatatagaatcaaaaactcatataaaaaattagcagggagtggtggcatgcactgtaatcccagctactggagaggctgaggcaggagaattccttcaactcgggaggcggaggttgcagtgagcctagatcgcgccactgcactccagcctgggtgacagagcaagactccatctcggaaaaaaaagaaaaaaaaaaaaaaaagaatcaaagactctgcaaattaactccttagcgaacgtattaggttattatctacatgtattctcttaaacctccatgtattcttgagttcttaatatcttcccccgtgttcttgaaatgactttctctcaacctgtgaaaatcctattcatcctagttatatgacatgagacaaattacttaagtacctctgcttcttttacaacgtttgtagatgatggagataatgagagtaccaatctcacaagaattttgtaagaattaaatgggttaacatagcaaaagtgcttaaaacagtgcctggcagattttaaactcaataaatggtaactatgaacactataatctttgactctgtccccacttctgtctccttataatgctcgtctcaaatgttactttgtcaacgaagctttctgcttcgctagcaaaattatctgtgcttccataataaagcactttggtcactgctctatcttaccttttttcttgttggctttcataccatgttttatgtttatgtgcttatggtatgattttttttttcactgtgagcctatggattatactgaatatgtgatcatggtatgaaaaagcacaggccttggacctggcttcagttctcaggtatggctctcattcattgcatgaccttagaaagattatttaactttaccgagtttcaatctctgtatttgtaaaatagaagaataaaacttatcttacaaggatactggtaagataaaaggagtctacagagagatccagcacagcaatttcttgacataagttctttccttttaactctttttacatctttaatgttaaggtcttagaaggcatggtctctttatgtcttatcactgagtgtacaattcatggcacaattctggctttaagtggaataatttgtgagtgtttgctaaacttgactaatatacctgtaactacagtacactgccactttaataccccagctttcacataaacacaaccaacagatggtgaaagcttttatttgcctataattaattctataatgttctgggggaaagtcctgaggcaaacagcagatattttgcttattccccttttaatctttgctgtcagaaagcttacaactaaacttacctttcaacagcaacaactaaacttctgtataaattttactttttcctttacagatattatcttatatgtcttttgttaagtcactttatatccattttggaaataagacggcatataaacatgttttacttcattttaatgacattttaggctgtgtcaaacacgaagtgactttagctacctttaaaagattccatcctgagagcttaaaatctgcaaatgagctagagtaatgtgatacaatttttatatacaaattatattgccttgtgagaaaggtaagcaaagatgtatttctttgtcccaatgataaattacacacaattcacaattctgccacacatatacacatatgtatgtacatgttatgtgtatgtagataaagattacaaaaacacaaatatacaacaaatcagaaagagatgttagttagaataaaagaaactggatcaacactagtcaccgaaatttatccactgttttactccatggaaaagtaacaatttaccttactgcatttaggagaattttcagattgcctagatagtatcaaacttgccagaacgttgacagtaaatgcttcactaaatctgaatataatgaaaaaaaatcacctaaaaatgccttgcatttaaaactatatattcttctatactatatctaaaaagactgtagcataaaaaggcagcatggttttgtgacaagtacccaagacctgttatgagaagactttaatttgaatattgactctgacccttactagctcttccactttagataagtcatttaatctctctctgagagtccgtttcttcttattctataaaatggggggaataatatctagcctatctgttgtaagaaccagtgagattttttttaaaaagtaaggtgtttcatgaggttttaccgctttacaaatattaaggtttaaaaacactacttaataatgacagaaataaactacatatgcagtaatttctcaaaagtgagcatttttgctgtctggctgttactgcttacagatttaagctataaacctaatttaagcttaatcctatttctgaaaactgtaaatacgttgtagaaacttgacaagttgataaaatgtatgctgacacttacataaaaaccctttctgtcccatcaagagcaaaatcccacatttaagctgcttcttaacttacgtttatatctgtatggtatatgaggacacataaagctggcaaaatctgaggaaagaaaataaacaatacttaacattagttaattaatatgtctgtaaaaatgaacaactttgacataaaaagcggtaaatatggtttgtagggcgagaaagacaatgttaaatttgtctgaatatcttttaggaaaatgaaaacctgataaattcaatctaaaaaaaccaaaaacatatctcaaatgttaaactgaaatatgttcaattaacaagttaaaatatccaaataaatctggcagaagttaatgtaccttaaaataaaaacatttgtttttaataaccttctttatggcataaaatgtcaagtggaaaaaatggagatgcaaatatacagttacagctatttaagaaaagctacacttaaaactgccgtaattgtctcacttacctgcttaacgtaaaaatacgattttacttaataagctacttaagtcaaattaaagttttcaacttcacctttagtcaagaaaattcgaaccagtacaaagtacaaagctttgcttgttaaattcaggccccagagatctctttttaaaatatgggagaaagggagcagggggttgtaggaaatcacacaaaatacctttgcatagcaacaaaaagtagcaggtactagagaaagatgtccattataaagatacacagttggccaagtgtggtggctcatgcttgtaatcccaccactttgggagggtgaggtgggtggactgcttgatgccaggagttcaagaccagctggccaacatggtgaaaacccatttctactaaaaatacaaaaattagcctggcatggtggcacatgcctgagacatgagaatcgcttgaaccccggatgtggaggctgcagtgggcaaagattgtgccactgcactccagcctgggaaacagagcgagactgtctcaaaaaaaaaaaaaaaaaaaagagataacacagtcaacagtgaataaaggttatgtaggatttttttttaaaatgcaaagcacaaggatctatttacatatcaaatgtaaataaaaaagtttttactttgttttaattagtagatttaacaaaaaatatgtcacacttttaagaactccaattttgtcagtaataaattggagttaggccgtgggggcagtggctcacacctgtaatcccagcactttgggatactgaggtgagcagatcacttcaggtcaggagtttgagaccagcctggcctacacagtgaaaccccatctctactaaaaatacaaaaactagccgggtgtggtggcgctggcctgtaatcccagctactcaggaggctgaggcacgagactcgcttgaacccaggaggcagaggctgcagtgagctgagatcatgccactgcactccagcctgggcaatagaacaagactgtctcaaaagaagaagaagaagaaaaaaaatcaattggacttaaagcaaactcattcaagaacatttgcatgtaagtatactagttttgcctgtagcaacccccttttatagctttaaaccaacaatgcaatacagtaataaaactttgagattgttttccttttgtatttttctctctgaatttttatattttctttttatgcagataatcaaaaaaataggcattaggatgaactgacattctttcaggtacagtaagacactcaacttttatttcataggagtaattaaatatggtacgttacttttaaaatcttacacctgtggctgggcgtggtggctcaggcctgtcatcccagcactttgggaggccgaggcgggcagatcacgaggtcaggaggtcgagaccatcctggctaacatggtgaaaccccgtctgtactaaaaatacaaaaaaattagccaggcgtggtggcgggtgcctgtagtcccagctactcaggaggctgaggcaggagaatggcgtgaacccaggaagtggagcttgccgtgagccaagatcgcgccactgcactccagcctgggcgacagagcaagactccgttatcaaacaaacaaacaaacaaaaaactcacacctgcaatgaaatcagtatatgtattattttgtcccctgtatatgaattcctgaagtacaaacatagggaaaatataccatctggcctttacaattcttcatttacctcctgaactgtctccataggcggcgggggatccttattcctgcagagattgacaatgacccatgtgacgttccgaaggaaggtgatggggatggagggactgatgaaggacagaagaggtttgacaactcccagtgatatgacataatctctacattgaggaccatcacctacagaaatgaaaattatatttaaaaaaaacttacattcaggatgagaaagtctgaaatgtatgcaatggctcatgtgggaacactgacgttctatgtttcctcaccattagtcaaaggcatcaagtgttgtttctccagattttgatctggggaacgtaaatttaacctaccaatgctaacagcaaactgtatatccttttcaaagagcatcatcttaagtcagtacttatgaggcaagaagagagtcaacacacattaaattcagaggaaacatagtatgtaatggctatgccaatgtaggaaaaaagttaatttagattcttaagaggattcctttcaaaccacttacctataatgtttcccaaagcccatactgcttgttcacaaacattctgatgtggtgaacgaagaagtctcagaaaaagaggtactgcatctgtaataaagaaaaactaatatttatactagcaacatgttgaagagtttacagatttcagatcaaagaaattgatcaaatacacagcctggcatattgtagctggaagaacaaatgtggcaaatatctttaccctaaaaagaatcaatttcagtattttcccctagtaatagtcaagtaccgtaaccaactggcagtatctaaaggttgctatcataccattaactaaaagaaagcaacagcatgaaatccttcctataatccattaaaaaaaaaaaaaaaaaaaaaagagttcctaccccaaacatgtaaccttaaaatgtaatgctttagtctacaaaatctcaattcctgatacggggattaaccaaagaactgattaatctcatatcaggtctatcttatactttaaaataatttctcataatccttactctttacagaatgtatacattatacccatttccagcataagctagatcactttttaaaaatttcaatcaactgtgcactacctcatttttttttttttgctgtatctgtgtattacttgtattatttacttaaaatttaaattaattcagttttaacaactttacggagatataattacaataaatttacatttaagtgtgtaattcaatgacatttcatatttatacagagttgtgaggacatcgccacaatctaattttataacatttccaggacctcaaaagaaatcttggctgggtatgatggctcatgcctgtaatcctaacactctgggaggccgaggcagatggatcaccaggtcaggagttcaagaccagcctggccaagatggtgaaaccctgtctctactaaaaatataaaaattagccgggcgtggtggtgggcgcctgtaatcccagctactttggaggctgaggcagagaactgcttgaaccagggagacggaggttgcagtgagccaagatcgtgccactgcactccagcctgggtgacagagcaagactctgtctcaaaaaaaaaaaatatcatactcagccgggcacagtggctcacacctataatctcagcactttgggaagcgaggcgggcagatcacgaggtcaagaggttgagaccatcctggccaacatagtgaaaccccgtctctactaaaaatacaaaaattagctggacatggtggtgtgtgcctgtagtcccagctacttgggagggtgaggcaggagaattgcttgaacccaggagacggaagttgcagtgagctgagatcacgccactgcactccagcctggcgacagagcgagactccgtcttaaaaaaaaaaaaaaaagaaaagaaaaaagaaaaaagaaatctcatacttaaggcagtcattccacatttgttcctctgccacacattccccaagcggcaggcaaccattaaatatctgctttctgtctttacagatttgcctattctggacatttcatacaaatgaaatcatactgtgttttttggggggtctgacttcacttaacattcttcaggttcatccatgtggtaacaggtattggtacttcattcttttttactgctgaattgtattccattgtatacaccacattcactttatccactcctcggttaatgaacatttgggttagttatgaataacattgctgtgaatatttatgtacaagtgtttgtatgaatatgttttcatatctcttggtttcacctaggagtagaactgctgggtcacatgataactttttttttttttttgaggtggagtctcgctttgtcacccaggctggagtgcagcggcacgatctcggctcactgcaagctccgcctcccgggttcacgccattctcccgcctcagcctcccaagcagctgggactacaggcgcccgccaccatgcccggctaattttgtttttgtatttttagtagagacagggtttcaccatgttagcaaggatggtcttgatctcctgacctcgtgatccacccgcctcggcctcccaaagtgctgggattacaggcttgagccactgcacccagcctttgtttttgagatagggtctcactctgtcgccggggctggaatgcagtgtgcagtctcggctcactgcaacctctgcctccctggctcaagcgatcctctcgcctctgtctcctgagtaggtgcgactataggcatgcgccaccatgcaatgctaatttttaaatattttgtagagacacgattttgtcatgtcacctaggctgttcttgaactcctgaactcaagtgatctgcttgccttagcctcccaaagtgctgggattagaggcatgagccacctgtgggtctggtgagaatagtattctcaatacatgattcaatgtaacttactgccatatcacatgctacttaaaatcaccttgattaccacacctaaaattagctaagtgtcccatactataataacgtacgtggtgatatctagtacttttctaaagagcttgtgtcagtgtcatttaacaataattattagcccatcttgaggaaagtaaaatttaaaatatgtcataagctaaaaggcagaagccattcagcatcttgaagatatcagaaacggaatttaaaatcctgttatcacagcatgatgtctactccaaaagataaaactctactcttcttttaataaccacaattaaaaatttttcatgataaattaatgacggctatgaaaaagatatcggtcatcaaaagtaacttataaaagtcatcatttaaaaaatgttacaagataaaatttctttattacaaaactctacttccttgccatcattaaaacacaaaaagttcagacagtaaggaatttacttactagactgcacaacagcttgagtctgtgcagaagttcctgatgctatgttagttaatgcccaagcagcttcaaactgtaatgaaggactgtaaaaaaacaataacacatctttttagacacataactaccacttaaattaatgaatcttaagactgataagatatggctattctttgccttgtccttgaatttcaccttgttataatccaattgcctgctagccaaccctactttttttttttttttgagatggagtctccctccatcacccaggcgggagtgcagtggcgccatcttgactcattgcaatctctgcctctggggttcaagtgattctcgtctccacctcccaagtagctgggattacaggtgcacatcaccacacctggctcatttttgtacttttagtagagatagggtttcactatgttggccaggctggtcctgaacccctgacttcaggtgatctgcccacctcggcttcccaaagtgctgggattataggcatgagccactgcacccagcagccatctctacttaaaaaatctctttggctcccaaagccagtcactatgaacctgcttctttatgtccactggtattacaacatttagccagtcattatttcccttgacttcgacttcctctccacagacacatctaatcaatatatcatgtcgattttacctcttaaacatttcttacatttatataatcacccctaatatcaagtgctagttgaggccctcatcatctcactttaaccactatcacacgctctaggctggtcttaaagctagaaccccatctgtctccattacaccatctgctttacatactagggatattacaaggctgtataattttgttgaaaaaacaagatcattatattttcgaatagtaatggaagacctcacaaagaaagtgacaactgaactagcttttcaaagatggatttaaaaagaaaggcagtgacagtgggaaataaaacaggtatcatgcatggaaggatcatgatgtgtaggaacgacaaggattagatcaagagagctgaaactaactaagaagcaagtaacagggtgtttgtgcatgtgtgtgtgtgtttcaggatgggagtgaggagtgtattctacagatatgctaaggatggggcattgaaaaagggaggaaagaaaataatgttcaaatcaatggtatgcagaatggctaaaaaaggttaaaggctgatataggagagacctattaaaagacatgttggggcttacacctgtagtcccagcactttgggaggctgaggcaggcagatcgcttgagccaaaaagttcgaaaccagcctgggcaacacggtgagaccccatttttacaaaaaataaaaaaatcagccagatgtggtggtacacacctgtagtcccagctacttgggatgctgggcgggggtgggatggggggattgcttgagcctaggagtttgaggattcaatgagctgtgattgtgtcactgcactccagcctgggtgacagagtgaaaccctgtcacaaaaaagacataaaggaaagacctgttaaaaggaaatgatagatattaagttaggatagctgaaagagtacaaattcccttaagtggaataccaaggattggggggatttagtcagcaaaaattaagattagacaaaggttagggagtttgaagaaaagcctataaacagggaagagagcaagcaaggttgttagtatcaaaaggttaaagaagtccgggcaaggtggttcacacctgtaaccccagcactttgggaggccaaggcagatggatcacctgaggtcgggagtttgaaaccagcctggccaacatggcaaaaccccctctctactaaaaatacaaaaattagctggacatgatggtgcgtgcctataatcccagctgctcgggaggctgaggcaggagaatcccttgaacccaggaggcggaggttgtggtgagctgagattgcaccactgcactccagcctgggcgacagagagagattccatctcaaaaaaaaaaaaaaaagaaagaaaaaagagaaaaaaggttgaagagatccaagaacaaaaggttttaaggagaatagatgtcagagatatagcaaatagtgatatacaggttaaaaagatggaacatatgagaaaatgaagtagcagagaagaactatgaggggactttaaaaaactcattaaaaatgtgtattatgaaaaaaactccatggatttcaatttttttgcaccaaaataaactcatactaactttctatacacgtctgaacatgatctagtttgaggcactaagaggggtaaggggtaagtcatcaatctgaaaagagcccctagaagagcaacatgaatcctgctaaaattaaagcaaaaacaaacatcaaatttatggtgaagcttgggtgaaataatggtgaactcactgatgtacttaaaactttacggggaaaatgcccccaaagaaatcagcggtttacaaatggttaactccttttaagaagggacaagtcggccgggcatggtggctcacgcctgtaatcccagcactttaggaggctgaggcaggcggatcacgaggtaaggagatcgagaccatcctggctaacacggtgaaaccccatctctattaaaaatacaaaaagtcagccgggcgtggtggcaggcacctgtagacccagctactcgggaggctgaggcaggagaatggtgtgaacccaggaggcggagcttgcagtgagctgatatcgtgccactgcactccagcctgggcgacagagcgagactctgtctcaaaaaaaaaaaaaaaaaggacaagtcgatgttgaagatgaaatccacagcggcaaacaatcaacaacaatatctgaggaaaagattaatcttggtcgtgccctaacagaagatgattgctgattaacagcagaaacaataaccaataccagacatcttgattggttcagcttacaaaattatgactgaaaaattaaagttgagcaaactttccccttgataggtgtcaaaaccattgtgcccagataagccgtagacaacagcagagcttccaatgaaaattttaaaccagagggatcaagatcctgaagtatttcttcaaggaattgtaaaaggagatgaaacatggctttcccagtatgatcctaaagacaaagtacaatcgaagcaaaagtggactggtcaggaggaaaggtaatgactaaaaagtttttggggatgctcaaggtattattcttgttgaccttctagagggccaaagaatgataacacctgcttattatgagagtgttttgagaaagtcagccaaagctttagcagaaaaaagcctgagagagctttaccagagagtctttctccaccacaatgtttctgttcattctgctcatcaaacaagagcaattttgcaagagaatcaataggaaatcattaggtatccaccttacagttctgatttggccatcttgtgacttctttttgtttcctaatcttaaaaaaacaacctgtaaagggcatctagttttcttcagttaatatcatgaaaaagactgcgctgacatggttaaattcccaggaccctcagttctttagggatagacaatggctggtagtatcacttacaaaagtgtcttgaccttgatggagcttatgttgagaaatcaagtttatatatttattatctttcatatattttattgtcttttgattccacttttccacaaacttttaaaatttcccctgtatatgatgaattctagcagaaggcaggaaataagatggtatatcagaggcagggaagaagtaaaaaaaacagtaagatcaaaaacagtaagacagtatatgttgcctcagactggaaggagaaagttattaagctggttaggtggtttggcaaaatactgggaatgggggacttaaatgagaaaatggataaatgtaaaaaataaaattataaagccaaagaaagtctttcaagatgtcatgtggaaaaataaaaaaaaatgagaaaagatatagaaaaaacgagtgcaataacaaatggacatttatggccgagtgcggtggctcacgcctgtaatcccagcactttgagaggccgaggtgggtggatcacaaggtcaggagatcgagaccatcctgtgaatggtgaaaccccatctctactagaaataaaaaaattagctgggcgtggtggcaggcgcctgtagccccagctactcgggaggctgaggcaggagaatggcgtgaacccaggaagcggagcttgcagtgagccaagattgtgccactgcactccagcctgggcaacagagcgagactcggtctcaaaaaaataaataaataaaaataaaaaataaatggacatttatcataagtttgacattgtgtagagtgctttgtatgtattatttccattccttaccatcacctaatttttatagatgagatagctgaggttcaaaagcca

SEQ ID NO: 460 - DNA, 62469 bp, Homo sapiens
tcaattttggagcttgtttctggttcagtcttgggaggatgtatgtgtacaggaatttatacatttcttctaggttttctagttgaagtgtatatatgtgtttataatattatctgatggtcatttgtatttctgtcaggtcaatggtaacatcccctttgtcatttctgatagtgtttatttaaatattgtctcctttattctttattagtctagttggtggtctattttattattgcaaaaagctacttctgtatttgttgatcttttgataaggctcagaattgcctgccaccactgcctggcttctccctgctgtcagcactggccctgatcttggactaaagttgagcctagcccaggagctataaacagtgggaggcagagacccaagtggaagggggtgggtaaggtccccccttcaagccagggagggcctgaaggctgggggctaggctgacagttccaccaaccagagttggaactgctgccttttccaggccacccatgggccaatcagcatgtactttctctcctctgaggcccataaaaagcctggagatttttatgctcagccagagtggagcagataatgagacaaccagcatcagagaggagctaccctttctgctaagagcttcagagactggcagagatctgcagagaccaccaagacctttagagtcctgcagagatggccgaatgtcctctgcagagaggagctaaccactccagggcctcctctctgctgagagcagtagaccttgagatgaccagcgagcataaaggagttaccctctccagggactcctctcctgagagctgaacactcaatggacaaattgcctgcccacagaggagagctacccactgtgggtctccttctgagctgttctgacactaaaatagagctcctcttcatgttctttacccttcactgatctgcgtacctcattcttcctggatgcaggacaagaactcagcaccacctgaaacagacgtttcggggaaagaaaactgataccccaaagatcccataacattttgggggctcattcaggatctgcggaagggtgaatgaaagtgaatctgctctctgtccttttttttcagagtctctaaactccataatagtcaagatgaaggaaaaatactgggcctttgtcaaccagttaaaagtgactagtgtggttgccagacttaagacacagaggataggcttgctggagagggcaatgtcaatcattcatcacattcaagcactgggaatgttggctttgttccaacccagtttcccttcacagaggtctagcaattgcatgagactgaaaggaggtcctggggcaactgagggtatctggcccagcctacacattggtgttattgaaaggctaataccctggattaactccagtccctgaccacccattagagtgttatcactagaacctccagtagaacctccagtctttctctctttccttccttccttcctctccttcttttcttttatttccttttattttctttctttctttctttctcccttcctttctttctttcattctttcttttgttatttctttctttcttctcttcttttgcaactctcatggttcttatttctttatatacaatgttaaatgttaaagatgttgttgcaaaccacagacattactaggtataatgagcatttgacttaattatcaggagtaggagtgtaaatgagaacggtatggtgtctattcttacaagcaaggaggatacaacagttgagcgttttctttccccctgttgaaagaacccacatgcaaagggcaagaggtattttcctcaggcactttcccctcccttgcacttaagttgttgttttgggaggcatcatgttaagccaggttcccaatttccaggactctctttctctcacttggttgagaagaacctggtctcacagcttcacttgcttatgataggaaagcaacggagaggctgtcctgtcagttgctggatgcaatcttccaacagccacctgggactaatagaatgggtctatgcactctcctgaggcacctttttttctgaagctttggtttgaggcctcagggaaaaaaaaaaaaaaactaaaaaactaaatctgaggggtccagaggcaagacagtggaggtctaggggcacagcgcaggtgagcatgactaactcctgctgatttggccctcccacttcatggatggaggtcatgctcacatccatggcatagataaggtctagggaactcaaagattactgacagtgaaaagcctgggatcttctcaggtgagtgtgaatattcctgcaagctattcctcctgcttcataaatgacagttgcatctgcacccatggttggcacttgcacaggtcaccaggactcagggatatgaggtcagaagaagagagatacgttttcttcttccatcacatatcctgggtattcactggaaagtgagaggaagaaagggacaccttttcttctctccgtcacatactctgggtatttgctgggaagagagaggaataaagggacacctctttccccttttttcagatgggtatccaaccattttcagcctgcacttctcttaagtgcatcctaaatcactgggacccctttgaccctcagatactagagagagagggaaaaaggctcctttctttcctctgtcctctcttccagatggatcaccaacgatcttaagcctacactcctctgaagtgcatcctaaatcactgggactactttggctctcagaatctggagaaaaagtgcctcacattcctttgcacaaaggtgtggctgaattatgttctacagggaggagaagcttggcctcaggaaggaagaattaatttcaatgccatcctgcagctggatcttttctgtaaacatgagggcaaatgtgcaagctttccttgcctagtggggtaacccacacctttgctgatattgtaggattgattcagctctcttagcagccatcttaggagaggctgcaaggggcagtcccagggaacttgggaagcaaacctcataggtacctccagtgggggaatcaactccctctgctcctccctgtccaggctctcctccaagcttgtcccatcctagaaatcctcattttagtcaggtcccagtctcattccttccccattaaagttccattaagggtgaatatggccacattaaagtccatgtccccttttctctacaggacttaaagcaaattgagggagaacttggcaagttttcagataaccctgacaggtatatagagctttccagaacttaacccaaatattttaactcttctggcaagatgtcatattacttttaaatcaaccctgactactgctgaaaagcaaggcatcctgaaagtggcagataatttttggggatgagctttgtatctcatatagggccagggaaggggatgacaccttcccaattggaagaattagcagtaccatgggagaatcctaaatgggaccccaatgatgaaatggcagaatggaggaggaaacactttcaggtgtgcatgctggaggtcttatgaaaaactaggacttaagcctctctattactccaagctatccatgatagagtaggattatgagaaccccattgctttcctggaaaggctaagagggaccttgataaaacatacctttctatttcctgattcagtcaagggacaactaatccaaaaggatacgtttatcacacaggcagcccctgacatcaagaggaagctacagaaataggatataggaccggatagtactttacagaacttcctgaaagtggccaccttggtcttttacaatagggaccaggaagaagtccaaaaaacggaaagaacgtaaagaaaaaaggcagaggccctaatagctgcctttcaggctcacagaaccacacagttctcaagatgcaactgctaactactacaaatgtggcaagccagggcacattaggaaggactgtccagatagcaggagaaaaccacctcaaccctgtccaatttgcagtggggacccatggagggcaaattgtccacagagacaccggtcactgggtccagaactagtctccaaattgtccagcaggactgatgggtgccagagctcctcctcgcagctccagtggtccagactgccattaccattcaggagccctgagtgattctggaagttcaagggaggaaggtagacttcctcctggatgcaagagcaggcttttcagttctcctttccaatacagaaccccctcctctcttagcatgactgtgaggggcatctcaggaaaacatttaccctgatattttccccaaatccttagttttcccaaacccttagttgtatttggggagacctcttgtttaatcctgactttttaaacatgcctgaaagccctactcttcggctaggcaggaatatcttggctcatatgggaaccatcatctttatggctacaggacagattctttgtctccccttcatggagaccgatattaacccagaagtctgggcaactcaggggaaaattggccaagccacaactgccataccagttgtgatccaccttaaggatcctacctcctttcctaaccagagacaatatctccccaaaccagaagttaggaaaggactaggagccatcattgataacttaaggatacagggcctcttcaaaccctgcaacagcccttgtaatactctgataccaggggtacaaaaaccctatggggaatggagactggtcccggacctcaacctcattaatcatgaggccaaaatcagaggccattactacgtgtgctattaaggatagtactgataagtttaaatgtgttttatggtccctggattgttgagataaagattaaaaaatttttaaatgtggatgataaaatttaaaataaatccacttaaggattataagtaaagcttatgaatttcaaccttagagaggaaaaatttggttgaattttttctcattattttcttatatctttgcatgtctggtaaaattttattaaatgctcagcattttgaattttaccttgctaggcatttgatgttttaaaattcttataaatactttatccactattctagggtatattcagataacttgagaaaattttgattatctggaatcatgtttttaagatatgttagatgagactggaatagtgctcagtgtaccatcactaaacagaaatgaatactgagtaatatctaccattaccacacttaccattactaaaacaacccactctgtgtaccctacccccaaaattatgaagccactgcagcttgtgtgaaaaggcattattcctggcttgttttaagagctggaagtcttatcttttccttttctgtagtacttcccctagttccattagtaggtagcttcctcacacatacgcacttacctgtgctcagcagaatgcttcaaatggaccatcttcaattacctctctctctctctctctctagcagcctgtccttcttcagtattctgtcctgcatattctagaaccatttttttctccttagattctcagcccccatctcctcagtttaggcagacttcctggctctgccttgatttctctccctgcttggaaactctcaaaacagttagctggttgttcagaggatttgattcctaaatgccaggagtcactatctatttttatctcatgtctgggtgtcttgctatttattgtttgtatatttttactattgtttgtatatttttactatgtttacgttgtttctggcagaagggttagttctagtccctgtcattaatccatcttggttgaatatgtgaatccttaaggattttaaaattaatatcatttattgtaggttgagtatatacccaaataccattgaaaatagagaaaattttaattattaaatagatgtaatggacaaactcagaaatctagtatcaaatattagagagtattcatcttttccataacacaggaaatatttaaaatattgattatatattcccataaggggagtcaaaattaaaattaaaaatatatataattataacacatttttagaaataagttttaaaagtttaataaaactccatttataaataacatttttctaaattattcacagatcaaaatagaaatcctagtaaaaatgtaaaaccttttataacaataacaatgacaataatacctattgacacacatatggaatacaacaacattcaaatatgttataatgtacaattaaaattattatattagaaaaattaagaaattctgagaattatttattatataaagtataagaaccactaagtagactcaatgtgtgcagaagtattgtgatattaaatcagggatcataaatcaataaagtagaaaaatgagacacatgaaaattaccaatttagccaaaggaagatttttataaaattacagttccacagtaatattgtgtctgtgtgtgtgtgcgtgtctgtatgtgtgtgtgtgtgagagagagaaggagagagagagagagaacataaaactgagaaacagtgactacaattgtccacaagaacaatctaaaaatagaataagagtatgttgctaaatctatgccaataaaatttaaaactacaacgaatggataaataattttaaaagtacaatgctccaagtccttgtcaaaaagcaatagcatggatatggaattctatagctattacaaatattgaatcattggctaaatctgttcccgcaagtaactcctcaggccatgtgatgaattaccggcaattctaaccaaacttgcaagaaaatgcatattccaattgtacacaaatttttacaagagcggaatcagaggtcacatttctccactcattctaggaggccaatatgactttgatacaaaaatggaatttgagcagttcaggaaagaaaaacatcatcaggttaatagaaatcatgagcagtaattcaaatatcttaaataaaacaattgtaacctcactccagtagtattaaaaaaaaatctcaacgaagctgcgtttattctggtaaagatggagtacctaatttttggtaaattgtataaataaactctattaaatccttaattaaagaaaaaatgttattttaattgatgtaaaatagagccattttctgaatttcaaaatctttttattataaaaaataaattagaggaaactaaaattaaaatgtaaatgaagttatgtacaataaattgtactaggccccattcttcattgtgaaatgatagaagtttccctgtaaacttgggtagaatacagtaatatcagtaattgctaattttattcagcattatactgaaaataatggttgacaaatgaaaatacctatagttttaaggcaaaaggattgttaaaaataatcttgttaaaattcaaaagagatagaattgtctacataaaaaaatttaaaatatacatataaaacaagaaagaatatgagggattggagcattttctaattcagaaggtaattacatagctgccaaagaacaacaaatagttgataatttaataagttgattccactttgaaaagcagtgacatttgtaagaaacaaagataaaagttcagtataaaaagcatcaaagagtgtaaaaaaaaaaagtaccttacatggaagtctctaaaaaaggcttcagtgaattcagatattcaatgaccattactacaaaatttccaaaaccaaaagtcggccattatcccctacatgaatatagattcactgaagcttttaagtcaagaactacattcttcatgaggctgtgcaagaatgagaattgactgcaataactctctgtctttggtagattacattttcagtttgatgcagacactctgaacctgtgaatgctcctgaatgggttgcacaggcatggtggtttcctcctccaatgttaccgaagtcctcgttataggctgtgactactgaacacctattggggccagctaaattctaagtgagctcgttggcattacagagttaatatcttgtattacaactggtgctggtgaattctaaatttgtctagcatgagttgaatccactgatctcaatttcatgatctttatgtgggctgcgagttgttgagattattctgacaccaatccataaatgaaatgatttaatgtcatttgtttattactacatctctggtcattgtacaattatacaaagagtatattatcaaatatttgtttaaagagtgaataggtaaaattatgccgaagttccctcaatcaaggtgactcgaaatggttgtctgacaacataatattctttaggcatttttacttttagctaattaagttaggaggctttgtctaaatacacaaaactagaattcacattcagttacattccataacatgaataaaggtcataataatgaacaattttttctaccatattttatataacaatgtaaaatttaatatttttgttcttaagtgtagagtgctaatatttgtagtatgaacagcaataaaaaagaccagaataaatggtgagggtggaataaacaaagtttcttctgataaggttttcaaccctccataatagacatggatttttatagacagagttttagaggatgtacttggggaattgctgtgatttctaaactcatacaacctttgcaaaaccttctttctatgttagactttatcaagtatcgcttagcctcacactgcggtattcatgtggccaaaaaatctgtctaaaaacagatttatgacaattttattgtactgctgttactgctttctacgtctgctaactgcctttcctgagcacttaatcagcgaagctctgtctgtgataagcattcacatatattctgtcatttaaattttaacattgcatgagggacagacgatgttatccccatcttacaaattagaacgccaaagataaaatggtttaaaaacttagtccaaggtgacacagctagcagaggtgatttgaattatttgaatggagatctatttgattgcaaggcctatgtcattaatcactgtgctgcactgacgattgtatgtccttctatatatatagggcatctctgtttaactgtttccattcccaactctatttttatagtaatacttttaaatgtttacatactggttttgcattatctactactcagatgcacacttcaatacatgtatttcaaaacaatacatgaatgggatacattctgagccttcgtttatcttagaatttacttttattcactcatacataaaaatgttagttttttttatcaacactatgatctcatgaattttaggtttgcaaaagaagatactgatattgtccactaaaagtaacagtaactaccacaacatactgtctactagtattacataacgagaatgttatttttgtatgaccactattcttcaatgcttgttttcctttttggttgcgattttgttttgttgatatttcttaaccctcaaataaccgttcaaagtattgttaggctatttccaagagtcagactatattgtttttatttcctaaaaaatgcaagttattacaatttgaatgtacatttctatctaaagctcaagagaaagcatttagttttcatatcactttgaatctgcgtttttgctatatttgttctcttctctgcatcaggaacacctactattcatttgctgaatcatctagtatgcctgtagcttaaaactgttgaattcttttacccccattgcaagtttatttgacattctgtgttgatctatagaatttataacctattctaattgcctctgactagattagcagtcattgtttaaaagagttttattcatatataatgaagtcacttgatctatcctgaatctcatcaagagttattttagttcctgtaaatgtataaattccataataatctagacatggacttttagataaacattcaaaagatagaactaaatagtaagattcaaagggagaattctatttagaatgtagttattgaagtccatattaaattcttcatttttataccacaatggggatgacagagtggaagaattgaacataaattaattaggcccttccacaattctgtcaaaccaactacgtcaggatggttggaaacatggtaaaactagtaaatttcataaggatgggccttttgccattctttatttgctgtgaagtgggctacttgatcaggaacaatgttgcatggaataccatgatagtgaataaggcatttttatgaatccacaaatgatagttttgtcacaagcattgcatcaagggaaggcctatctatatccaaagtgtttctcttccagtaagaataaaactctgcctcttccatgatggaaagagtgcaatgtagtcaaactgccaaaaggtagttaataatcatggtagagaatatcattcagggttggtctctgctactggcagatttggcactcagcagtggctatagccagatcagcctcaatgagtggaagctcatattgctgagcctgtgcgtaacctgtatccctgccaccatcaccggccactttgtctatgagcccattgtccaatggcaggtttgagtaggaaagagactggtatctaaagaatgggtcattttatccacttgactgctatatcttctactgttggggtcacccctattgaatattcacatagaacacaaatgtcttcatgttctttgcccattcagaagtctatccagatatctcttccccagaacaccttgtcaccaattttttaatcatgttccttcaaattcccttatcatagagctaaaccattggtcatagctcatacatcaatatatactcatatctctggccatctttctttccagccaaaataagcaaccgaatacattgctcaaaactctgcccactggaaagatttccctttggcattcccctttagggatatcctaggaaggggctgtagtgctcaagtttttcacttctgggtgatgctagtttagtgttcagaactctctataaagcagatctgagttttctctttcttggtctaataattgtaagaaattgcccatgaggctataaatatagtctggggaagcaaaggtaatgtagcaggcatagggaccattggtattgaggttatattttcatgtattgttccatcaaggtctgctcaaacctgatcttgtatataccacttccatttgataacagagtgctgtagtacacaccccactttatgacttgggagataaaacaatttctggctcatactggaaagctcagttgcataaaagcttggtggcccatggttaagtattctgtgtctaataaggcccagtagcaagccaaaactctttcttaaaggcaaataatcatccacagaaggtggcatgactttgtcaaaatcctaaggatatgtactgtgattcaaatatcggaacatgccaaaggttttaaatagcataactttctgtcactgacacatcaagcgccatcagatctgctgtatcctgtggccgaagtgttacagcagcttgcatggcagcctggaattttgcatacacttctcttctggggattactcaaaattagctgctttttacatcccttgttatatgagccaggatagcacatcctgatgaaaaacatgttgctctggaattaaaattagatggctggatgctgtaccattttttttttcggttgtaggaggtaccagatgcaataactaatatttcaccttagaagagctatctcaacataccctgcttcactttacctctaaaaatttctctaaggaagtctcatgaatttttgtcagattgatattacatcctctgacatagatttcttctcaatacatctataaaaattgctacttattgcttactcagtccaataggcataacatcaatattatagactaaaggattgtcttatagaagggagtttgatcgaggtctctgcagatgaaattgtagtaatcgggggaagaatagatataatctcaagcttggacagtaaaggtgcattgctgacattgccagcaaaatgcaaacagcttatggtggtcttttttttgacaggtattatgaaaaaaaatctcctagttcaatagttgcataacagatgccagatgatgtgctaatttgttcaaacaatggaaccactcctgaaaagcagctgcagttggttgagtttataataacctactgtcattccctgaaactcatcttttttcttcacagaccaaatagctgagttgaaggagacatgggggcagtcaccatctctgtatctttttagttcttgatgttaacactaatctctgcagtcctccaggagtgcagtattcctttcagtttactcttctcttagggagaagtaattctagtggcttttatttggccattcaaaactcatgcttgagccactgcataactagattttttaaaaaatattttgattataaattaacatcatacataaatattaactgaaaatttattttgggcctagaaataatagttgaaattataaaaggcctaaaaggaaataataaaaatatttgatagaagtttggcaagaacttattagataggacacaaaaaatatgaatagtaaaataacaatagttcgttaatttgtgcttcatgctaatttttaaattctcttcaaaatacaccaattacagaagatagcaggcaagaagacaaagactaggaggaaatatttcaataaatatacttaataaaattgttgtaatcagaaattttaaaattctcttaaatttcagagagaagacaagtagacaattaaaattttggagcaaatatttgaatgtacaattcccagatgttacagaaatgataaatgaccacactgaaaaatgcttaaaaccttagtcacaatagaaatataaaattaagccataatgagttagccatttcataaaggaaaaaaaaaaaggactagtgatagcaactgtcggtaagaatacataacactcaaaattttcgagtggatttgtgaaacagtaaaaacatttggacatagtttggctgtttcttataaagctaactattcacttacaatatgggctagcaatttatttcttaaatatttgaccaaaggaagcggaaacatacatctacaaaaagaatcatacagaaatattaaaaaactcttttattgataataatccctaattgtatacatttcatcaagaatcaaatgaagacacacaattagacattttggtgtatctatgtggtggatttcttttcagtattaaaatgaatgggttctgataaaatcaataaggatggttaaaacattatgctgagtaaaggaagacagttatcaaagatgccacagactctatggcatatgataccatttgtatatgtcttggaaaagccaaatctaacctatagagataaagtgtttcatttgtcacttgttatcactatgtcgggtggagaatgactggtaagaggcacacagaaacttttggggttacggaaatattctgtgctgtgattttgactgtcgtttcgtgattgtccatatatgttgcaacaataaaattatttcaggccaggcgcggtggctcacacctgtaatcccagcactttgggagtctgaggtgggcggatcaggaggtcaagagttcaagaccatctgggccaacatggtgaaaccccgtctttactaaaaatacaaaaattagctgggtgtggtggcgcgcgcctatagtctcagctactcgggaatctgaggcaggagaatcacttgaaccagggaggcggaagttgcagtgagctgagatcgcgccactgcactccagcctggcgacagagcgagagtcagtctcaaatatgtatatatctatatatataatttcattaagtgtaaactgtatcttattaaaattaaagcaaagcaacatcaacaacaaaaatgcatcagaacctaaagcaaggaaataaaatgatttatatataaaaataattaagacctcttaaatagataagctaatcctgcatccaaactacaggaacagtcttatataactgttttgtctcttgaacaaaaagtgagaagaaatagtaaatgatgatatctccacagtgtgaacaatgtggactgaggttggatggaagttaaagacccttacaaaaaccatatttagtctttgtgaataaagaaattttctaccaatagtatcattgtgattcaggatatctatatctatatctacatatagatatagatatgtatatatacagagagagtgaggaagaaggtgaatgtgaaataaatttcaccagcgttctgctgctgaagcctgaggcccctggcagaagtaagaaagaaatgtgtggcacaaaaggcagttcctggccaatggagaaaggactgctaaaggcagaaagcctcctcaagaagcaagcagattttttttttccaaaaatactaaagcaatttttattttatttgcattggtttgcttattactttttaaatatatagcaacaaacagttaaaacactccaagcctgataaggtactactaaggatacttgacatagtgcagccccaccccatcttgttatcacatgtgacagcatttcctctgaaatcttcattttcatcttcaattttgtgactgcccacccttatgatttagttagtattatgtaggaacagtcaccccaatagatattacccacctggaactgcagagtcaatgattatagtcactttcctcaaagcacagttatactctcttagttcttttctgttcatcttataaaacattagctgtcattatgcccaattttttttcccgtttgtttgttttctgaactgtcatcttggctattgaccagtggtagagaaaagttacggaacttgccaaactatttaaatattaaggtgtcaaccacaaattttacatgttttagaaatactcagaaatgtcaccatattttcatttctaactctctaggaggacaatctctgcctcatcttgcccctgcagcctccttattttactcaaccacaattggtgatttttaaaatgatacttcactaggtaaatataacttaatgaaatgaaaaatatctcatcttccaccagaaacactcataaactcatttgcacccagcctgacagtcgctatctttccttctgttacaacgggagatgtgacctaattttctgggttacgtgatttccattcatctcaaaagcccttgtttctttccttacgctcaattccttctgcatctttcttgccttttgataatttctattaacatataatcatggtttaaattcccccatcttataaataagtagaaataatgaaagtttttgtttctcagtatgtaaaataaatgttcgaagaacaggttacctagtaggggtttgctaacaactgcctggcaagtctcccagcttcattcttctcctccttcagtctgttcttcacacaaacgggagtgattctcttctatcaaagctattggcaagtaagatacagaaaggcaatgattcttctctgtttcctctctcatgagccctggttcctagtagaaagcttagcatctagtaggcagttaaaatatatttattgaataactgaatgtatggacagtcaatgtctaaaccacgtggctgctgggtgtcacacccactcgaaattccactagtgttctgctctctcaccacgcacagatccgtctcccttcctactctgctcagttatgccaatggctttacagtctagagaccctgtgtttaagcttacagaagaatatacaccaagagagttatagtggcaaagcaagaggaaaaatgaaaaaaaaggtatttgggttaggatgaaaaagataaaaaggaatatcccactcatttttatatttttaaacattaatttttccattttttttcacatcgacaaacaaagaatactcatgacgaaggtagggaaatgaggtaactgcatgttacaagagtgaagcatttttattttcccttagtcatctcaaatataatcacttaataaataacatagtatatggaattcctttaagtgctccaagcagctcgtgatataatattgtaatttattttaatatgtgaatttcctttgtgattcttggataatccatatcacagaagtactataaatataggacacatataaaagatctctgaaatttaggtgtttgggctttttctttctttctttttttataaacaatagaaatttatttctcacaattgtggagaccgacatgtccaagattaaggcactggcagatttgatgtctgatgacggcctgttgcctggcgcacagattgtcgtctttcactgtaacctcaccatgacggaacgggcaagggaactctctgtggcctcttgtataaggatactaatcctattcatgaaggctgcaccttcattacctaattacctcccaaaggctcacctccagataccatcacactgggtgttaagatttaacatacaaattttggggggacatggccgggcgcggtggctcatgcctgtaatcccagcactttgggaggccgaggtgggcggatcacgaggtcaggagatcgagaccatcctggctaacatggtgaaaccccgtctctactaaaaacacaaaaaattagcgggcgcctgtagtaccggctactcgggaagctgagggaggagaatggcgtgaacccgggaggtggagcttgcagtgagccgagattgtgccactgcactccagcctgggcgacaaagtgagactctgcctaaaaaaaaaaaaaaaaaaaaaaaaaaaaaaaaaaaaaaaaaaaaaaaaaaatttgagggggacataagcattcagtctctagcaggtaattttttaataatgtgatttttctaggtattgtaactattaatacttggtgggtttttttgtggtcactgctttttttttattatactttaagttctagggtacatgtgcacaacgtgcaggtttgttacatatgtatacatgtgccatgttggtgtgctgcacccattaactcgtcatttacattaggtatatctcctaatgctatccctccccgctccacccaccccaggacaggccccggtgtgtgatgttctccttcctgtgtccaagtgttctcattgttcaataaaattattccactttttgccccaatgtttttgctaagtttaaaatatttttgcaggctatcttatttatttgttttctgttttttcatttattgaataattctaagtgtattaatatagcagtaaggactcaaggtcagatattgtttagtggaactaactcatagataaaagttacatactgtacttcactttttagagttttctgtatttgagataaaatatactgtgacaattgactgagtaaaaacagaaaactgcattttatcagttcatttttagtagagtgatggagaaacttaaaaaaattgattctgaagagccagttatattttattggtttactatcatataaaatttgttccaaatatttattttttccaaattagacgctgtcatatatcccctctactataaaacatcactattttcctcctaaatctcagacaaaaatgttaaattatataagcatgtaagcttactgacagagtagttgaaaaaacaaaatactttgaaaagaattttcatcggtactggcagtaataacatttcctttctattcctgtactttgtggattaaaatgatgcctagcattttctacctgacagtggtgacaatgccaaattctcaaataccctcatataatacatgtttgcaatgacggttgctactattgttaattgctaaaaaattttcattaattaacagtgcaatttaattatttgattacctaactctgtaataatgtgaatgaattgtttttattttattaaaacatttgatgattataattttaaatgtatttacatctaagtcatttttttcatttgtgtgcctttttccatatacaatctggtttcattttatgggaaatgacttttatgagggtgacattaatgttaattgagttgtttcatctacttgattgtgtatcatgctgaaagtgtcacgttaatgacgaaagccatcaaaacaacaaagttattgtgttattaattaactaagattattcgttttgttttcttaattttcaaatatttgaatgcaacagtgttacatgcaaaaaatagaacatagagacctgttcctcaccactgggtaaagtataatcacttcagaaatgaagtctgacagatgctatttctggttagcatctggaaatggcatgtcaatctctgaaagcttattactcaatatcaaagaggatttagcatttaaagggaaataatctaagtcagtccatgagatcaaataaataaataaataatttcatctaaaaattttccatcccgtttgtcttctttcacctttctttcaaatctgttaggataggaagaaaaaaaccttagtctggcatactttctattcttccttacacactttcaagcgtgtatgatgtctcatgtgtgaaattttgtagttgcatatttagatgctaagatactgactatttgcattttggcgtaatacatttttggaaataagtgtgtgttgtggggggtagaactcagttaagtaattaagctatggaaataaatttataaatcagttaagataatcaaacatttataaacacctgtgtgcattgtatgatattcaacacacatagtggtttgtgactgcttcagaatttttttattaatatgctgaccaaatagaggtaaaagaacatttaatttctccaatggcctatacttcaaggacccaagtattagagacaatatctatcactcatattcattcgtatatatctgctctgagagttccaactttcttttgaattgctgcagaggacaagtatgtgttgcattttttctgtatttagattatactcctaaagtaagagatggaatcatgagacagacacagatgaggctgaagtattttaatcctcaaaatccttgactgaaacttgtccccacttcccagcaaattgaaagaaccagtctttacctgcttagcagttgcctattgttgtgtaacagattatcccaaatttcaaagcaacaaacattttcttttttatctcacacagcttctgaaggtccaaaaacaaattatgggttaactacgtggctctagctaagcatctcttgtgtttacattcgcttgtgagttggggtgaagacatctgaaggcttaactaggactgaaagatctgtttccacagaagtttactcacatacacgtcagctggaggccctagtcattgccatgtctaagataataaatagttgttgttttaaacaaccaaatatctgcataattacttatgcagcagtagataatcaaaaccaatttctttggtaccagaattaagatatgatcatcacatatcccaaaatataggagtgattctgtaaatcatcagtgggcagtagctagaacaaaatttgtggtgatagtagtgaaagtcaaaattgccttgaactgactcttggtagaattctgtacattaaatagcctgccattgagggcttactgaaagagaaagatgttatgagaaactggaggaaagaaaggcttgttacgtgtcagaaagcttagcaattcttcatatagacagtagaaatggtgcctaatgactgcatcccatgggtaagatttccagtctcaactctcttactctgtgtcataacataatttggaggaacgctgattattccacagactatgatattgatctatctggatggcaccatggtgtttactgggcctgatgagaaatgagtaacaataattgcatatgacattgtaatatataaatgtccttggaaattcaggtgcttcaacctcagtcaagtttttttggatccacttgtcatgcacatgttggcatatttcttggaaatttccttgctattaaacaagagggaaggtgatacattttggaactccaggtgaagatctcattacaaataaaggctcaaaatgcttctttgtgctttctgatttggttaagacttatttagacctattccttcaacacattaaccaggtaattaatgactgtcagttttgaattgtaattagaaaaaaagaaaggttttctaataggtataggttgtgatataaactaccttgacattttgaccttatgtctcagcagatctaatactacttactagaaatgcccagaggcagataaagatgtatatggagactgcctcaagctttataggaatatcacagaaaagacttctcgaggtttacaaaaagactatgttgtcttcttttaccgaatattttacaatttaaaagtttcatccactttgttactaagccttcgtaggttaaaatcatgaccatggggacaccaggtgaaaatatttctagagatgcctgtcatgaatctagttcaccaaaccataatatcaggcatgaacaataattattcactgtagaatgttctccctttttaaactatagttgggccttgaacaacatgggtgatagagcactgaccgccacacactcaaaaagcaacataacttttgactctccaaaacttaactactgatagcctgctgttgaccagaagccttactcataacataaacaacactttgtacgttctatgtgttatatactctattcatgcaataaagtaagtcagataacagaaagtgctattacaaaaatcataaggaaaagaaaatatgtttactattcataaagtaaaagtggaccataaagatgtttattcttgtctatgcattgggaaggctgagaagtaggaaaaggagggataggtctttctgtctcagggttggtagaggaagaagaggtaaaggatgtggaagaggaaacaaaagaggcaagcaccctcagtgtaagttttattgaaaaaaaaattactaagtggactcacacagttccaactcatattgttcaggaatccactgtagtctttttttattaaacactttttatattgtttagtttgaatgtgtcatatatttcttctgggaccctgattaatactcttcgtagtgatcaaagttataaattggtagaaagacctacttattgtatgtgtaatgcagcaaaaaataatattccaaatttgtaaagcctatattaaaaattataaacataaagtagcagatctatcatgagaggagcattttttaacacatctatatgtaattgattgttaatagaaatacagcatatttttacaatgtaattaataaacaatacatcttgggttcaaatgtcctaggaggagaaacacaataatttctcacactcatagaaaaaaaatgacaaactctcaatgtatcaagatgcaagtcaaacaataacaattaccaaaaatcataggatcccaactttttatttgcaattaaataaatggtaaatccaaagtatcttttatctacttgggtatttcttagcgattttgttttaaatttcacctgtccataattctttactttcaactatatatgggttttggaaattattttaactagataagatttctctattctttgaacttctaaaaaaaaaaagtcttttcaatcattcttctatgatgttgtgattatataatactaatagttctacacataaatatatggttaatttaatggataaatccttaattttaaatctcatatgaaatcatttaattcatgtgtgccaccactatacattttacatttttctaaaaataaatattggtgggtttctaattgtatttaattcaagaatcaacctgatttatttcttcaggcattggaacaaacaaaataacatttctatttcctgcagcaaatactgtcacctcatagtatattttgaagttcagtaatgtgatgcatccaacttttttctttttgcttaggattcctttggctattccaggtcttttttcttttcatatgaattctagaatagtgttttctaattctgtgaaaaataacagtggtagtttgataaaaatagtgttgattctgtagattgctttgggcagtatggccattttaactatattaattttctcaatccatgagcataaaatgtttttccatttgtttgtgtcatctctgatttctttcagcagtgttttttagtatttctcatagatatctttcatctccttggttaaatgcattcctaggtatttaatttatttttttagtggctactgtaaattgaattgtgttcttgatttgactctcaccttgaatgttatttgtgtatagaaatgctactgatttttatatggtgattttgtatccctaaacttcgataaaaataatttgatacatttaaacaatatgtggtgggctacaagttgcaacataaagtagtagtttagtggagaacaaatcttaaatgaggtttttacatccttgcttctttctttgctcttggtacatacagttagaatggttcagtgttagacatcactcttaggaccatgaactttcatacattggaagggaaagatgaaaagactcacctccttgcacaacactgaagcattataagaatgaaatggcaaaccaaggtttattgtccttacatagtgtcactaactaacaatttttaaatgtgatattgaactaccttctctttctgtcctggcctttcccatattttaaccaatttgaagccagctgtcatcaaaactgaggagtgattgataattctacccatgaaattccagatattgtttcagactctggtaaagagtgtaaaaatacatttaggtatgtatcaattttaaaatattattttcttatctagatctagcataattaagcattctttttgtttagtagttgatgtggcttggctgtgtccccacttatatctcttcttgaattcccatgtgttgtgggagggacccagtgggaggtaattgaatcatgggggcagttctttcccatgctgttttcatgatagtgaataagtctcatgagatctgatggtttcatgagggggagcttcccttcagaagttctttttttgcctgctgccatccatgtaagatgtgacttgcttctccttgttttccataattgtgagatatttaaatatagacattgattagagtttagaaattttctattatccctttcatttattaaggtaagatatctgagacccagaaagctcatagtgtcctagattataaagtaaatttgcataagcatttttgtatatttacttttgtctaatatattattttaagcaatcattctttttttaaagggtgataaagattaaactgatttattgttttgatatgcaataattaatgtgcatttcattaggtgacagaaatgtcaagaagaataaaacaaagtctctgactttaaagaaatcatgttttaatgacagagacagacatctcctaaacaattacaagctgaaagatcaagtgtaaccagtggcaataatttctatgagagaacaggacaaagtgattccaccaaaatataagcagtaccattcattttaatcatcagtactgtctccatttggaattctttgccaagaggtatacctacgtctactctaactcacagcaggagttccctaacaaagtgcacaaagcagctttctcttgggcaaaatattatttcacaagttcttcagttccaagaaagcatgtctccaccacattgatgctgtatatctattgtttcttgactttttaataattgccattctcactggtgtgaggtagtatctccttgtgattttgattttcatttctctaattatcagtgatgttgagctttttatcatatttgttggctcatgaatatcttctcttgagaagagtctgttcatgtcctttcacttttaaatgaatttttttttgtaaatttgtttcagtttcttgtagattctggatattagacttttttcaagtggatagattgcaaggattttcccccactctgtaggttgcctgttcgttctgttgatagtttcttttgctgtgcagaagctctttagtttaattaggctccatttatcaataaaaaagtgacatttattttttaaggaataagaagacaaatcaataatcagttcaatcacctacctttacaaaattccattcttaatgtggcacatgccaatatacatggggcattttaatattggatttctgtaagtgatatcatgaaacattatagaaacattctgcatccaacttgactcctgttggacttcttgtgcagatatcatctagctatgtcattctacaagcacaatgggtgcgacagcaatctcacttcttaaccagggacatttttttcttatagctttaattttgtccaccatttttctcattagggacagtttctgcttcttaactactccatttgcttaaaaattgttatttcaaaagcaataaataaataaataaataaaaagggatttagtttttctgaccttgaggaaataaaaatcaacaagaggtatgaaactgttcttggttttaacaggattcatcatctaagtataaaagtgacaaaccataaaaataaaatgtgtatttcccttacaaattaaagtctctttcaattggtttcaaaagacttgttccttgcctcataaaatgcatattttcaaccttgaaatataaaaatcatttttcttctttctgacagataaagccattttactttgctacaaaggatatagactacaataactgacaatcataaatatatacggcaaatgtccttgctctattatacgtatattaaacctacttaaagataagcaaagtaaaacttcagtaaatcgtggtctgatttgggtatgcagacaataaaatacttgaggcacagagtttacagaaatatgtcattatagaatttgtaatggcataaattcacttatcttacttgagtcacagatagaagctttttgagaatctcataatagatataagttctaaactactagctcactaaattatagagattgtgataaaagacataagaacattaattatttaatttattaaaattatttcaatttgaaaaatttcagccataagctattatttagcagtgatgtcacagtaaatcaattttgtaatatctttttgttaaattttattgtaaagatttttaaagtaatgcttaacagatactcaaattgttaaagcattttataaattcaattcagttatctatatttaatttatattcagaattttaaactgtactttaaactgtcctctaatgttggaagtttttaataatgtataagtttaaagcatcactagatctatttctacctgcttatgtttttcatattttatgattactattataagaacatgtataaatttgaaaattaggaacatctttgccttctaccattgccaggcattgtcattgacccataatctaacttttctataatagactataatatatctgcatagccctcactgttgttaataaaacagtaggattgtttgtaagtgatgtgaaggctcatgacaaatgattacccatatagtaaggataatttaaatctacaattatgaggcttatgtttcaaagactatattacacaggatctctgttctttcatatatctctttatccactattcaataattttagtgtcttttttggataataataattctaactttcaaatttgacatttaaactttaaaaatttaagagattaatataacaaaactatatttttagtaatattttattcccaggtttactgttgaaatgtgtcacagcaacctctagaaatttataaagcatattcaaaaatctccctagcctaatgattctttcaaataaatatacaaggtcctggacttaacaatagtttgactaagaattttttggttttattatgtgtgtgctaaagcaatatgcattcagcagaactcatactttgaccactcatacaaacatttgtttttcactttcagtagagtattcaattaattatatgagatatttaacattattataaaatagcctttgtgtgaggtgattttgtccaagtataggctaatgtaaatgttctgagcatgtttaaggtagacctgacaaggctgtgatattcagtgggttatgtgcattaagtcatttcaacttaaaatattttcagcttatgatggtttacaggacttaaccccattgcaagtcaaggagcttctgtagtgatttttgtaatgcctgagaccctaggaatacaggagaaacctgctaccttaaacattttaaagtttctactgtattatttatctatacatcatctagtaatatttcttcattctctccctcagtcattttttggcacatgtgcaatgagtaccgaaatgtcaggtgctctgtgagaacatagcattctaatgatgaaaacaaacttaggataacaaactgatgatatttcctactaaggttcatacataaaggtccatagaaaagcatatattttaaaacatattccaagattgaatgtgttgatgtgacatcatcgaattataagattaattagtttacttcactttagaatttttaatatataccctaaatagatattaaaaattgaaaggaagtaaaaaaggtataggaacttgattgaaaggtgggtgctatggtttgaattgtgttccctccaaatttcaggtgttgtcaatgtgaaagtattaatttgtgagaaacttaagatacgattatgtgaaaggacatttctttcatgaatgggatccggtgcccttataaaagagcttgatagagggagtttgtcctttttgcccttctacttttgtttatctggagaatcctgactaatacaccattgttatacacttgttagactgcatataagacaatattttaaaatattttcaaggcattatgaaaagtattctgcaatttatgctttagaaagtaaatttataccgaaataagaagatttgatagcatgaaaccaattactgcaaatcgttttcttaactacatcttgtttttgtttccatttctacatttaaaaatatataaattaagaactcttgagagtttcaaatatactctttagaaagtgaatgccatacaccttgtccaagtaagatcagatgtaatatacataagatgtgctttctgaaggtctgcccgtgtactgaacttttgaaaaatgagatctaaccaactattataataaacgaggcaatttataatgatgcagctaattataatttcctcagctcttttttctgtgttttctgctgtccttcaggacatgataattttctaaaacatctctactagatacttagtaagagaacaaacaatgtattacttgttatttcatgtaaggtactttcccaagaaaaaataaatacctagagttaagaaatcttattatttataattcaacatttcactctttgtttatgttaaatgttaatttcacaaagaaaaaaacttattttttaatatgatgaataaaatttcagataggctttaatgcaaatgttgacagtttagtcatcattagtagggagacaatttgtgggacaatgatgatgatttactataatacctattttggttcataatagaaaacttctataggtttaaagtttgtgataaacttagaataataaagaatcttgccctaaatttgaatatttcaattgtttcacagcttgggacttttcttcaggctggacctaaaagaaatggaaatatttgtccaaatttgtaacatgcatttatctttcttttaaacataatttccagagagatgcagtttctgaacattaatgttgataactatatataaaggtaatagttttctttttttttatgtaacaagcttttcatagaatggtactgagaccagctcggtcagggaaaccctaatccagtggcgctagaggaattaaagacacacacacagaaatatagaggtgtgaagtgggaaatcaggagtctcacagcctccagagctgagagccccgaacagagatttactcacatatttattaatagccaaccagtcattagcattgtttctatagatattaaattaactaaaatatcccttatgggaaacaaacggatgggctgaattaaaggaataggttgggctagttaactgcagcaggaacatgcctttaaggcatagattgctcttgctattgtttgtggtttaagaatgcctttcagcagttttccaccctgggcaggccaggtgttccttgccctcattcccgtaaagccacaaacttccagcttgggcattagggccattatgaacacgttacagtgctgcagagattttgtttatggccagttttggggccagtttatggccagattttggggggcctgctcccaacagaatggcaatactactcctccaggggcataagaaaacagagtgttggggttactcttgcaatgaacaatttagatattacaaacattatagagaattgtaatatttaatttatcctaccttttgattatagcctaaaatgaagaatgtcattaactcatttataatttataataaagtgtattataattggtcatctcattgtatatgagttccacaaaaattaataatggttattttatcatatagctctctacaacatgttataatttggaatgtttgcatttgaggaagagctaatataaataattaatgcacctcttttgaaatggaatagtttcctaaactcactattccactgtttccagtcatattgttggacacatttatagctctaattatatttattacagtgtaatgtgatgaaaactaatgagctaaccatccatctcaagaatctaggtagaattaaaaaacacgtattaaacttaaataataagttaatagaatagaaattaaaattagtaaattataaaataattcaatgtgaagaaaaacaaaatgtaattagttctttgaaaagatcagtgaaattgatattccctttggattattaaattcttaaaaagccataaatgacttaggtaagaaaaaagaagaaattcccaaagattctaaagacattaaagatgtgataagagaatacgaataactttattataagtaattttataaactcagttgaaatggacaaattcctaaggggaaaaaagaaaatgataaagcatataaattatgaataatcctacatatatttattagaaattgaatgtataattttaagaattcatcgagaaactcccaggcccagataactttatcattggtttacttcaaatattttaagaatagattacatatatttaaccttcttccagagaaaaaagagacatttcacagctcctttggtggtgtctgcataattctcacatcaaaacttgataaaaatgttacatgaaagaaaaattgcaggtcatcacttttttgaacatagacaaaataattttaaattattattggtagctgatttctggaataaagtagtccctcctcattattcaacagttttgcttttcatggtttttagtcacctgtggtcaattgtggtctgaaaatattaaacaaaacttccagaaattaatagtcttaaattttaaaccatgcaccattctgagtagtgtgataaaaacttctgctgtccccctccttctgcttggatggaaatgatccttttgtccagtgttttcatgtcgtatgcactgcctgcctcttagtcacttaggagctgtctcagttatcagatcaaaattcaatatcatctatagggtttggtactatccacagtttcgggcatccactggggacctggatctgtattccctgtggataagggaggagtacttggcctatacaggataattcatcacaactaatgtgtgtttatttcaagtatggaatactgctttttacttaaaaaatgtctgttcatgaaaactggactctactcagtggcttacacctgtaatcccagcactttgtggggccaaggtaggcggattgcctgagttcaggagttggccaccagcctgggcaacacggtgaaaccctgtctctactaaaatgcaaaaaattagcccggcatggtggcatgcgcctgtagtcctagctacctgggaggctgaggcaggggaactgtttgaacccaggaggtggaagttgcagtgagctgagatcgtgccactgcactccagcatggagacagagtgagactctgtctcaaaaaaacaaaaaacaaacaaaaaagtcaatgtcattaaaatgtggagggatggaaatgctcaatgtaagtttcagcaaagaaaatgtattagcagacacacagagagaaacagagacagagagatagagacagaacaaatgtggcaaagtcttcatctttggtgaaaatgagtagaagttacatagttgtttattgtactagttttctggattgattattttctcaatgaataatttggggaaagggcaatgtgatttgccacatcaatagaaaaaaagagaaaattttatttcaatgaatgcagataacatttaatgaaatacagtcaatatttacggtaattgataacaactttaaattgtcgtaacaaactacttgtaggggatcactgtcttaatctagtaatgggtaatatatgctgctatgggtataaaatgtaaaaccattttggaaagatgattgtatctcctaaaattaaatatacccacattatatgaccctgtaattatgaccctgtaattttacaaacccaacataattgaataccacatatcccaggctatatgcattcttttcttaacctgtggaataaaagaaacatcacaaaaatactgtgttctatttttatagctttcaaatgagggaaaatgtaaactaagccatatgggcttgttttaggaagtaggaaagggtaggaatggataaagaagatgcaggggacttttggaatgccgatagtgttgtggtttttaaacgtgttggttacatttatatttgctaaatctcatcaagctgttctcatataatttgtgcattttcttttatgcatgctatgatttaaaaaaaaggttatagaagacaaaatgtcataaaaagaagtgatgaaatacagaattgatcaagaaaaattacctcaaacctaatcaggagtataaaaatgaaaacactttataatttaaagtggcaacattgatgttgaacatgcagatatcttatgcattgtaagttgtgatagaaactgatacaactttttacaaatacaattcatgttggattaaatttagttcatatggtggcacagtattctcttggtgccactttgccagctggaaatctccatggctggaggtgcttcttctcagtcttcacttgggccactgggcttgctgtgcccactcaaccccatgcaggcttcacttggctcacagtactgccccagaccctgcgaccatcacagctctgtgctcagcctgtggctggtgtgggcatgcctcaaccagcttctccactgggcactggtgtctggatgagggggatgcagtggcagtgcctgaaaacttgaatatgccagcagccacctagccccaaggggtactacagcttctgcctgagcccccaggaagtgttacagctctcattcgtctcctccacctgcagctttggtgaatggggtcgtgtcacagctcattcggtctctccatccatggcttggcgaatggggtatatggtgcccagcaatttttttcactcttgtagctgggcgagcaagagcatgtgttacagctcttttcacatccaccatttgagagttctgggttcttgtcctgcaaccaagaagaatgacttacacagacaatggagagtgagcaaggcagaaaagaattttccttagtgacagaaacgctctggacaatgagaggtgacctgaagtgggtagcactctgtgtcagaaggggcccaaaagcaggtagctgtctttgaagctgagtctgggggttttatgggctcagaatgggggtgtgtgtgctgagtcgaccatgtacaggtctggaaaaagcatcattccattggctaaaaggaattgaggaaattttcactccagttgtggactgcacccttaagtggcagctcactttccagtcttcaggctgtctgggagttgaaggttgggtttcactgggacctgtccctgtctgcctaggaatttgtctgtttcctattgctatcaatagcaggatatctgtaagataatttgcaaggcaacattatttgtagtaaaataaataaatgcattaattaaataaaaaaacaggaaatatgttattgagaaagtcatacagtttggcattatatattaattttaaatgaactatgcaaagatgactacacatgaactacagcataacatattacatatttataaagatgagtttccaaaagttattattattattcaatatgttagttatttcatattcttatatgtgcataaaggtagaattgtaaaaccacaataaatataatgaaaatatactgtgtgtggtggctcaacctgtaatcccagtgactccagaggaccccttgagcccaggagtttagagatagagtgagctatgatcacaccactgcactccagcctgggtgatatagagacctgtatcttaaaaaaaagaaaaaatgaaagaaagtaatttctgaaaaatcaaactcataggttgtattattttctttatgagcatacaagtaagatcataaattgtagctgggtctatgtttgtagttggtgaggtgagggggcagccactgcaccgtaaaccagttggaccccagcttagataagtggctatgttcctgtaccaaactgagggttgggctgctatttcttgcggcctaataacgagatgcagatgaaatgggggaggaagagagtttttatttctgtaaccagttacagtgagaaggcctggaaattatctccagaccagctcaacattacagttttccagagtttatacacctcctaagctatatgtctacatgtaagtgtgcattcatctaaaaacataaatgattaacttcttttaatctctaagtaaggtctgaatcttgaagactttcctctgcagcctcaatacatttacttaatctaaatgggtccaggtgcttgggtgattacgcttatcttgtctcctgctaaatcatgggaatttggggatttccttcaggcctccagtaaacttgtttgtggaggcctagggagtttcttcagatccccaataaaacttatttattcataaatggatcctgttaagaattccttcattattttctcatgctttaaggctcaggaaaggcctagtcaaaactcttggtgggcttttgtttaattccagcctttgtataagggcactggcttttaatatttaacttaaccactcagtcagcactgaaacagttgttatggaggcctttggtgagacctggccttccacagccatgtgggcttctgtggtgctctgagaacagtctgcccctcctctctctcctgaagagagaagatgagcttcctcttcaacagcagcttatttaaaacttttaagaagagaagaatatccctgaaatgtttcctcactataaattcttaaaaaatgcaaagacaacaccaggaagtggaatttgagacaagttgttatattgccagagggagagggcttcagtgaatggatcacatgcaacaatgtggatttttctaccagaatattaaagaattatctcctggagcaagccgtccagtcgtgtctgcatatccaaaatataaatattatttggcaggtgatattaacattaaaaagctaatcaaatatactcttctaaaatgcatgcgttattttgatgactttggttctaaatcagcttgatgatactcattttccttctaagattactatcccatttcccaaaatctttgtaacaaagcctatttattctcaagtgtttgtttagggtttatacctgtatttatcagcagcacattgattctgtgatgcaaaagcagaggaagcctacttcaacactttcttaagtacttaattttctttgtttaagagctcaatctgactgataaggatgagttgacacctcttcaggaattaattgagaagcttgcaacaaagataagcatttgtactaggaaagagttttcctctagcttcatctatggctggagctatctcattgctatctgctaaactagtgacacaaactgagaaaacaggataaaaagacacccaatatctatatctactgataaaattgtcccaatggtgggtaagcttaatagcttcagagtaagaactttagagcaaaccaatctgacttattattatgtgttattgctcctgtgattgtggaattacactttattgtagtatgcgatggctaatctgtagtttgttagttttgttattttccttttgctgaaaaaacatgtttggctgtttcaggtgacagcaaaaggggtagtaagaattattataaataatttgttaacatgtttccaaaacaaatttcctaacaacataattagtcatgtcttctttcacttctatttggtcaatagaaaatatactttaaagtttctttaacattagaacaactgtatcactttggatacctttatttgcaggtttatatgccaatgtttttatagaataagaatacatgtgtataattttataagatatatgattttgattcaggtcatcacatggtaattatgagagcaacaaaagttgtttctgataagaatttttaaaatattttaacagattttggattttattaccccataaatctttcaaaattgttaggaaagtctatgattatatatcaaaaatatgttttcttaaggcttctgaggatgattttgcagatttttattttaaatgctctgttcattatttttaatacatgcagttttgggttaaagaagtaaaaattttaaaacatgaaaaaggtagatctcaaagccatgtttttatatatgctatatttgagaggtcttgaaattttgcgtagggaaatgaaaaaaaagttcttagtattttgattattttgtatttaagtttactttaaaaattacttctatatttatttttattgtgacttcatgggtgagctttttctgaataaacataacaaaaaaacacactgaaaaccatgaaggtgaacgaaattcaaagtgcacacatacgaaattagatataaaaataaatatgtactatttattagtatatattcctaattattagtaaatcttattttaattgctcacttaaacttttaagattacaataaagagtaaaattataattaatgagcaaaaaatattaaatgaataaaatctatattgcatagaatttgaaagctctgatgagcaattactatatataaaacctattgataagctttcaaatatatatctacatggtgaactgaaattgttaagctttttaaataaaatcttttgattcctgaatttaaaacaaattccagaagagggagatgtttactctcaaatgaaaaatgtgttgctcagtgtgaataaactggtttctataaaacaaagaataagatttatatatcatcctaaaatgtatggaaatcatagattctaacactatattgtggttaaaatttcatctttatgatgtattataggtacttttcctatttgtaggcatgttttatgtcaattgattttcttaattaaaatgtttcctgaaaatttcttaattattcaaaaatataaagatttttgttttcacagtcattttaaatagaaattaatatttaacatttgagaaaatatatttatcacgatacgtttttcagcaattgtcaataactgttttgttaaaattctttaagaataatatagaggcaatatatcataatctggaaatacttttaaattaacatgtattatttctaaatatgcatttatgtactgatatagagatagctagctgttcaatcagctcttttgtattttaaagaaaaaattatttaataagtaaaggcaaaatattttgttttttttttatgagaaagaaggaatgacaataaatataatgaaatgtagtggtattcttaattgtgaagataatatcacagcatggcacattttttatttacccagctgactagcctatgaggctcagtgctggcagtctagatcttgcagggaggacaaatatacataaaaccctatgtttggcttctccttctaaagctatcttgataagtaatgtctacttctgcactcctcctatttaatttcttgtctctgatattaagtagaaagatgtgaaaagccagtgttaatttccatgtcattggcattagtcttttgccaaatctgtgtattttcctgaagcaatgtgaacatgtaccctatgtttttcaccaggtctatttgagattctcaacattactatgagtagtaagtgggtgcctagttgaagagatttttatattgtttgtattaccttttccctcagcttcttatttaaatagcttagaactgtccccggtgtgtgatgttccccttcctgtgtccatgtgttctcatcgttcaattcccacctatgagggagaacatgcggtgtttggttttttgtccttgcgatagtttgctgagaataatggtttccagcttcatccatgtccctacaaaggacatgaactcatcattttttatggctgcatagtattccatggtgtatatgtgccacattttcttaatccagtctatcattgttggacatttggcttggtcccaagtctttgctactgtgaatagtgccacaataaacatacgtgtgcatgtgtctttatagcagcatgatttataatcctttgggtgtatacccagtaatgggatggctgagtcaaatgatatttctagttctagatccctgaggaattgccacaccgacttccacaaactagttccacaaacaagggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatggggggaggggggagggatagcattaggagatatacctaatgccaaatgacgagttaatgggtgcagcaccccaacatggcacatgtatacatatgtaacaaacctgcacgttgtgcacatgtcccctaaaacttaaagtataataataaaaaaaaaaaattcacaccggccatttttcaaagctaaggtttattttctatggctcacatgaaaatatatttccaagtgtagtgtagctagcctgcctgtttaccagattactatctatccaaacatagggaaacctttaattcaggctaaggaaaagaataaagtggttagcaagaaaatatgggagctgagagaagtaaacggcagtattctaaataaaaaacaaacacatctattaattaatactattttctactcatttgacaatgataaataaatattttttacatttctaaaaaattagcttagaacttcagaaaaattatgggctgaaatatcaatgtcagaattgttgaaaaacatataaaatatttttgtggaaatatcaaaactatactgacaataaacctaaacttactgtataaacagtgtttaagctctgtgaatcatcgtcaacagcacaaaaactctggcacctgcaccacgttaagtgcaaattatttgctagaataatgtttttgttaaaggaaacacaatattattttagatatgcttgctgtttttgtaagaaagttttcactcacagtaaaaaataattatatgaataaagttgctaatgaacttaagtgtgaacttctgagttgggcaggctctacaaaattcatgaagaaattgctattataagtgtttgtcttcaccttctttttatgtcatctttacacttttatttcacaatctacaaagaagtctctttatcctatcttaaacattcttcagtgctgtatgcatatcatgtatatcctctaattggttgttagctttccaaagaagacgttaagattcctctttcctactcattttgtacactgacggtgtccacaatcataatggaagaataatttaacaatgctaattcgatatccataattccttgagataatgcataaaaagagtataggaaaagaatatttggaatacagaagcaaaaaaaaaaagaattattcatcttcaaaatgaaaatatcattcctctcataaaaatccttcaaggactctcaagtgtattaaaaataaaatcgaaatactttacaatgacattaaatgattttatcacctgctcattagctcttaccctttactgcgtattccattcccacaacacccttaatgctctgagatccaattttgccttcctgatgaccttcatctctcacacactggcatagcattctacctttgtaattgtgtttactgcatgaaactgacaccaataattttgagataacatatagtcatccagtaaatcatctatttttttttatattactggaagattttcttttcttccttactctgtgttagttcctgtatgttgtgttttatagtccattttacttcctgaactttaatgctttcatgaccacactaaaatatttttcctgtatgttctcggtacacaggacctgtacctctccctagtattgtgtcttggagcttgtacgtactatttatgcaataatagttaattattatttgaatttatgctaatcatcttgcctttaatgttcccccaacctaaaatgtcaacccatgggacacattcatttttaaattataaccatttttcaagttcatgctcacatttccttctatcactgaccttttcaacttaactattccaggttttattgctttttctctgctgtgttcttagatatatttattttaatcattctaatgtttagtactcatgttctattgcttggtgacccatgttgtccttgagatgaaagttaggtttggaaaatcaaggacatggtattatgtttctgatgaatctctaaagatttctaggttagaactaggctgataatgtgtgctcaataaatattgatgggtttattaaaatggccatggagaaggaacagataataatacatgacaactcattttttaagatgtttttacacacttgggaacaaaatttcagctgtcttttaaaagtttcaaatgttaggagataaaaatagtgtccctggacataagtgacagacagctggctgataatgtgatgatgaatcatttgacattcttttatatttcttccttcagaactcttaataagaatgcgtgccattagtcagcaataaggaatcctgcatagtttgtgggtggatcacaaaagaagtagcaaaacaatatttattgtcagaataatcaaatggtaatattgtcaatttattaaaggtataactcagtgtagatgtctaggatccagagatggaacaaaggaaggacaatgtactatagctttctaggttgtctctataaaatgtacttgtgtgaaggtaagacattccctactcactacctggaatcttttctcctagtgcattttcacaaaattggcttctatttgccagtggggttgaagcttcaagaccctacattttttttttcttcccagcactagcttttcaacactagcagagctatcagccgtgtgagctgagataaccactctatgctgaaaggcttctgcattgctggaacagctctcagcatatggatatttttaactttgtcaaagcaaggctaatgtctatagtgatttttacaataatggacattcctacaaaaatagatgtgctcgtatttgcgcatttcctttatcaatttatgcaaatatatttcatgacagatgtaatttcctaaattttacaacttgaaaatgaaaatataccttacgttacaggttacctccatattgtttcatgtttgtaaacttagttttaatactaatgacttaccccttctttaccattcctgtgatcctctgcttccttattcaaatgttcaaacatcacgtttttatcatgatttttgacactatgcttttttatcctttttaatatcattttatccatgtttaacatgataatatttaattttatatttgaaatttgatgagtgtttttaaattcataatgcctaaaatttaaaggtcttttattatcaggatgccacagggaagacacacattttggaactatcacagtaatagctatcatagtaatacaacaactgactacagtgtttacagtgatattttcctactattaaatggagggatgtttgttagaatgggtgcccatgaggacttgccctgttacacatctagaacaccctaattgaaattgctctgaccataagcagaaatgagatacttaccaaaatgatgaaaatccttaataatgctcaggagtcctgcttacaaacgaatagattgcatgtcattagaaacaaatggttgatgcagattagattgctaggaaaatagaacacaaagttcatgtttggaagattataactagcataaaacttttatattttttcttgctttaagttaaaacagactatatcctgtgaaagattttacacttttcaaaaatacattaaatacatggtcccatttaatcttttaaaaaatgcttagcaagcagcaatttcacgatggtcaaattcctaatatgagagaagtagaaataggaaaaataggtcaccctgatacttatgttttcattttgcttaatatacgtttgtatatttcaatataacattaatagatatcgtgtcccttcacagttctaaagtagtaagcaaaatgaattaatttaacctatgcaattaaaaccaatttggaagaatattgaggtagcacactgttacgggaattagtatgactcagtaatgcagttgaaagttagtggctcctaatccagtatgaatcatggagatgagagaaatgattagataaagagatatttaaaagtagagtatcccaaaatgattaaaaaataagaaaaaaatcgagcctcctttggaatctgttgtagagatatcaacttggcatcttggcagcataaagacagtaaaatgaaagtcgtgggttttaggcatattcaccaaggggagtgtttagaatgagaagaaaagataaacaaggaaagtacattaagactttttaagatgcggagaagagaaattaagtacatagtaaggataattcaaactttcagaggaaaagaataaatgtatttacatagaaatttggtagaaagtatttcagtgaagaaagatcaatgatcaatataacaagtacctacaaattagatgcagagactaaaaaaattatccactagattgtatttccagacgctaattgcaaatttagcaactacgtgtggaaggttgaataaaaaataaacccatagaattagagagcatgtgtgcaagaagtgatttctgaaaatttttgaggaaaaggaaagataacaggcgctagagggagactaatatcaaaataagatgtataattggcagaaagaaatatgctatctcattgaaattatggttgtgaaggatattagtgagaaaaattaaaataaattaaggtcaggtctaacaagctggaatgacaagtaatgccaagtgcaggagaaaagattaaggagtaacacttgtgttgttacaggatcgagaaagagaagaatcagtatgttagaagttgagatatatttttaatttcacatgaagtaagatgtaatgctaattattaagagtttttggggtgataagagaaatcttggttttgaagataatggaaaggatttgaagtgctaattatttataaatagagaaaattgactgtaagaattatggaagttgaggtataattttgattaatatttactgtacgaccagtatgccaaacattgctcaaactcctgacctgatacaatgatacatagcatagagagaagtgtctctgaacttcataactacataactcgtgtccaagaatacacataaagaaatatatatgctgtgatctagggatttaaatgacatttggtagaaaagaaagtggctttgtgtttgcatccgaaagtctgctttagtggtagaagataaggagaatttaactaggtgaatctagaatattagaaaaagatagtaggagagtaaaaaggggatggttaataagtacaaaaatacagttagatagaataaataaggtctcatatttggtagcacgatggtgtgattgtaatgatttactgtatgtttttaaaataactagaagagtgaaattagaatgttctgagcacaaaaaaatgataaatgcttaaggtgatggataacccaattactctgattttgtcattacaccttctatgcctatatcaaaacatcacgtgtgccatacatatgtacaactattatatatacccataatagttattaataaaaatacaaaaataaaaaagaaggaacatcatatatgacaacccagaggtgactggcatatgtgatggcccagaagttcagcatgatataagaataaagagaaagggagggaggaaacaaaagtattttgggacactgttgtgatgcatggcagaacatgcaagaaaatacaagtttttacaaattgtttcaacttatggttaactgtatggatcaatataaaatcagttagaaactagtattatggtttaccataataagtgaaattattggacttgattaaatgccaccagaattgctttggtaaaatgattaaaatggaacaagccaaaaagtgaagagactgatcgtggcattctatggtattcaaggtgagtgatgatgatagcctaaattttagaaatgtggttatagaagaaaagagatcttaacatttttgagatatcttcaagaaaactttgtgatttattgacttgggagtatacagtaagatagcatcaaggatgagtctaacaaattgttagttactagtcaaaagctgttgccattctaactcagagaaacaagagcatattttggaaggcaattatgagttaagtttttgatccactgagattgatattccatttgaacatccaaaaaattatggtaaataatttttggttgaaacttttatttcattgtgatgtgtttttgcttttgtttgctttgttttcacccactttttaaaaatggaaacagtttattgatattgttgaaatattttatattttccaattattattattactatttttgagatggagtctggctctgttgcccaggctgtagtgcagtggcacaatctcagctcactgcaacctccacctcccaagttcaggtgattctcctgactcagcctcctgggtagctgggactaaaggtgcttgcctccatgcctggctaactttttgtatttttagtagagacaggctttcagagtgttagccaggatggtccaattaaatgtttaatgtttcctggtattctatttttttaaaaaaaattattccttttctctgttttaccatttattttttctatagagatatatgtcaataattaatgctgttatatataaatagattaatgtttcatctgaaaagaaaacaacttttatcattttcaaaattgttaatataataggttatttcactgacagtatcaaataactttccctttgaaaggtaaaggcatacttaaaattcatatttattcctctattttatcattatcattctctgggattttacataccagctattaataaattttacatttgttatttgctatttaaaaccagaatttctgtttacattaaatatgtaacatattacaaataatatctacccaatgcagcgtttaatttttatacttgagattcttaaagtcatagttacttcttccaatttattattttaagatgaaaatcactcaccactgaaaattcagaaatgttaacattaatcatatttgtatatatgaaccttgaacaaatgacattaagttaaaaaagtgagaaatgaaagagatattttatgataccacttacataaaatatcgagaattggtaaatacgataatttagtggttgctttcaatggcaacattggtgtttgctgggtgctagaaatcagaaatgtttgaagtgtatatttataaaataaaatatttttatttcaacagcataattctctttattttacatttctattttttttcaaacttcttcacttggccacttttgctgtttactactttgaatactgttttaattttctactttagttttcctgaactcttgaccttttcctgaattataagtattttgtcattatctcattatatcatagattttatataatgaattatatatttttaataattttattgagaaacaaaagctgatgtggaagcagcttggagatttaccaaagaacttaaaacagaactattatcaacatagcaatcttattattatcacatatatatcccaaaaatctaagttattctaccataaagacatacatatgcgtaggtacgttcactgcagcactattcacaatagcaaagacgtggaatcaacctagatgtccatcaatggtggactggataaagaaaatgtggtacatatacaccatggaatactatgcaggcataaagaagaacaaaatcatgtcctttgcagcaatatggatgctggaggacatcattcttagagaattaatgcaggaacagaaaaccaaataccacgtgttctcatttataagtgggtgctaaacattgagtactcatggacacagagaaggaaacaatatacaccaggtacttcttaagggtggaggatgagaggagcatgatgattgaaaaactgcctatcaggtactgtgaccattacctgggtaatgaaatatctatatacctaatccctgtgaaatgcaatttacccatgtgacaaacctgcatgggaaccccctggaccaaaaataaagattggaggagaaaacaaaaaaagcagatgtatcatgagattgtatttacttttgttaagtgtaaacacttcacaaaagtgttgtgtttacttttgttaagtgtaaacacttcacaaaagtgttgtgtttacttttgttaagtgtaaacacttcacaaaagtgttgtgtttacttttaagtgtaaacacttcttttgtaatactcttttgtagtatttttcaactacaccaaaaatactgctttctttcctttttactaagaccactcaccccttttgtacaaaatagatattcccagatctgcttcgtacccgataacatcttttagcatataacttatctttatatattactgctctcagatcttgatgtaaggggctcatcagtgtttacagacttatctgatatgtttttattgtaatggtgcatgaaatattccaaacttcagactatatgatttacacaatgttggaagatgggaaactttcctgcttggtgatttcacattcaaaatataacattctacatcatctattaccaaatatcaaaattatacttattgaaaatataattccagaatgaatgcatagaaggatgtaaatgagagtagtggatcagagtggtaaaagggattgagacaattctgaatttttaaagtaatcaaaacctccctttaaaggtaaaacctcaatacagctttagttggctattcatagtggagggagaacacaaacattgtattttcttgtattacaactaatcttctgtaacaagattttttcacttgaatatgtatttattattatcaataagtccttttgacaaacagattaccaagtaaaatcacttatttcaaaagttttgaatagattgccattgtctgtaactcctaaatatttagatgttggcagatggtgaattgtgatttggtttgcctaaaaatgtgaactcaatactcatatgagttttttattataatttgattatatatgtcttcttattctaacagatataattttgtcatacttttgttattgacttttagtagaaatatcatttataacatgcttcctttcttaagactcatattgcttattctgtttctaggttttacgatgggagctgcaaaagtgtgctttagaaaatgagattttgatatatttgcaaattacattaaatgtgctcctgtcaagtacagctaagaattcctgaaaagattattactttggtcacttgagtcttctaaacacacaaaaagcttttaatgtgcccactgaagatagattatttcctctgaagaattgtttttacaattgcaatgacttttagttcttagacctgaaaattaaaactacctagctgaacaaaattaagacattaaaaaaataagcattatgtcttacattattacaaataagcactaaaatagtattgaataaaataatatttaaatacacaaataagaaatctcatggtctgctaaatctatctgtatatttatttatttatttataataaattatataattccacttaaagtaaaattccactggatatttcttagaatatagtaattacaaaggagaccgtagaaaccttgagaaaatgatgcaggtataccttagagatttacctatagaagcgtgggaaaacccactatatcttttttcaaagacttaagcttctgttcaagaattattttctatttaaagactatagtcaccaagggaaaccaaaacctggtattaaaagaaagctgttccatgttgtgtttactgccagactgttgttcggaaacattttgtctaccaaaatgagtaacttcctttcaataaaccacatcaattctaatgtagctctttccataagcattagctatattgttttcaatattttaaagaagcataccacttggttcactgttttctctttatttattacttgggtccccttctttccttcagtactccaccggcatcaatcacccaagcccctattaacacataaactacaagcctgcctcaaaaatactgtggctcagttttaaaccacctcaaaaaagtgagtcacatacatttttttttggtttcccagtacatataaaagttgtttacactatactgtgtctattaagtgtgccacaatattatatctaaaatgaacaaggtatatatcttaatttttaaaatactttattactaaaagaatgctaacaattatcagagtctttagcaagtcagaatctttttgctggtggagggtcttgccttgatgtcgatgactgctgactgatgagggtagtggtttctgagggctggcatgtctgtggcagtttcttgaagacaaaagtgaagtgtgctatatcaattgactctcatttcataaaagatttctcttagcatgtaatgctctttgatgccactttctccacagaacttttaaaattatagtcagtcccctcaatccctgttgctgctttttcaagtaagtttatatatcattctcaatacttgattgtcattatcacaatgttaactgcatcttcataaggagtaaatttcaagaatcactttatcatccataagaagcaaatattcattgattcttcaaatattatcaagagactggagcaaggcagtcacaacttcaggatccatttttaattccacttctctgtttattttcattacatctgcagttacttcctccactgaagttctgaaccattcaaattcatccttaagggttgaaattaacttcattcaagctcctgttcatgttgatattttgaccatcttctttgaataacaactgttcttaatggcatctagaatggtgaatactttccagaaaactttcaatttactttggccagatccatcagaggaagaagtatttctggtagctataggcttaaaaatatatttcttaaaaaatgagacttgaaagttgaaattacttctcatttcatgggctgtagaatggatattatggtagcagatatgaaaagaagcttcttgtatatctattattagagctcttgagtggccatgtgcattgtcaatgatcagtatattttgagaatacttctttctgagcagtaggtctcaatagcaggcttaaaatattcagtgaaccatgctataaacagatatgctgtcatccaggctgtattgttccatttatagaacatacgccaagtagatttagcataattctttagggctctagaattttcagaatggtaaatgagtattggctttaacttaaacttaccaactggttatttacccacaggaaaaaaaaacaataacactatatcaaagggatactaacactcacaagtttactttagcactattcacaacagcaaagatatggaatcaacttaagcgttcatcaagagattaatggataaagaatatatggaagatatagtcaatggaataatatctagtcacaaaaaagaataaaatcatgtcatttgcagcaacatggaaggaattggaggttattatcttaagtgacctaagccagccacaagaaggcaactatctcatgttctctcttttacatgggagctcaagaatggaatcacatgaaggtagagaggggaaacatagacaacaaagactgagaagaatgagtgagtgggaggggagagaatgaacagaactgggttaaacagtacaaacatacagtaagataaaatgaatatattcaatgtttgatagcagagtagggtgactatatgtaacaaaaatgcaatgtactctagtgacagacatcctaaatactctgacttgataactacacattatatacatgtgacagaatttttcaagtatcccatacatttgtacaaaaaaattaaataattaagtcaccagctacattagcccttaacaagggagtcatccagtcatttaaagaatagaagccagacattgatttctcctttatagctatgaaagccctaaatgacatcttcttccaatagaaggctgttttctctacattgaaatctattgtatagtgtagccaccttcatcaattagctagatcctctggataacttgctgcatcttccacatcaacacttgctacttcgcctttcatgtttatgttatgaagatggcctctttccataaaactgatgagccaagtcggctagctttgaacttttcttctgtaggttcctcatctctttcaggcttccagaattagagagaattagggctttgctctccattaggttttgacttaaaggaatgttgcagctgttttgatcttctatccagactactaaaactttctctatatcagcaataaagctgttttgctttcttacttttctagagaaacttttctaattttctagaaaaacttttctttcacaatcacaacttggctaactggtgcaagagacctagcttccaacttgtcttggctgtcaatgtgccttcactaagcttaatcatttctagctcttgataggaagcgagagacatatgaatcttcttttcatttgaacacttagatgccattgtagggttattaattggcctaattttaatatttgtgtctcagggaatacgaagacctgagaagaagaagatcaatgtaggaatgattggttggtggagccatcagaacacgcaatatttatctattaaatttgccatcttgtatgaatgcagtttgtgctgacctaaaataattacaataggaacatcaaaaatcactgatcacaggtcactgtaaaagttagaataataatgaaaaactttgaaatattgtgagcatgaccaaaatgtgacacagagaaataaattgtgcactcgctgttagaaaaacggtgctgatagatttgctgggtggagggtttcctcaaaacttcaatttgaaaaaaatacattatctgtgaaatgcaacaacatgaagcagaataaaatactgtatgcccccaggtagatttttggttttttattctttcacactttggcttgtggtcatctgattatatatatggaaatgtgtgtcattactcatctcatcaaaaatgtgacagttattatgcacacatttctgaatttatcactcaatgctaggtgtcattgctttaatacattggtaatggtccaatatatgctttgaaattgttttagaaaagcattgaccaattgatattttattatttgtagtcctctttttgtgatcgcaaagtatgtgaaaataaacatctttgaacttctcttctcataaacaagtgtgttttttactcttagggatgggttcccagaaatggaattgttggaacaaagtgtacacgcaattttaatttttgtagatgttgccagatggctttgtaaggttttttttaaacaattcacatctcttctagcattgtaggagagtactttaagcctgcattcctgttgacaatagatgttattactcatttcagttttgtcagactgatatgtgtaatgtgatatctcattcttacttcaacttgcatttccctgactagcagtacatttcagcatattttcatatgtatgctggtcatttgaatttgctgttatatgacttgcattttcatattcctgcctttttttctattattttggggggttagtcctttgtatgtaacacacgttgtgtttatattacaagtatttttaatttaaattcaattgcttttctgttaatcttctcagtattactttttctaaataaatacagtctgccttttaaattacagggttttttttagttcagaatatactaaactcccctaagattgtaaatgcacattcaggaatatttttgtagggcttttattttttaaagcatctatttttctattctaagatatatgcccaggtttatactatcaaactttattttacaaatttacttatcttgcacctcttgcaatcggcgttactatcttttaaaatatttggtacgattgtctggtcctggagataacatttttggagagaattttagttacagattcaatttccttagtaagagtgctttacagttttatgtttcatactgaataagttaatatagaatatacttctctaggaaataatgcctttttactaagttgtcttatttatatgtgtaaagtttttttgtagtattcctttttaaatatttacaattcataattctctattttattcttagtattagtaatttgtgtcttgtctcttttacctttgttagtcttcttaaaggcttgttagttttactgagtttttcaaagaactggctttctgtttaatttttattttctgatttttttctattttcatttttatgattttcttcattttacttgatctgggtttagtttgcccttttttctagtttcttaagttggaaacttaattatttactgtagatttttctaatataaacataatggagtaaatatttttctcagcaataccgtagttataaaccacaaatctggcaacttcaatatttattttcattcactgttctttttaaatatattcaaaacttcctcttggaccaacagtttattaagaagtgtggattgtttggtctgtcattaattttgacttggtaattatcaatcaagcatcaataaacatttgtgtggagctttttgtatggctataaattttcaactcatttaggtaaatatgaggagcacaattccttgatcatatgatatgactatgttaagctttgtaagaaactttcaaaatgtcttccaaagtggttgttccattttgcattcctaccagtaattaaagagttcctgttgatcaatgtcttcataagcatttgaaattgctagtgttttggggtttaaatgtagatagagtaaaatttgttttattttttttaacttaacttcagaatgatgtgatgttgagcatcttttcatacacttatgtctatttgtatatctttggtgaaatgaaaattcagaattgttgtgccccttttaaaattaggtgttttgttttctcattgttattgaatttaaaaggctctttgcttattttgagcacactttctttatcagatatgtgtcttgcaaatattttctccaagtcagtggcttcttgttttcttctataaaaaatgtattttgcaaaacagaattttaaaattttaatgaaatctaactgaagtttttgttctttcatgagttatgcttttggtgtttttgttttatctaaaaagtcatcatcatatccaagataatctatattttgtcttatgcaatcttctaagacattctatagtattatggtttacaaactctgtggtaaattacttaaacatataaaatcttgccgggcatgatggctcatgcctgtaatcccagcactttgggagacctaggtgggtggatcatgaggtcaggagtttgagaccagcctggccaatatggtgaaaccctgtctctactaaaaatacaaaaaaaaaaaaattagctgggagtggtggcatgtgcctgtagtcccagctactggggaggctgaggcaggagaatggtgtgaacccaggaggtggaggttgcagtgagccaagatcgcaccactgcactccagcctgggcaacagagcaagacttgccccaaattaaaaaaaaaaaaaaaaaggtacaaaatctgtgcctagattctttttaaaaatgtgcccaattattaaagcagttttttatgaaaagattatatttttctccattggattgctctttttttgtcaaatatcagtttattctatttctgggctctgttttctgttttcattgttctgattgtttactatttctgcccatatcacattttatagattactgtagctatacagtaagtctggatatcaggtactgtcagcactccaatttggatttcttaaatagtgtgttagttattttgggtcatttggcttttcatatacattttagaatcttttctgtttgtctgtgtttaattttttatatccacaatgtaagtacttgggattttgattggaattgttttgaatctatttgtcaattgaagaaaatgaacagccttaaatctttctatgcatgagttcgaaaaatctctccaatgatttaaaacaaatttgatttctttcctgagagttttgtagtttttatcatttagatattgcccatatttttgttagatttatacccaaatcaccctcttgtttcttctttttatttttatggggaaggagtggggaaggtgatgctaatgtaaatagtgcttatttttaatttcaaatttaagttgctccttgctggtatagaagaaatcacttgacttatctatattaaacttgtatctgcaatcttgctacagttgcttacttttaattaattaatttattttaattgataaataaggtggaatatatttatcatataaaacattatgttttgaaatatatgtacactgtggaatggctaaatagaatttattaacatatgaattacctcacattctttcattttttgtggtgagaacacttaaaatctactctcagtgatttttaagaatacaacacattgtttttaattacagtcatcacattgcacaatagacctcttgaacttatttctctaatgcgaatgaaattttgtatcctttggccaacatctcctcaaccatactccctcccacaaccgcagcctctggtggccaccattcaattctgtggcactgtgagttaatatttttaggttccacataaaagtgaggtcatgcagtatttgtctttctgtgtctggcttatttcacttaacattatgtccgtaatgtcctacggattcatctatgttgtcataaatgacaggatttttttctttttagaagttgaatagtatttcattatgtgtgtgtgtgtgtgtgtgtgtgtgtgagtgatacatataaatccagtgtgatgtaggatttttcttctcagccactttgcaagctgggacttctggccagcaactccctgcccaggccctgctcagctacagcggcatgcccaaactcaactgtgttatagcttgtacccatgttcgacggtttctgaggtcttataccatgcccaagaagaatgaggatacactggacattaagtggtgagaagggcagagaatataaatcccaagttcattttctttattcttttatccattgatgaacacagtttgattctatagcttaactattgtgaataatacttcaatgaacattggtgtgcagttcattctctgacatgctgatttcatttcctttggatatatatccaggggtgagattactggatcatagggtgacactatttttatttttttgagaaacatttttgcgttttccataatggcagtattaattcatattcccgccaacaatgtatacaaggcttcccttttctttatgtgctcaccaacacttatcttttatcattttgataataaccctttctaacaggtttgaggtggtatctcattctggttttatatttccctgaggattagtgatgttgagtattttttctcatatacctgttggctatttgtgattctcatttttagaaatgtttaattaggtactttgctcacttttaaattaggttgttttcatactactgagttgtttaattttttatatggtttggttattagacacttatatgcatggtttgcaaatatattatcccatttcatagctgtctcttcactctgttgttttttttttttttctttggctgtgatgtaggatttttcttctcagtcagtttgcaagctggggacttctggccagcaaccccttgctcaggccccgctcagccacattggtgtgcccaagctcacctgtattatagcttgtatccaggtttggtggtttctgagctcttataccatgcccaaaaagaatgaggatatgctggacactgagtggtgaggagtgcagagaagaattatattgagtaatgaacaagctttcagtgaagagagaacacggggatggtccctgtactcaaaggtgggaaattcccagcatgtggctgagtctgaggccttttatggactcagaatggggagtgtgtgctgattggtttgtgagtatgcaaaaaagttaaagggaagacaccactcaaaggtggccacaacagtgtagaaaaccaattaggaaagcgtaggtatatttaaactaggtgaagtgtggggatcaatcaagggaagcatgccaaacaggaagacaagttctcactctggtccgaggatttaacttttagcttggctttaaggttttaagctgtctttcgctcagaggtgaggtttcatcagggatccatccctatctgcccaggcatttggctacctcctgtaactatcagctgtacaaaagctttttcacttgatgtattcctatttgtctgctttttgcctttgttgcctagacttttagggtcatatccaaaaaattattgtccagaaaaacgacatggggctcttctcctatttttgctcttagtagttttaaagttttggaacttacatgtaagtctttaattcattttgagttgatttttgtatgtggtgtgagtcaaaggtctaattttattcttctgtatgtcaatattgagtttcccaatactatttattaaagagactgtaatttcctcattgtgtattcttgatttatgtaaaaaattaattgaccacaaatgcacagactttcttgtgggctgtctattttgttccattggtctatgtgtctgtatgccagtactatacttttttaattactaaaactttgtgttatgtttcaaaatcaggtagtctgatgtctccatcctttttctttttgcttaagaatgctttggatttgggggtcttttatggatccatacaaattttaggattgttcttatttctgtgaaaaatttcattggaattttagtaaggattgtattgaatatctgaatcattttggatagtacggacattataacaataatgtaggtaattcctccaatccatgaacatgtgctttcacattgtttgtgtcttctccaatttttttcaccaatcttttaaagttttcagggtacagaaattttgtctcattggttaaatattttcctatgtaatttttgtagttattgtaaatagaattttttttatttatttctttttgacatagttcagtgttagcatgtggaaacactaataatttttaattgtttattttgtatcctgatactttactgaattagtttattagttatagtagttttgcaggaatctttagggccttctgtacctaagatcatactgtctccaaacaaggacattttaactttctccttttaaatttggatatctttttttttctttctcttgctaaattattctggcaaaaacttttagtagaatgttaaacagaagtggtaagagtcagcactttgtcttgttcctaaacatacagaaaaaggttttgacttttcactatttactataatgttagttgtgatttttgtcacatatggcctttattgtgttgatataacttcctttatacataaattattgaaagtttttattataaaagaatgttgaattttgtcaaatgccttttctgcaaatattgacatgcttatatagtttttgttcttaatgctgttaatgttgtctgtcacatttatatatttgagtgtgttgaaacatttttgtatccctggaacaaatctcactttatcatggtgaatgttccttctgattcattttaattagctagtgttgttttgaagatttctgcatgggttttcatcaggaaaattctgttctggtagtgcccttgtttatctttagtatctaggtaaaactggcctggtaaaacgagatggaagcatccctacttctttatatatttgaatgcggtgataatgattggtattaattcttaaatgtttggtagaaatcagcagtgaagccattaggtcccgggcatttttttgacagcagactttttattactgattcaatttccttagttgttaatggtctgttcaggtttcctatttcttcataattcagtcttagaaggttgtatatatttagaaatttatccatttcttcaaggttatgcattttgttggggtttaattattcatcctagtttcatgaccctttgtatttctgtagtatcaattgtaatgtaccttctttttttctgattttaattacctgaattttttctttttttctcagtctacctacaatttgtgtattttatcttttcagaaaaccaactccctttttaaaactgttttctagtgtctgttttatttctgatctgatatttaatgttttattctttttattttcttcggtcttagtttgttctttttctaattccttgaggtataacagtttgtttatttgaaatttttattccttatttatataggcatatattgttataaatttctggatctgcttttgttgtgtttttaaaattttggtatatgttcatgtttattacattataatatttttaaattttatttttaaatttcctctttgccccgttggttgtttagaagcatgatgtttaatttacatgtatttttagattttccaaaattcttcctgatactgatttctagattcataccattatggtccaaaaagatacttgatttgatttctatattcttaaatatgtcaagacctgttttgtggactaatatatgatctattgtggagaatgctctctctgtgcttgagaagaatgtatattctgctgctgttggatggaatgtcctgtatgtcttttaggtctattttgtatcaagtgtagtttatatccaatgtttttatattgattttctgtctcaatactctgttcattgctaaaagtgggttattgaagtcccttaatattgtcgtattatagtctatgtctcccttccaatctactagtattttacatatttcagtgtttcaatattggatgcacgtatatttaccatttcttcctggttaattgatttatcattatataatgaccttctttgtcctattttatagtttttgaattaaagtctttttttttctaatataggtactgctcattttttgtttcccttggtacctggcatatctttttctattctttcactttcactctatatgtatccatagaagtgaagtgagtctcttgcaagaagtatgtagttgggtctggtttctttatccattcagccactctatgccttttgattaaaggatataagtcatttagatttaaagttattgtttacttctgctatttttaaattgttttctgttgttttataagccctttgttcttctcttccttttgctgtttgccttagtgattagattactttctttagtaatgtacttttatcctttactttttctctattgtgtatcttactgaggcttacaaaatatctcataattatgacatacatttttaagctcataaattcatgtcttttggataaaatacactacatttttacaacaacccctgaccacattttaaattaatgtcacagttacatctttttataccgtgtgtcccttgtaaaattattgtaggtattattattgtagtagtgttgtcttttaaactttattctaaatttacaagtgatttacacattatcgttacagtgttagagttttcaaatttgactatatactcacttttacttttttatctatatctaactttttcttttttaaatgtaggtctatgtttctgactcatttcattctccatgtttctgaagaagttatttaaacttttctttcaaggccggtgtcctggtgacaaattcattcaatttttgttcgtcaaggaagtctttaatttatttttcaattttgaagaataattttactgaataaagaaatataagctggtgtttcattttgtttttctttcaacaatttaaaatgtcactctacacttttgctaaaaatgtttttggagaagtgcagtgtaattcttctcattgtttctctggaggtaaagtgttcttcgtttcaggcttttttaaagattttatgtttgtctctggtttcgtatactttaaatataatatatctaggtgtagattttttagtatttatcttggttgctgttctctgagcttccataatctgtaatttagtgtctgtccttaatatttttaaaaatctcagccattattacttcaaattattcttctgttccttttgatctttcttctctttcttttattacaattatgcatatgttacatattttataattatcttatggtttttgaaaatcctgttttatagttttgagagttttctccttgtatcttagtttcaaatctatggtttatcttcaagcttattgattttttcactggctgtgtgcactctctgataagcccatataggagatccttcatttttgttactaggttttttttatttttagcatttccttttgatttttctttgtttccacatctctgcttatactatgcatatgtttgtacatgttgtctacctttttcattatagcacttaaaatatttatcatagttattttaaatttcctttgtgataacttcaaaatctttgtcttaccctgtttctgatgcttgcttcctctcttcagacagggctggtgtgttacctttagcatattttttggtagaaagccagacaaaattattacataataggaactaaggtagataggtttttagtgtgacgttttatgttgttttggcaagaaattagactgcgtttactgctttctgtagctatcatgtcagtggcgaaagttttttctagtaatcttgttttgtctccctgcttatgtttggatttttcaagagatatcttaaatggattgaggcttgcagttcttttagctgtaatctgttactgtacaggaaccctgtcgatgtggtcgtaaactgtgtgacaaggggaggtgtactgtagacctaggtattaggtcttttggtaattaggtattagtctcgtagtaatctttagttggctattcctcttccccaatatcagcggttaaagggggctacagttgggaatatcccttctctcagataggtaagtctttggtaatcccccaatccgctttgatatacagttttacctaaaaatgagccttgttaaggacaacagggagctctgagactacttccaagtggttacttttccctcccccagccagaaacaggaaaatattttcttcaacagttaccctgagaactgggtaggtttctggaagtaaaacacacaacggtgtgtcttcttgccccttcagagcttttaactgtcaaggtaggttacactgagccttttgcaattaatacattacattttcaagtgctcttaccgatactggttccagctgtgggcttctgctcctgggctgctgctgtgaataacctattaatttctgtatctgtctgtctgactaaacaggttttaggacagcagtttgccctgcaactttatctgatggatctaaagataatcgatttttattttgctttgcttttattttccttgttgtgaaagtgggagtaatggtttccaatgctcttatgtgttagactagaaactgaaaggccctggctgtgtttgtttgtttgttgaaaaagaaggttttctttctgtttcaatattctctgcaattataattttgaattaatcaagtttatggcagaaaaaaatactttctttttaaattaataacctctctgtttatttttctcaaattatttttagtatagttttattcccttggaaaaaatatccagctacagtaatcaatacatttatttaaccatttgtagtgcattcctgaattatttttgtagaaatgttaaatggaaacatccttagtatggaatgtttctaaaagaaggatcataaatcatttctgaaactcacctactggttgtataacaataaaatatatgacatgatctaaatcaggggtttgcaaactatgacccataaaccgaatcttgcacatcagttgcttttataaagaaaatgttcttgtaatacagccaacttatttgtttacatattgcctattgctgcttccacattatggttttagaattgaatatttgtgacagaaattgaatgttcccaaaagcctaaattatttactgttttcatgttgaaagacagaatctgtttgtcccttaaataaataataatcatcactaagcacataaaggtttctaaaagaattaaactgaaattaaaagtaagttgtcttaagcttgagttgtcacttcaaactttgttatatcagtattttcaacattccttagactatatattgtgcacatttaaaaagctatagtagagcaaactagttataaaaaaacttaaaactattaccaattcaaaataaaataaatgttatataacatgaagaattttataaatgttgacattctcaaagtgtaaatattttgtgtgtaattgtcagaaatttagctacagtttcttctctcatttacatctgccaaatttgctaaaaatgactattggtttatagtttatatcacagctgctgaaatttattttttatagaatggctatttttctagcttttggcaccattagttttgtaaaactaactgagctttagtggctttagtgtgacagcacttgaaacttgtcataggaaggttaaaatcttagttaccatggcatacagcatttctcacatgtttaacatattcctatttttgatgttagatacaagaaaaacaaggaaaccaactaaaactagagctctcaaaaagaaatagaaaattacatattgactccacattttgaaaatattccaaatagacattcatttaaactcttgcacccaaatttttaacaatacaccaatatttactttaaaatgtcatgaaaaga

SEQ ID NO: 461 - DNA, 20001 bp, Homo sapiens
caacacttctgatttttttccttttaactattattaaatatttaggattttaaaaattccagaattatttacacagataaaatatgttaagcaatggatcatgatgctattgaagtagaacagaaaatgacgtttttgagtaatcaggctgttccacttaatcaaagcatgcttaattagggagccctcttaattgggactttcccatcttatcaaatccagcctaataacactcaactgtaaagacaggtgcttaattgggataataattctagataattgggggtgcctgcgggtgaccaagagtagcttacatcaatctgatttgaagatattatgcctttgtaggtgtctcctactgcgcttatttgctttccaagaatgacctctccactgttaaatgaacaaatgtccttttagcactgactgctggaattttctgtttctatctcggttttcaatcacactataattcttaagttttcttttattataaaataactacatattattttacataggataaatttattattagcactttcaattgaattttaaagcaaataattagcaaaagctaggaaatcaaataccacagattaaatatgctctaagacactaaattataaagaataataattaacacctttgttctctgaaatacaataattcatcatgtgtaaatagattacttagcttaatttctttttacttccataccatttagaaagttcagttcctggccgggtgcagtggctcacgcctgtaatcccagtactttgggaggccgaggagggcggatcacgaggtcaggaaatcgagaccatcctggctaacatggtgaaaccccgtctctactaaaaatacaaaaacaaaattagccgggtgtgttggccggcgcctgtagtcccagcactcgggaggctgaggcgggagaatggcgtgaacccgggaggcggagcttgctgtaagccgagatcgtgccactgcactccagcctgggcgacagagtgagactccgtctcaaaaaaaaaaaaaaaaaaaaaagagaaagtcagtcagttcctactatagtatgtgttatattgggcatattcacagatatcagattatttgactagcatcaaaatgctggtcccattccccccaaatagcagatactcaaattagctgactgaatttggaaacgtaaacttttttctatttaattagctatttttaattaaattagattattaaaacaatgcacataataaaatttcattttattctgtttcacttatgaagcctgtaaactcattggatgaggtagacttttctataaatatacttccaattagaacaaatttctttctttaattctttttaataaaatttttagtaagagtggtgttaatattgatgtttctccctttaagccaagacacataatattttacagctgaatgtggatgtctttaagagccatagaaaagttatattaatttattgtaaataaaaattctgtacaattaaaatccctgaaaattaaaaacaatctttatgaggctgtttttaagttagtaattttaataactttacaaaggaacattttagatatagcccatttttttaagtatgaactgtaacttgaacttatatgcactatatattgttaaaaatcatttcagtaaaacattctagaagagaacaattcactaataaacttaacctaattttaaatttaaatattattctagtttattgtttctggggctttctttttattttaaatttcaaaagtgaaggtatgtttccagtgaaaataaaattggcaatgatttcaaatttgggcaaggttatggaatcacagaaaccctcattggttgctgatagaaatccagaatactacagagcactttcaagaacagtttggtattttcttaggaagctaaacataaacttaccagaagatccaccaatcacacttatatgtatatacttcaattaagttaaaaatttacctttacacaaaaacctgcatatcaatgttgatagcaacggtatttctaattgcaaagaaagaaaaaaaaagaagcagtcaatatgtcctgaaatagttgaatgggcaaactctttatattcatacaatgagattttatttagtgatttaaaaagagctatcaaaccgtgaaaaaacattaagtaactctaaatgcacagacttaagcaaaagaagccaatttgcaaaagatcatgccatcttattccaactatatgacattctggaaaaggaaaatgatagagatggtatagataaagatctttggttgtccagattttgaagaaagggaggaatgaataggcagagcacagggtttttgtgggtagtaaaccattctactttacattctaatggtgcattaatgacattctgcattttccaaaaccagtagaacttacatagcaaaaataatgaaccttattgtaaactatagactttagttaatatattaatacaggttcacaaactaacaaatttgccacacaaacgcagaatgttaaaaatagaggaaatggggttgagggttacatgggagctctctgcactaaatgctcaatttttctgcaaactaagctattctaagaataaagtattaattaaataaaagttaacagacctattcaaatgaagaagagaaaacaacagattcaggagaagctgaggagaaaagtgaatgcttatacactgttgatgagaatttaaattagttcagccactatgaaaagtatttgggagatttctccaagaatttgaaacagaactacaatttgacccagcaatcccattacagagtatgtatccaaaagaaaataaaataaaaagaaacatgccctcagatgtttatggcagcactattcacaatagcaaagacacggaatcaacttagtcttgaactcctgaactcaggtggtccgctcacctcagcctcccaaagtgctgggattacaggcatgagccaccactcccagctgactcaatattcttatagagaaaacaatagcactgtaaaaagcacatttagagggaaaggtgaagatacaacttaaacaatgatatcaatcatcaaaatcagacgaggttcagaaaataccacccagaaatatgggcaggcagtatttatagacagaaaaaggaagtgatatacagaaagagcttgactggtggctggtcatttgccctatttggaagtggtgtgataaggcatgtgccttatatggacatgattttcttacttggcaatctgtgattggctaaactcagtgtcatgatttgacacaactcacctatttgctataagaatattcaaagttatgtttctggtgacttacctactaagttaggttgcagttctctacataaaaacttaaagtattgaggcagccttaagccaaatttagtttaatttaacaatctcccttaatttcagcctctcaattttgagaaattgacaaaaatttggacattgaccctatcctttgacaccatcacaatgaactggcttggtttcagtatggaatttaaattaattacatcaactgaatgattatattctctttatgttttcactattcaaatgtagtgagaccatttgatgtacaatggatggctacatcagcgaattaggactatttagagaatacagcacaccaggaagaaaaatatgatgtctgtcagaagtataatatgaaaagactaaagtatactcttttactcgagccaccacaaatcgggacaattaaaataaaatatattgaaaatgagccagaagaattatatatttgtttttatcaattagcttctttgttgatttcttgtaactgagtttttatcacagtagatacatggccttatccacgtgcagcagaaactgttagttattgtatacacactcccctgtttaccaataaaatgtccaaggcaaatcatgctaactaaagcaatttaagcaagacaatgtaaggttttctgaaaaatcatagtctttgcagtagtcagttaaagtagacaatgtttgaagcaaaagtctaataatctattttacatttatgtcaaaccagaaaaggctactagaagatgaccacttagattctaccaaaaaatgtccattcagagagatgtatgcctgctgacaaattaaattcttctttattccattgttcagataaagaagtattcaattttcaatttgtcttggagtgagactggtacatttaagataaaaatccctcaaggcattttcttggtattcagttaattctggttctattgggttagcagttttatgcaaccaatcagttttattagagttctgggtattcttactcagtccagtagcataatcttaaatttaacaaaaacttttaagagttattttcatgaatgtccttgaatacaaaacactttaggcttaaattgacttaaggttgtcctggttaaaggtttcatgagaattcattataataataatgtaattgacaagaaaatttggttatttctctggaacacattttatgataataactagaattctggtcaataatattatggcgaactatcactttactgggaatttcacaaaattgctagaaaacattgtaataacacagtcatacaaaaatgactgaaagaaggtttagtatcacttattatttcacagtgttctcatctaatttattatattaaattagcccaaatagtttaatatctctttttttataaggtgatatttctttttgaaatgttccaagggcccatctagaaaaccccaaagttaattttatgcataaaaaattatggtttagaatttcatttttggaagattttcaaaattatcaatggttcataaacattggatcaaaataagataacaggtcactgtgaaaataatagtcatttaattaaccaatgggataaatttaaaaattcaaaggcaaatacagtaagttacataatacaaaaatagttttttaatatagagaactccattttcttaggtaatcaaaatttaataaagacaacatacaacaacaaaaaattattttgacaaaacaagatcattttttcctaggctaattatttaaaaagataagaaaaagtttttacaaccttttattaacaccaaaacaatactccaagaaaaccttgctgttttaacagaaaggaccagttttacttttgcaatggtgtacttttgatattaatgcttaattgttagaaaaagttataaataattcctctttaatttcagtcatcttcgtcacatataaaattcctctcacaggattcatcttctacaaaacttctacaactttcttatatccttctagttatttgtcctatgcttttcccattctcatttgaaacagccagtcactttacgttaggacaaagtaagagtcttttcctcattatttttagttttatatgccatatattaattataattttatttatttatttatttttagatggagtattactctgccacccaggctggagtggagtggcatgatcttggctcacggcaacctctgtctcctgggttaaagtgattctcgtgccacagcctcccaagtagctggaattacaggcacctgccaccaagcccagctaattctggtatttttagtagagacatggtttcgtcatgtttggccagtcttgtcttgaactcctgacctcaagtgatcctcctgtcttggcctcctaaagtgctgggattacaagtgtgagccatcacatccagcctattaattatcattttaatctttagcaactgattattaattagcattctgtagattaacactatttcataatttatagaaatagatgctttctgaaggtattttttaaatttattaacagactcaaacatatttagatttcctatatcatattaaaatctagatgtcaaagccatataaacataaactgatgttcaacaattaatgttttaacattttatcttatttgaaataatataaatatatttataaataatattatttataatatcgaataataaataatgaatattcatcatttaacttagcaaaactccaaatgtgtaagttaccagtgagattggaaagctatttttaagtagttacattgtaacacaaaacacgctagctgccatcaagttattttcctggttactacttgtaactatgcacatgttagatgtcatcacagaagcaagaatctaaggagttaaatacatgacttgttttttcttgtttgaaaactgtacttgatatgcatgatacaatgaacactgcattttcacttacatctttattcttaggttaagtttatagtttgatgagccttaaaaatatttaatagaaataaaagttgtgggtctgtactacatttaatattgagaactctaaatacatgcctgtttttattataccaataatattcttattaagaattgtttattctataaagattacccatcataaacattgagaaaataatctatacaagcacttattttaaaaaaaaatcaaaaacagtgtttttttaaatttagcaatatcaaaagaagaaaaaaattattatgcatataaacatgtgtaaatatataaacaaaaagtaatcttatagcttttattttaaaaatttaacctgttccaggtataaaaataaaaaactcactaatgtattaaacaataactggatctcaattgtttttgtgcccaagtcaacaagatgtcctgtcaatatggttaaagcttttgactagtatttctgaaaaagacttctaggattttttaatttgccttctgtagaatatcttttgattcacgttatcttttaaatgactctgcatagcaactaaagtatgcattccattgcttttcttccattttggaccctttcttttctaatgcacttcaccagtaagaagtttatctcggttaaaacttcaccactgtggccactgtagttccaagttgttcttggtaaggttaacctatttttcaaaagatgaataggatctgggcccacagtatttgcacacaattttagcaggtatcccaggggttgtagtcctgaagtcctggtgtccctgactgctgatagttgcaggaaatcacttgtataaggtatctttctgaggcttctaactgatccaatccagtaagttatcagatacaatctgatcctgcatctggtccagtaataattgttcaactaaagtcagagagctcaaaacacaaattcatggagttctaatctgagagagaattcagccaagaacccagttgctataagaggtcagtgaacacaatgggcctggctaggtacctttgcttttccactcagtgctcctgagtatcagtgaaggtctacttcattcaacttctgatgccaaattattaaataaaaaactttagacaaattaaatttagtagagtttatttgagaaaagaacaatttatgaattggacagcacttaaaaaccaagagaggttcaaggagctccaagtagcaacaaaggaagaccatatgtatagatagaaaaagacagaaaaagggtgtctgtatttatagatgtaggggaacagcttgattggtaatagcttggcattttccttgtttagatatggtgagatgagtcattcactttagatggacatgatcttcttggttggcattctgtgattggctaaagcttggctgctaagattacttgagagttggctacttattttagaatatagtcttaatttgtgttgcagtttgcctacctactacgttaggttgcagttctgcacatagaaactcaaagtaaagaggcagccttatgacaaattaattcaatttaatggtataagaaatccctgaattaatgttaaaattgaattaataataatgagtaagaaagaaataactcccaaagagatcaagcagaaatataacttttagatatgaatatataataattgaaacttgaatcttattggacatttaacagaatatgttagatataattgcagatacttagtaaactaaagttctcaaaaattataaaagctacagcaaacactgctatttaaagtttcgaaatataaagaatacatttttacaacacaacatttatcttaaaattattgcaaatggagagactagacagaatgaggaaaataagtatattatgcagaatttatgcatataactctcaatatcaagttccagaaatgattatacgtgcacacacacacacacacacacacacacacacacacacacctctaggcatatcataaagggatttcaaatataaaagacaacaacaacaaaacaaaagcaaagcaaagcaaaaattacaaaagttagattgttagctgatatcttaatagcaagactaaaatcaaatacaatataactgtttatttgaagtgctgggaaaaataaagcatgctatttacttgtggttttatacgaaggtaaatagagttcaaaaatgagggctattctttgttggatgaatgacattctacttccagtatgtttttaagcatattatactcatcctgtgcaacaatgaagaattataaagtctttttcaaatgaatgaggctttgttcatgttcaaaaacatatgaagaaaatatttaagagtcttattcggaacgggaagtatcaaatataaggcatttcctgccaggctaaggtgttactttgagaaaaattatgttacttctacttttatttgaacatagcttttctatgtttatgtgaataaacattggttttccctgcgattacagagtgtggaataactatgcatatctatagatatatgtttcatgtgcaagatgataatgtgtgtgtatatatatgctttgtaatgtgtatatatatatatacactataatatatacatactgttatatatatataaaacacacatatttatataaatatatgtatttatttaaattaaggtagtaagactccatattaagacatgggtcattgttgtttctaaaattactgccttctaaagcctttctatattcatacgtattgtctattgatacatgtgtcatcctgttaggagtgcttacttgaagcctagccaatatttaaataatttataagtgttattgttaacggttatttttccattcttgtacatcttgctataagaggtcagtgaatgcagtgggcctggctaggtacctttgctttttcactcagtgctcctgagtatcagtgaaggtctacttcattcaacttctgatgccaaattgttaaataaaaaactttagacaaattaaatttagtagagtttatttgagaaaagaacaatttatgaattgggcagcacttaaaaccaagagaggttcaaggagcttcaactagcaactagcttatgcagttgcaatttggtaatgtttcaaaaggaagacagaaagaaagaagaaaggaaggaaagtacaaaagacatagagatgaaaataaaggtagaaacgtaagaaacaaatcatgtttctgtgtttgaagtggtgagatattataaattatttgataatttgacatataaagaagaatttgtcaataggctattttgaaatactgaatatttatgttacattgaaaacaatatttttaaggctacaatttatatatatataaagatatttcaaataaaaaataataaatacataacaaagaaaggaaggaagataggaaataaaagaaagtatagaagaaaaaaatggaagaataaattgatatatgtgacatgaattatatattataatttcattttaatatagctctgtataaaaaacatatgtagtgtttaaaaggcatatgtttagagtagatgatgtcttccatgatgtctaccaatcataagccagatgacagtcaagaatagctgttagtacttgtttatttatcaacatcaaaaaatgccagcaaaacaaacaacattcagaatggatacgagcagctgtggatgctgtgtggagttggtgggagtggggtgaagaggagaaaaagagagagaaagaaattagtttctagttggctgcatctgttacaacctttccagcccatgcagcagacatgtgaatgagcaagacatcttgcacatcaggctcaattctgactccaggggacttgagctccagatgcctttagcctgcgagcctttgagaaaccccaggagagaactgtccagctgtgaatagtcaattattaaagatactatgttctgtgacaatttgttacatggcattagacattgagaacaatctgaaggcatgcctgaggttagaaaactgtaattaatagtggaatcagtcagaataattttatgcttttcttggtagtgatgatcaacatgggacaaagaaaacagaaagtaagatataccctacatgtacaaatttgcaaaaaaaaaaaaaaccaaaacaaaacaaaataacagtactaaggaaaaatggctccgaaagaaattttaaaggaggctaatgtacttaggttttttcaatgaaactcattcattttattattcaaggtaacaggcaattaaaaagtacgtagattatctaaagtatttgaaatatataattatgaattgaaaataaagctagaaaattttaaaataactgttctctacatatatgtgtgtgtgtgcgcacgtgcgtgcatatattgtgtgtgtgtgtatatatatatatgtaaccctgaagatatttattgaactcttaccctggagcagccataagttgttccctaggccagcaaaacttgaaattttgaaacctagtccacaaatatctatctatttaaatagtaagttaaaatgaaatttttctaagtgcatccttagacgcttctttctttcatattgtgggtcaaaacaaagttgtcacaactgaggatgtacgttatttcctttatccatgtccttctaatgtacatagatataaacacacacacgcacacatttttaagggcagtgtctttataattccctgtgtattttattaatcacagtaaaattatttactttttaacaaaacatgatttttttccaaaaattatttttctatgtttattttcctgcttcaaaatgatagttgccattattagtttcctagtcttgccaaaacaaataacaaacgtggtggcttgacacacaaaaacacttgctttttcacagttctggagcctcgaagccccaaatcagtcaacagagtcatgttccttctgaaggctctagaggatactctatctttgcctgttgctagcttctgatggttgccagcaatccttgtcattgtttgagctgtagctttatctcttcagtatctgtttgtgtcttcagatgagcttctttcctgtgtttcaatgaatctccacatttccttctccttttataatcactagtcattggatttaggacttaactctattattccctcttaatgtaaatacatctgcaaagaccatctttccaaataaggtcatattcacaggaaccagagattaagacttcaacatatactgctgggggatagttttcaacacactgaaattgatgacagtgatataaatacatgtaaaaaaagagttgtcacaaatattttaaatcatgtaaaaaaccccaaaatatctaaaaattttaaatagcatggtagtcttatatatgatggcatataaataatgttgaataaacaaaaaataacattcaaacagttattccaggtatctttaaaaaacatcaaacagaagaaagtacttatatggatttatatgtaaaatataatcagatatttaaaaaatctatttggtaattgaattgaattctattctgtatatgagagtaatactcgactttccaaaagccaccatggaaatgcagcaattacttaaaaaacataatttcctgattataaaaaataaaataaatggagcagcatcatggcccatttttggtgtcacagtttatcctacatgaaagctgttaccagaaacctagagggaaagtttagaaacagtgagtgcataaaatcacagtttttacatacagtgattttaaagaagagatagttttgtgtcttgactgagcattttgttgtgcaaactgagctgtttacaaaaggaaaggaatcgaaaccatgattcaactgagtcatccaaccttgcccattgtagcatcattaagaaaaaaagacactctttttttttttctggaagtttaaacattattataaagtaaaattatagataagtaggtgtagtttcatcatcaagtctccagtgtatgaagaggaaaggcacaacctctttgtgacattagcaggatccacaaatctatcacaggaaggttttcaaagaaatcatttcctttctaaatgtattaaaatactggtaaagcaatgggcaggcttgcttctgtaacataaggcattttatttttaacatatttatttttcaatcttttttttttaattcagtgataacttttcctgccccaaccctcgttgttgcaccatcttcaccctttattactctctccacataatacatgcaaccatttatgctgccgaagcacttagagataatgtgggatattatattgcatgtggatagcaattcccctagatttaaaacattttattttggaaaaaatacatgctggacacatttccccaccttttatcctctgttgagtgtctgctgttgactctgcccagcaattttctgttactctgaaagcagaagtatctcttttaagaacatcaacttccctttccaacccacctccctattacacctctaatgttctgccagtggcttcacaatgtatgactatggatctctgtctacagttgattgttccaggagtagataataaaggcattgctttctaacaactactcatgcctgtgttcagaaatagatgaaaagagcttgtctaaattgaaagcaaacaaacaaacaagccaaaaaaaaaaaaaaaaacaaaaaacgctcacatagacaaggatgcaggattgaaaaggagatgactggcaacattgctggtctcattggtttcagaagtctaagcacaccttctttactcataattaaatgaaccttattttattctttgcctaaggtctttcgtgatgattttctgtctgtgtgtctttctgtcactttctcatctctatttttcttacaaaaaagacaggaaaatttatctggaaaataataaaaaaaggcaaactaaatcattattaatatttttccttattggggcaagggattaaggcatttctaaactattgttaaacttaatatgcatcaggcacaagaaataataagaaggatttatgagtaattaattttattagaatttgtttcctattatcatctgtttccaaaagcaagtcaatgataagtcattacaccttatttcatagtatacacattattttggtggattgatgatgggttttaacattataaaacaggaaaataaataataaatcataaattgttgattatttatttggtttttataagtatatattccgtattttctaaccaagaaacttgtagaaaatatccctaattttagataattttataatttgtttatatttttatttgcttcattcattagcacataattatttaatgcttattttagaagaaagccagataaatcaatactttgatttttctctcctcctcttttctgatgtccatctgtgagtatcaaatggctaatcccaatttgaagtcaaaaggcatgagaacacattgatacagttcatactatcagtctttcagggaagagagcaggatcaaggagagtgcagagtggacatggtaagtcagatagcacatgtatgcatgtgtaacaaacctgtacgttgtgcacatgtaccctagaacttaaagtataattacaaaaaaaaagaaagaaaatacctgacacaattcttgtcttgtttcttatcatctactctatctttatttcagattaaatatagtgttttcctaatgagaaggattcacaaagatccgttatcatccattttattttatcattgataggtggcttacaatcaagtcttgctccaaactaaaacctaacatagtagtcattaccagtgttcttcagatcacatttcagaaagagaggtagtggtggtgaggataattaatttacgtaaatcatagatgttacagcccccagactaaatcttgtcacgaccttacattggtaatcacaacatactccttctaccaacttttcacagtctcctgccctctggtagcacactagctacaaggggtgaaacccagtcatttattgcttcagggtaggcagacctttattaagttatcctattttttattgctctgcattattgtagaacttaagagaaagcccaaagaaaatttttgtttccaaatatattcctccctgttccaattgtatttaagcataacaacatgattaaagggaattaatcactccatatgcctccttatctgcttggtatctcaacttcatgagaaactcaaaatactcatagagtagtcttggcttctacatataatgacatataaataatggcatgtaaatatcccattatatatatatatatatatatatatatacacacacacatatatatatgtatacacatatatatatatttagttcatcagaattataataacctttcttggtagaagcatttgtcctaaaatatccaaattcattgaaccaaaaatattgagtaaggggggtgaaaaatagcacatatgggtattaccacggcaattaataaggagttttgttagccaagaaagggacatgctgacaaggactgtgctcagagaaagcaaatctgagggaatcaatctgccactagcaagataatttattaccctggaagaatggtgtcttatcaagagctcaagtttgtctctgtagttgatggactggatattagctgtgtttaaagtgtaattgtatttgtttagataaaatatttatgaactcattccagtcactgtggccattttgtgcctgggcccaatgactaagcgctgggttggttaggaagtctcaaatatatccataggggaggtaatttttagggcctattctgacatagataacacattttgcaaatgtgctttgggtactttatgaatatgtatatttttacactaacctgcacaaattaccccatgttgttattcaatataataattttgttaaataattttataaagtatttaatatacatttccttttgatgttgaactttgtatctagaaatttatccttctgctatatagaattgcaccttgttaaagcattgttagatttgtattgtgttcaggctaatattagtttataacatttttgcttttttcacctatattttaatttcaatattagattattcttttcttaaaatatgtagagtgagcttttttgtctcctattttctgaggttttcaaatcactgtaccatccaatattgacaccttaatttttgtcaattcttataattttgtcttttctttttttacatttattctttcattcacttgtgtacatatcactggtaatttttcccaggaaaatataatctccgtaattttactcaataatttggtatacaatttttttctactttattcttgtaattgtttgtcaatcttttcctatttatgcttataatattcttgttagtacaattgagattgaattgcatgctcctaaaagtttgaagttcagttcagaaaatatattttaataagaattttcacaccataaatttattaaaatatagttcagaatatgtatattttctatctgaggaaaagagaatggatatggtcattggagaaatattagagctaagtaggcaagtgtctgtgctgtgctgtgctgcactaagctgtccatgtccttaagatttcggatcaaaatccattttgtaaattgttgcttattttatagtaataatactaaacagaagaataaaaaagtataacctttgttcttatccaacaaagaaaataacaacaacaaatatctttcctctgagtatgagagatatctttattttttatttttatttatttattttttttgatatttaatttcctttttattggaccaaatgttatggtaaatcactccaggaaaacggctgagcaaatgtgaggctaacaccacaaccagccccagaagtaaacaaaagcacaacaccggcaaaagcattcactttgaaaattctaaccctggcacagcagtcttgaggttcatgtttccccactgcgatgtgcttaacttgaacagtgtggctgagctttcccattctaactagggtttcttgaaccagaaacaaaggcaagtcagttctgaggctgagattcaaataatcagatcacgggacagctgcaaactggaaagcaaatgagacagctactggagtgatcccattaataaaggccctcctcccaacacgtggccctttccccaacacactagaggccaacagaaaggacacttcttcctctttggaaggaaggaagctaacaactggaatgagtctgattaacctggttaacaactggaaggaggaaggtctgttatgagtctctttaaattcctgctttttccttagtagtcctaatgaaggaggagaggatttaaaaaaaaaagagctaaaagtattttgctgttgcttttgataacgctgtcacacacaatgatgattttttaaaatgaacactgggatttggccaggcgtggtggctcacgcctataatccctgacttaaaactatactacaaggctacagtaaccaaaacagcatggtactggtgccaaaacagagatatagatcaatggaacagaacagagccctcagaaatgacgccgcatatctacaactatctgatctttgacaaacctgagaaaaacaagcaatggggaaaggattccctatttaataaatggtgctgggaaaactggctagccatatgtagaaagctgacagagagatatctttaaggtacaatgaaaaccattgttaaaatatattcatatgccacatttctctattcaccctaccagttatattttctaaagatattttccttctaatgtgttcattcacatgaaaatttcttaatacagatatttccaattttagtcaaatatattttcaactttataaaatacatctagcaagtaattcatttttaaatgagagagcacacagtatataatgtataatgcatgtagaatgcttttccatatatatatgtgtatatatgtgaagataaaagagatatagtgtttctttcaaattattgctcaaaattagtagactgtgtatgaattaagaaatacagttatttgctgcataatgatatttcaatcaataatagaccacacatatgatggtgattccccaaagatgatatcatatttttactgtactttttctatgtttaaacgtatttagatacacagatactcaacattgtattacaattgcctacagtattctgttcagtaagatgttgtacaggcttgtagccaagggtcaataggctatacaatatagtccaagtgtgtagttggttaaacaatctaggtttctataattacattctatgactccatgatgttcacacagtgaaatcacctaaggatgcattgctcagaatgtatccctgtcattaagtcatgcatgactgtaaatgcaattgttttattcattttcacacaacccatttgctaatgttctctttttgaatgtgctcatttcctattttatctcctacttttatttccatttctagctatgtttttattcttaatgcaaatgaataatcatataagtaataatgagaagaaattagaaatcacacagcagttgtaggaaatgctattgagaagaattaatatgttttttcacattatgtgggttttagtgttatactaggaatagatattggttcagatggttttattcttagtattatatttttatactcagttttatattctataactatttctgggagaaagatatcaactaccttctttccataagacctgtaaaattttatcagtaaccgtataaattatgtcagaattttccaaatccttcaccatgggacattagttctgttaaagaactctgtggccaaatacttacattaaattaattaaaaatcctacctgtaataattatttgcttttttaaagcaaataactacttgctctttcaattttattaactcaatacatgttagatagtaatcaaaacagccttaatattcccctgagattgactaaattttagaatttttcctcattacaggtccctgacctccctttttaaaagagcattcatttttagaaaagttgaattgtaaatttgtctttgttccattgacatataaatttttttcacagccttctgctggttttacaagcaagcaatgtctttcttaaggacctgggagccatctgttcgaaatgcaatcaataaaggtagcaactctttctctgtgagagagcaagagctaaaaattgaaaactgccaattagcaaagacagaatgactcatcacattaccagcctctctcattatgtcctccagtacttttcactagctcatcccagtgcttaaaaactctccctctttttgtttcaacttgagttcagttcaatatctcctccctattgcagtagtcctaaatcctattgcaatagtcttaaagtccttcttgtctgtttgttttgcctggtgcacaattttctttgacaagtatatcatgtttgggaagaactttaagaaataacatctgtttaatatcatagttctcaaaacatgaacactttgataaacctgagctttataaaatataatttctgaaatgcaaataaatgtaaatattatttatatgtaatatgtaatgacatcaatagatattgagcactcactatgagcacaatcacatctttagtattagaaaaatgcaaaaatatgacattgtctctatcatgtattattttatatgttaaaaatggaggctgggtgctgtgggttacgccagtaatcccagcactttgggaggccgaggagggaggatcacctgacgtcaggagttcaacaccagcctggccaacatggcaaaaccctgtctttactaaaaatacaaaattagccgggagtggtggcacacacctgtaatcccagctattcaggaggctgaggcaggagaatcgcttgaacctgggaggcggaggttgcagtgagccgagattgcgccattgcactccagcctgggcgaaagagcaagactccatctcaaaaaaaaaaaaaaaaaaaaaaaaaaggaagaaacagagttaaaagtacattcaaaattatgaagcaaagcatacaaatttgctttacaaaaattataaaacagaaatgaaatattcttgcaatgctctaggaaaaaaaaataaacagtcatgttctggcaacaccattcactccctttatcccttcaagcctgaatgtgtttactaatctcctgctgttatttctcctggtgcttcaccatccattttacctgtgtgtcaatgcatatctctggctatggtgtctgaatggattagtgaggcttttgacaaggtccagtgtctcagatcccagtctcctgcacaaaaattgttgtagctaaaaataatttattttgcaagacataaaatgtaataaaataaaaagcaaagcagtgtatggtaatgtcataaggagatatttgttttcttaatttattcaattactgagtaatgtgattttgtacaaattattctacttggtgggcctatcatttatataagttaaagagaaattgttagatggtgtggtgtctcaattttc

SEQ ID NO: 462 - DNA, 489696 bp, Homo sapiens
tatgatttaatattatctcccttattatgtagcttgcttcttgcttcatgaaccttgttacaaatcacaaatattcctaatattttattatgctcttactcaaaatatatgctgtaagaaccaaaactatacgtaatttatagaaacacacatatatatatattatatgtgttttgttccaatacattaaaaaaaatcttatggatttgacattgggaaatattctagatggcctgctgtaggatttttcttgctatgccgaaatcagtgtcaaagacactgaatgctatgacttgtgttccagatatatgtagaaatgagagtccattttgaaaagccatctgataaaacatgttgctcataatttaccttgtaaattacattgtagtaccttcccagcattagtaaattagaaccttaatcacaacctgacaatactgcctgtttaaatttgcatatcaaatgaatcttcaacaaaagagattaaccatctttctttttccaaaatagaatcaaatacagggttagcataacaatattatttttaaatgcctttcaagtacaaaatataacatttaaaaacaaatagtttgtcagagtgaatagtcatatataccttaagtgaaacaaaataaaaatgagcaaaatatagaccatttatttgtagtaaggcttctagtttttttcatcttattttaacttacacatttaaaaacaaggtctagtatttattttcacaacattattattgagaccaattaattttttcttccttcctttacttccaaccatgtatttatgcctattctttttccgactattacaaataatattgtattttatgttttgaattttttcatcaataccttttcaaacaaattttaaatataaattgattgttcagaaatagccactagatattaagaatttttctacatgcactgtttgcttccatcctataatcacccacttacataatccttgaacattttttattttaattctgggcgattccatagtgcaagaagcatttattttttccatttttaatagaatattttgtatgttgattttattcttcttgtagttattttcagtttcattaaaaggttctataataaatcagtattgcttttactttattaattggtactctaaaaaatgattacaaaatgaacaattgtttagattcttggaacacaatccaacctttgcactctaaaatttaaacaccataaacttccaaataatagtctagtacagataatcgctagaaacattacacactgactacctctaaaaatagcagtatttttcaagttttcatccaaaatgttggaaaatattggttacttgactacacactgctatattttaccctattaaattttcatgagctcacataatacaaagtgctgactacatgcatggccacacacttcctcttctcatagaaccaaatgtatatggcatttactaaacagattcaaaagtggcatggtatgtttcaacaacaccagctccttcaagagtgctaaatgaagaaagtgctagcacatgacaatttagagaagtaatagactttcaaattatctagtgtacagattgcatgacgttttaaagacaagagctttattctgtccttattggattaagcgcttattagtgaaaatacctcttgagatgcttgagaggcaatagagaattcgaaagcactgtagcatcacagttgggaaattgggcattggatttcaaccagtagttttacctggctctactttttataagctatttcactgtgaaaaagttatttaaccgttacctggccttatttttttctcatctatataatataagagataattttgaatcccttagagtttggttgtggggattaattaaaatattttaagaagtaaatattttaaaaaatgcttagagtttctgaactgcagtttgagattctacatataaagagggggatcttttaatatttttgcttattgtaagcaagagctgaacaaacaaatatccttcctcaacaagacctccaaacttttaccagagtaactgtgcattgcaaaaagaggaataatcagacttttggggaatgaatggacactggctcagaggtgatattgactccagggaaccccaaacatcattgtggtcctccagttaaagtaggggtttatggaagtcaggtaattaatggagtgtttgctcaggtctgatttacagtgggtccatcctgtggtcatttccccagttccagaatgcataattggcatagacattacttagtagttggcagaactcccacattagctgccggattggtaagggaggggtattacagtgggaaaggccaaatcgaagcctctacctagaaaaatagtaaatcataaacaatattgcatccctggagggattgcagagatttgtgccatcatcaaggagttgaaagattcaggggtggtgattcccaccagatgcccattcaactctcccaatgggcctgtgcagaagacagatgaatcctgaagaatgagagtggattatcataagcttaaccaagttgtgactttaattgtagctactgtaccggatgtggttacattgcttgagcaaataaacaaatctcctggtttttagtatgcagccattgatttggcaaattgcctttttctccatttctgtgcataaggcccaccagaagcaatttgcctttaggcaaattggacctttactgtcctacctcaggggtatatcaactctccagctttgtgtcataatcttgttcaaagagactttgattgcttttcgcttccacaagatagcacacaggtccattacattgatgacagtatgctaattgattggatccactaagcaagaagtagcattggtgagacatttgcatgccaggggatgggaaacaaattcaactaaaattcagagaacttctacctgagtaaaattcctaagggtccagtggtatggggcctgttgagatattccttctaaggtgaaagataaattgcttcatttggcccctcctgccccaagaaagagacacaatgcctagtgtgcctattttgattttggaagcaacatattctttatttgggtgtgtcactccagcccatttactgagtgacccaaaaggctgccagttttgagtggggtccagaacaggagaaggctctgcaacagttccagactactgtgcaagatgctctgccacttgggccatataaccagcagatccaatggtgcttgaggtgtcagtggcagataggtatgctgtttggaacctttggcagaccccataggtgcatcacagtggaggcctccagaatattggagcaaggccctgccatcttctgcagataactactctccttttgagagagctcttggcctgttactgggctttggtagaaactgaacatttgactatgagtcaccaaataaccatgctacttgaactacctatcataaactgggtgctttctgactcatctagccataaagcgggtcatgcacagcagcattccgtcatcaaatggaagtgatatatatggcactgggcttgaaaaggtcctgaaggtacaagtaagttacatgaggaagtggctcaaatgcccatggtccccactcttgccaccctgccttctttcccccagcctgcatcaatggcctcatggggagttccctatgatcagttgacagaggaagagaagactagggcctggttcacagatggttctgcatgatatgcaggcaccacccaaaagtagacagctgcagcactacagcccctttctaggacatccttgaaggacagtggcaaacggaaattttcccagtgggcagaacttcaaaaagtgcacctggttattcattttccttggaaaaagaaatcgccagatgtgcaattatatactgattcatgggctgtagccactagattggctggatggtcagggacttggatgaagcatgattggaaaatttgagacaaaaatttggggaagaggtatgtggatgaatttcttacagtggtcaaaactgtgaagatatttgtatctcatatgagtgctcaccaaagggtgatctcagcataggaggatcttactaatcaagtagataggatgactcattctgtggacaccactcagcctccttccccagccattcctgtcattgcccaatgggaccatgaacaaagtggccatggtggcagggatggaggttacgcatgggctcagcaacatggacttccaccaaccaaggttgacctggctacggccaccactgagtgcccaatttgccagcagcagataccaacactgagcccttgatatggcaccattcctcggggtaatcaactggctacttggtggcaggttaattatattggacctctttcatcatggaaagggcagtggtttgtcctgactgaaatagacacttaatccagatagaggttgcttatccttcacacaatgcttctaccaagactaccatcagtggactcacaaaatgccttatccaccttcatggtgttccatgtagcattgcctctgaccaaggcactcactttagctaaagaagtgtgtcagtgggctcatgctgatggaatttactggtcttcccatgttctccattcattctgaagcagctagattgatagaatgtggaatggccttttgaaatcacaattataacactaactaagtgacaatactttgcagggttgggaaaaaaagttatccataaggctgtgtatgctctgaatcagtgtccaatatatggtactgtttctcccatagccaggattcacaggtcgaggaatcaaggtgtggtagtggagccagcatcactcactatcacccctagtgacccactagcaaaatttttgcttcctattttcacattatgttctgctggcctagaggtcttagttccagagagagtagtgctgccaccaggagacacaacaacgattacattaaactgaaagttaagatttccactcagccattttgggctcctcctgcttcgaagtcaacaggctaagaagggagttacagtgttgcctgtggtgattgaaccagactatcaggaggcaatcagtatattacttcacaagggaggcaaggaggagtatgcatggaatacaggagatcttttaggccatcttttagtattgccatgccctgtgattaaggtcaatgggaaactacaatagcccaatccaggcaggaccacaaatggcccagacccttcaggcatgaaggcttgggtcacttcgccaggtaaaaaaccactacctgctgaggtgcttgctgaaggcaaggggactacagaatgaggagcagaagaaggtagacatcaataccagctatgaccacatgaccagttgcagaaatgaggactaaaattgtcatatttcctcctccttttgttaagaacatgtttgtgcatgtatagacttgtactaaaaatgtatcttcatttttatttcctttttcctttatcgtgtgatataagatttattgactttgtatcagtatttaaatgtttttaaatgtatgtaatggcatttgtgttgggaattggtgcactttcgggttgtacaaaggatagctgtattatgttaggcatacttgtgacttattattgtctttatttgaagattatgtatgatttcaggagatgtgtatgggttcaagtttacaagccatggacttgtgatggttaatactgagtgtcagcctgactggattaaaggatgcaaggtattgttcctgggcgtgtttgtgagggtattgacaaagcacactaatgttcgagtcagtggactgggaaaggcaaacccagcctcaatctgggtgggcaccatctagtaagctgccagcatggctaggataaaagcgagcagaggaacatggaaggactaaactggctgagtctttcagccttcatttttcgcccatgctggatgcttcctgaccgtgaacatcagactccaagttcttcagcttttggactcttggacttataccagtggtttttcaagggctctcgagcctttggccacagaatgaaagctgcactgttgacttccctacttttgaggtttcggaactcggactggcttccttgctcctccgattgtagccagcctattgtgggacttgaccttgtgatcatgtgagtcagtactccttaataaattcccctttatatatacatctatcctattagtcctgtccctgactaatacatggggattaattaaaatattttaagaagtaaatcttgttaaaaacgcttggagtttctggactccagtttcaggtcccacatataaagggctgaacagaactttttttactcctgcttattgtaagcaaaatctgaacaaactgaatatcaatgatgttcttctacccaggagaaaattaaggacacaggcacaaactaccatccaaaaatctggagacacacaaatctaaaaagtcacagctaagttctgttttcatgggacagaatttccagaatcataaccaagaacacttaaatggtaattttgatcaaatgctgaagggtaattgtgaaggatggtcagagtgagaagctccttaggcatggagtcctagaaggtctccacacagttgtgtgttctacctctgatcccccaccagtttgtggcattgaagaactaataaaaattgcatcttgactactgagtttgggaagtggcagacttgtcactgtgaaatattatgagagcattgttcatttaaaggtgtgctctacaggggaaaatacattacctgagtcttatctgacttgagggtagggtattctcctacaggtatcctatagttttccagtatcacataagggggagaaaatttttaaaaggtatataattgatatgatttggctctgtgttcccccccaaatctcatgttgaattgtaatctccagttttggaggcagagcctggtgggtggtgatttgatcatgggggtggtttctaacgatttagcactatccccctagttctgtctcatgatagagctataatgagattgggttgtttgaaggtatgaagcatctccctttctccctctcttcctcctgctccagccacgtaagacatgccagcttctctttccaccatgattatgagtttcctgaggacataccagccatgcttcttatacagcctgtggaactgtgagtcaattaaagctcttttctttataaaaacccagagttaggtagttctttatagcaatataaaaatgaactaatatagaaaattggtaccaggaaagtgcggcattactataaagacatctgcaaatgtggaactgactttggacaaaggttggaacagttttgagggctcagtaaaagacaaggagatgagggaaagtttttaacttcctaaagacttgttaaattgttgtgaccaaaatgataatagttatatgtacaatgaagtccgggctgaagtgctcccagatggagatgagaaacatatcgggaactggagtaaaggtcagtcttgctgtgcttcagcaaagagactcttggcactgtgcccctgctccagagatctgcataactttaaacttgcaacatatgatttagggtatctggcaggagaaacttcttgtagcaaagcattcaagatattccctggctgcttctgacattatatactcatatgtgttgtgcaaagatattatttgaaacagaacttacatttaaaagggaagcagagcatgaaaatttaaaaaatgtatcctgaccatgtggtagaaaaggaaaacccattttctggggaagaattcaagcctactacagaaatttgcataaataaagataagctgaatatccaagacaatgaggaaaatacagccaaggtatttcagagacctttgtgacagctcctaccatcacaagtccagtggcctagagggaaaaaatggtttcctgggccaggcccagggctccaccgctttgtgcagcctcaggacatggcattctgcatcccagccactccagctccagccatggctaaaagggccctggatacatctcagaccactgctccagagagtacaagccacaagccttggtggcttccatgtggtgttaaatctgtgattacacaaagggcaagagttaaagttaggaagcctctgcctagatttcagaggatgaaaacacctggatgtccaggcaggagtctgctgcaggggtagagccctcatggagaacctctactagggcagtgcacagaagaaatgtggagaccccacacagagtccccctgggacactgcctatgggagctgtgagaagtgtgccaccatcctccagaccccagaataatagatccaccaacagctttcattgtgcacctggaaaagccgtaggtactcaacaccagcctgtgaaagcagccatggggcctgaaccatgcagagctacaggcacaaagctgcccaagtccttgggaaattacctcttgtattgatgtggtcagaggatgtgagacatagcgtcaaaagagattattttggagctttgagatttagtgatggtcctgctgggttttggacttgcatagggaccgtagccccttcatattggccgatttctctcttttggaatggaagcatttgtgcaatgtttctatttccattgtctcatgtaggtaactcacttgttcatgattttacaggctcataggtggaagggacttgccttgtctcagatgagactttagacttggatttttgagttaatgctagaatgagttaagattcgggggtctattaggaaggcgtgattgtgttttgcaatgtgagaagacatgagatttgggagaggccaggggcagaatgacatggtttggctctgtgtccccacccaaatcccatgttgaattgtaatattcattgttaaaggtggagcctggtgggaggtgattggatgataggggtggtttttaatggtttagtactattctcctagtattaactcatgatagagatatcatgagatctggttgtttgaaagtgtgtaggatcttcccttttgctctctcttcctccttctccagctatgaaggacatgctggcttcccctttaccttctgccataattgtaagtttcctatggtcttgccagccatgcttcctgtacagtctgtggaattgtgagtcaattaaaccttttttctttataaattacccagtcttaattagttatttatagcaatgagagaaaggactaatccaataatacactcccttgataccttaccaccacagcaatagggctccaatataataatagtaaattaccatgaaagagctgtaagatgcagatacaggggtgctttgaaaagctctaagtcaataaggaaaagaaaaacatagtataaaaatatgaagcctctggaatctatgtatagcaaacattaaatgcagtccaacttttagccaaacaaacataaaacctctgtccaaaaggctatttacctcaattcctattttccaatatattatttctagctttcaacaacataaaattatagattatggtaaaatggagtgcaaaacatagtttgaagagacaaagcaagcatcagaatcagactcagatatgacacagatgtagaaattaaggaagaaaatttaaaataagtatgataaataacaaatggaaaatgcagaaaacatgaaagaacaaatggctagttaaagaaaagagatagaaacctgttagaaagcacataaggaaatgccagaaatcataaagcactctgacagcatgaagaatgcctttgttggggtcaccagtagacttgagctgcccatggaaaaaataagtcagcttggcgattggtccatagaaacttgccaaatttaagtgaaaaaaatgatataataataataacaacagtaattttaatcagaatagaatatccataaactgtaataaagttttaaaatgtgcaacttatgcaaaatggtaacgacacaagagaaaaaagagacaaagggcagaataactatttgaattaataattgtttaaaatttgcccaaactaatgacaagcacaaaactacagatcacaggcccatagaacccttagaatacatacaaagcaaactgcacctaaggcatatcatattcaaaatgcagaaaattaaatataaagagaaaatctggatcaaagccagagttaacaaacaaaaacaccttatctataggggtacatgcagaggaattacagtgaaaatttcattggaaacaatgcaagaaagaaaagtgtggacagaaatctttaggctttatgtcctatttccagtgaacttttattcttagaagtaaaggaaaagttaagaagttcagtcaaacaaaagcctagggaagtcagtaccatttgatgggggcagttggaaatagtatagccactttgatgggacagagtttgccagtttttttataaatctaagttttgattactaggtttaaagttatgctctgattaagaaaacaacaaattaaaaaaaatcaacctaactatatggtaggttttaacaccgttctcccttaagccaactggaagagccaataaaagcctgggacaatttgagcatcaaaacaaaaacctgagctgggcgtggtggctcacgcttgtaatcccagccctttagaaggccgagacaggcggattgcccgagctatggagttcgagaccagcctgggcaacacggtgaaaccccgtctccactaaaatacaaaaaaaaaaaaaaaaattaaccaggcatggcggcatgctcctgtaatcccagctactcaagaggctcagacaggagaatcacttgaaccagggaggtgaagactgcagtgagccaagatcgcaccactgcactccagcctggcaacagagtgagactccgtctcaaaacaagcaaaacaaaacaaaacaaaacaaacaaagcaacaacaacaaaaaactgttggattttatcccaaagtttaaaatgaataccatgatattatagatactaaaatttcagatgcatgtctcagattcaattagagatattttctttctttcaaataaatgtgtgttcttgagtaaacaagtgtaatttaattaaaattaacagattacaaatatacatagcactatcaagaatgggaaagcacgagaattagtttaaatagcatcatgttttctgaataattaataagatcatcttataaaataaaatgccactgataagcttttgaaataacttattctcacaattttcttcagattacacatagtatacctgctaaatggagttctcaaagcttccataaacaacttatattaatttttaagaaaacaggttccatcaggtatcatataaagcattaaatatttacttttaaataaaaagttacaaagtaattattagagcagtttgattactgaaaaactggacaagggaaagaaaatacaaggtaattttatattacttcaacttcgtcatttaggcatttatctgtcaatatttaaaaagttttttaataaaatgcatatataaattcaactttgcttttcaaaactatggcatacttacttgatggaattaaatattgaaagaaaaaatacttgccacagtataatattcttgaagaaaaataagaaactactgtgctttgaaaaaactactgatgaatatctattcaactacaacgcctaaatcatgctgaaaattgtaagaaatgttgaagattcacaaccttgcgtttcaggcaacaggatgtgaaaaggagaatagaatttgcacttgtcttggattcaatatctcaagtagtacagaaaatctattgctaagaaaacaagacagtgagactaaaaatgatatctgtaaatagtttagagaataaaaattgtagaatccagtaaatctcaactccttccacctgggtaaaggtcttatttttcttaaggatattttgaaatattagacagtattcaatttttcaatttaccttaatctttttcaagttcaaatatagtaaaggaagatattaagcatcatgaaatgagaccagtaaaaagaaaaatagtttcatgctaaatttacggcatttactacggcttttgcacaagataaattccaaaatctgagggaaattggtgtgtatttagaactacaaaaaataaataaacaaaatagatttagaatgctgtatgttttacaatttgtgatcagagtagcttttattaactaaaagatatatacattgcactattattcaataacatattcaaagtggtgaaactggctcaaattcactaaaaattcagtgtgaaatgtttaaaaattattacaataacttcttgcaagtttattctactttcttattgcctaatgtaatatattaatactttaaatattcatgtaagattatgctgttaaatatatcagtaagcacactttctataatatatttcagtgcagccaaatatgaggcttctttgatgataatatgtatatgttgcacataattttcaaggcattctcaggaatcattaatacaaaattttgttttactgtgtctctttctattgcatatattataaaaacatcaaaaacatgacaagaagacaggagaaagaactgtagtgaatatttggaaatataagctataattattaccaaaatgtaatgagtaagtagaaaatagcaaaagtaaaattaagagcggcatagaatacaggattaagatggcagaaagtaaacacttctccctgagatctaacctaaaatttaaaggaatatcaggcagcaatttacaaactaataaattcatcaacataggaataaaaccatttaaacaagaatgtcagaaaggctaaaatgttagaaattcatagaaatattttaagtctttacattagcaaaataatgacaatttttgagaaaacaatatttcagaagaattataagtggaaagccaaattaagtcacttatagacccaaatcagggtgatctgagtaggaaaatacattttgacatctaaatcatgttgttcatgatattattacctcagattttttccccatcaagtgatttgttttaaaattatctagttaacttaattgaagctacagagcaataagtacaataaacatgctgcaatttcatgcaagaaagattaatcttcatatattttattcaaagaaataaatcctatagaagagattacatctcatataatttcatctatatttttaaatgtacatgaaatgcatgcaaaatattcataggagaattatacctatagcctcaagcactaaacggggcaatgatttccaggttgatttttagatttgatattaatccagtagatttttcaagagaaatttttgtggaatctggtaaggccaatctaatatttatatgaaaatgcaaagaaaccctgatacccagaaacactatcaaggagagcaacaattagaatgtcttacagcaaccaaaaacttagaggaaaaagaacactagtatgaagaaacagaaattatgtcattgtgatattgtgcaaggatttgaaacttagccaatggaaatgatacatgcatataggaacctgttatttttgacaagttggggctggaaattagtgaaaagatgaaaaaattctgtagtgaattgtgtagagttgattgagtgatcaaagtaggataaaagttgttgactgaaattaaaattattgaggcagaaataatttgataggggtttattgaaagccaagtttgaagattgactctggaacacacatcatcaaagctaggtatgttataacctctgttaaaagctgaaatatttttatgaaaaataaaaatatttatgaaaaagtttaggagaagggtgaaggactgctcatatcaatgttgtccttttttattggaggttataatatagaggttaagggcaaggaaatacattcacacaacatctatttactgtagaagacaacaggtaagctaaaatgttttgtgcacaagacaattagtataactttataatttggaaataaattagtcccattttaagtgttggtagatatgtattaattagtaggtgtattagtccattttcatgctgctataaagatactatctgagactggttagtttataaagaaaaaagaaggtttaattaactcagttctgcatggataggaggcctcaggaaacttacagtcacggcagaaggtaaaggggaagcaggcatctccttcacaaggcgacaggagagagagagagtgtgaaagggaaactgccacttttaaaaccatcagatctcatgagaacttcttcactatcatgataacagcatggggcaaacacccccataagccaattacctcccaccaggaccctcccctgacatgttgggattataatttgagatgaaatttggatggggacacacggccaaaccatatcagtatatcaatagtttgagaaactcatgataaaattgtgaagattcattaagaatttgtatttaagcacaggatgtaagccatgatatatgaccacttctaggcagtcaaaatatagtttttttctttacatgtagggatgcatgccttaacatttgtctgacatagcttcagatcctgtttattattcagtatctgattgtcacaatgagtctttttcttctgccttatgatctctcttttagcattactgctggtcagttgcgtctaaacggtgaaagggagggatataatgagtcatgtctgacctctggtcctgttatggctgggatctctgtttttaaggcttctctggggtccccttggccaagaggtgatctgttcaatggtgggggtcttagaagcttatttttagtttacaaaggacaacatgaccaattcctcatcccataaacaaaattagttcctggtatataaaaatgtaaaagatgaaacaataaagacagtagaagttcatacagaaaaatcttcattattttgccatttggccacattttctgaataggtcaaataaaacaacagctatcaaatatgaagaattattttttttattaacagaaaccattaaaatagtgacaatataacatgtaatgtctgtgaatgactggaaatgttaaagggttgaagtttaaaaaatataaaataatcaaaaaataggaaaaataaaaagagaggacttaaagtggtactaaaattttaaaatataaaatgacaaacgagcacaagaattttaaaaatccaaaatttatgtcatgaaagaaataagttatgttataggtagcaaaaatgtcatagtattgtgatagttaatttaatgtgtccccttgtctaggctatgatgcctacttgtttgatcaaatcctactcgtagtaaatagattattgactttaagtaaatatattaaatgacattttttggatagacctcatccaatcagttaaaagtcttcagagcaaaattgaggtttcccagagaagggggcaatctgccacaagactgtaaaatagacatttgaatttccaacctgttgttctcccccacagattatggattttcccaccacatagtcatgtatgccaaatccttaaaatctctttccctctatataattttattttaaaaatttaatgtggaaaattttatttccacatggtcacatgtcaaagaagacagaaacaaatggaaaagcattccatcctcatgactatgaaaaatcaatttcattaaaatggccatactgctgaaagcaacatacagattcaatgctattcttaccaatgacattcttcacgaaactataaaaaactattttaaggatcatatgaaacacacaaacaaacaaacaaaaagcctgaatacccaaggcaatcctaagcaaaaatagcaaagctggaggcattgtgttacctgacttcaaactatactatagggctacagaaaccaaaacagtatggtactggtacaataacagacacatagaccaatggaacagaatagagagcccagaaataaggccacacacctatgaccatctgacctttgacaaagctgacacaaaaaagcaatgggaaaaagaattcctatttagtaaatggtgctgggataactggttagccatatgcagaatattgaaattggatccctttattacaccatgtacaaaaatcaacttaggatggattaaagacttaaatgtaaaacccaaaactataaaaaccctggaagaaaatctaggcaataccactcaggacatagacacgggcaaagatttcacgacaaagacactaaaaacatgtcaacaaaaacaaaaattgacaaatgaaatccaattaaactttagagtttttgcacagcaaaagaaactatcaacagagtgaacagacaacctacagaacggaggaaaatatttacaaactatgcatctaaaaaaggtctaatatccaatatccataaagaacttaaatttacaagaaacacacaatcccattaaaaagtatgcaaaggacgtgaatatatactcttcaaaagaagacacacatgtagccaacaagcatatgaagaaaagctcaataccactgatcatcagacaaatgcaaatcaaaaccacaatgagataccatctcacaccagtcagaatggttagtgttaaaaagtcaaaaaatatgctggagaggttgtggagaatagggaacacttgtacactgttagtgggagtgaattttggttcaaccattgtggaaggcagtatggaaattcctcaaagagttaaaagcagaactagcattcatccagcaatcccattactgggtatatacccagaggaatagaaatcattctaccataaaaacacatgcatgtgaatgttcattccagcactattattcacaatagcaaagacatggaatcagtctaaatgctcatcaatgacagactggataaacaaaatgtggtacatgtacaccgtggaatattatgaagtcataaaaatagtgagatcatgttctttgcagggactgatggagctggaggccactatcctttgcaaaataacacaagaacagaaaaccaaatagcacatgttctcacttataagtgggagctaaatgatgagaaaacatgaatgcaaagaagggaaaaacagacactagggcctaattgagggtggagggtgagagaagagagaggaacagaaaagataactattggatactgggctcagtacctggcagatgaaataatttgtacaacaaatccccatgatgtgagttcacctatgtaccaaaccctcacatgtatgtttgaacctaaaataaatgtgtagaaaatttataaaagggcatttttagcacatcattcattttattttattttatttttttattttattttattttattttatttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccgcacatcattcataatagtaactgaaatagaaagccaaataccaattaagaataaaattttaactgaaataagccagggaaataaagacaaatgtctcattatctcactcatttaaaatctggaatttaaaaaggtggatgccaggggctagagaggtttgatggggagacggttggggagttgttagttaagggataccaaatttcagttaggcaggcacaataactttaagagatctgttgcactagttgatgactttagtaatagcaacacattgcattcttgacaaaaatgcaagaaagtggaggccaagtgttctcatgacaaaattattgaggtaatgcatatgttcattagctagatttagtcattccacaatgtatacatatctttaaagcattatgttgtacatggtaagtccattatattatctgtcaatttttaaaaattgaggaaaaaagtttaaaaaaatcactaactcaaattaatttacaaatcaatgttgccattttatctcatgctacatgcagtatataatatgaaaatacaataggtttacaatgtgaaaagaaagaataaaatgtatgtgaattgttatatctttgtgtatttctgtaggacagataataaaatcaaatgtacttcagttttatgttacaacctgaacatttctattaaaaggacagataagaaagaattcatcctgtatgattctatttgcatgaaattcaaattataaaaagcgaataatttgggttaaaataagaatgctaataaagtgggagaagtaataatagagagaagccataaggcagctttaacatgctaacttaattgtatttgttgcacattttgaaggtacatggctataattactttggagaatttactgagctttatatttaagatttgtacattctcacatgtatatgtgtgatatggtttggctgtgtccccatgcaaatctcatctcgaattgtaatcctaattgtaattccaacgtgtcaaggaagggacctggtggcaggtgactggatcatgcgggctgctcccctatgctgttctcacaagatctgatggttttgtaagtggcagtttcccctgcactctctctcttgcctgccaccatgaaagatgtgccttgcttcgcctttgccttccactatgattttaagtttcctgaggcctccccagccatgcataactatgagtccaataaacctcttttctttatatattgtccaatctcacttattctttataaaatgtgaaaatggactaatacaatgtgtatgaaaaatatacagtatatgaaaagaatatggtataagtcagtaaaaagtttaaaatggaaaggtcatcatacaggattaatattgactatatcaatgactaatttcaagtcaaataaggtgaaggtgctaattaaaggaaaaacaaaattttatgtatccttgtgtatcattgggtaccacaggatcctagtggtaatttgcaattgtatcatattgtataattataaacatataaatagaaataactttcttaaactcaagttcttatggcaataaaacatcctgcttgtttacaaaaatatatattaaaaaataaaattcaaattaacattactttagtatgacaggtgttgttttgctcaaattaatcacatcccagaagtaaagtatttttctattgatgactttttattgcaaattatcactccaaagaagagttcagtcttcttaaatggtaaaataattcaacctgacaacaatagcagatgctgttaataacagtaatcagtttttgtctcaataaaattaagacattccaacttaattttgctgaatatatatatttccaaacatgaacaccatattttacactctttttttgctcattaacagttaaaccataaatacatttaatgatgcactgaaagccaaaacttgaatatgtttgtcatttaattattattgtataggtttattttatcaccaaaataaaaaaaaaaagggaagatgaactacaaatgtgaaacttggaaacttacaaatattcagtggttattgagaaatagccaagactattcaacatggatttaaagagcaaatttagtctaataataaatactaaactgactagacaattggacttcatgaatacctaaagttccaaatcttagaatgggatgcagaaaaatacttgtttctcagataggaagttccagcctactctatgacaatgtcttcattctggaagttggctgtgtaaccccttcactcctgtgtaaaatggtcatctttgctgaggaattgctctctgaagatatgtcacaaccaatctttacttgttatagatacaattagatatacaataattatggataaacataatggatacaattatgctgtgccattacttactctttctcagtcccttgcagggtaccagttgacttatcagattgttgtttctccttgcaattcctcttgagtaattaataaatttaataccaaatgtgttttgaatttgtgtttgcatttctgttttcagctgggacttcatttaaaacttagggagtgtaattttaaaatagcctgctctgagtactttatcgacaagaatttaatatacaaactgctaagcatgaaaataataaaatttaaaccgggcaactgggaatttctttaggatgttttctcctcttataatgacatttaagccacttctcaaatctagcaattgatctcaacagttctttactgatttctcttactgagctgttatttctgaaaactttactgcatttatcactaagcacagtgttataatcatgtgaaaaatcgttctttttcttaatttttttcaggattgctactccttgtttaaatgttcatatctttcctcttcaatgaccatttttctcgtacatttcttctttcctttgtatatcaggtaggcgaattaaacttttctttcttttttttctcattttttatatacactctcttttgctctcacagtaagacaaaaaatatattttgccagagaatattgtaatttttgaagaaaaatactacttaattgagtgtcagcaagtaaacaaatgagtaatagaataaatacatttcaaatgcctccacaaaaattatgcttctctagcagtggtaggtttttgtggaaactgaaaatattgcttatttttaaacctctctctatttccaaaatgtaaaggttcctgtttgtcaacaatttgtggccatgccagtgttttagtttgctaagatgtccataacacaataccacagactgagtggcttaaccatcataaatgtattttctgatggttttgggggctagcagtccaagcactgttagtatgttttgtttcctctgagttctctctccctgtcttgcagacggtcaccttcttgctctgtatttgtgtagtatttacatataaccaacacacatcttcccagatacatacaacattatctctagattacttataatacctaatacaatgtaagtgctttgtaaatagttgttacacggtattcttaaatttgtattattttttattattgtagtcttattttcattgagtttttttcttgattattttcatttcacagttggttgaatctatgagtgcagaagccatgaatagagaaccaagtattcatacattaaaacatttgattttaaatatattcttccttggaaagacctcatttaaaaacaccttctagcaaagtgaaaatggaacctcaaaaagattaaatcatgatttcaagggctgtccttgaaacataaacagggcccttaaataaacagggcaatgcgaggcatctcagaatgagtatcctctgtgttaaacaaaataaatcagaatatattacataatttgatagtattaataaaaggttgggatttataaatgatatatttacaaaggtttaaagatgatgatgctgaagcaaaccgtgttgaggggaatacacaagaaattaatagttcaggtatgaaaagacattcagaatatttgagaaattttggtaagaaaagagaaagtatttaatatatatacttcacttttttctttgaaagttatatgttatgatatcactttattcatgagtccagtaaaaccatataattgtgctttcataaataacatacctacaattgataatattttttcaatttttataattaacctaatgtaaagcataaaaatccaattttaaagaatgaatatataataaatattataaaaataatgttatagcttataatatttggaagcatgggagatacaaataaaataataagacaggagtgaagggtaaacattttctgatacatatcaggaggtacttcttaaaatttatgttctgtaatattaattagttgaaaaggtaaatgtaagtcatgataacatgtatcttcttacaaatagcctatcacttcataccagaatatattgagttatcatttctaaatgcaaggatttttacaatatcaatattccttctgaatttttttgtactattttgcttttacaacctagcatcacaacaatccatctgaattaaaagacagccagaatcgttcaaagagtagggggaattttggagttatatttaatttacattaacatcctatctttgagagcttgtaatagctaattatataaaaaagtgtcattaaatctgcatgtatgatatctaagattacttttattaaaatgatgccttcctctaacctaccttttattttcaaacacttgctatgcttacatacattgttgtttttaatgttcactttggtttccattattatccccatttttcaggtgagaaaaaaatacatcttggtgtttgccttagtagccatcacaaaagttatgtcctggttacagtagttagaatttgcacttaattaaacaatttcagagaccacactaacaataaatatgccaagacctattatgttgtctgtataataaaatcaagagaaatataaacttctccaaaataatattttcaaagatgaactgtttttgaacaaaaaataataataataaagtcaacatttttaatcaaattaaaatcctggctatatttattctaggcattggcggtaattcaacataatttaagaaagtgaaactgtttttgagaaggaagtatgtagtatgctttcaatttacatagaagattctgaggaccctaactcagaaatcaagtttactcattagaaggtggcatttcagcatgtggtctgagattctctgtgagtcatctgcttcagtggtgacacacacactgttttattaacagcatcaagacatgaaaagcaattgtgttttttagaggctctttctattaacacagtgtaaaagactccagttttacttaaaatgaacaaaacaaaaatgcgatcgaaaaacgaaatgttcccactcaaatgtatgcttctgtttcatcatgtttgtttctcactttgatgcttagattgaacagtttcacaagtaaatacaactggttggctcatatatattcatgaagagagaaaaaatttccttctgagtagctccacacagaaaagtttccctagacgttttgaatcctgaaagctagacttcaatacggcgcagaatgacccacgtggagagatggaggaatgctctgggtttttgtttttttttttttcatttacactctatataagccacaactgaccatgatgtttctatcttaaaccaatgtctttagtcatgctgttgtattgtttcctaattctctctaactatgtgatgaaatttagctaccactcgacctcttttacttccaagtacaaatacattgggggtcagcaggagatgttagaatggcttgggtgagatgttctcatccaaaagatgaatctttactgtttacacctgttggataccacatagaagagggatgagagttaagcacttcaaaattcagtgtggctgaatggtcatagtcttgcattaaataaagtattctgaggattttctgacagctatagaacacacaaagtgaggctaatgagtaaatattgtttatttcattatttgtatttcccagtgttttacatttctccttcatttagtttatttgcatttttctgtccattcatttatatcattgtttatgtcatccattatttatgtatttttaattttctatttcccaaattttatcctatttgtgcaaccctctgaccccaacactgtgtggttcacttcctacttaggtatagtttaatctgcatttttaaataaaaacatctaacattaaatacaaatatgccttttccaatgaaaacattttaatatgccaataaaatattatgatctaaaccctgccttaattgagataaaatatttagaatatattttattactggcaagctcaactctcatctacttgcttaacccacaagcagtcagaaataatgtaaaattcaaaggtgctcttattattttctttatgagaccattttcacgtaaaggaccatttttagaagttatattgcagtgcagtttcattattgtaatattggagtttattttttacatttagcccacaatattagacatatcattcctctttttatgtgttttatcatcaatttacctcttttttggatatgatttttattcagttatggtacatcaagtaattgtgtagtgatctaatacttgcatatatagaaatgtcttacctctgctctggctggtaaataataccttggctgagtgtatttcttaaaaatatttcttttaataattttaatattagaatattacctccctccctcttcttctctccataccttccctccttccttcctttatttttttattccatccttcttcctttcctttttctatacagaagagtatcttggacaagtaccaaaatttaaataaggtctgtaaaatagaatgtataatggatccttcataaaaaaatacacattaaaaaattagtgtgtgatgcaggcagtggtggaggtttgatgtcagtagtgtattttccaatttctcagaaaaagaattctttgaaacattattgccgtctttctgtacattaataattgtgttaaaataaatgcaaaaatgttagattaaatttgaccttttattttttagatatataattctgtgtgaatttgattgcacttttgaaagtaaaccacaatctatgcatgtaattatcatgaatccttataattttatgttgttttgtcatccactttgaatatagattaacttttttgtaccacaagtagggatcagtcaaccttgacatagtttccagttttttgtctcctcccaattcctcaaggtggttgacctatatatttacctgtacaactgcctcctggtgacccctccctatgtaagagctagatacaacctacttaactcaccccactgaccttgatatcccacataaattatgtagacatatggcaatggccactagtcagagcatgaccccatggaacctgcccctgcctgctctaaagccaccaagtagagctcccccaggaaacttgcttgggtaacatgctggaccccaagaaaggccttgatccacaggcctcttgctcaaacttgctcttctctctcacacacacttcttacctgctggttgagcacacctgtcctgtctgactttcctgtttccatcgactccgtgaggtgtgctgccctcttccctctgatctgtaagaaatacactgttcctgttatttcatgtgttttgttgagttgctcctctgtgtctcacctgaccaactcacccaaacctaacttttttcctgttctgagctctcctagagagtggcgatcttggcggagataaactaagcacatatcaaacaagaaccacaaggtaatctgccagcataaaaagtgtcttgtgaaaaaaaacaccgggttacaggcattggattatctgtcaggataaagatgtatccgtggaaggcacaccataaatatcaagcaccaattcccttggaattctatcacggtagggagagagttcatctccagaaagagaccccaagaccaaatttgagggaaacataacagtcatgctgtaagaattcctccttacacatggaattcagaagtcccctcgaaatagttccaaagctgtgtcttttttgcagtaattttaccctggtcactgtgcagcactgtcaacaaggaaaactcaggcctctatgtaagttttcttgtattttctggtttaattctctctcacagaaattataatatgtgtgtattctgtatcttgtgtcatttttcacacttctgctaatattagtgtttataatttttctttaacctgtccctctaaatatatgactcttctatattttatgtgctaacacaaattcactatatgcagcatcaaatgcataacaaagcaatattttaaaaagagtgatgtattccacttgacaaaaaatattttgcagacattcagcttttccttgctgtcatttatgtgtctttctcacaaaagcctttggttagaaaatgaataaaataaaaactgtaatttttcagcatcaaagcttttaaaaaatatagcgctgaaattttcttttagttatttctctctgctcacatttacagagctttaaagtattgtctttctcattagcctttggtgatgataggagccatatactgaattatcttctaaatggtttgcacagattgtcaataacaacacagtaattcaaaatgctattataatgcaccatgtatcatagaaacattatgcaagctatcaaaatataatggctgtcttctctttcaagttgttattattattattatttcctttctgaaatttttactcttaatgatctttggtctaccattgtagattaaagacagttataggaatagaattattactaaatgagaaatagtaatactgttaatgctagtagtaaaggtctaggcaaattataattattttatatgcttttgttcattcatttattaattcattcaataggtatttgcttattataagcactgttgtgatgatataacaggacataaaacagaaaataaccctgcttttttaacttacataataataataaagaagttatagcattaaaaatttaggctttttaaaatgtatgcttctaattcagtgatatagagattactgttaaaataagtatgaatgttcaaaacataattagaatgctgagcaaagctataataaaatttgttacatttttagaaattatagtatgatttataaaatttcataaaaatatgccatatatatacatatagtaagttctgagttaagatcatctgtagtttgtgggaaattgactttaagtgaaatgatgtattacaaagcaattgtttttctcaacaacattataaaaaatgtcattgaaagaaacaaatttaatctagaaccttctgtatataatttcatgtaagctcatagttttcaaaaactatccacaaggttaagtgaggacttacataccatttcatataaaaataattagtatataaatttaccacattctactttagcaggactttctttcttctcaaaatgtaacattaaagtagatttatgtaggttagatacatgattcagaaatacatttttccttttctgaattgcactgatacacacacacatacagtacacataagtgttcaatagtgtcctataatattttacccattcctcagtaaagagtattgaatgtctaggtcagtcttgacttaaactttcactttcctttaatcccttgcttttaggcaagccatcacattctaatcagttcatgaaagagctttgaagaagttttggttgcattagaaaacggatagatttcagcagaatatatgttcttgctacaatcacccccttcctgtttttggtatacatatgacacctagagcacaggaagacatcttgtgaccataaacctatgcaaaaaaagacagtgttcaaagaatgaaaaatgagaaagaatacagacttcatttaaagacatgataaatgtacttttcataaggttacttttaccagatttttctgattcacactattatgcatcagatatgtccatatgagtcttgttcaaaatttttaatgcacatatttatcatatgtacattcctcctacctctagctctcattatattttatgctaaaaaaatggcaatgcctgttttttcagagatgcaattgagtagcctgccacagagcaatataaatttggtcatagtgagaatacatgaattctactgcgtatgttttccaggtgggatctcctcattctacaccagaagtttaaatatactttgtagaatgtagaatgtactcgttgaaaagaacaaataatcacttgggccatttgtttttccaaataaattatgtttatctagcaaagtgtatgattaattgcatatgcatgtgcttgaaacagttaaacaaatctaaaaatatttgaaataaataatggagtatatttcatctttgtccatagagttgtgtgtcaacttatctttcatttctgtactcaattacatgattgttaaatttattttatgaaattaaatgttagattaatcaaaatgaggaaataaagggcaataaaagatgaaattgatttctaaatatttgagtgcagaaattgattactaaatatttggcttacaaatcctttcagatgtctcatgaaagaccagagaagaaaaaataccatttttttcttaccacatgtatatcacagtaacatacttttaagtagtattctttattcatataattgtaaatatttttctataagcaaattcaatttacactatgtaggggctgggtataatttcatagtatcatatttacttatttctctcatatttttagatgtagaatttatttccaattttggaattatgaaaactgaaatatgttaattgtatggtagttttcaataaatgttatactaccagtattattaattgaataaggtaattattatgaattttcaagaccatagacatttcttacttctcattttaataattgtttttcatcacttcttccttgtgctatgggtattatgggatttttgtttgatttttgtaatgtagatactttcattttatggcatatggaaaaaaatcaggcatgaccattatccatatcaattatgatactgggaaatcagtattagcaaaggaaaatgtgcatggtatgtgtgtgtgtttatgtttgtgtgtgtgtatgtgtgtgtatacttaacagtatagtatgtgtccttttatatatatgttctaattatacaataggcctgaaagttctgatgtctgctttgaatggtattgaagccctaaagtgaggtctgatacgtagtaaaaaccaaagagcttgtagatgagaagcaataacaacaaatgaaaagagacatactgatgttcattaactcagaaaactgtgcgacctaagatattggtcaatagaaatgttcacggcaagttttgcaacagatggactctccgtctaaccgtgattgtcatcattccacaaccacacacatgtacataatttagaaagaccatctgaggagattatggacagctttctacgtggtggttataaccacagctgttgttatttgtgaaattcttagcatgtagctactaccctatcatcaataacattatgtcacctatctcagggaaaacattcagagcttgtctttgttgtgcacagaacatctgagaaataagtaaaaataacaatatcacaaataactctcttgctttctttctcaacatacgacatgcctgctcctctctttaccttctgccatgattgtaagctatctgaggcctcaccagaagcagatgctggcactatccttcttgtatagcctgcagaactgtgagccaaataaacttctttctttaaaaatttttttaaaaagaaataacaacaataatatttgtaacacaagtgtttctgttgtagatgtgagctttctctaaggatgtgtgttttcttttttccagaaatggcagaaatcattaattaatggggtaacattgggtttcatacagtctcaaaaatgagttgatattgtggtttgcctcagaaatacctattatttattctgaaagtgtttatcaagacatctgaacaacaataagttctttggaggatcaaagatacctgtggatattcacggaaaaaaaatgacacaaaatcattttttattatatgaatctattttaaaataattccacgcagcaaaacctaaaattggtgttcttaatttgttttcaattagaaagcgacaatctgaataatcttatactaacaaattattttattcattatacctaggcaaaaattaatcagtgaatatcaaatacagtatagtttatgcgaaaagctcgttttcacatatttcatgctcagttcctattaggaggaatagtgagattttgaacatctgtttttaaaaataagtgttttaattagcaggatacagagtgtcttcaaataacaccatcattcccaagggaactccaccctgagggagttaaaagaactccatgaaacatgctggtaaccttctgcttgtaacagaaggaccatgacactctctgtggcctacttggctcatgcacacagaacagtttattgaatgaactaaattacatagggggcagcataaagccactttattctttcccaaaattgtcctgtcattgatttagtctctcagcttgcttttcttacacaggataaaagatctggtttgtcagtcattagaaaaccatattctattgcgttaataataaaataaagagacatgaaaattccaaactttttgtaagttaagtgaaattcacggctatccaaagccagaaaaatcacaatggggaggaaggacttggtgcttcctttttctttttcttgcttaatctcatcctctatcttagccgttgtttgtggctttactatatttgggacaagaggacagagaggcaggagaggtaggagacataactgcgctatgtagtttttttttttttttttgagacggagtctcactctgtcacctaggctgaagtgcagtggtgcgatctcggctcactgtaacctctgcctcctcccgggttcacgtcactctcctgcctcagcctcctgagtagctgggactacaggcacgtgccactacacctggctaatttgttgtatttttagtagagatggggtttcaccatgttggccagggtggtcttgatctcctgaccttgtgatccgccaccttggcctcccaagcctggccccctcgaagatgtagtttaatgtgcactggtggtttctagctatggcatattccaaacactaatgttttttcttttgtgatgtgttttctataggttcttcagagaactcccaccagtgtgacttctcacaattttattgatctagacaatacctctcacaaatgggatgactttttaaggggcacctacttcagattcctgccttagtcctcatggggccacagtcaacacacatctttgctctgacaaaatctggtactgcctttctcaaaaagtcacctgccctctctagcctaagtaagaagcaagtgatccactcttattttaatatcatccatttcttgcctataaacaaattgcacaaagtaaataaaatgtatcctttaaagaaaagatgtatagatttacatttaaaaaaattatattcaacaaagatatcatggataaagccaaaagacaagaaatgattgagagataaaaactgcaactcatataaacagcacaacataggtatccagaataaaacatctatctatctatctatccatccatcatctatctgtctataaagtgaaaataagttattagaatgattgaacataagttatgtcttaacaagttatagaagataaaataaataagcaaaatagaaaataaatacaatctacttcacttttctgagaaatgaaaaattctactaataaaatgtgacttttgaatacaccaaactttaaggtaagtgtcaaaatcaagtgatgtattggaaaacgagcattgtacttgctggtgggagtgtaaatgatacaaactctttgaagaacacttttcctacatctattaaatcttaagacatgcatgtcatctggtttttagtttcactccttttattacatttagagatacttttccatatgtgacaaaagaggaaatccaattgtgtgacagtttattggagtattgtttgcaataacccaaacaattgagaaaatctaaatgttcatcagtagaagatggcataatcatactaataaatcaacacaaatggaagcatatctactaatgtgtataccatcatacaatgtaatactgaagaaagaaagttttgctaagactcaataaattccaatttgtaatgatataggtatccacattcaggatagtaatacctgcaggggaatatgggaaaagacttagattgagggcttcaaatatatttagaacattatcttactgaaaatgtcatgaataacatgttataatatttaaaatctagtaaagcaggatggtagataacatcatcactcatactatttactaatgtttggtatgcttaagaatatctcagaatgaaataaataaatctataatcattgcctaataaaaatgtagatagcatttttataatttttcaaagaaatgattatccaggccctaaagcctaaccaccaaatcattttattataaatctagaaccagaaataccttttgactcagcaatcccattactgggtatatacccaaaggattataaaccattctactataaagacacatgcacacgtatgtttattgcagcactgttcacaatagcaaagacttggaaccaacccaaatggccatctatgatagactggataaagaacatgtggcacatatacaccatggaatactatgcatccataaaaaaggatgagttcatgtcctttgcagtgacacgggtgaagctggaaaccatcattctcagcaaactaaggcaggaacagaaccaaataccacatgttctcactcataagtgggagttgaacaatgagaacacatggacacagggatgggaacatcacacactggggcctattgggcagtgaggggctaggggaggaatagcattaggagaaatacctaatgtagatgatgggttgatgggtgcagcaaactaccatggtaacaaacctgcatgttctgcacatgtatcccagaatttaaagtataataaaaaaaagggaaacaattgatagatattagtacatgaacatttaaaacatttatatgtaaaaatatagtataagtacataaatatacgttatattttggtaacattactttcaagaattttggtacaacattttatgtgtgttatcaaggagaaattaagtaactgaagagactaagagaattccttaattctaacttatgtacatataaaagggtacatgttaagtattattaattttctgaaactttattttttcatatgttttaattattcatttttaaaaatacttcaacttttactttagatttagggtgtacatgtgcaggtttgttacatgggtatattgcatcatgctgaggttttagtacaagtgctcccatcacagaggtagtgagcatagtacccaataggttttcaaccccttctcccaccttcccttcccctctagtagtctccattgtctattgttgacatctctatgtgcatgagtacccaacttttaactccctcttaagtgagaacacttgctatttgaatttctgttcctgcattaattcgcttaagataatggcctccagatacatccatgttgctacataggacatgatttcattccttttatggctgcttgtattccatggtgtatatatcccattttctttatccaatccattgttgataagcacccaggttgattctatgtttttgctactgcgaatagggttgcgatgaacctacaagtgcatgtgtctttttggtagaatgatttatttcttttggatgtatacccagtaatgagattgctggtcgagtggtagttctatttcaagttctttcagaaatctccaaacttctttccacagtggctaaactaatttaaatccccaacaacagtgtataagcattccctttagtctgcagcctcgccagcatctgttgttttgtgactttttaatcacagccattctgattgatgtgaggtgttacctcattgtggttttgatttgcatttctcttatgattagtgatgctgaaagtattttttaatgtttgttggccatttttatgtcttcttttgataaatgtctgttcatgtcctttgcccattttttaatgaggttattttttgcttgttgaattctttcagttccttatacattctgcatattaaacctttgtcagatgcatagtttgggaatattttctccaatttctataggctgtttactctgtaaatcatttttgtttgtttttggatttttttatttttttctgtgcagaagctctttggtttaattaggtcccacttgtcaatttctgtttttgttgtaattgattttgaggacttggtcataaattctttcctaagaatgacaggcagaatgatgtttcccagaaggtctttagcttaattaggtcccacttgtcattttttgtttttgttgcaattgcttttgagaatttagtaataaatcattttccaaggattataggcagaatggtgtttcctaggtgttctaggatacttacagttcaatgtcttacatttacatctttaatatatcttgagttaatttgatatatggtgaaaggtatggtgaaagtttcattttttttcctgaagctttcttgatattgtcaaatttgattatttgtctgaattttaatatctagtttctgagacagttttattcagaattttaaaataattgttccaattttttcctactgcctgttcttgtaatgtacattggatacaaacctgtacattggatacaaacacattttttttcctccttcttgatctctggcattaggcccttttcattgtcttcagtattataaaatttcattttttattggtgtagggaacgttttattaaaagatttttgaatacttcagttgttctctattatgttcccatttttctttactgaggccaagagaatgtcccttgcagacctccaactgcagggaggataactgatcaaggatcccagcagctgtgctctgaaaaccatcaatacctttgcccctttcctgggagccatgtgaatcctgaaacccaaattggacttgtagacttcctgaaggccttgccaacctgcgagatgatttcaccaaacattctctccctctgtcctttactcgggatcagctttgcatcatgttctgactgcatttgcatttcagcctcccttgactcctcctattttctttcttacaggtgttttttcttttttttctctctcttcattccatcttggcatttccttcttagtgaatgtggactaacaaacctttatattgcacatctaatctagcatattgcacttcattgctttagctttctcttattaaactctaataatacacacacacacacacacacacacacacacacacacactgctttacatatttgtcccaagtacttatcttgtctgatttttcttgctcccaaaaagccagtatttatttaatgaatgaaatgctttcctaaaatatttttcttaagtattttcttacttgaagagtaccagcacattttattattaaatatcttgcatattttatcacattttactttttcggtgggtatatgcattattcttccatggctaccataaaaattaccaccaacttagtggtttataacagcacaaatttattatatctagataaaaagtctgagcagggtgacagtgggctaatgtaatcaaggtgttggtggtctccttcctggagtttctaaggaagaatccatttccttgttaattaatattgctggcatatttcaattcccatggttataggacattttccctgttggctgtcatctgaaggttgttgtcaccacccagaagccactgcatttcttggttcagggcctgcaacccccaccttcaaaacccacaacaaggagtagagtttctttcatacttgcctgtgttcctgtctgaacaaggttttctatctgtcagaatagccattcaaaaatctgtcgtgtgttgaacactcttatctttctgttgtggggcgtataattgtcccttccaccttctaactcccatgttcaagcacaatccccagtatgatggcatttggagttgggactttggcaggtaattagatatatatgaggtcatgacagtggggtctgtatgagagacttagtgcccttctaagcagaggaagagaccagagtgcttgtatactggctcattcgatctcagtccccaccgccacctgcctcctgctctctctctctttaccaagcgagggcacaacaagaaggaagtcccctacaagttagaaagccctcaccaggaacaaaatctaccaaaaccttgacgttggactccccagtccccaaaattgtaagaaataaatgtttgttgtttaagttattcagtctatggtactttgttatagcagcctgaggaggctgcagcagttttcatttctgccttatcaccaaattcactggttccatattttcatgtaatttttacatttatatagcagtttccctcatttttcaaaagacagtatgggttgttgcagctgcctaaccattcagttgtatgtttttatgacattttattaggtattgaatttgttcaccattctgttgttgtttactctcatattttgactggatttatgaaagctgaaatcctgtctcacattgaagactttctaaagtttcctgtttataattcagaaagaagttatatcttaaatctcatcctttctataagacaccctgggtcaaccgagtctgtcattttacatttgtgatattgtagtatattatcaatgtaaaataaaagatttatttatttttggttttttattgagaaagggttttgctccgttacccaggctggagtgtagtggtgctttcatagctcacagcagccacaacctcctgggctcaagcaatccttctgcctcagcctcctgcatagctatgactacaggtacatgccaccacgccagactaatttttaaattttttgtagagatgagttctgccaatgttgtcctggctgatttctaactcctggcctcaagcaatcctactgacttggcctcccaaagtgctggtattacagatgtgagccactgcacctggcacaaaatgaattttttgtattttcatttataaagttatcaaagttttggctcaaatactatgcccaatattctttattcaaaatgcatagttttattctttcttattttatgctataaggaattttacaaatgattatctaattaacaataaactcaaaactaaaaccacagaggacctttgatatattatttaaaattgatatcattatgaaataagttctgctcctaacacagatcttctacttttcaaataaattatattttggaagaaaattattaggtgatttcaatcaacacattacaaatgtatgagattacggtaaataaaaacttgtatataattggtgaatatttatgttgaattttaattatttcctaaaaagtgctgattatatcagttttaagtcttgcatttcatttttcaattttaaaatctattttttttctgttttctaaattgacaatatttgagtggcaattaaattgcatcctctgccaatcaatcatataagcattttatatgcagactgaaaatatattgcacatgtgacatgggaaatcaaatttggggttgttggaatgagggataacaaattgtatgaaacaggatgaatgtgattgtaattatttgtgtccgtctgttctcacactgctataaagataccatctgagactgggtcattcataaacaaaggaggtttaattgacttacagttccacatggctggggaggcctcaggaaaattacaatcgtggcagaaggggaagcaggcaccttcttcccaaggcggcaggagagagtgtgagcttttgaagaaggaactgtcaaacccttatgaaaccatcagatctcatgagacgtcactatcatgagaacagcgtggaggaaactgcccctgtgatctaatgacttcccatcaggttcctcccttcacatgtggagatggtgggattacaattcaagatgacagatttgggtggggacacagccagaacatatcattgttattttgtgaatggccataataaaataataattacaatcacattcatcagtaacttttcttaagaaagtaactatgttatcatgcattcatttgattcacaaaatgaagccatttttgtaaaaaagaaaatattagaattctggaaaaaatgttattagtaagatagttgtaaaaagcttatatattaatagatattacttatacaaataagttctaaaaactatgctatagaaatagtatacttaaaactaatcatataattcaaattatatagttattaattaaataagttggggaacagcaggtttcttaatctattgaatctgatatctctgcaaaaagacaaattaatttaaaagcttcctcaagtatgacagttaatgattacagtagatttattaatgtttctagaaagtgaactaaatattaaattcatcttaaagataataaacaaaaagcaaaacttaagtaatataccctttaaaaagaaagttaataatctgcagtgttgcatgaagcccagaagctgtgtttatctgtagataccacagaatatgtctatactatgaatgaattaacataacatttttacagtgtattatttctccctataaaatgaaaaaatatatgaaatgacattataaaatgaattctttacataatagtttgcatatcattatatttaacacaatgtcattatattttactcaaaatattatgcgtgtattgagttaggtttagaagataatgattttgacaccactcatgccttaaaaacaacaaaataagcagaggcacaaaaatccaagtagttaatttgatttcgaggtaaaaaattccatactatatagtagttttagatattcagttaaagaatgcagtcagtgggtaattcttccaaatatagtggctaacatttttaaaagttaattttgaaccatttttattgattccattttgagacctaactttttaaaatgtataaaataacttgggaattttgaaaataccataccaaataaaataaaaatctatctcaagggcaatgctaagagaggtttttctttccatatgtcatcgaagaagattgctaattgacttttcaacatatcctcctaatctagggtaggcaaactgtgtcccactgaccaaatctgatgacctttcacctgttttgtgagttaagaatttttgttgtttatgttttttaacatttttaaatggttcattttaagtagttatataagcacctagataatgtcctcaattttgccccttgggctgcaagcttgatatattttcattgtagcatttttatagaaaatgtttctcaactcttgtgacttgaagcaaaactgcataaggatttaaatccacctattgacatgtttactatacatcttccctgaattttttttagtttctacaaaacaagtaaaacaaatggaaacatgtatttgcatctctttctctcttactgtttactattatcattacctggaagcaatatttactttcatctattaggtataaagctgttagaagaatatacagctaaaatatcctttataaagttaactaatacgaatacacaggatcattatattagtgcatttctttttaaggaataacatattagtggtataagagaaaaaaaatgcttaaccagtggatcaaaatgcatcaaaacaatacaatgcaatgaggcaaaacaatgcataataaaataatggactgataaagtcagtgatagcatgtcacacacaagaaattaatcaagatataataggttatgttatgtcagtacatacctgaagatcttgggaaaagttttgcacgttataaaattggattaaccctttcaagttctacaggtgcatctaaatttgccacaaagttatgaaaatataatacactgtttcaatatattgaatgtcctattgatatggtttggatctgtgtcccaccaaatcttgtgtcgaattatagtccccagggttggaggtggagcctggtgggaggtggttggataatgggggtggatttctcatgaatggtttagcaccattcccttgggtgctattctcctgatagtgagttttcatgagatcgggttgtttaaaaccatgtagcacctcccgctgctctcttttgctcttgttcctgccatgtaagatgggcctactctctactcccaccagttcaccatgattgtaagttcactgaggcctctctagaagccaagcggatgccagcatcatgcttcctgtacagcctgtggaaccatgagccaattacatttcttttctttataaattacccagtctcaggtatttcttcatagcaatgtgagaatggcctaatacacctatgtatagtggtggaggtcgagtgggacaaaacttttttattgttgttctttaagttattttcaaacattaacattttacatggtttgtaggatcatgaaaatatgaataagattaatattattttaatgattactgtaggataatgtaaaagaaaatattttgctatttttagcttccatgcagaacttagttatttttcttctactatatataagaaatcccgtttatttgcctctatgccattttgtacattgatacacttgtgtaaaatttaagttattggcattacgtaatagtaaaaactgaggtattttgagaatgtatttttggattcaaatgcaggatcctaaatttcctatctatatgagcttgtagaagttatttacactcttagtgcctcagttttctcatctgtaaaataggatatttagcaatatatacctgatatagttggtgtactgattgaataattgatacacattaatcacttagaacagggtcctactcagaacaaaatgtatttcaatgaacaagggtgtatgcacatatgtaatcattgtagatgtttataaatcaggtgtaattccttttaaacagtagtaatcatatttctaataacataaagcctcttaatttatcatcatcttgataaaaagaaaactacttttgaaaaccaatgaaaaaaattatttaaattaaatgtaatatgtattacaaatattggtttttagcaaataaaggcttagcaatgtgaaaagattacttttaatggcaaaggcctccattacttttgcaccaaactaaaaaagtttatgcctataaaattaacattttttcacagcacttttgtcttctgccaataaattcaaaatcattattttcttttcacataataataccatggtgaagttttaaaacaagttattaggaattttcagacattctgcttcagcaatgacaatatatttttaatatatgggacatgataaactagattgttgtaaatacataagtaaaaatcatgtttatattttcattctaatttttcatgttgactcttattttccgtagctcatctcaggttccaatatttgttacggggaagattcaatgaacaaaatcataaatgtattatgctgtttggaatttgattttctgtagcaagttatatgctcccgtgtcatacttttccgttttaaaatgtgtttgcaatttatttttcagaccaaatcaaaggtatgaatttacagctaccatatttgctttttttcatctacactttaaggggaaccccatcaaaaagtgggcaaaggatatgaacagacacttctcaaaagaagacatttatgtggccaacaaatacatgaaaaaagctcaacatcattgatcatgagagaaatgcaaatcaaaaccaccatgaaataccatctcatgccaatcagaatggtggttattaaaaagtcaggaaacaataatgctggcgaggctgtggtgaaaaaataggaacacttttacactgttgctgggaatgtaaattagttcaaccattgtggaagacagtgtggtgattcctcaaggatctagaaccagaaataccatttgacccagcaatctcattactgggtatatacccaaaggattataaattattctctataaagacacatgcacacatatatttattgcagcactatttacaacagcaaagacacagaatcaacctaagtgcccatcaatgatagactgaataaagaaaatgtggtacatatacaccaaggaatactatgcagccacaaaaaagaatgagatcatgtcttttgcagggacgtggatgaatctggaaaccaccatcctgagcaaagtaacacaggaacagaaaaccaaacccctcatgttctcacccataagtgggagttgaacattgagagcacatggacacagagaggggaacaacacacaccacagcctgttgtggggtgaggggtgaggggaaggaacctagaggatgggtcaataggtgcaggaaaccatcatggcacacgtatacctatgtaacaaacctggactttctgcacacgtatcccatttttttgtttgtttttaagaaataaagaaaaataaaaaataaaaaaataagctttcaaacaaccaatggttacttgggaaactacaattttagttttccaaaaaaacaataacaatctttatcaacataaaaagatgcaaaataaaattgcatgaacattaatgcattaatgaaacatgctatttatttatttaaattttagagtgtggttaaagtatcttcagatactgccttttccatttctgtaaaacacttatttctgaatatttccattcttcgttctcttcataatcaaacctctaatagatgtatgtctattccaagccacatccccatctccttaaactgtgcatttctatgtatgtcatgcctgccatcacctgcttttaaatcgattcctttcagttccttgtcagtgtcatcatgtctgttttcattatttttcctttcgggggccttcttgttgcaatggttaaaactttgctatttttcttcttttctacagtcttcacctaatctctgaggtcagatgtgagaaaaagagttggttcttctggtttcagatatttactttcctagttatatacaaataatctcttccatattaccttttttccctaacagtaatgcaatcatagcaatgaatatttttctccctcctgtaaatttgtatgttttgaagcatctgtaaaaagattcagactagacagccactgttataccatgcagtgagtaggtaggttgccctgatgtcagctccaccaagactgtccatgatgggtgagaaaataaaaaccagtctgtgttgctaaaacagaatgatgatttttgtcaaaaactatattatttcactattatccaccactgactaaaatacagatataacctgattatttaaactcaggactctgccgtttgacttccattttttcttattgtctgatatacttcactgacttcactggattctaagtattaaaatctgtccacacctaatgagcattctccattcctagtaggatgctagctagtaagattgaattactggctcaatcaatagccatccttatgaatttcaagtcatattagcattcatttgctttattgtccagtatttttttattattctctcaggccttgattaaaacagttccagaaaacttcatgataaacttgctaaaactcactttttactttcaagatttagaaaatcataatcatgaatcacttctcacttattctatatagtgcaaataaatctgatagctggaatgaattcattccccagctcctactcaactatttaaaggcaaatactacttctcattcatcctttatatatatattctacaaaaattcactttaaatatatttgtcagatttagaataaagttaagtatgaaacggcttttctgaaattttttatgcagaatgaaaaaacaagacaccatggggctctgtgtgccttaactgaagcatttctgaaagccaggatattaccatacagcattttttccaatttggcatttcttcttgttgaaactattttatctacctctactattcctcataatttttttttcagaatctttgatcaggtgcctaatatgccccaagattaatagagtaattctgtattacctgctgttttccttttctaacaatttcatgctactatccattgtactcatgaaataaaaggcatgaattcaaagagtaagactagagttagctttggagagaatttagaagacagaagatcctgaacatggaaaaaagtgagaatacaatcctgaatatcagaaagctaatcacaataaagaagatacacgtaaaacacttctcagtggctgctctgagaacaaggatgaggaggagaacaacagatgcaaatcaggattcacagaaaggcttgggggattttgtgtgtgccagaggacaaaacaataaagaaagaataggcaggagctatgaattttgaacacaaacgtgctccttcagtatatgaactaaattttggaaacagtaaaagaaattcagctggctttaaggcatttgtttttttgttttcagcaaacaataaatcgatcaatggcaaattgaaggtaagatttacaaccctatttgaaatgactgaagactgcccctctccagtattagtttcattttgactttatttccatccaggaatctgtcattttcttctttttatagccagaatgctttttacctatatctccaatacaggttctaaaatcattcaaattcatgggtcatcagtgaccctcaaacatggagagattatacttgggaagaaaagtaaaattattgatctctgcttttaaaaaaagccaaatatgaagcagcaatgcatagagttataaagatgcatgttaatcttcatcatacctggtcttgattatttgtgttacagcgctacttggacaatggatttatttcacatcagtatattttcaataattaaaaaagagaagactattcattcattcattcactaattccaacacacaaatatattttttttttcctggaacataaatgaaaatagtcacttatgtattacaattcatcagttcacaatacaaataatagtaacaatccacctcactgccgggaatattgttaatttttaataagataacatatacaaaaatatgcttctaaactccaaaggactatgtggaatattggggattcttatattttaagagctgtcttttcctaaaataaatgtaagactaccagtgccagctacgtgatgtgcaggacttagcacaaaatgaaaacataggagccttcattcaaaaataaggcaaacattgtcattaaaaatactaaaatataaaacatttttatttcttcgctcatctcttgacttgtcactttggttttttatttgttatttaatggtatttttctttgaatacaacgatacttgtagagcgagtatagaccctcacaggtgcacaggggccccacgttgtgactccttgttggtatacacttagtacctgggtcagagcgagcaagcatgagcaagagacgtacaccattgagttctccgcctagagtcttcggcactggcagcccagggttaggatggacgctgctagagtgtcctaccccaaaatgttgctggctctgtgcaccatttccccatcttccgtgggcctgcactaatgtcctagagatgaaagaaagtgggcctacctaaccactatcccccttgctactgtgcctcttcctccttcaaggaggatgcccaaggatgggtgggcagaggaatgcaggaggccaggagagccctgtgccaccaagactctggaagcagccagaacctatcctgcacagacagggagagacaggaggctggatcatgtatgagcaaagccacccacgcaggcaacctcgttctatcagattttattcacaacatacaaattcagagataaattagaaagaactactaaacagcaaccattgaatattcaattcttatctttggaatagagttctgtgccaatgcactgatcccacacctatgaagccatccctgatggctatctcaaatgcatcatgtgaaagcaacaggaatgctctttgcagtgaaagtcagctggactctatgtattgatcaatatagtcaatttctcaaaagtacatttaagattctaggccgggggcagtggctcacgcctgtaatcccagcactttgagaggcagaggcgggtggatcacctgaggtcaagagttcgagaccagcctggccaacatggtgaacgcccgtctctactgaaaatatcaaaattagccagacgtgctggcaggtgcctgtaatctcagccactggggaggctgaggcaggagaatcgcttgaacctgggaggttgcagtgagccaatatctggccattgcactctagcctaggtgacaacagcaagactccatcacaaaaaaaaaaaaaaaaagaaaagaaaagaaagggttctagagtagttacatttacttcagttttaaaaaataactaattaaaagaacttggacaagtccattatttttatattgttctttcttaatggatatcaccacttctatccctaataggaatctcttgtagttagtgtaaaatgatagaaattgcagcattaaggaaactgtactataatgaagtgaatttttttagctatggaaatgtttgtaattaaaaataactatactaataaactattagaaggaatataataaactctgtcaccgagttatctatcgacttaaaagggaatttcttatattacaataaaactttgattaacagttttagtaatgactatgctccaaggttatttattgcctcctcaaaatatttttaatcgtgtttaatagcattttagtttttaaaattattttgctatgcattgtaattgcttatgtagctttcaaaaatggataatagttatatggcataacaattacaaaatctagaatgtatcaaactattattattgaatatctgtcgaatgtgaagtgagttttgaaatacattaaccacataaatctaataaaaataagttagcaaaatctaatatgtggtacagtgactgctttgtaaaagacattccaaaaatatttgatgtatataaaaggaaacagaaaaatgttaatctgtaaagacattaaaatcaggtaaataaaaaaatatatagatggagaccacttaacaactttaaaaatgttatttttttctaaacatttaataacactaactacaagaatatttttctattacgaatttaaaaattccatccaattccccagaaaagtttagaataaactagctcaataagaggagagaaggaaaaaaaaaagatttatagaaaatggtttatagaatgaaataaaagtaggctggtaacgatgaaagctattaatcaattgagaactaggcaagggaaaaactggaatggcagatcctattcactttatggatcaagttacaatgtttgggaagcattcaaacagcaatggaaatttatggacagactttaagcaggaaagttacgtatttatttttgtgaagttactccaactgcttttggaaagtgcattagagtggctcaaaggaagaattgaaaacacgatggctaagtgagtttattttgcagtagtttaggagatatgttggattctctgataaagtagttagtaaaagaaatagcaggagattggctgaatcaataaatgttttgagttagaattgctgtctgttaattttgtgaaagtaaagcaccagcaaaaaatgactactcgtgtatagtatgatcaactgagtgtatggaggtgttgttgtcctcttattgttattattactcttataattattttaattatgaaatataattgaatagtggaaagaatataagattcagaatctgacaagttagctctgattccctactctgtcatgtatttttatgtgatattgaacaagccacctaatttctgagatgtaaattcttcattaatccaaaatattaatccatttaacttttgagctagttttgaaattcacatatgtttataggttttaaataaatatcattaaatttttgtgcaactttccacaaccataggaaatgcctataaaaataatgcccataaaaataaaaatcagtccctgggaggtggaggttgcagtgggccaagattgcaccactgtaccccagcttgggcaacaagagtagaactccgtctcaaaaaaaaaaaaaaaaaagaattaaaaaataaaaaaaaaaataaataaaaattagtcttcacatatgcttaaaagaaaataatattgcgatttttcatttctcatcttttctcccataacacaattttgatacatatctcaaacatgaatgtcttggtataaatacatattttcatgagacatgagaaaaggtagtcaaaaaatgatttggtttgtgtttttcacataatttcatgccctatgctacaatgaattgtggataaaaatcattaaagtctacttcaaactcattgtacatggctcataaaaagtacttactgtttggatctaattctcagaatgatcattctggtaatcctaaatctaatagaaactcaatagccagccctagtaaataaggcaattaatagttgataaatgaagatcaggcattattctactttgaattttcaatccattgctataaccatactctaaaatttattatattataaatcacaataaactaggtagtcatttgccccatgtgaatcaagattaatctaaagtattatatgttatcaaataatattcttgtatatgtttaaacattttactaatgtaatatttactagagggatgttaccacaaattttcctcatctttctgatccccatgtaaatttcttaacacgtccaaaataatagtgtttatttcctctaaattcttcctccattgtttcaaaatcaatttaaaaacacctccatacactcagttgatcatactacacacaagtagtcattttttgctggtgctttactttcacaaaattaacagacagcaattctaactcaaaacatttattgattcagccaatctcctgctatttcttttactaactactttatcagagaatccaacatatctcctaaactactgcaaaataaactcacttagccatcgtgttttcaattcttcctttgagccactctaatgcactttccaaaagcagttggagtaacttcacaaaaataaatacgtaactttcctgcttaaagtctgtccataaatttccattgctgtttgaatgcttcccaaacattgtaacttgatccataaagtgaataggatctgccattccagtttttcccttgcctagttctcaattgattaatagctttcatcgttaccagcctacttttatttcattctataaaccattttctataaatctttttttttccttctctcctctttctttccctcctccactcaatgcttggtatagtctatttttgctttctggaatctaatacactactccagcattccccaaccttttttggcaccagggactggttttatggaagacaatttttccatggatggtgagtgggtgggatgatttctggatgaagctgtttccacctcagatatcaggcaagcagagttcacaacagggtttgtgctcctaggaaaatctaatgccaccactgacctgacaggaggcggagctcaggcagtaatgctggttcctgccgctcacctcctgctgtgcagcccagttcataacagggcacggactggtaccagtcccagcctaccagcctaggtagccccttacagcacttacctcaatttgaatttatatgtcaaacaaagtggccatatcttaaaataggtactcttgccacaatggcaactaaagattctatttaggtcaacatttaccttcactgcccatcatataatctgtttgttaaatatttttaaataattaaatgaagcctaacagtgggatgaccatatattcatggggaacaatttgaaattattgtgcccaatttcattttattgaagttgaacaaataaaaaactcaggtttaagtgagtcacctgggtcgtgaaattaatgttactgggatatgtaacaattaaacattactttgcttgaattgaaactggtataaatcacgatattttcatattttaactcataaagttctttaattattgtttgtaatcaagtccccactaaattactaaatttaacacacattcgatatcacacaatttcaagcataatatccaacaataaaataacaatttaaacattagtcgaatgaatacttgagtctcaaaacacatatcgtgcagagtacttttcccaaaataacaatttagtaatcttatattgtttccaaataatatttttcattccagtaaagcaaattatattattccatatagttccagattttgaaaacatcctcaccacaaagattccttgtgttactttttatagctatgtccatttacctcctgctcccattcctcctttagccctggtaacaacgaatattttactcctttatatagtattgtcctttgaaaaacgttatagaaatggaattaaaaattgcaggattgacttcttctccctactcaggagacggctcattcagattattgtacgtatcaacagtgtgttccatgtgaatgccaagttatagtacataacatggatgtaccaatgtattcatctgttgaagaacatctggattaatttcagttttgactactataaataaatatgctataaatattcgtatataggttactacgtgaacataagtcagtctttctctagggtaaacacccagaaatggtgtgatgtggtcgttgcatgtttaacgtcatgaagatctgctgtgctgtgctacagaggggatgtaccattgcatatctccactagcaatgtatgaataatccagtttccccctcttctcaccatcagtatgtgtaattactattgttcattttagttactctgtcatgatctcttattttacattttattaatatttccttaattggtaatcatgttgaacatcttttcacaggtttatttgtcatttacgtatattttttggtgaaatgtctgcaactcattactttctcattttctatcttcctaacagaatttttcacagtaaaagttaatcttgatagactccaatttatgaaaatgtccttttatagaaagtttttgggtgtcaagtctaagacctctttgcctagctttaaatccattttttaatttcattttagttttaagttctcatttatatgtgattcatttttgatttattttatttataaggtgcaagacttagattgagctttattctgtccccttctgaatgttcaattgcttgagagccatttattggaaaagttaacttttctctgttgaattgccatggaaaagttgatctgaagatagaaatgatagatctttctctcaaaaatttggggagagaggcaaggaacaaaaacaccaaacttcacctactggtacctgcacaattgaacgtttctctgaacttcagctaccggtctgtacagaattgaacctttatctgtacacttgaatgtctttgactctactctgcacaggaaggtaaagggcacccctacatcagtagatagctggactgtttattgcggttgactgtgcagttgatagggaacaactgaaaactgtgaataagttcttagtgagaggctcagtcttggtgtcaacttagaaaaatgtgtagcaagaaataacaaattagagtaaaactgcgtaaaatattctatccttcatcaaaactatttaattattctaccataggggttacacttttagtgcatgttttcaaagcaaacttagaacgtgtgtgtgtgtgtgtgtgtgtgtgtgtgtgtgtgtgtgtgtgtcttctttaggacaaataaatataaacaagggatatagcagcatagttaaatcactccctgtcattacaccataagcactatgaaagtaaaatatgagactgatttccactgagttcctactacctgagataatggcatatacttgatgcataaggaatacatattggtatttttaaattgtatttatttatttttttaatgtgcaatgatcggtactctgaagtctgaacatgtattgttgaaagaatgaaattaaattatatatttgggaaaaaagtgtttcttttttgcttttcttacaatataatttataacaatgcaaataaaacccttggttgactattaaacatagattagttcttaaaagacctttcagattcctgcttggaatatttctgcttcttcttattttgacacagttcatattgcataaactcccaaagcagaattatattttttaaactttcaagattgaatgcataaaaaaattatcataataaagctctattttagatgactataactaatgatattcaatagaagaatatatatatttttcttgatttcaaagcaccttcaaaaatgttatttaggtgtttttaaaaattataatttcttgaacatctgatgattagatggggaaaaatttgtcagttaactccctgttttctattttctcattttgtttctatttttttgcactacgaagcaactgcaaagcaccccttaacacctttgaacacatgctattattttgagtcacaaaaatattaggttgttgcaaacgtaattgcagtttttgccatttttagttatattgttttcttttttttttttttttttttttgagactgtgtctcgctctgtcgcccaggctagagtgcaggggcacgaacttggctcacttcaacctccacaggttcaatcacttgaacctcctgggttcaagcgattctcttgtcttagcgccacaagtagctgggagtacaggcgtgcaccaccacacccggctagtttttgtattttttaatagaagcggggttttgccatggtggccaggctggtctcaaactcctgacctcaggttatccacctgcctcggcctcccaaagtgctgggattacaagcgtaagccaccacacccgacctatattgtgttttaatagaataatatttcattagcattagatatgttccaaacaaaaaaataattcaactacaataaattaattggggttgaaaattagctaaatttcaagtatagtgaagtagtatagctttaatacaaactgagtaattttgaatacttttacttagtagtgaagtgatcaatcaaggaaaatatcagaaaaatatagtcttccaaatattgaatataaactttcggtttaaattatcatagtgcactgggtttagggcagctgcttccaacagttctaaaatataccccaagaagtgctaaaaagtagtggatctgagtttttccctaatgaaaataatatggaattttttccctcaagggatgttaacacacaaagacatgcacatagatagatgatagatagattagatagatagatagatagatagatagatagatagatagatagatagacaaaagacgaggcaagcaattaaacttggtgacaatggtaaagtctattaacatccctagggttatactaatttagcaggggctatacaacattcatatcactgggaatgtcctttggtttttagtctcagtggaatctaagacatcatggttcccaaacatgggcttctccactttttcctcctgaaaccaacgcaataggtgggcttcagtctgagctaagatcccaaaggtatagaatccactatgaattttcctttgttttctgagctccttccacaccctccaatcaatacccagcacttcagccaatgtttgcctaatttaaaattcttgtgactgcatgcactatttcccattacattttctgttatttattttttggcataaaaagaaagttgtttctcttgcatttaccaattattttgccaaattttggtaattattactaattttatttttgttgtagttgatttccctggacattttagaagttcaaactataaacattgtgagataataatttttatgctgatatctttttagtgatttaatgttaatgaagagtaccgccaaaggaagttgagtattacctgtgattgcaagcattcttgtcttttcttctaactttaattacattcttagtatttaagctccatcacacgtgcagtgggtatctagtccacttagacaaatgtgtaatttaatttaatttttaatttttatatctggatacatgaaaatagttatctattgctttgaggtaactattaggaaactaatatatctttgcttattttttcctttgtctctttaaatcaaggaaatatgttacaatctatacaactaaaccatcattgcatttctggaatgtaccctagtttgtcaatgtatttattggaaatcttaatagcaggtaactctgacaattaatttgagccataatgaacttaatataatctattatgcatttattggaatttctggtagggctagagaatgaaactgtttgtttttaattcagtaacggggcagctaggggaaacacctaactagactaatgtactctgtggtaggaaagcattcctattgttaatggtttctttctgacacaatgctagggactggatagtagttcctttgccacacgtgatccaagatcacgaaataccactaaggcataaaacaatgacccatttgtgcccactaattcacagtgcttactttcatccttcttgtctttctcttttatttctgcttggcaaaacctatgtcatgtgaattcaagctgcaagggacttactaaatatagttatatggaattagtactaagtgagccaatctgcagtaatcagcaataggccaaacatttgtttctgaaacccccatagacagccttcttctaacttacaatttgcaactacagacatatcaaccaacagcatgcttccatgtagcataatatttctttctttcaaataattataatcacattagccacttaagactgaaaatccaagtatcatcagtcactaaatccatctttaggcaatgttcacatcccatctattaaaaatcacaacctagcctgtaatcactgagctaaattacaatcttcacccacaagccctatcatgaagagctggtgaaatggagcagggaaaatgctaaatatatgatcgcatactaaaacaaaggagtctattaaggaaaacatgggcaaatattataattcttgtttataaaactagccgcaaagatatagttactaattacaatttctcttgtcattcaacatcttcatcagggatattttttacttcatgaatgactcatttttttattattgaaaataatttcttttggggtttgacctaattttggttttatcctatgatggagtagtaaaaaaaaaagcttatattctttcatacaatacagtattatttttgtttttaatcaccttcagttcatgcaactcaaaaataatttcctctctttctctcttctatttatttctatcatccttcctgctcttttgttcttctgttccaacagcaaaacattctttctcttttacttatgctccatttggccagtggcatgaggattacaaataatgttcaaattgcaatccaaatattccattaaacagatccatttgtgtatcccttggcaaattcaattcctcactgggtagaagtcacaaactgaatgcagttatgttaccaacaaagttaagagaccatcaagtactttcttagtctttgtaacataagatatctatatttgacttttactttttgagaagacatcctgatacagtctagaaaagcagacaaaagttagattatgggggtggcatgacattaaatataatgaagtgtacatcttaacttctagggaaaggtattttagaaaggcaccctatgtgcttgtactttatctcatatttcctctctagcaagttctacaaaaccattttattacttagtggatcagcatgatttcctcaaaaatccctatgaataagttatagaacatatccagaaaggcaaagcattaacacaaaaccattgagctatactttctgaactgttaggaaaaattaaattttattttcatctgaaaaggcgtttgataggcaatagctagaagccagggtccaagtgactgttttgcttttctccagcaaaaagaacataactagaacagcaacagtgcagttgtatacaccatctgattcagattacaataatgccttgccagaacctaagaaccatctgatatcagaacaggccaatttgggcaaagtaattaagtaagagattaaaaactgccactcctgaatcctttaagtttttaatggtgattcttacttttattggcagtttccccaggaatatggtgctactttcacggcagcaaagatttggatgcaatcctattggagctaacgtcgtgaaaacagtgtctggtaagtatacacctattcataaattgtcaataacctatatctatttacctgatttagttttgtgagtggaaaagttgaaaaaattgaagattttagagtataaggcttgaagttttgttttacttggtcattagttttctatgttaggctgagattacacatattaggaatatatgtattcaaatacagctattgtgattcagcaactctcaacaacagaataaacagaatcagattcttaattacaaaaactcagtgagtttaagtgattaaagatattgtggagtagtcattgaatatgctgttatatagccagcccttgagtagaaaatttaagcctagagaatatagttcttttcctttactctgcagcagagttagaagctgttagttcattctgcagtagttgtattcctcatgctctgctgttaatttagcctatttcaggaccaactcagtcatccacctaaagtaaatcaagagcactttttttctctcaacttttattttagattcatagtgcacacttgcaggtttgttacaaaggtatagtgtgtgatgctgaggtttgtggtatacttgaactcatgatgcgggaggcgagtagagtgccaaataggtagtttttctaccctttccccatctttctcacccttttgtagtctccagtgtctattgttgccatctctatgtccatgtgtacccagtgtttaactcccacttgtaagtgagaacatgcagtatttggttttatgttcctgagttaatttgctctgaatagtggcctccagtgcatccatgttgctgtaaaggatgtgatttcattcttttttatggctgcatagtattctatggtgtgtatataccacattttatttatccaatcctccactgatgcacacctaggtggattccacgtctgccattgtgaatagtgctgcgatctttttgcatgggtcttttgcaagtgcatgggtctttttggtcttttggttcaaaataaatttattttgaacaatttatttatttgggtatataccctgtaatgggattgctgggtaggatggtcattctctttttagttcttagagatatctccaaattgctttccaaagtggctgaaccagtttatcttcctaccaacagtataaaagcatcccctttacttgcaggctcaccaatatctgttattgtttgacttttttataatggcccttctgactggtgtgagctggtatcttattttgattttaatttgcatttctctgatgatgattagtgattatgagaatttttcttatattcgttcactgctctttgtgttgcatgtcttctttgagaagtgcttgttcatgtcctttgccaaactttttttttttttttttttttttttttttttttgagatggagtctttctctgttgtcctggctggggtgcagtggcacaatctcggctcactgcaacctccacctccctgattaaagcaattcccctgcctcagcctcctcagtagctgggaatacaggtgcatgccaccatgtctgactaatattttttttatttttagtagagaaagggtttcaccatattggccagactggtctagaacgcctgacctcaggcaatctgcccgactgggccttccaaagttctgggattacaggcatgaggcaccatgccccgccttgccaactttttaataggattatttgttttttgcttgttgacttctttaggttccttataaattctggattagatctttgttggatgcatatgttttcttccatttctctgggttgtctgtttacactattaatagtttcttttgctgtgcagaagctctttagtttaactagattccacttgtcaatttttgttttcattgctatttcttttgatgacttagccataaattctttgctatgacaggagcacttattttcttactactatgcaccacaatatctccctattctaatggtaactatattattaatattgttgtctctcaagatgtgcagctgataggttctaggaccccccagggatatcaaaacctgcattctcaagtcctgaagtcagtcctgctgaaccttcagataagaaaagttgacccactgtacaggtcttttcctccacattgggtgctatggccaggcatatttcttgggctaacccttgttcacattcttttaccctactaccagaaaatatacacatacctgacttttctttggcatgcaaagaacgtggaaggacccagattcctatatacctcccataaaataagtgtgttcagatgctaagcagagcaaaacgagcagtgagtcattaacatcaaccatcttcatcagcctgacacctacattcctcctattcaattgttatttgagagtcctacttcttaaaaggtagaagctacaaaaaaatcctcctaaattaatctggaaaatatgtactaaatctcaacttttctcgactgcgtctgagaaacaaaacagccaggagagccaaattacaagagggacaagcaccctcacagagggacaaaaatataaaaactttcaaaagaggatggaaataaaagatggctactgtacaaatgcataagaaaagccaattatgggttatcatacaagttcaccataatttgaggtaccagatgtaatgagcattggcaattactacttttaagagttaggaaaatctaaatatttgaatgggtagaaccagttggtagctcacttattacactgtgtatatcatagtcttgatccagtcatgattttttctaatttctgaacattcattcatattaacaaatacattgtgaaaactaaaattgtttatgattctcaattgtaagacaaaatatttctgagagaaaaagtttttaggtataaatactagtttatcttcatttacaaatatgaataagttcagatgaacaagttaaatttgtagtaaattatataaattaaaatatgcaaattatgtttattgtcaaattatcattcaagataattattcaagtaattatttccaataaacatttttgtctctttaaggatttatttgttccatgggaaatgattaactaatagcctcagtgaaggtaatatttctttgggtaatatatgtgtcttctcttctcatccaagctataccttctcgtacaattgcatgtttgtccagggacatttagtctagagaaacaatagagggcaaggaacttccccaatgttggaaaagataaaattgatgattttacaaatttataatctaattttaagttacgctatcaagtttggaaaataattagctagttatattaaatgtaaaaatacattgaagttttagaaaaacttgttgtccttgaagttgcctttcagaccttttctagaaaaaaataaaatagtttccccaggaacccagtgtttatcttaactcaactacttattctccaaacttagggataggtaaagattcaagtctaacggaaatgttaccagatgcacatttttaaatttacttatgtagaactaaaatgaaataaatattttgctttattcctaggaagtatttagcctttatcctggtatatttttcaatgaataagataacattgttattctaaatgaaataaccttattgcttaaattcaagagagtttaaccattgagaagttctaacttattgtgcattattaaataacttatatatacttatatacatatgcatacacatatatccatacatatgtgtgtctgaataaaatatctgtttatatgtctatgcacacatatatatgtatttacaaacatgcatatgtattattattatagccaaagaaaaggaaatttaacaatttgtagaagataattttaatcatttattactgctataaaaataacttttctctctagtaatacatttcttaaatgggtgctctaaatattctatttaaaatttgtagatatatgtgtcaataaaattttaagtaaaaatgtacataagttcacactcaaagtttcaaatacttcataattagttttaacaatttgtatgtaaaaagcattatggcattatggtagcttacttagaataatataagtgactgagttttttgtttgtctgttttgttttgttttgttttgtttctgcagaagttcagcgctctctttggtaaggaacatttataagaagcaaactttgaaatgtacgaggagagggaagtgatttttgagatgcctgtaagtgatgcagccatactatctttgggggaaaagtgttaggtgcttccatatggataaaatatttaatgctttaaacatttatcttagctcatatatgctgcgtgagaaatatgcttgttgaataaactcctttctatttttgtcagtcgcttttaagcaaatttatagaaagagcttgactgtcaactttaatatttcatttttccaagataggcttccatagtatgaaatgttgttaagatacatagctctaagttttctttctgggatcagatagggataaagataaagaacttaacataagtgtatctgctgtaaactgctgattcccttttaacagcgacttgacaggacatgctaagatcaagtgaaggactgaactgggacaaggaaataaaggaaacaggaacatttcaacaaatgcttaagaaattaatagaaacattgaaagttgtcgagaatacatagagtacaaatagatttattatgcataaactacatataccttattttattttattttattttagtctctcgaattcataaatttggagttaccctaatcaatatattattaaagataatgtttctgtcctacttcatgttatattctatttgcatcatatgctttctactaaatattctttgcaattcacaccttcatcatctgaaaagctgtcttcattttaccaaactgtgattagcaattacattaaatccatagttgtttcataaaaaatggcttaacgttcccatttttgtcattgccttttttgtttgttgtactttatagttaatatgttggaattgaagaaatgtatctgtgttcaattcattcctgcaatatgtctgaaagttaccactttctcctctgggattttcattgtgtcaaatattctacaacactgatattttatgagaaaagaataactctagctagatacatgacaaagagtctccaaatctagacccctacatataaattattgactcagataatatataattcctgtcactctgaaagaaaaagataatatgtgaatgcatatgcatacatataatatgtatatatataatatgtatgcatatgcattcacatattatctttttatattagctatcatagatattatttttaacctttctcaagaggaattattttaatagtgtccaactaaaaccccagaatatggagtgatcatgtttacaaggcaattgtagaagatgacctctgtgcttgatgtctgagacataatgactatacaaggtttacccaggaaactcaactgctttggttccaagctctcatcttgagacctgttaacatctccagtgagcctggactgtcggctggccatgaaaaacttgtctcacattagccacttaaaatgccccctcttttcaactgcatcccttcgtttctgcttttttcaggtagaaactgcttccctcagtcaattttctcctctacatgtactaagaaggaaacattacataaacatgtttcttacagaatttaacaaaagcatgcagtgtgcttgaacatttgcatagaatttgtccattatataaccttaatatacaatcgattcttatccccccaaccttttgtggctccttggttcatattcggatcaagcagaaggttccataaatattattaataaagtgactagttcttttttatttttgtattaccttgcagtgtgtaaattattttcatgcaaaatgacttatttctctggaaaactatataaattgtttagagcaggaattactggtatttacttttacatattaggccacgttaagacttagatgtttactggattacccaagtttcccagtacagaaataaaaggaattcataattctattttctaattacattttctaccatgagtagaattaataatcgtgtgcatgatttgggattagtatggctcctaacacatgtaattgtttttatgactgtgattatattcaccagcattactgttactgttattgtgattcttgtaaaatgcaaagtttgcttgaataatgattgtatatgacagtagactatacatcgtcttttctttcttacctcatagtatcaactgcttatggattattcatatgcacatttctaatatattatatattacatcatgttatctgtacatcacaagtaacaaaaaataattattgtcaactacttactaggtaccaaggattctaattgttattattccctaactaaacttttaaaaaatgctaaattacaaaacttcaggaggagttaccaggcagcgggtagcaagtatatgtttttcagttttcttggaggtacaattgaaaaagagatagaaaagttgaatttctttagtttatttttctttggccttgtgcatgaatgttataggtaaaaagggtgcaatatttttaataactatctcaggtcaaagcacagtaaacacaatattttatgttaactatatattcaattattggaggtttttagaaatcacattaaaagtatattttttctctttttctttcttaaccgtacatgtattcctaaccagttcgaacattaaatcctgttagatagaaactcctacactaatgaatgttttgtttttagaataacaggtcaagaattttgcaccatagtagtaaagctatgggtgttcattaaaaaaagggcagacagtgtcacagacatgagtacagattggatttatcttgagcctctggcaaatcatgaaaagccatgaaatgctcttagatcctagatgaaaggcaatatgaagtgaaaatagatgctttgaaaatgaatcttagtttgcattatacttgtccagttttaaaaacatttctgaaaaaaagcaaaaatgattaaatacatattttacaagtatatttttatctttttttactaatgaaatcataaaacataaaaatgtaaattgattactttcatttttcccttcccagctatataagtggctttgttccaactatctccaagattttcctacttattaaaatatagtaaaaatctttacattgtgatagcaatttggaggttagtcagtcaggatactgtctcaataacacatgaagttagtgaaacatatctaatgcctaagtaatattccttttttatccaccttctacctagaaagatgactaagaatactgtcaagaacaattaagtttctaagacacattcagacatggaagcaacaatcaaattatattcaattagcccaaaggaaccaacccacaattcacattaatctctctttccaattttaaatcttattattgaacttgagtacttttaacattagagtgtagaatcacttatgctaaattctgctccaccgagtagtagcaaaagagaggggatactacgaagtataatggagatattgccaagtacatgcaaattgatcttcattctctgttactggcaaagaaaatgttggcaatatcttttttaaaagtatcttaaatttgtataatggttcagttatattcacaatgtctgaaaccaccagaattataagagaaaagatgaattcagtagaagataatgcactttgaatccccaatttttaatatcctttatgactaggtgtagacggctgttattgacatattatatctcttttacccatgcatattttagtccttagttgaggctatgattttcctttctccttctggcatcctgagctaattttgttaaaacacttaggccgacaattgggaagcaattcacgtgtactactagcatttctcgacatatgactcttccaatcagaaggcttccttccagcaattatgagactgggaagttcacacatataacgtatcaattttagttatacgtcaagatgcagaacacacacacacacacacacacacacacacacacaaacagtaaaaaaacagtatgtggaattagcccagatgacctcagcctcaagttctccttaactgcacttccctactgtgagccctgcacaaatgctattagcttagtttagttgcctcttttttccatagtcctgatttctgtgctcatatccagtggtgtcatatgtttgagtctgcctctccttgaaattactcagcatacttagataagtttttatgactttctgtcttcctcaggcggagggaaacctcagccaaagaccttataactgccgttgtccttgaagaggctgaaatgaagatagagggagaagaagggtgtatttgtccactttcacactgctataaagatactacctgagactggtaatgtataaagaagagaagtttaattgactcacagttccacatggctggggaggcctcaggaaacttacaatcatggcagaaggtgaaggaagcaaggaccttcttcacatggaggcaggagagagaactgtgagcaggagaaatgccaggtgcttataaaaccatcacctctcattagaactcactatcacgagaacagtatgggggaaaccgccatcatgattcaatcacctcccatctggtttctccttcaacacctgggaattacaattcaagatgagatttgagtggggacacaagcccaaccatatcagagggattggtaggagtatggaggaagagactagctccaaaatcctcaacaatcatttagatgtgcttttggtagcaactggtttagtggaggctcatgattcaaccaaagaaactttcaattatttttgacctgccattcactttttatcaggtgtgaggtattcatggcagtcactctatttcagcattgggaattttgtgaaacttttgtaaacagttatagctacattactttctggctggaaccacaagtttgtgctctgtaatttatataaacttagctcacactgcagaaactttaccaatgactgcaaattgggggcatttgcagccccattaacatgaaagtatttctttgcttcttgcctagtgacaatataatgacttgggaactttttcatggctgaaggtcatcaagattttacctagatgtctttgcatcagtttctcattatttagtgtgtcaatttaatcagcatagtaaacctaggctggggcaacaagatctcagttactagtccataccaccatctatattttcctacaaaaatttgtttgtctcaggaaatcttcctgagaagatgtagcagctaggtcccactgggatgaacaaacaaacaatctctgagatgtttactattgtcttctagtgcttagtttagcactagatggactgtaggtgtgataaactgtaggaaggattacttaatgagacttctcagctgtcgcaattttcattaacttgcattacacattatgctccctcatttgcaaaacaaagaatccaaagttctaataatttgcctggtttcttcccagagcaatcatgaagtttcatcttgttgcaagcagtgtacatggatgtttgtaattttgtctgaaaaaggatcagaaactacttccagcttaggacatattttaaaactctgtggccgaaataggtggacctgagattgaacaccaaattatcaagaaaggcttccaatcctgcataggtttaaaacaaccagagcaccattttggcaacatctgctatcgaatctgctttccagtaatttgccagcacccacctcctcaattcttcctcattagaatacaataaattagaggacaacttattacctgattgagtatacgatttaacaaacatgttctttacctgtttccctggtcttccctcaaatcccattacttggcctgtgtatcctcaaacttcctcttctggaagccatatttctttcaggatctcatcattgtcaccaaaactggcaaggactgtgaagggtctgaggttttatttatttatttatttatttattttcaaaattctcttttttattacttttctcagatacctgttgttactgcatgcctgcctattcctttttttttttttaattattatactttaagttttagggtacatgtgcacaatgtgcaggttagttacatatgtatacatgtgccatgctggtgtgctgcacccattaactcgtcatttagcattaggtatatctcctaaagctatccctcccccctccccccaccccacaacggtccccaaagtgtgatgttccccttcctgtgtccatgtgttctcattgttcaattcccacctatgagtgagaatatgcggtgtttggttttttgttcttgtgatagtctacagaaaatgatgatttccaatttcatccatgttcctacaaaggacatgaactcatcctttttcatggctgcatagtattccatggtgtatctgtgccacattttcttaatccagtctatcattgttagacatttgggttggttccaagtctttgctattgtgaatagtgccgcaataaacatatgtgtgcatgaattttatagcagcatgatttatagtcctttgggtatatacccagtaatgggatggctgggtcaaatgatatttctagttctagatccctgaggaatcgccacactgacttccacaagggtcgaactagtttatacagtcccatcaacagtgtaaaagtgctcctatttctccacatcctctccagcacctgttgtttcctgactttttaatgattgccattctaactggtgtgagatggtatctcactgtggttttgatttgcatttctctgatggccagtgatggcaaccattttttcatgtgttttttggctgcataaatgtcttcttttgagaagtgtctgttcgcgtccttcgtccactttttgatggggttgcttttttcttgtaaatttgtttcagttcattgtagattctggatatcagccctttgtcagatgggtaggttgcgaacattttctcccattttgtaggttgcctgttcactctgatgatagtttcttttgctgtgtagaagctctttagtttaatcagatctcatttgtcaattttggctttggttgccattgcttttggtgttttagacatgaagtccttacccatgcctatgtcctgaatggtaatgcctaggttttcttctaggatttttatggttttaggtctaatgtttaagtctttaatccatcttgaattaattttttataaggtgtaaggaagggatccagtttcagctttctacatatggctagccagttttcccagcaccatttattaaatagggaatcctttccccattgcttgtttttctcagatttgtcaaagatcagatagttgtagatatgcgacattatttctgagggctctgttctgttccattgatctatatctctgttttggtaccagtaccatgctgttttggttactgtagccttgtagtatagtttgaagtcaggtagcatgatgccttcagctttgttctcttggcttaggattgacttggtgatgcgggctcttttttggttccatatgaactttaaagtagttttttccaattctgtgaagaaagtcattggtagcttgatggggatggcattgaatataataaattaccttgggcagtatggccattttcactatattgattcttcctacccatgagcattgaatgttcttccatttgtttgtatcctcttttatttcattgagcagtggtttgtagttctccttgaagaggtccttcacgtcccttgtaaggtggatttctaggtattttattctctttgaagcaattgtgaatgggatttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatataatcatgtcatctgcaaccagggacaatgtgacttcctcttttcctaattgaatacaatttatttccttctcctgcctaattgccctggccagaacttccaacactatgttgaataggagtggtgagagagggcatccctgtcttgtgccagttttcaaagggaatgcttccagtttttgcccattcagtatgatattggctgagggtctgtcatagatagctcttattattttgagatacgtcccatcaatacctaatttattgagagtttttagcatgaagagttgttgaattttgtcaaaggccttttctgcatctattgagataatcatgtggtttttgtctttggttctgtttatatgctggattacatttattgatttgcatatattgaaccagccttgcatcccagggatgaagcccacttgatcatggtggataagctttttgatgtgctgctggatttggtttgccagtattttattgaggatttttccatcaatgttcatcaaggatattggtctaaaattctcttttttggttgtgtctctgcccagctttggtatcaggatgatgctggcctcataaaatgagttagggaggattccttctttttctattgattggaatagtttcagaaggaatggtaccagttcctccttgtgtctctggtagaatttggctgtgaatccatctggtcctggactctttttggttggtaagctattgattattgccacaatttcagagcctgttattggtctattcagagagtcaacttcttcctggtttagtcttgggagggtgtatgtgtcgaggaatttatccatttcttctagattttctagtttatttgcgtagagatgtttgtagtattctctgatggtagtttgtatttctgtgggattggtggtgatatcccctttatcattttttattgcatctatttgattcttctctcttttcttctttattagtcttgctagcggtctatcaattttattgatcctttcaaaaaaccagctcctggattcattaattttttgaagggttttttgtgtctctatttccttcagttctgctctgattttagttatttctggccttctgctagcttttgaatgtgtttgctcttgcttttctagttcttttaattgtgatgttagggtgtcaattttggatctttcctgctttctcttgtgggcatttagtgctataaatttccctgtacacactgctttgaatgcgtcccagagattctggtatgttgtgtctttgttctcgttggtttcaaagaacatctttatttctgccttcatttcgttatgcacccagtagtcattcaggagcaggttgttcagtttccatgcagttgagcggttttgagtgagtttcttaatcctgagttctagtttgattgccctgtggtctgagagacagtttgtgtaatttctgatcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttaactttgtctcgttgatctgtctaatgttgacagtggggtgttaaagtctctcattattattgtgtgggagtctaagtctctttgtaggtctctcaggacttgctttatgaatctgggtgctcccgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctagttagttgatgcagtttcttcctagcctcgatggtctttacaatttggcatgattttgcagtggctggtaccggttgttcccttccatgtttactgcttccttcaggagctcttttagggcaggcctggtggtgacaaaatctctcagcatttgcttgtctgtaaaggattttatttctccttcacttatgaagcttagtttggctggatatgaaattctgggttgaaaattctttcctttaagaatgttgaatattggcccccactctcttctggcttgtagactttctgccaagagttccgctgttagtctgatgggcttccctttgtgggtaacccgatctttctctctgactgcccttaacattttttccttcatttcaactttggtgaacctgacaatttatgtgtcttggagttgctcttctcgaggagtatctttgtggtgttctctgtatttcctgaatctgaacgttggcctgccttgctagattggggaagttctccttgataatatcctgcagagtgttttccaacttggttccattctccccgtcactttcaggtacaccaatcagacgtagatttggtcttttcacatagtcccatatttcttggaggctttgttcgtttctttttattcttttttatctaaacttcccttctcacttcatttcattcatttcatcttccatcactgataccctttcttccagttgatcgcatcggctcctgaggcttctgcattcttcacgtagttctcgagccttggctttcagctccatcagctcctttaagcacttctctgtattggttattctagttatacattcgtctaaattttttttcaaaattttcaacttctttgcctttggtttgaatttcctcctgtagcttggagtagttggatcgtctgaagccttcttctctcaactcgtcaaagtcattctccgtccagctttgttccgttgctggtgaggagctgtgttcctttggaggaggagaggcactctgctttttagagtttccagtttttctgctctgttttttccccatctttgtggttttatctacttttggtctttgatgatggtgatgtacagatgggtttttggtgtggacgtcctttctgtttgttagttttccttctaacagacaggaccctcagctgcaggtctgctggagtttgctagaggtccactccagcccctgtttgcctgggtaccagcagcagtggctgcagaacagtggattttcgtgaaccgcgaatgctgctgtctgatcgttcctctggaagttttgtctcagaggagtacctggccgtgtgaggtgtccgtctgcccctactggggggtgcctcccagttaggctgctcgggggtcaggggtcagggacccacctgaggcagtctgtccgttctcagatctccaggtgcgtgctgggagaaccactgctctcttcaaagctgtcagggacatttaagtctgcagaggttactgctgtctttttgtttgtctgtgccctgcccccagaggtggagcctacagaggcaggcaggcctccttgagctgtggtgggctccacccagttagagcttccaggctgctttgtttacctaagcaagcctgggcaatggcgggtgcccctccccccagccttgctgctgccttgcagtttgatctcagactgctgtgctagcaatcagcgagactgtgcgtgagccaaagcagggcaaggcattgcctcactcaggaagcacaaggggtcagggagttccctttcctagtcaaagaaaggggtgacagacggcacctgggtctgaggttttatatacttgccagctaataatttagccagctgctgtttcacgaatactcataaagcagataaactctaaaggatcctggctaacatggtgaaactctgtctctactaaaaatacaaaaaattagccgggcgtggtggtgggcaactgtagtcccagctactcgggaggctgaagcaggagaatggcgtgaacccgggaggcggagcttgccagtgagccgagatcacgccactgcactccagcctgggcaacagagggagactccgcctaaaaaaaaaaaaaaagggggaaatctctaaaggacaaattttaatttattattcaccgaaataaaatagcagttgacagagtattagcattttagccttaagtttcctgagccagttcccacatggcttggagaggagggttagatgacacctgcacacactcagctgtgttacagtgggggactctgagcttagggaatttgaatctttaaaaataggcaatacacatgcctgtccttttttttggtggaagacattaactttatcgtaaatgatagcaaatatgcctgccatttattcttagggaaggttctctctttcctgtaaatccatttgttgtaaaaaataacctttaaaagtcgatctggaataaaggtaagtcagtgtctcactcttattatatgaagaaattcaatagtcccatggagcatactctcccatgaactcacacataaaatcataggagagaaggaggcctcactgctgatgaatatttgaataccttgaatgcggcagtagaaacctgagtacgcacacttgtcaaaaataaaacagtgctcttgaaatagatgcattttattatatgcaaattctatcttaggaatcatgttgaaaaaggatataataggtgagcttagggattttatttaataaaaaagctttcaaattggcaacttagaacaacagagtccacgttatcatcctaacccacattgtgttgacctaagtgataattaataaaagtgtgcaaagaataccctcaaagttagaagactccaataatttatttattgaatttaaatctagggtatcttgtagttccaatacttcttcgatttattagatgttgcttcataattttcacacatgacaccatccaattcattcctcatttccacttacataatttatattcatcatccagaatttatattcatacatttcaatggatggcttccctgacaactttgctgcatctcccctgcagccactttggaagaacacatcacttctcctttggatctctttttctattaaaaaacatattgacttaaaaaaaaaaaaaaaaacttctgcacctaaaatcatgcctagagcatgcaaggaactcaataaatagtttaaaaataataaatttgtatattgcaatatttgaacactcttgaagccattcttaatggatatgtttgcccttataattgctttctcttgggaaagtgttggactcttattgtgcttctaagggtgtctatagcccttactttgtcagagtactcatgaatgatctgttaaaagttcatgtttcagtaggaagtgccatttatatcagaacacagaaacttgaagacatttatcatttatgaggtcattttctaaaagggaaacaaaaatgctctgtcagtgatgatcttattcaatgaagaattctaaatgacacatttatggtgtgacatttccttgtcaaaagaacattatagtcattatcattgtctgcataatctgccagattcctcagggaaaattaccatgacctaatgtatgagcaccttacacttgaaggtggatgctaataaaacttggtatctctagaaacaagttattgcccatacctaagaatactaccataacatataaaatataatgtataaacttcttcaagacaacccttatacgcccaatcaattatacagcattaaaatgtaggctgagtatttttttctctttcaaaatatttagaacacatttttactccactctcatgacactggcagacaacattttacttaaccagtcaaatgagacatatatgatagttctatggttcaaacaattaactgtatcattttccattttcatcattctcttggtgataaatcacctgaagttagtacagaatttctactaattgttccttaaataacaaaaaaggctttatattaacaagactgataattttcattataaattaatgctgcatagttatttgactattacagcaacagataacaaacatgtatattttacaggcatttttatgggctaatcttaaaaatatatgttattgttttgtcacaattgaaaatgttttcagattgcatttttttaatttaaaaaaatgagagttgaagaaaaatgattacaactttacatttatagttttagtttactgaattcatttttttcatttaatatttgaaaaacacattcatcaaatatctaggtgtctgatcttgatcatatagtgaagaaatacgatataacctctgctctaaaggtacttataactttgcagagataaattgtcaactaagcagagctaaggataattaaaataggtatattttacttctgtcaattcctaatgtttcactcaacacagttatttcagaacatatatggcacacaatgcgttaggcactgaatacgtatcagcaggaaaaatgaatgtagaaactgttttgacatatacagcttactataaagtgcagacagtacaaaattagtcaaataaagatgtaaatataatccatcatatatgcaacaaaaggaccaaagaaacaaggataaatgatcaaaatagcagatattttctcatctatttgtgggaaaggagaccaaaatgaagaggtgatgtcagtgatttcaaataaatgaaatcatgtctattattagagtgttgcaggtatgggaagaagagatgaaaataatatattcaaatgggttgagacaaggcattgaacattgttaaagcataaattaagatgataatttattaagatgataaattaagatgacaaaaaatactttttttaatgtggagaagagtttggagagtggcatgtaaaaagagaggcttttaagtataatatgcataaactgtaacaaatacattttgattgtacagtttgattagttgaaaatatgtattcacccatgtaaccagaaccataatcaagatacagaatatatcctccatcacatcaaaatatttcattgtgctcttttgcaatcaccccccacatccatcctcatctcagagaatcatcaatctgctgtcattagaggtaaatgttaccccttctatagtagaatttcatacaaatggactcagatactacttgctattttgtttctggcttctgtcactcagtttatgttggtgatactcatcttccctgaatattatttcatttaacaggtatttctgttaaggacattttatttatttctgttttatttcattccatttgatatattttaaggttgttattattctttaactcttactggtttaaagcaacaccaattcagttttgtttgtcagaagtcaagtttgacctgactagtgtctttgctcaatgtttattaaggcaaaaattgaagtagctttcaggtggctgggcagttaggagaggctctgggaaaaactctgcttttttgggggggtttcttttttttttttttttttagatagaatctcactctgtctccaggctggagtgcagtggcacgatctcagcttattgcaagctccaccttctggattcaagcgattctcctgcctcagcctcccaagtagctgggactacagatgcgcaccaccatgcccagctaatttttgtatttttagtcgagatgggatttcaccatgttggcccggatggtctcgatctcttgacctcatgatccgcatgccttagcctctcacagtgctgggattacaggagtgagccacagcacccagtccaaaaatcactttttgaatttaattagattatcttttttcttttctttcttttttttttcttttttttttttgaagctatataacggaaattactgcttcctttctgtctgttagctggtggcttctcttagtttctagaaacctctctcaagttcttgcacatggtttcctctatttcagattcagcaacagtgtgtaaaatcctcacacgtggaatcgctgacttgactttctggctcatgcctgaggccaccagactgagaaagttctctgtctctcagggcttatgtgattagatttaggctgatctgaatggataatctaggattatctccatatttaaaggtccatatcttcaattacatttgcaaaattcctctttttgtttaacaaccatattcataagtaccagggattagggcatggacatctttgggtccataatttggtctaccacacttagttttctcaagtttccatttgacaatggggtttatcgggtcttttctgaagcatacaagcacatcattttccacattagacgcaacataaaggaattagagtggccatctttaatttggtccaaatttcatgtaacaattgccagacttcctttatttggagacttagactctgaaattgtgactattttatttttctttttaattgaatacaaatttatctttatgtgattttacatatgtattttaaaataaatgataatatttctatcaatttgtaaatgtcagcgcaaaattttatgactcactcttcttttactcacagtatttagaacactgttttgactaaaacagcaagtattcaattaattaatatatttgacaaagtactttaattaagtgattaataattattatgtattaccagagtagaaaataaaacgatttttaaaattttttaaataagaaagccactatttatattaatttaataatcatagaaataatataagttttctgatttacacttttttttatacttcagttctaggatacatgtgcagaatgtgcagatttgttacataggtatagacgtgccatggtggtttgttgcacccatcaacccatcatctacattaggtatatctcctaatgctatccctcccctagccccccaccccccgacaggtcacagtgtgtgatgttcccctccctgtgtccatgtattctcattgttcaatgcccacttatgagtgagaacatgcagtgtttggttttctgttcttgtgttagtttgaagagaatgatgattttcagcttcatccatgtccatgcaaaggacatgaattcatccttttttatggctgcatagcattccatcgtgtatatgtgccacattttcaaaaaaaagttttatataaggatagtgttgatatttgagctgggtgtctaaatacatgtaagacatttttaaggatttagagatttcattctttgctaaaataagccctgcactctgtccttacttttctctcacttaactaaatcttcattttaaaattattttttgtttctactgtttttccataaaataatgatatatgccttttactcacccaaaatatttataataggcagaataatgccatcctcctctccaacaaaagatgtccatatactacaagttatacttgccagaacctgtatctcacattgtgaaggagaattaagattacagatagaattaaaatgggaaatccttaaaataggaagatcatcctggattattatggtaggcccaaggtaaacacaagagttcctaaatgtggaagagtgcctcagaggagccagtgtcagagagatgctgtgtgaggaagtctcaacctgccattgtggctctgaacatgagaggatgctttgcaatcagccttttgaagctggaagaggcaaggcaatgaattcttacctagaactttcagaaaggatcacatacctgctgatgccttaatttcagcccagagaaacccagtttggacatttacactccagaactataaaataataaatttatattattttacaacactaaatttatggtaatttgtcacagcagcaataagagactaatacaatgacctccctattcccacgtccacattaaggtcatgttgttctctccttttactggcaaatttattgcaaatcagtctattctttcctcagttttaatgttctccctcccttttctgtctttactggttggtacttataaaatccatattataatgtgtaagtttcttcatcagatgcagagcacaatgaggtgaacacaggtgataattagctttgcggtttttgctggtgttttctcatcaaggtctcttattttaagcccacgtctgtgcatgttttgttagtttgcacataggtttcatcatttccttaaaattattggttttattgtttgccttataaattcattttgttatcttttctcttgatgtctttaagtgcagattgtattttaatgctcattgaaatatgtggattgtgtttaatattgttcaggttttttctttaaagaacaaattcacgtttaatgcataatatagcctccatttttactcttagctgttcatcacaacaaattttgacatattgactaaatgaaaatgctttttttatgtcaattactttccttttaagatacccatagttattgtggatgtccataattttttgcctactgagatagcctcctattttgcactcttccattccaagcattagtatacacagagtgagattttcgggaaagaaggtcatgttatatgccattgctcctaaaataaatttcaactctttacagggcaaatttttttcccaacctcactttgtgccattctcatgctaacttaatatactctttttcttctcacaatcctttaacaagctaagtactctttaatgcagaacctttgtccttgctaggtcctaggtgtgaaatgcacattctcatcctttttcatggctcacagtttctcattttttgggactcatgcctcagtttacatatcatttttccaaaaggaatttatcaaataacttatgaaaaatatccttattgctgctttgttttcccattataatattcttcagaatttctttcttagaacatacaatttgatctttgttgttattttgtaattacttccacatatctttcatagtaagatgtaagttctatgaagcctggtgctatgtcatttctttcctgaacccagctcctttcacagtgcctagtacatttttgtttgtgataaactgatatctatccaatgattgtgttaacgaaatcacttatcaccctcttcaagcatttaacttatacagtaaaggcccttctctattttctatataaaaagaaacagtagagtctatatcccagcatcaaaaagaaatggtgtccattgagaatggattccatacgatttcctgtattttaatctacctgaaaaaagaaaaaaccctctagattaggacatatcagaaaaaaaaaccatatatatataatttatatatatataaataaatcttgaaataagtaataaattgtcaatttatgagtttaataacaataacaaaatctgtgtttgcatacacataaaagagtgtgaatatatgtatatgtacacagatattatatatagagagagagaaagaaagagatggagtctcgctctgttgcccaggctggagtccagtggcacaatctaggctcactgcaacctccacttcccaggttcaattgattctcctgcttcagcctccctagtagctgggaatccaggcacatgccaccatgcctggctaatttttgtatttttagtagagacagggtttcaccatgttggccaggctggtcttgaactcctgaccttgtgatcctcctgccttggcctcccaacatgctggggttacaggcgtgagccaccacgcccggccagaagtatatttttgtaggctgaggttcttcatattttctgaattttataaaacagaaaactgaaaaatttaagaacctattaatatttataaaatgaaccattatttctcagggtataaatctaacctttataaatattatactcacattgaaaaacatacctaatacctgatgtgtctgtgtgtgtgtgtgtacgtgcgcgcacgtgagcatccatcctggtgtctcggaggtgtaaacttctacctaccgccccaaatattcatctttgagtaaatgctcaaacgtgatattatgaaacattttccccgtggtgactggatttaccggacttgaatgatggatggatatatatgttctgccttgattgaccagtgattttcccaaattgaaatgaaatgaccttggcttcttcccctgatgtcgaccatcagtgtcattaggaaggtgaataattgtgtgttttattatttgcatctgatgtttcttattttatggctcagcattctacaactgtaatttattgtttgagcttaaatttcaccaagcttttagataacttttataaattctaagtgagttcatttcccagcagttattccttgaggactctctggctcttcatttgattgccacataagcactccggactgaaagacctatttctgcttttgaaaggttaaagggaaaaaaaattcttcttacactgaatttttcctgacagttcaggtctcctcagatgatagccaatctatcctctagcagatgaaatagattagtataggactcacttatgcttcaatgtacaataggataatgtgacacttcatcttctcactgtcttctctattgcatctcacttattcaaaaatcacatttcactccaatatgaaacattcttcacagcttgcttctttctggctcatatttctttcagtttttcccatcaataaataaaattgcttgaagatcccttctctatttcctatacaaaaactttacttttgtacattattgtaatatagaactatatttgtctatctaataagatgtcatttttttcactaaccttaaatttttggacttgtgaatatctaaaaatattttgtactttgaatttaaattaaaatatttaaaatcagttgctgttgctttaaaaaatatcagtattgcattattttctaataactgtataaattttaaatatagttccatgtttactaaattatacttttgaaggctcactaatacatcttaattattgttttcaatttcccttttaaaatcaaatctaaatatttatttaaaaattaaataatctcagtacatttatatatcataaccatatatcggattttccctaaattgaggtttttgtagtttaacaaaagaaaacagagtaacctcaaaatatctggacaagcaaaacaatttttaaaaattactgacaaatctcgcatggagagcagtatactaaaagctaatcttagaggttatatttgaatctttttggtgttgtattattagctccagtctcaaattattgttgtagtttctcatatcaaaatttggagtggatttgtaggatatgatataatatttgagatgctctatcataaacacagaggtgtagtaaataaatatataaatcttgaaataactaataaattgtcaatttatgagtttaatagcagtaacaaaatatgtgtgtttgcatacacataaaagagtgtgaatcacatttctctttaaagagagtctgtaaggctcatttcagggatgtggtagacgttgattactatataataattactattaatactctggttctaaaaggttctgtgtgaaacgaaaacatgctactatcatctcttatggtctcctttaccaaaagtcctcagagtgtgggaataaagtatactcagtcttaacgttcctctgtgcgtacaagtagagcctaacaaaatttataatgcatgtttgtgtaaagaacaggtatatatttctgtaaaaaggttagggtatttaaagttgctttttttttcttttagatggagttccactcttgttgcccaggctggagtgcaatggtgcgatctcagctcactgcagcctctgcctccccagctcaagcagttctccagtctcaacctccaaagtagctgagattagatgctcaccaccatgcccaactaattttttgtatttttagtagtgacggggtttcatcatgttggccaggctggtctcgaactcctggcctcaggtgatctgcccacctcgtcctcccaaagtgttgggattgcaggcgtgagccacagtgcctggccaggtataattttttgaactaaaaagggctttttaaatttgatctttgtatgtgcttgcacagaatataaaaatagggttatccttcattattatgtgtcgagtacaaaacagagaaatccacttaaggttgaatgatgaaatatgataaaatatgtaataacgccaggcatggtggctcatacctgtaactccagcgctgtgagaggtcaaggtaggtggatcacttgaggccaggaatttgagaccggcctggccaatactgagaaacctcgtctctactaaaaatgtgataattaactgggcatggtggtgtaaatctgtaatcccagctacttgggggactgaagcttgagaattgcttgaacccaggagtcagagtttgcagtgagcagactgcactccggtctgggcaacagagcaagactctgtctcaaaacaaacaaacaaacaaaaaacttaacaaagtaaaatttcaaaagacaatatataacaaagcaaacaatataatcaaaagacgccagtgcaataaaatcaaattatttaatcctatgaagattttcgtaattcagaaactgagtaatattgtgaaacccagctatttgtttctgtctgttgttaaaaaatttggatccagtattaagaaaaccacataaatatgtttttaaacataagaactcagtataattaatttttacagtataattaatcatcaagaatatatattaaaatataatttttatattataataaattcaaataaaatagaacatagcattttaagccagttatttttgtatgatgtatagacctaattatctaacacaattattaatataattccaaaacattttttattctttttatgactaatgtcaaatgttgactctgaagccttcttaagacatgccatttaggttttcaataacgtctataaaaggatttatgtaacatacaatccaccagataaaatgaagataatttttacgttattcttttgttcaagctctaaaagcaaaaacaaaatgaccatgtgctatgcatagtatatgtattagttcattctcacactcctacaaagaactacctgggactgggaaatttataaagaaaagaggtttaattgattcacagttccacaagctgtctaaaaagcatacctagggaggcctcaggaaacttacaatcatgacagatggtgaaagagaagcccacacgtgttgggagcaggaggaagagaagagagggcaaaagagaaagtgccacatctgttttcaaacaaacagatattatgagaactcactcactatcatgggaacagcaaaggggaaatacacccccacaatctaatcacattccacctggcccctccttcaacgctggaaattataatttgatattaggcttgagtggagacacaaaaccaaaccatatcattctgccccagacttctccaaaatcccatgtttctgtcacatttcaaaacacaatcatgccttccccaaaatccctcaaagtcttaactcatttcagaattaactcaaaagtccaagtctaaagtctcatctgagaaaaggcaagtgtcccttccacctactgtaaaatcaaaaacaagttagttacttcgaagatttaatgggggtacaggcattgggtaaatgctccttttccaaatgggataaattggccaaaacaaaggggctacagaccctctgcaagcccaaaatccagcagacagtcattacatcttaaaccttctacataactttctttgactccatatcttaaatctaggccacactgatgcaaggggtgggctcccaaagggagcttgggcagctccacccctgtagctctgcagggtacagcccctgtggctgcttcatgagctggcattgagtgcctgcagctttctcaggtgcacggtgcaagctgtcagcagatctaccattctggggtctagaggatattggtcctcttctcacagcttcaaaaggcagtgtccagttggagattctgtgtgaaggctccaacctcacgtttcctctctgcactcacttagtagaggttcttcatgaaggctccaaccctgcagcagactactgcctggacttccagatgtttccatacatcctctgaaatctaggtagaagctcctaagcctcaactcttactctctgctcacctgcaggcttaacaccacatggatgctgccaaggcttggggcttgcactctctaaagcaatggccgtagctgtattttggtgctttttagtgatggctagagctggagcagccatgatgtagggcaccatgtcctgaggctgcacttagcagcatggccctgggcttggcccatgaaaccacttttccctcctaggcctccaagcctgtgttgggaggggctgtcatgaaggtctctaaaatgtcttggaagcatttttcccattgtcatggctactgatatttacctcccctctatgcaaatttcttcagttggcttgaattcctccccagaaaatgggtttttcttatggtcaggctgaaaattttctaaacttttatgttctgcttcccttttatatataggttcaattcagaccatttctttgcaaatgaatatgatattttgctgttagaagcatcctggttacatcttgaatgctttgctgcttagaaatctcttctgccagatacccagaatcaattcactcaaattcaaagttccacagatctctagggaaggggtacaatactgccagtctctttgctaaagtgtagcaagagtgacccatactccagttcctaataagtttctcatctccatctgagaccacctcagcctggactttactgtccatatcactgtcagcattttggtcacaaccattcaaccagtctctaggaagttctgaagtttctctcatcatcctatcttccgagcccttccaactgttccaaactctgttacccagttccaaagtcactttcacattttcagttatctttatagcaatgcaccactctcctggtctcaattttctgtattagtctgttctcatactgctataaagaactatctgagactgggtaatttattaaaaaaggaggtttaattgaggtacagttccacagactgtacaggaagtatggctgggggaggcctcaggaaacttacaatcatggtggaaggcaaaggggaagccagtatgtcttacatggcaggagcagaaggaacagaagagatggcaaagagagacgagcaacacactttcaaccaaccagatttcatgagaacttactcagtattatgagaacagtaagggggatatctgccctcataatctaatttcctcccagcaggcccctccttcaacactggaaattagaatttgacatgagatttgggtggggacacagacccaaaccatgtcagtatatatatatatacttttgagtctacaaagtactatatttccaagtacaagtaatatattttatctttgatcattactgttaggtggtgggtatttagactgttatttataatatagagccaaataattttttagaggaacctactgtttgatgttactaaattttggaattctgaaactaaaaattgctatatttctgggataatctctgacacattttgaaacattttcaggtttaacatttttgttttaaaaatatgtttatgtaatctatgtaatgggacagctgaatatttatttttgcctaagttagccatgattaaacatgtttgaaagccagtgcactaaaggtttgctgatctggctgggtacaattgtagtccaatccagtttctcttttaagtgtgccataccgagatggcttctttgtacgcctcctgcattcattcctattcttctattatcatcatcatcaccaagttacgaattaatggtcatcatcaccaagttatgaattaattaatcactctcttctgagctttgtttcacttctttcaaccccctctgcttgtgcccttccaaaatattctcataatgccctctggaaaaagcatgtataacctcaatattttctctgagtattatcttcctctttctgttgaaactcgatatgatccttgcatgcgcatactttttccatagtgaatgcaatcactatgagagttgcatttctcaagtgaatgcagtctttcagctctttattcacttcaatgctgaaaattttgcccacgtcatcatttccccactgttatgcccagatcaatatgcttctatcttccttataatgaacacttcccttaggtaatggatggcatttacctgttactgtattgtctgaaatgtttcaatggagccaaactatgatacaaacattggcaactacttacttccctagttgtttatagctaatcatctttttgcagatgatatttagtcccgaaagagtatttctgatacccttcagtttttagatgacaggcaagtgactatacttgtaatattgatagtagtaataacagtgacagatattattattctgcatatatataatatgcatatacataagtgcatatataattagcacttattatatgccagttataactctaagcatttgccatgaattggcatataaagtcttcacaaaatctctttcacatagaattccatccttattttagaagtgaggaaactgaggtatataacttaggtaatttgtcagatcagacagtgaggaagtgtcataaccttattcacacacaggcaaccttaatctactagaggtctttcatgtgtcttagcaaaactatatctttcaggactttcttggaatgtatggctggcctttggagagggggtgaataagtaatatatattcatatacatatagagagaaatatatatatataaacttcaatagttttgggataacagaacaggtagtgtctggttatatggataagttctttagcggtgatttctgagattttggtgcacccaagcagtggacactgtacccagtgtatagtctcttattcctcatccccttcccaccccttcttcagagtccccaaagtccattgcattattttcatgcctttgtatcctcatagcttagctcctacttatgagtgaaaacatacgatgtttggttttccattcctgagttacttcacttagaataatggcctcctgttccatccagattgctgcaaatgtcattattatatttctttttatggctgagtagtattccacagttactttatccactgattgatagatggggatttgggttggttctatatttttgcaattttgaattgggccgcaaaaaatgtgcatgtgcaagtatcttttttgcataatgagttcttttcccctgggtagataaagaggtgaataattctttatagcaatctagcatactcctagaagctaagatatctaatatttgaatgttgttatttcaatttttaacattaacagtacctcttcactgagatagtctcaagtcagctacactagaatacaataaagtgctaaaatataatttacctttaaagataagaaagtcttgtctggtaattcagcatgaattccagggcctaaatacattcagctaactctaattatggaaaagtgtgaaatgaagcctggaaaccatattgattcaatggaagttcagtttctacttttagaagatagtttaacttgtgaatgtcaattacagagttttactgttggtcttttaaatacggagtatattttactgagtttgtcattaattaagcagagtcttccttccttaagaactactgtgacttatgcaggaatgtttaatgagaataagaccaaaatagagcttataagaatatgatagatgatctcaggctaggctttttctaatgcaccaacacaataattatggtacctctaaaatagtgtctcttttagaataattagagcctctgcttctcttcccataaaacatttgaattcagaatggatctcactggaataagtaggcatctggaatccagagaacactgcttattcataatgaacatataacacaagtgagcaataaactttttgtctttttaatccactgatattttagtctacaacttattaggattaaacatctagatcaatttactttgctggagccacaggcatctcaaattcgctacatctgaaattaaacctgcttctcccactttgacctgtttcatttaattttaccaccattcaaatagccaaccatttcagaaaccagcatgctatttttgagtcttcttttacctacgccaatatctaaccactcactaaattctactgatttttaaatgtttgaacttctccctattcccactgacattacacccttttattctgcccgtgtttcttttgtatttttaacacaagactcaactgttttcttcatatcacagaaagaataatttgtactagtccattcttgttaatttcctgataaaaaatttcaatgactacattgtttttatgaaatagttatttatttatttattcatttatttatatttatttatctatttttgagatggaatctcactttgtggcccaggctggagtgcagtggtgcgatctcagctcactgaaagctctgcctcctgggttcacgtcattctcctgcctcagcctcctgagtagctgggactacaggcgcccgccaccacgcccagctaattttttgtatttttagtagagacggggtttcatcgtgttaaccaggatggtgtcgatctccggacctcgtgatctgcctgccttggcctcccaaagtgctgggattacaagcatgagccaccatgcccggccagttaaatttatttttaacagagcatgaaaatcacttcacagcatgcccttccttttcaatatcacctttgactttttcccatggcttgtaccccatgtttagctatgtagaacagctttgtctcccagaaatccaccccacatatgctctttctgcatcataaaattttctctctaaagtagaatagacctccactaaggtctcttaaagtctatggtaatatcttctgttctttgttgttatttttcttaattgtaactctgtctattacacaaacatacctcagaaatactgtgtgattccagaccactgaaataaagcaaatattgcaataaagcaactcacacaaagtttctggtttctcagaacataaaaagttatgtttatactgtactataattcactaagtgtgcagtagcattatgtctaaacaatgtacacaattttaaaataatttttactataaaatgctaataatcacctaagctttcagtgaatcccattttgctggtggagagttttggcctgacattgttggctcctaactgatcagagtagtgactactaaaggctgtggtggctatggcaatttcttacaataaaataacgacgaagcttgccacatccattgactcttcctttcatgaatgttttgtctatagcatgattctgcctgatggcattttagcctcagtaaaactttcttcaaaactgaagtcaattctctcaatccctgctgctgctttattaactatgtttatagaatattctaaagcctttattgtcatttcaacattgatcacagaatcttcaccaggaacagtttccatctcaagaaaccactttctttactcatccatagaagcaatttctcagtcattcaagtattatcacaaaattgccccaattcagtcacatcttcagattctacttctaattgtagttaccttgctagccttacaaaatgtatttcctaaataagacttgaaagtcaaaatgactccttgattggtaggttgaagaatggatgttgtgttagcagtcatgaaaacgacattagtctacttatacatctccagagctattggttgacgaggtgcatcttcgatcaacagcaattattttgaaaagactttttctgagcagtaagtctcaaaagtagacttaaaatatacagtaaaccatagcacaaacagatatgctgtcatgcaggctttgttaatctgtgtagagagcataggaatagtagatttagtataattcttaaaggacctacaatttttgaaatggtaaatgagtatttgcttcaacttaaaagtcaccaccggcattaaccactaaaaagagagtcagcctgtcctttgaagctttgaacccagacattgacttctctttagttataaaattcctaaatggcaccttcttccagtagaaggctgttttgtctacactgaaaatctgttgtttaatgtagccaccttcatcatttaccttagctagatcttctgtataacttgatgcagcttttatattagtactttctgcttctccttgcacttttatgtgatcgagatagatgagtttcttcaacctcatgaaccaacctctgctagcttccgatttttcttctgaagcttcctcatctctctctgccttcatagaattgtagagacttagggccttgttctggattaagcattggtttaagggagtgttataactggtttgatctatctagatcattaaaactttttccatatcagcaataaggctgttttgctttcttatcatttctgtgttcaactggcataatactttcaacttccttcaaaaattttcctttgcattcacagcttggctaactgctttgtgcaagaggcctagcttttggcctatcttggctttcaacatgccttccttactaagcattatcgcttttagtttttgatttgaagagatatgcaactctttctttcactttaacacttagaggccactgtagggttattgtactaatttcagtatcattgtgcctcagaaaataaggaggtctgagaagagggaatgaatgaaaagggttaatagcggcttggtgggacagtcagaacacacacattttttgatgaagcttgtcctcttatatgggcatggttcgtggcacccctaaacaattacaatagcaacagcaaaggtcactgatcacagatcaccacaacacatataataataatgaaaaatttaaaatagtttgcaaaaagtgccaaaaatggtaaaacagagataaggagtaaacctgtgttgttagatagatttgctcaatgcagaattgtcacaaatcttcaatttgtagaaaatgcaatatctgtgaagcacaatcaagtgaagcatagggaaaatggtattaatctaagtatttccaggttatcagttttatctggttgttgaatccaattcaacattgtggccataacaccaaacacagaaatgatgtttagacagtagtatgttttatggtaaatgaaagggccaattctaattgctgagtcaaatcttctgctgtctacagaaggctttattttttctcctttttattgtgcaaaatgccttttatttgttttacctctaagagccatcactgcattattctggttctatactgtgatctttcttgcctatgttctttcttcaatgcctgggttggctaaatagcatcagcgttatttctgctgttacaacaatgagagagggactttaagatcctctgaaagaagttggcactttttaagaagagtatataacaaaattatgttccctgattttgaattgtcatgatatttatattgtgcccgtcctagaaacagcagttaataaccattactctttaaaaactcaaagctttgtattgcatgagctttacttgaatttaactaaaatacatgtattattattaaaagacacaacctgtttttttcaaatatatagcattttattgtaaagctcagaaggtttagatagaaccttctgatcaccacttcaatataaacactcactactttgattttgattagtactgtatcttacactaaatcctagattcaagctcattctcaaaaggaaaatgttttctacaaaatatattatgtgaaagaaaaacactgatttatgtttagaaggtatgatatctactttcaaagataggacagatatttagctttgtttttagcattcttaacaagcctacagagattatgaaaaatggaaaggcaaaataaatgtgctctcttactataatttagttttaaaggggttaaaattctaaattttaactatattgctttcagaaattattttcagaacattaaaaaaaacttcccaaaattaaagtacccaaaaagatttgttccctctgacttgctgagctcatctctttcatgttttaattccactgttggcactctttgaatactatggtttctactaagccagtgctcacttcagctagccctgcttccacagtgggcagagagctcttgatccatgctgccctcctattagtaggatcatcttgcagaaaaaatttgctaagtctcatttcaaatcatgttttaatatgcttgtcatgtaaccccagctctacctctcgctgcatcaagtttggcttatgtacacagccatttcttctgcgctttgttttgttctattataaagagattgtaaaatcattgctatatttcttatgctgttggacaaagaaactattggtaaagtcagttatagtaaaataaaagaaaaacaaaataaaaatttcaatcttttattttacttgtctccataattttgggtcatctggtggtattgtgctatacgctccaaaaggcaacagatataagaaacacaggtgcagtggccacaggaaattatgtcattgaaaaaacaaaattcaaaaacatcaatttaaaaatataaatttaaggctgcattggtaataaaaataacatgtgaagaataggagtacagaaaggaaaaagatatgtagcacaggagtacaggaaggtaattaacagtagtgctttctatatacaaaaattaaaaagagaacagtgacttgtatacagaattgttaaatcattttttgtaaacataaagatatttaaactatgctctgcagagtagcatatgtaggtctgaaagacaaaaatagctattatatgcaagggaaatgattgtgtcattttaattgactaaaagactgacaatattaagcaatttgctgtttaaagattactttttcaatgcctatttttgtatagtgttttgattaaggatacagataatatatcacacatatatgtatacacatacatatgttcattgccaggtaaaacacaagatactcagtcaaattgaaatttcaagtaaacaacaaataaggtttttttccttattgagatgaaatttacagagcatgaaattaaccattttaaaaggtacatttcagtggcatttactacatccacagtgttctgcaaccaccaactaaatcaatttctaaaacatttccatcaccctaaaataaatctcatacctattaaacagtcactctctactgttcttttagttagaattcttttagttagaataatgctttagagcaggggtgtccaatcttttggcttccctgggtcacattggaagaagaataattatcttgggtcatatataaaatacactaaaagcaatggtagctgatgagctaaaaaaaaaaaaataaaaaagaaaaaaaacacagagagtgagagaaagttacatccatgatgtaacatatgtaaatagttcattctttataatggctgaaaaatacgatattgtatgcatttatcagagtttgttaattcattattccattgatggacacgtagactgtttccatcttttgtcttttgtaagtactattgctatgaacatctatatacatatattatttgggtacctgttttttattctttcttggtatatatgtaggaatggaattgcatggttatatggtaattctacatttaatttttaaataaatgcaaaactcttttcaacaataatgttaccattttatattgttaccaacaatatataaaggttgcagtatttccaaatgtttgccaatgctcattatttttatttttaaaattgtttaatatagtcaacctaatgggtgtaaactggtatctccttgagattgagatctgcatttctctgatgactaaggatgttgaacctcattttatgtgcttgttctcaatttgtttattttctttgaagaaatatctatttcaatctttgcttatttttaagaagattgtctttctgtggttaagttgtttctataagaattctggagactagacccttactagacatattggcttcaaatattttctctagttctgtaagttgtttttcattatcttgataatgtcatttgatgctcattgttttcaattttaatgaaatctaatttattatttgttactcatatttttggtgtcatttccaagaaggattgctaaatccatcatcatgcagatctactcctatgtttttctctgagaagtttacacttttaggtcatgtttaggtcactgatccattttgagtcaatttttgcataccatgtgagttagggatggttccagcctcactctttgacaatggatatccagttgtgcctataccaattgttgaagagattattcttttccacattgacacctttgtcaaaagtcaattgactgtctacatttggcataaattctgggctctaagttttattctattggtttgtatgcctattgtattccattgttacactgctttgattactgtagcttcgagtaagttttgaaatcaagagaaattatttgtccaatattgatttcttttcaatattgttttggctactcacaatttcttactttccacatgaatttggagatcgtcttttatatttcttttttaaaaaggaaggcagttgggcgcggtggctcacgcttgtaatcccagcattttgggacgccgtggcaggtggatcacctgaggtcaggagttcaagaccagcctggccaacttggtgaaaccccgtctctactaaaaatacaaaaaatagccgggagtggtggtacacgcctgtaatcccagctactcagaaggctgaggcaggagaatcatttgaacctgggaggcagaggttgcagtagccaagattgcaccactgcactccagcttgggcaacaagagcaaaactccaactcaaaaaaaaagaaacaaacaaacaaacaaacaaaaacagataggcaaagctgaaggctgtttaaattttaagaggcattgcattggatctgtagattgcttgcgcgagtaagtaaatcttaacattattgtcatccaaaccatgaacatgagctatcctttcatttatttggatcctctttaagttatttcagcaatgttttgtagctttttgttgtgtgagttttcagttccttatttgaatttattaccaggcttttttaagatgttattgtaaagggaactgatttctcaattttcctttcagattggtcgttgtttttatatataaatacaactgatttttgcatgtaaatcttttaccctgcaacttttctgaatttactttttgaacctaataaatagttgtatgtttgtgtgtgcattctgtatgtaaaagcatgtctttcattaatggcaatggttttctttttttagtttcctgctgtaacaaattataacaaactgcatgtcttaaaacaacataaatgtattatcttacatttctggagaacagcagtcctaaatcaaagtgtaagcagggatggttctttctggcaaccctgaaagagcatctgttctatgcctcttcccagtttctggtggttccaacaatccttgcctttccttggtttctacacacttcattccaattgctactgctgtctaccattgtgtctctctgttcaaatttccttcttattataaagacacaagtcactgaattagagcccaccctactccattatgaccttaacttgtttctatctacaaacatcttatttctaagtaagattatatttacaggtactacagattagaacttgaacatttaattttggagatacaatgcaaccaataacaatctgcgacatgcacagtattttcatcccatccgagaatccacagaaggtttaaatcattccaacatcaactctagcccaacaactcatttaaatatcaattcaaaaacactcaaatattatttaaatcaggtacaggtaagactctgggtatgattcatctggggctaaaattcttctttgtctgaagacctgtaaaacttaaaaacaagttatgagatactcttccccaggcctcctttagctttttgtccatggctttctttatctctttgaccacatttaagactatatttcaaatatttgtctagaagaccaatatgtgtgcttccttggggtaactttttttaacttctcctgcaaaaggccattattttttatttttatataatttataatcttttctaaaatctgaatatttttagtatcacaatgtggcagcataatattagatattttcttctcttccaggtttgttacatataatttgctgtatattgtaattttatttttatttgacttttcaaaactttctttataaagtctgtattctttgttgtgtttagtttatcagtggtttctgaagtctccaagttttttagatagtggtcagctagtgtttggcagagatttccttaaaatgttggatatgaaagtgagagagagaaaaaggaaagaaagataaagagagagaaagaaaagaaagtaagaaaataaaaagaaagatagaaaataaaggacacataaagaaaaattgaaaggcagaagaaaaaaaaaaaagaaaacctgactcagtagtcacagattatctgtcattgggcacaccttcaatgacctagcaagaccacgtgaaactatgcaatagtcttactttttgcttgttctgaacctagagatgagtaaaggtaaaagctgaattccgtagtgtttcctaagtatgtgttctactttaagcatgtgtgtggcttcttgaaaccctcatacacgtggaaacttttccatttccttatttctcaaagagattatcaacttttcctctcaggtttttagcttgcttacttgtttgccataagtggcagtgagttattcattctctgtagagtcatttaaaggaattccctctgtacagccacttttctgcctgagagttctaagttacatgaaacaaaggccagcaaattgcctgagtctcttaaggaactcccagaatgtcacaatggacaaacactactatttgaaataagatctaatttacttctggaacaaaggaccatcaaaccactctgggaacatgggctgccatgtccaagaccatcactgagctagggaggtggaggaacagcaagaacaagtaaaaacactacaaaacttttctaccatttttaagtgctatttaaaaattttgtttggttggctgctgctaacctttaactactttccagagttctgacaatattgattctgacagtttttttttttattttaggtgctgtggagggatgagtacctatgctatacattttgctaataccatcacaatttgtctttgttgtttaagtatgtgcagtgtaataattagtgaatatttatattaaaaatgtgttacttatgcaaatcttaagcttatttgggtgtcctatatttttatctggcaacctattttgaatatacagagacatatacacatataggtacacatgcggatattggcatataaagatatatggatacatatatataataaatatacatattttttctgagaatgtatagtgtataaattgatgaaagactaaaacattaaacaaatgtaaaaacagaaaaaataatattttattcaagttaaacagcagtaagatagggttataaaataatggtgatactttaaggatgagaaagtattagagacagtcttcatcaatgatgaatgaagttcaatataaagctagctattgcatatttccttgattctagggaaatttcctttttcccattttaatatattcatcacatcatttgccttgtatatatggacaatatcacatgttattaaactttaattcaagttttgattttaaatttttattaaagtgtcccttaacatgttatttcacatttcagtcataaaatgtaaagttactgtataatcaaaataattattttttatcactttaggaaattcaattagtcaatgctcccagtggagttgatctcaaacttaccaaaaccaaagcaaaaactttaggtttttcagatttgggggatttgaaactcgtggatttgtgggcaaggagtcactatatatatatatgactatatatatatgtgtgtgtatacaaacatcatgttttcgcttggtaaaaagtaagattactctttttaatgtgctgtgaaatcaagagacaattcttaatgcattagtttcctcagcctgccataaaaaattaccattaacttggtggtttaaaacaatagaaatgtaatctctcatgattttgcaggcagatgtctgaaattaaggtgctggcaatgacaccctttctctaaaggctctggaagtgcctctcccagctcctagagtttcttggcttgtgaaagcatatctataatctctgcctctctcatcacttaatcttctctcctgtctcctctgtctctgtgggtcctcatttattatagtttttatgaggaatctagtcattggatttaggatctctcaaaatgtaaatgatccctcatcttgtaattcttatcctaattacatctgcaaagacaattactccaaataaggtcacattctgaggttctgagtggccacatatttgggaaccactctccaacccactacacttaaaaatgcattatatattcatattttctactactaatctttgccttcaacataattattaagaattttatttcattattttctgtttgaacaatgtcttaaaatcataaaattctcagacacgagttagaacttaagaattattaaagaagaaacccttttaccattacatattagataactagtgcccaaatactcttttttttttttttttttttttgagatggagtctcgctctgtcgcccaggctggagtgcagtagagtgatctcagttcactgaaagctccgcctcccgggttcacgccattctcctgcctcagcctcctcagtagctgggattataggcacctgcgaccacgcccggctaattttttgtattttttagtagagacggggtttcaccatgttagccaggatggtctcgatctccggacctcgtgagctgcctgcctcgggctcccaaagtgctgggattacaggcgtgagccactgcgcccggcccaaacactttcgactattatgtttaatgtattaaactgctcaatggatattaattttgtaattgcctaaactcttgctagattatcaaaaatctgcaggttcacatagaactcaaattagaaaaaatgtaagtaattattgtgttctgacctcaattttttcatgaaatcatcaatttcatttggtaaattatgtgaatttatttttctaacaaaaactaatatatggcagttaaaatgctctaccaaagaaatataatattaatatttactgagacttgtgagtgatcaaaaaactttcataggcaagttaaaaaatgaaatagaattgaatagaatgacttttaaaaataatttgttattattcatgtgattgttctctttgcaatgtatgcattttagagcactatatatacacatttaaaatctaaagtgattttatagtcttagaggagcaatatttttaacttactacttccaaaaaaaggatggaaacttgttgattactgaaagcaaaaagataaattacatgataatttctacaaattatcagtttcagagagtactacattattactaagacattagatttttcattaaaggttaaaaaattgaatgtttcagaaagtatctgtgttaagtaaattatgtaaattgtaactaaattatcctgcattgaagaaatatgttaatttttaacctgctgacttactcttagaaaattgctaaatgctaaaagtgtctaaacatttcaatttgaatgcattattaaaaacataatgacagagttccttacacaatttttatttaacaactaaaagggtgattctaggttactgtaattaagctcctcaaagccttcatttataaagatccttccagagttaccattttattaaagccaaagaaaaattacattgatacttgaagcattttcatatgtaaatgtttctatatattaaccatgaaagttgcagcactccacttcctcttctacttttctctcattttgattgctttttatctgtaggaattatattctttaaaaaattagctatattttaatttatcagatgacgtattatgcccattaagttgtttcattttaacttgtccatggcctagaagcccaaagaaatggtattagtaggaatgacattgaatttcaggagcacattgactggtgcattaatatgggactatgttctaaattgttaattatgccaacatgataaaatatatttaatcaagtatattatttcattttttggtgagggcatttatttgtgaataagctaagtttttaaacaaatttctcagaacaaatcatgtttgattttatattttatgtagcataatttatgaaaacatttacattctcaatataatcaataagaatttttatgattttcagaagaaaataattaaaatgtgtacatgtactctgcgtatttgcaactctgaaatgaagttattattttcccaggtagaaaaaaatcatctaaatgaattaaataaaaacacattatagtattcaaatttgcacatacaataaacataaaataaaaagaaaaattctgattttttaaatactaattcatgtgtagatacatttttatcctcatcaaggagccattactgaatataatggaaaatttctttttttgttgtttggttttactatttatattcagttcatgatgtggctgataatttctgcaaggcaaaactctagttcccagagttaatttattcaaaaagtacagactttccattttaaaatggcagactcctttttaacctgaaaatatattagaataaaaatgtgaggtcataaaataggacaagttagtaataataaaaagggtagaggtagagagaaaagtgtccaataattctttctgtggtagaatacagataaaccttcgtggccaatgatactggttgcctacatattactgttacttgctaagagaaatccagttttactaaggaggtttgcacctaggaaaggaaactatggtaagtgtaaatcaatgatggtatccctttctactttgcccatgatcaatttatgcacacacatattatctggcctctgctggcaacactaggatttgtttctaccctcagaatagaggagaagggaaggcgaaggtggggggcggggagagagagagaaagcgaaagagaaagagagaggaagaagagagagagaggcctcactggttcctatgaatatggttgagtaaatgtgatgcatgtacctgtggcagctctcttgtgatcatatgaggaagcatcacctacacgcagactagaaaatgaaggtatcacatcgtgcacagacaagttgtcccacatttatacattctgttaaataaataatggtcattgtaaatgctaagtcagagttacttagaacctctattaccaatagtcaaatgcattctataaacatgcttttaaactatgttgattgaaagaggctgcaaaccactgctcaatgaaataaaagaggatacaaacaaatggaagaacattccatgctcatgggtagtaagaatcaatatcgttaaaatggccatactgcccaaggtaatttatagatttgatgccatccccgtcaagctactaatgactttcttcacagaactggaaaaaactactttaaagttcctatggaatcaaaaaagagcccacattgccaagtcaatcctaagccaaaagaacaaagctggaggcatcacgctacccgacttcaaactatactaaaaggctacggtaaccaaaatagcatggtactggtaccaaaacagagatataaaccaatggaatagaacagagccctcagaaataatgctgcatatctacaaccatctgatctttgacaaacctgacaaaaacaagaaatggggaaacaattccctatttaataaatggtgctgggaaaactggctagccatatggagaaagctgaaactggatcccttccttacaccttatacaaaaattaattcaagatggattaaagacttaaatgttagacctaaaaccataaaaaccctagaagaaaacctaggcaataccattcaggacataggcatgggtaaggacttcatgtctaaaacaccaaaagcaatggcaacaaaagacaaaattgacaaatgggatctaattaaactaaagagcttctgcacagcaaaagaaactaccaacagaatgaacaggcaacctacagaatgggagaaaatttttgcaatctgctcatctgacaaagggctaatatccagaatctacaatgaactccaacaaatttacaagaaaaaaaccaaacaaccccatcaaaaagtgggcgagggatatgagtagacacttctcaaaagaagacatttatgcagccaaaagacacaggaaaaaatgctcatcatcactggccatcagagaaatgcaaatcaaaaccacaatgagataccatcacaaaccagttagaatggtgatcattaaaaagtcaggaaacaacaggtgctggagaggatgtggagaaataggaacacttttacactgttggtgggactgtaaactagttcaaccattgtggaagtcagtgtagcgattcctcagggatctagaactagaaataccatttgacccagcaatcccattactgggtgtatacccaaaggattataaatcatgctgctataaagacacatgcacacatatgtttattgtggcactattcacaatagcaaagacttggaaccaacccaaatgtccaacaatgatagattggattaagaaaatgtggcacatatacaccatggaatactatgcagccataaaaattgatgagttcatgtcctttgtagggacatggatgaagctggaaaccatcatcctcagcaaactatcgcaaggacaaaaatcaaacaccgcatgttctcactcatacatgggaattgaacagtgagaacacgtggacacaggaaggggaatatcacacactggggcctgttgtggggtggggtgaggggggagggatagcattaggagatatatctaatgttaaatgaggagttactgggtgcagcacaacaacatggcacatgtatacatatgtaactaacctgcacattgtgcacatgtaccctagaacttaaagtaatgctcaccatcactggccatcagagaaatgcaaatcaaaaccacaatgagataccatctcacaccagttagaatggcgatcattaaaaagtcaggaaacaacaggtgctggagagaatgtggagaaacaggaacacttttacactgttggtgggactgtaaactagttcaacccttgtggaagtcagtgtggcgattcctcagggatctagaactagaaataccatttgacccagccatcccattactgggtatatacccaaaggactgtaaatcatgctgctataaagacacatgcacatgtatttttattgcggcactattcacaatagcaaagacttggaaccaacccaaatgtccaacaatgatggactggattaagaaaatgtggcacatatacaccatggaatactatgcagccataaaaaatgatgagttcatgtcctttgcagggacatgaataaaattggaaatcatcattctcagtaaactatcacaagaacaaaaaaacaaacaccgcatattctcactcataggtgggaattgaacaatgagatcacatggacacaggaaggggaacatcacactctggggactgttgtggggtggggggagtggggagggatagctttaggagatatacctaatgctaaatgacgagttaatgggtgcagcacaccagcatggcacatgtatacatatgtaactaacctgcacattgtgcacatgtaccctaaaacttaaagtataataataataaaataaaaaaaaagaaagaggctgcaatacagtattatcacataaggactcttcataaaggtgaaagtcatttgtctcaagagaatcataaagatcttcctatcaaagttaacctctaagatctctgaagtaaaaagtattgggaatttacttgaaaggcagtcaacagtagagcattccagtcacttattaaaatattcatttccatttcagcttatagagttgctagcagaagtaattaaacttttggttagaattaaaccacaaaaagcagggcatgaaaagtcagcatttgtttctccaggtacagtacttgcttattgtaatatccacataagataagacaataatactcctaaattgcactctaaagagctctcaattacaatctcagaaaaaaggagctccaacttcccattcatgagaggagtccattcaggaagcagacctacttacatagcagccaaggaaaaccacagcagctagtcaaataaaccaagtcttttttccttcaatctgactcaaaaaacaaacaagaaaaagctaatagaatgaagtagagagatcaatttaaacagttagattaaaacaaaaataatcaaggagaataaaaatgaattgttaaaggaagaaaatatgcattcataaaaagcatgaaaaaggatacgataataaggaagagtcaaataagataattgtcaaggaaaaacaaaagacttctaaagataaaaactgacataagccttcagaataaaatgctttgtattattagtatatgaatttgaaaaagacaccctaaaatacagtgtgacaaaattaaagaatattaaagcttctagagaaacacacatctccactcataaattttaactcccaaataaaagcttgtgtctggctcccgaactagagcaggaaatatacacaaaatgatgctatagcatcttctagtgctagtaagtaaaaagggtacaaaaaaaaaaaaaaaaaagattggagtgtttcaaaggtacaaaagagttaactgacagaattcccaaaggccaaagttgaaataagttgagcaacaaactagtattgattgcaactcaacatagaaaacaaacattcataagtttatactgatataatgttatatacaaatgattgaataaacaaataaataaaggggaacacaaagatattctaagcagaaacattccaaatcatttatgtggatatttggccttcaaaaaaggtggaacacaactactgacttcttaagtgtgggctgcacatcttgacttcttaataaaaatcacagtagggaaataagaaaaaaataattttacagttgagaaacttgacagtcctcaaccatggttcaacctcagcagtcacaaatcatgttgatagtatggacccttgatataaatgaaagataatggcactttatctttgtggtcttcctctcaaaattccacaaccctagtccagtcataagaaaaacacctgaaaaatcctaattgagggacattctgtaaatccctaaccaacactcctcaacactctctatgttatcaaaaacaatgaaagtatgaaaaaactatcatagccaagagaggcctaaggagacatgacaaccaaacaaaatgtgatatcttgtattggatcttggaacagaataaggacattaggtataattaatgaaattaataactatgtatcactgtgggtacatgaaatatcacaaatacatcatactaatgtaataggttaatgataggagaaactgagtgtgtggtatgtgggaactctatagtagcttcacaattttttgtaaatctaaaattgaatgagcaataagtttaatatttaaaaaattaattataaaacagttgagttacctaagtgcaactatcaacctgacaacagattttctgtcaggcacaccaagtgttagaggaaataattcagagagaaattatttttaatatataaatgaacgtaccaataaatttcctactattatgtgtttttgatattccattcttcctttaaatgaatttatatggggatatattctagccaaataatagagaaaaattgggggaaaaaaacccagaatactgaggagtgtagttctaaccaagaaaaataatgaaaagaagtcccagaatgatgctttggcagaaagcctttaaatgagacttcagtgattgaagaagagggcaggaggcttcttggaagggtgatcaccaatgaagagatttccatgcaatagagaagataactcaatatggatacacccaaagatgggagactgcatattgttacgtttaataatataaatttatgaatttaaaatcaaggaaaatcaaaaccaggaaataagaaattgctaccaaatgtatagggtcattatgtatgccattgggctttgggagaaggaactgtgacactaatattcttctttccatagcaaaaattatttgcaaagtagcataaatcacatgaatttttatattttagaatcaaccatttttccaaaacaggaataagtactgtgacaaaactatataaatcatggcaaaaattataaaaccccaacaatataaatgtttacacattcagattactgcatttttatagttatgaatttgattacccacatagcacatattgttgagaatttatgaaataattttcttttcaaaaaatctctcatttttaaattagtaggtgagaatatacattcctaagtctatagaggaaatattaaaattcattatgaattatcattttattacaaagaaatttatatgtcaaattctatgaaatttgtttttctgtactgccttctcagcatacattttagcagctaaacttacctgattacaaagaaaaaggatgctatgcttttataaatgatgccatctatgaacaaaaacataacgctgaaaacaaactttgctatgtatcagcaatgtctcaatataaacaggatttggcagggacaaaaagttggcagtgaatttatgaagagaatcatagtaaaaaacaaaaacttgttatgagtctacggtcacatcatttttcctgagtttgacagtgaatagattaaattcaaaacacatatttgtgggtgaacacctgcaccagattctatgttagttattaatgatataggtataaaaaggttcacagctctttcttcaaaaccaaacagttaaatagaagaggcagacatgtaaaacattcttatggtccttttggtagatgtaaacgtaatccagatttaagctgaggtttctctgacaattgaaatctaaatataatttaaagcaaccctattcatgttttgtccactatttctccaaatactggaaggtttaggttatgtcatggtctctctagctctttttttcccctcctgtctgaatgtatattctccaacccacagctttgcctttatttctgatctggcatagagtagaagttggatcttggccccttttcataattaatatagacaaatccaacaaaataaacaaaccaaaaaagacaaaaatcaactacctgtccctgcgtattgcacaaacccataagttcatttttgaggtgagtcacaggggatttgaatagcaacaaaacaaataatttaattttcagtttcagacattccatttctcaaaagtactgcagtcagtttgccatggttctcagccaattcaccactctcctcttcactctaagctgcttctaaattccttttcttttttaaggcagagggcattagctatcttgtattgcctgtctcctcaggaaattactttctctcatgaactctctttttatttcaattgatttataaaagtgctttactaaatgacaagtgttctctccccgtaagtttctcttaaaagatcacagaattattttttcttgtagctgcaagttaatataagttaatacatgaaaataaacatgaataatgaaatgagaataggtaacatatattgaactcttaaaaatatgccagtcaaatttaaaattacatcacataaattatacatacccaatgatgtagatattgtgctgatattttcatcccgtacattattttttaattcactgaaattaaaattgcaaaagcaattatggttcagcaaaactgtatgaactttgggaaatgatatttttctaaaaggggcacatctaactttaagtgtgaaatatattggaagtatccaaagcatacagagtgtatgtgggaatttgtgaagaagggagaagaattttaagtacaaagacgttaaaacagcgtggttgatatggagaggcataaggatctcaaaattgatagcgtattacttgccataataaatgggtatgaggttgtgaagagtatagtttgaagaagcagtcataagctagagcataatagaattccttaggagaaaacactaaggatattgatatctattttaaactctttagaagctgatgagatttatgctatgtacaaagtagtagattattttcataaatctacttttaaagtgtggaaaaacttagaagaaaagcaaggtgacactacagaataccatcaaagatgatggtatcaaagaagaatatgcaaaactattataataggttagcaaatgcacaaaacccagaatatatatttgtacttagtaccagttattttatatcaatgttcctgaattacataaatatttacattattcttgaagttaaaggcaatctaccactaaatcaggacatacaaagccatttacaccattttatactttattactggattttgcaggtggtaatttggattttcaaaagttgaaaatgttgagtagatattttatgttttatttctgtgaaatgcagtaagaaatattactttactttgcagataataccaacagaaatgataagagttcgttttaaatcacaaaaatgttagaatatttgcttgtaatttcagaagagaagtcactgacaaaatatgaatgtgaaaatcatgttttcaacattttttctgcaaggtatatactaatcttcaagttctgctcatatggaattgttgctttttaaataagagtttgaatcaaacacacttacatataatcaataattatattttcataatcaaatttcaaaaatatttagtctatattctgtatattttcttagggatttaaaaagttatttaaaaagtattatttttcacagcttcttttataagagcatgtcatgtaacttttaagtttcaaaaatgaagtatacttaataaaactgaaatgaaactaataaaaaaatataacaactctttcacaatttatatatatatatatatatatatatatatatatatatatatatatgacattttgattatgaacatgattgctttgccatggaattgtttatattctagaggagtgattcttatctggcatatcatggcacccctcagagacacagctgccacttgacacatcataaacttgtatgggatccaaataaaatttaaaatcatgcaaacaaatgttatgaactagacaaattagcagaggaaactttcaaattccatttgggcataaaacaaacttcacataatattattcaacatagtaactcaacaggcaagtgctagcactactagtgatgctatgtacattttacaatattagcatagctatattgctttaggagaaaatgaacttgaaagattgacaaaattattttaaaatttataaactattcattttgtgtaatgattccctcaattcagtagcctcttttagcgacaatctgactctttttttccttaattgtttcaatgagttcaaagaagtagtaaatattgatgaaagttgagaatacagaagggcagagatttaagtggcaatgtttcagaaactgatttgaggtgaacagattgtccagcctgggctcaagcagagagcacatctgaatgccacagtttctcatggcgagttttgattaattaatcttaatttagtgcttagaggtctttgaatatttaatgctggtcctgactcaggagtgttgaaaccttataaacaatcatccatcaggatgtgatgtgatagttattttgtggcctgatattcattttcaacttctactcatctatatgcaacagagataatgtcaacaactgatatttattccaaaacagcatcaagaaaaacattcatcaaaatacagagttgagctagtactctgctgttgaaagggttaatgaaaaacaatcttgaattaaacaaattaaacacactcctgacttgtttatttattttactttattattaattaatccttggtgttcttttggacccagcctaatgtagtacttacaagcatcatttattattctaagtgtgatacatacatatatatttaccttagttgtataacaggtactataattatcctcagtttagacacgaagtgggaaaatgtatgtaaatagcctgatgcattaacaatccaaaagggtgaggctgaagtttaaacctaaacattctggtactaaagcaccatattgtgtttatgcgtatatatgcacacaatgacacgcacacaatgacacacacacacacacacacacacatataaaatacactacatacacatataaatatttacactatatgtgtaaaatagtctgtgtatatgtctacatgtatatatctgagcataacactaggttgggttaatttcctccccctttttaacctatgactgttagttaaatattaatctctcctatagagatagattgtaatacccattacaatttaaaacactccaaaatatttagcatatatatgttctcttgtagttttatgatttatttgaatatcatgtgtattagtatgcacaataaggtttcaaccactgctttatacctacagaagactaaaatcataaaaattttctttttaaaacatttaaaatatactctgtaaagccaatgattgtattatctaaatgggctatcatcatatagaagaattttaatgacttatgtgtagctatatgaatatattttagagctttatcgattacgcttggtatgttgcttgcattttgcctactttattaaaaccaatattactgttaagacagagtttcctagacttactgcattatgaccctttgaaaattacaatcttttgcaggaaattgattgcagctaaaaattaaatatgtgcttaaatagcaggaatattataaacaaaattattattagaactgataaatacatttaatgtgtatgctttaaaaattttctaatcattaagatattgaaatcaaatgttctttatgtattaaagtaacgaaatcacaataaattcaatactttaaccttaatacttttgttataaaatatgacatacacaccaacatttttaatgaaagcagtttttactctttagtatgaatctacttattatattgtataagtatgagaaattgtagtatatcatatcacttgtagcaacaattattttccaatgctcagctttcatcccagcataaaatgaaaaaaaaaaaattttgaacatgcaacttgaagccatttcttcttttacagaatttgagtatttccactttttatgtttaatgaaattttatcatgtgaagtttatcaataacattgtcttataagtaagaaatgtgcatttttcttataaatttacactttttaatgtataaattaaataattaaagctctttttcttcaggtatatgttatgcattgatccatggaaagaaactgagaaataagtgaatgtgggataatctagaaagagtttttatttaagtggaaaagatatatattcctgatttaaaagtagggatagtcttatgagattttaatttggataaattttgtagatgaccagaaaattatttaaaacaaaggtagaactgtgccatattttacactcatttgtctattatattgatgtaacctggagcaaaggcctaattagtattgactttaggtcacatccatagcactgcaggttgccgtggcaatagtaatctacctgacattactgacattataatgagcataaaaatgatgtaaatcataattaaagtgaatattaattacttatcttgatcttgggggacagtctgggaatgcattttaaagtgtttataatgaaaaatagctataaagtcatgctgtaggaaatgcaggtagtttacaaggtttaatctctgactgtatgctcaagacagattgagcttctattatggacgtgaatttgttttgacatctgactttgtttgaaggcactgtaggtaataaaatgtgttgttgtttaatctattcttctgtcactcatttctccacggaagggccatcagtcaggaaaatagttaacttgtcaacctgtggacattttcctgagataggactggttgtaccagccaacttcatgaattgtgcatttcacactaagagtatggtttgagtctgaccacatgagatatatatcatttattaaattggttcatgttttatgatgacaaaaaataaaatatatgtaaagctgtttctctgaggggtgtcatgatacagcagatataaaccattgtttatgaaccttttatacagtttaattatatctgttttttatgcctttggaacttttaaatattaaaatcacagttcttttcatgtttacctttatattagtggtgaaaactaaggatttaaaaattatttaaaagcataatgactcaaataatcaagcattgtatcaacatatgaattcatgtgatacagatttttattttgagaagaatgcatttaaataatagcagccatggaattacagttttctttaattgttttgtgtcatatgacattcaataatgtagtatgatgtattatcatataaattatgcaaagcttagtagccaagagaaaccatttaattttgctctggaatttgtggaacagtgtttcaggagttgagttgggcccttcatctgcaaacatgattcacttgctgccatttagctggtcactcaccttgactgggaaattcaagacagcttaacttattagcctctcacttgtgctaggaatgactgagacaatggaggttggacaaaatctctctttccctttacatgttctttctgtatgacaaattttggcttcctcatggaataggctttctcagggtatttacacttcttatatggcagtttaaaatgttccaagagatctacatgaaatctgcaacagttcatgtagcctaaattcaggctgcattcttccatttttacgacattcctttggcaacataaggatagtctaagtgaatatgaaaagatgtggttcattggggaccattatagactgtctatctcagtcggccttctcagccccagagatttttatcccttccatgtgcaaagtacactcatcccttacagaaacccccaaaagtctcatttcattataatagcatctcaaatgttatggagctcctggtcttgttaatgtgcacataagtttccttggatataatttcttaatcacaatttctacaaatctcatattttgcaaacttaacaacagattatctttgactgaaagattcaatatacaatgttgagatagagacaatatataacaccatactagtctgttttcatgctgctgataaagacatacctgagattgggcaatttacaaaagaaaggggtttactggacttacagttccacttggctagggagacctcacaatcatggcagaaggcaaggaggagcaagtcacatcttacgtggatggtggcaggcaaagagagagtgcttgtgcagggaaactcccttatattaccatcagatctcatgagacttattcactctcacaagaagagcccgggaaagacctgcccccatgattcaattacctctcactgtgttccttcccataacacatgggaagtccagatgagatttgggtggggacacagtcaaaacatatcattcctcccctggcccgttccaaatctcatatcttcacatctcaaaaccagtcatgccttcccaacagtcccccaaagtcccaactcatttctgaattaactcaaaagttcacagtccaaagtctcatccgagacaaagcaagtcccttccacttatgagcctgtaaaatcaaaagcaagttagttactttctagatacaatgggggtacaggcattgggtaaatacagccattccaaaagagagacattagccaaaacaaaggggctacaggccccgtgccagtctgaaatccagcagggcagtcaagtcttaaagctccaaaatgatctccttcgacgccatgtctcacatccaggtcatgctgatgcaagaggtggcttcgcatagccttgggcagctcctccctctgccttttcagggtacggtctccctcctggctgccttcacaggctgatattgagagtctgtggcttttccaggtgaatggtgcaagctgttagtggatgtaccattctggattctggaggctagtggccctcttctcacagctccaccaggtagttccccaatagggaccctgtgtggggtcttccactccatgtttcccttcagcactgacctagcagaggtttttcatgaggaccccactcctgaagcaaacttctgcataggcatccaggtgtttccatacatcctctgaaatctaggcggaggtacccaaacctcaatccttgatgtctgtgcactcgtaggctcaacaccatgtggaagctgccaaggtttgggggcttgcactctctgaagccacagcctgagctctacattggcccttttcaggcatggctggagatgctgggacacagggcaccaaacccctaagctgcacacagcacagagaccctgggcccagctcacaaaaccacattttcctcctagacctccaggcctagtgatgggagaggctaccttgaggacttctgatgtgtcctggagacattttctccattgtcgtggggattaacatctggcttctcattacttatgcaaatttctgcattctgcttgaattccttctcagaaaataagattttcttctctatcgcactgtcaggcagcaaattcctgaacttttatgctttgtttcccctttaaagctgaatgcctttaacagcacgcaagtcacatcatgaatgctttgctgcttagaaatttcttctgccagatactctaaatcatgtctctcaagtccaaagttccacaaatctctagggcagcggcaaaattcctcccagtctctttgctaaaacataacaagagccatctttgccccagttcccagcaagttcctcatttccatctgagaccacctcaacctggacttcagtgttcatatcactatcagcagtttgggtaaagccattcaacaagtctctaggaagttctaaactttcccacattttcctatcttcttttgagccctccaaagtatttcaaccgctgcctattacccaattccaaagtcatttccatgttttcaggtatatttcttagcagtgtgccactctactggtaccaatttattgtagtagttaattttcaggctgctaataaacacctacccaagactgggcaatttacagaagaaagaggtttattggacttacagttccacgtggctagggagacctcacagtcatggtggaaggtaaggaggagcaagtcacatcttatgtggatggcagaaggcaaatagagagcttgtgcagggaaactcccccttatattaccatcagatctcatgagacttattcattctcacaagaacagcacaggaaagacctgccactatgacttgattacctcccactgggttcctcccacaatacgtggcaattgaagatgagatttgtgtggggacacagccaaaccatatcaaacaatagacactctcagtcaaaaagtggaactgaggttgtgaaggaaggtacacagaagtgaatccagctgagaatatgatcagtgactagtgcccagtcatgcttccttggtgtaaattgtgtggctattggacctactgtctgctgtatttcaatagagtactattctagtattctaactttttaataaaaaatgttttcaaataacttcttcagtttgttattccctacagaaatttggatatccaaaggcctcttttcatttcatattttgagttgaacaagtatacctactttaaaaatattttgggtttctatgtactcaattataattcattttattattaatttttacattacttaacaagaccaattatctttacatgaagctgagaggcagggtgctattttacaatgcccttaagagatttaaaagccatattggataggcccatgaattcttctggggtctgcacaaaggctcttacagccacacagctgacattttagccctgaggctatgtttactggtgtccccttggacttgatctccacctttattccatttcttagtttaaaagtcttttgcaacaaaaaaatggatatgagaaccagtcgcatttgtaaaaccagcaagtcttgctggtgtattttctctaatattttttcaaaaattaaaccaatacttatttaattcattctttctcatattttatcattagaagctagaagactaggggacttctttgataatgcctgaaatatcccctgtgagatacaaacatttatgagatcattttttctattttccatgttatacagcaaacagcaaatagttttgacaaacttctgctagtacattagaatgtttctgttttcttcagactccaagaccatttttctcactctccttcaagccttcaacaacagccttactgaggcccctacaactgttgtgaacattctctttcaggaccttttagtttccacctgccaccattataaaaagtgttatatctttttggcatttttataacactccagttctgttaccaatttctgctccttatttattgtggtgtaacaaactgatctgaaatttagtagtttaaaaatattatgtcaagaattttagtaaagctcagttgagcaattacttggatccatatcacattaaatttggcgatattcagccaataagtgtgctggtatagaggagccaaggcagctcagtttccatgcccggcatctgaattgggatgattagtaaaaccagcagtaggctagcattggtgtatctcaatgtagcttttccatataataagcttaggcttctaaaatggagtggccatccagcgtggaatgtagccacattacagcttaagatgtagcaaaacaacacgagacaaaacaaaaataacacacacacacacaaaaggaaaaacagaaagagggaaaaatataaataactgacttttctcttcatttttattttcttctggtgtttgcccttggttcaatctaagtaaaagcaaaagtaagtaaaagtcacagagcaagcatgcctagttaatgcagtctatatggatcaaaagggtagtttatctagagtgttatgtagaagaaaaacagaacaattcattagcttttttgttcaacaattagtctcttccataagttgaagaaagttttattcccattaccatgaatataaaaaattactactagcttctgtatcattggacaggtgaaaattcaattttcatctctagtactagagtttatggtgttgggaaaaatgttttcagcagtgaaggtacatgtttatccacataatgtaagtacctgctagaagacacattgctgccccttccatgaaagcatgatacaatgtgattcttctcatagggctccacaatggcctctgctgtggacaagctgggctctaaaaatggaggtggaaccaataaataataaccttccaaatcagaaagcaccgggctcagatgggtttattggtaatgctaccatacacttaaagaagaaatgataccactttttttcagtctctttcagaagacagaagcagagagatactgcctagcttattttatgtggccagtgacactctaatatccaaaccagacagacgttataagaaaataaaacgattgatcaaaataactcatgaagatagatacaaaacttattaacaaaatattagcaaattgaattcaactaatataaaaagaattagataccatgaccaagtgagatttgtttatgcagagctagttcaacatttgaaaattaaacacatcaacaggccaaacaagacaaatcacatgattataattgatagagttcaataacaattcatgataaaatctctcagtaaactaggaatagaggggaacttcctcaacattgtaaagaatatttataaaaccctacatataatatacttaatggttagacacgaaaaacattcccagtaagttcaataattctttataatcttgtactggcagtcttagctaatccaataaggcaagaaaataaaataaaaggtgtaaagattgggaaaaaataaacaagactgcctttgttcataggtgacatgattgtttatacagaaaactaaaatgaatgaacaaaatacttctagaatagaaaagtcatcactgtatggttgcaggatatattaagacacaaaagtcaatatatgtcctatatgccagcaatgaacaagcgaaaactaaaagtaaagacactataacattgatattaacaccctaaaatatgaaatgcttacacacaaatctaacaaaatatgtacaagatttatatgaggaaaatacaaaactctcatgaaagacataaaagtggaattaaatggagaaaactctacattcatggatgagaagacatgatattttcaaaatgtcatttttgcccccaaattgatctacaggctcaatgcaatgccaataaaaattcaagcatgtatattttggatttcaacagattgattctaaaatttttatggtgatgaaaaattcctatgataaccaaaacagtattgaagaagaacaaggttagaggactaaaactctctgacttcaagattgactataaagctacagtaattaagaaagtgaggtataggtgtaaaataggcaaatagatcactggaagaagataaagagtgcagaaatagacccacataaatatagtcatcttatcttcgacaaaggagaaaagacaatataatggagaaaagatagtcttttcaaaattcatggtagaaattccattactgtgtatatacctaaaggaatatacatcattctattatgaagatacatgcatgcatatgttcttttcagccctattcacaatagcaaagacttggaatcaacccaaatgcccatcagtgatagactggataaagaaaatgtggtacatatacaccgtaaaatactatgcacccataaaaaggaacaagataatatcctttgcagggacatggatggagcttcaagccgttatcctcagcaaattaacgcaggaacagagacccaaaaacagcatgttctcacttataagtggaagttgaaggatgagaatacatggacacatggtggggaacaacacacactgtggtctataggtgggagctgggggaggaagagcctcaggaagaatagctaatggatgccgaacttaatacctaggtgatgggcttatctgtgcagcaaaaaccaccatggcacatgtttacctatgtaacaaacctacacatgtaccccagaacttaaaataaaagttgaagaaagagagagaaaaaaaaagaaaaattcatgctagaacaactggacgtccagttgtaaacaaatgaatctagacacagaccttacatgtttcatgcaattaactcaaaatttctcacagacctgcatgtaaaacataaaattatataatacttagaggacaacataggagaaaatctagttaacttgcgtttttcaatgacttcttaggtgcaacaccaaagtgcgatccatgaagtaacaaattgatgagttaaacattgaagcaacaaataaaaatgtctgcattgtgaaagacattgtccagaaaataaaaagacacaccatacactgggagaaatatttgtgaaagatacagtagagaaagagctgttatccaaaatataaaaagaacacttaaaactcagtaataaaaatatgaaaaaacatgaccaaatgtagaccaaataccttaacagatttctcaccaaaggagatatacagatgggaagtaagcatgtgaaaagattccgtacatcatgtatcatcacgaaaatgcagattaaaatgagataccactacctaccagttagagtggccaaaatctaggacaagcaaaacaccaccaaatgtcaagctgacaacaatagatgctggtgacaatgtggagcaacaggaactcattcattgctggagggaatacaaaatggcacagctactttggaatatagctttgcggtttcttacaaaattgaacatactcttactgtattatctagtaatcacctttcttaaaattacccgaagaaactgaaaacaccaaagcctacacacagatattcatagcagctttttttttcataactgccaaaatttagaagttaccaagatttccttcaataagtgaatgggctaataaactgtgatacatatagatgacagaatattatccaacattaaaaataaatgagctatcatgccatgaaaataaatgaaggaaacttaaatgcatgttattaaataaaagaagtcaatctgaaaaggctacaaactgtagaatttcaagtaattttatagaacactctagaaaagaaaaaaacatggagacaataaaatgattggtggttgctaggagttgggttgagggaggaatgactaggcagagcacggaggatttttaggacacggaaaatacactgaaatgacactataatggcagatatgtgaataaacatttattcaaacccacagaacatacaaccccaagggtgaaccataatataaactagggactccaggtgatactgatgtgtcaatgtaggttcagcagttgtggtaaatatattactctggtggagcatattgataatgggagaggctatgcatgggtggaggcagaaagtatatgggaaatctttgtaccttccactcattttgctgagaacctgaaacttctctgaataatagtgtattttttaaaaagtagaggaggtaaacttatcgatgaccagcattaagccatgttgtttgagaatttttacttcccattaccatactttttgattcaacatgtatgcaaactctggcatccaaaaaggtatacttaactcagtgaacacagctatggttttcctaaagtgacctggccctaggaaaatttaggttactcaggttggtgaactgaaggcttaaagaggaggttattactagctggggtcagtgtttcttatatatggcataaatttgggtttgcttgctatgctgtggtggcatacaagactatatctattacatttttaagttaatgaagcctttttagttgtacatctatgaatatattgtatttgtgcctgttagataaacttgaataaatgaagaaagatgacatttacagcaagatgtgtcttatcaatctgtttgttgggatgcatttgtgtaaagaatgtcttctaataagcatatctataagaatatattttctgtttatttcaagagatatatccataaaatcttctctggatatcctagtcaccaatcctttaatcttgaattctcaaacctcaaccagccagtgaatccattagcactgtccagaagtcactacccaagacttgtgcctccagtcacaaattcttcctaaccatggaaatcatatattttgctcaaagttctgcccactgtgaagttcactgtttaacattggttttcaaaacaaaccctgtgtaaggctgtttttcagcagccatttaattctggatgatgccagtttaacatacagactcagctgcaaaccagggccatatatttttttttcttctgttgacagtcatagtggacaccccatgaagtcatatcagtgttgtgaaggaaatgtgatagaacagtatgagtaggtattatggtagactgagccacctgttcatgtaatttatttgcatcttctcaggcttgtctggatctagtttgtatatgccatttctatttaaagatggaatgctgctgtgcatgcatcagataatactcaatctatgattagtagctaagttcagagacattttttccatggccagacattcatgattcttcaaatagtcactatgtatcttgaaataattctattcaacatcatgagacatgaccaattactaagtcataagaaaattacctgcatatatcattttcacatccaaactctgtctactgcaatcacatagctacaggttggacttcgctaaacccacagttatgttcccatgtagatttcactacaatcaagttcctgtaaatttaatttaagaaacaaagacgacaaagccaatattatccctgctttataaatgactttttctaatatgccagctccagtttaaagtcaatatcttaaaggtctctctggtgatctttttttttttttaattttttgttatttagccctatgtaatgtagactccaaagtaagggctaagaaaagaaataaataaataaaaaccatcacagttgatagaacattgacaaatcataaaggcagatagataataatagattacagacagatcaatctgtactttatcactcttcccaaatattacattttttacaaattgaagatttgtggaaaccctgaattgaacagtctattggtgtcatttttccaacagcaggtactcattttatttttctgtgtcatattttgctaattctcacaaaataactctttgattgtattatgtctgttatgatgttctcacttgtaggtgggtgctaaaccactagaacacatggacacaaattggggagcaacagacagcagggcctacttgaaggtgaaaaacgggagaagggagaggataaaaaaaactacctattggatatgatgcttattagccaggtgatgaaataatctgtataccaaatccccatgataggcaatttacctacataatagaccttcatatgtacccctgaaactaaaataaaagttaaaaaaaggccatgtccccctattcattgaaatattgacttattttttggcaaaatatattgtcctgctgagctactgaacaaaggaaagcatcatatataatattatatggtgtttggtgatgtatgaatatctgctacaacaaaaactgttttgtcatatacatataatgaacattatttgtttatcatttattaaagattacatttattttttcattaattatcattttagtacttttttcattctctttatttagccttttataaattttccctgaatcaaattattatagcactctaaagaaagtttttccaaattatttttggtggattttctatttccttatttttctgagtcacctagaacattttcataagttttactttttgtgttgtgttttgctttatttcttttggcttcacttaatgagacaacatgcccattacaataaaaggcctctgagggagggaaaatgtgaattatcacaaaattctgcttttcttatttggcacatatttataattagatttaaacggctagcctggaataagagttgaggtgggactgagttttacttaacagaaaaaaaaaatttagatttcttcattcaccaacaaaaacatagttgtgggctctcaattccatagtgtctgtggcagaatctagagttctgcctattattatggcatagttttcataacattttaaaatataatgcagaataaacactcttgatattatactaatatatagccatttcttatgtttttttttttttgcttttctagaacatttttggatatttcagttatattattaaacaatataaggggaaaagttctgacccactgtggtgctatattttttattaatacgataaatatttattgagtaacttcagtgtgtcacacacaatgcgctgagtagagtatatgatgaaaacagaaacatatgcattcttgcctttataggatatattgccctaattttcaaattagttaaataatattgcccagcatttatgatttttcattcttccaaaaattctaacgttgtttttatatttttatgcttttcttaaatatttggattactagtaattacacttacaataatcttccaatttaacattgctatgtgctaagagctaaataaataattttgtagtataattcttataaatatatttcttagtatatattttcagtctttaaagtatatactcatagatttcataccagagttgcaggaatgttttaataccatacatagaataggatattattcatttctggaacagtttatgataaacatgtaatccccttgtattctgaattaatcagtgcaattatatctagttggtttaaaatgcaatcctcaaattccttcgatttaacagataaagtgttttttttttttctcatttgaagactgatgtggatgttcttaactgagctcctgtgtttggtggccatccttatagttctgcctgcctgccatacatacgtagaaaaaaaatatgaaaaccttagggaactgtttatgcctcagaggtccacttcacttctgttcccagttcactgatacattagaactgaatgggaccataccgaggctcaagtcaataaatgtgatacaccacataaaaaatttaaaacaaaaatcacacgattatctcaatagctgcagaaaaagcatttgaaaacatccagtatccctttgtgactaaaaccctcagcaaaactggcatacaaaggacataccataaggtaataaaagccacctatgacaaacccacagtcaacataatactgaatgggaaaacactgaaagcattcctgctgagaactgtaacaagatgaggatgcccactctcaccacttctactcaacatagtagtggaagtcctagcagaagcaaccagaccagaaaaagagataaagggcatccgaattggtaaagaggaagtcaggttgtcactgtttgttgatgatatgatggtacacctagaaaaccctaaagactcctccaaaaaactcctagaactgataaatgaattcagcaatttcaggatacaaaatttatgtacacaaatcagtagagcttttatccatcaacagcgaccaagctgaggaccaaataaaaaacttaaccccttttacaatagctgcaaaaaataaaataaaatacttagggatatacctaaccaagaaggtaaaagacttctacaaggtaaactacaaaacactgctgaaagaaatcataaatgacaaaaacaaatgaaaatacatcccatgctcatggatgggtagaatcaacattgtgaaaaagaccatactgtcaaaatcaatctacaaattcaatgcaattcccatcaaaataccatcattattcttaacagaactagaaaaaaaatccttaaatttatatggaatgaagaaagaacctgcatagccaaagcaaggataagcaaaaataaccaatttagaggcatccatcacattacctgacttcaaactatactataagaccataatcactaaaacaacatggtactggtataaacaaaaaagagaacataattttaacacatacatgtgacaaccagaaagtcagcagttgtcagagactgaagaatatgcaaaatagccttatgatgtgcacttgaacaccacaaattatatttcacagtaaacagaattacatgctaatttttttctaattatctgattgaaactacttttttattttgctctggccaaagacaggataaatcctgaagaaagctgggagatgtgctgatattttgataattaagtatgtggatagagtgggataatagtgtaatactatcagatatttatgttacgaattactgtatgtcattctatgtctcttgcatttgtggaagacagtgtggcaattcctcagggatctagaactagaaataccatttgacccagccatcccattactgggtatatacccaaaggaatataaatcatgctgctataaagacacatgcacatgtatgtttattgaggcactactcacaatagcaaatacttggaaccaacccaaatgtccaacaatgatagactggattaagaaaatgtggtacatatacaccatgcatgtcctttgtagggacatggatgaagctggaaaccatcattctcagcaaactattgcaaggacaaaaatcaaacaccgcaagttctcactcataggtgggaaatgaacaatgagaacacttggacacagggtggggaacatcacacaccggggcctgttgtggggtggggggaggggggagggatagcattaggagatatacctaatgtaaatgacgagttaatgggtgcagcacaccaacatggcacatgtatacatatgtaacgaacctgcacgttgtgcacatgtaccctagaacttaaagtataataaaatatatatatatataaaaaaagaaaactatttttagaagtgtaggaaaaaaattttgtgtcttctttcttgaccttgtgatactattaatatacattttacttttcaatattataaaccctattgtactttttaattttactctgagcattcagttattttttaaaatatctaaactaacagaaaataatctttcatatttactctcgtatgtatcatatgcagtgcttttaattgatttggatagatccacattttactctgctatcacttttttcgactttctgaagaacttcttttaacatttttttcatgtgtttctctttgtgatgaattattttagcttttgttgttctgcagatatttattttgacttcattttgaaaagtacatataaagtcccaggtggatttttttcttccagtatgttaaaggtatacactcttgtcttttcatttatgttgtttccaacaaataaatgtgctgtcaatcttatatttgtttcactgcatgaaacagttgtttgttactctgctgtcaatagtttttctttattactaatttggagcaagttaattggaatgttccttgctgtagatttcttcatgtttctagtatttaagttttattatacatcttgaatacatagtttactacttcccatcaaatttagaaaaatatggcccctgataatttcacatacttttactttaacctatcatcatttctctccctcgggagctcaaattataattaccttgtatttcttaaagttgtcccacggttcagcagtgtttctttcatttgtttttttctcttttctctttgtctttcagttatgataggtttcattttttttacttcaaattcactaatttttccttctgtgatatctaattaactgctgctctcacccagtgtattttttatctcacatattgtgattttcattggtttatgtgtaattatctttttaaaaattatgtattttccatgtctctacttaactttttaaacatatagaatgcagttaaaataactgttttcatgtcattttctgctcattcaaatatctgtgtctggtctgtcaatttccattagctaattttttttctcattatagtttatatttgccttcttttgtcacacctgataatttttgtacttttaaaaatattttttggctattttgtgtgatacagtttagttacttgcaagaagttgtatcttttgggggtcttgcttgtataatttattaggcaggcattgagccatatttattgtaggactaattattcctcactattggatcaagatttttcacacactctccccaaaatcccatgaatctttaggctctctagtggctggtgagaatattcctggtcagcctcaagcactgggcattcttagtcatagtcttttcagatgattctttcagaggtttctgctagtttcctcacatatatgtattactattttcagtacactgctcaatgctcaacaagaacccattaaacaactccaaagttttatctgtagttctttcatctgtatgtatctttttaatgaactctagtctcagtatccctgtagtcttagatctttcttcaagactcagtaagtcagtttattttcttctaggctctttcttcattcaccattgtctgcaaatcttatcaggtcactgatctggtgtaatcataggaataattttttatcatttttttccttttctctgatgtattacttttctttgttgtttaaagttgaatgtcctgaaaactgatttttacatattttgttcattgtatgattgtctgtttttgatgcactatctgtttttgtttgtttttgagatggaatttcactcttgttgcccaggctagagtgcaatggcgcaatctcagctcactgcaacctctgcctcccgggttcaagtgattctcctgcctcagcatcccgattagctgggattacaggcagccaccactatgcccagctaatttttgtatttttagtagagacgcggtttcaccatattggccagggtggtctctaactcctcacctcaggtgatccacctgcctcggcctctcaaagtgctgggtaatatatatataagatttctattttatttcattttaatatttgtaatgactttgtatcacatcttattttatgctctatggattttaaaagtagtataacatggttcctattctttattactttttaagaaaatacactgagcaattttaatattcttttgaggattctcatagaggtatgtacctaatgaaataagaaagtataactgggattcagtgctggtttaattgagtacttggcagatatttagccaatgctgcctagaagagtcgattatggaattacatttgaattgatgatttcgagttctcaatggattaagacacagcatgaaaacatttgactcataggtactatgaacaaatgtgcaaaggtgtgaatagtgtgtttgcaaaaccgcaaacagattgctgtttctggattatagagtcatgaaatgttaattcagtattgaaatgtgaggctgaggtagcagaccattgccagatcaaaaacgagcttgcataatagccaacatacctgaccacgatccaatgattacattatgacttgagtaaaaagataaagaaaagtataatctttaagaaactttattgagcctccaacagaaattagaaaacatagtttgaagactctactatttgtatggttgtgagatttggggtaaaccattaagtcatgatggaaatagcatcacaaaagagacaacaggttgactttcaggatatgggcttttaaggatttacaaagatagggcagtgtcaaaggttttgaggatgattctaaaaaaaactatgaaatgattagccataaatttcagggtaaacaaaaaataaaaataatgctagatcataataaactgcagtacaactaggaaaatacaaaattattttctgtaagtgggatagaaaaactcaaggttttggaagcaaggcacttccgatacagtttgaattacattaaaaaccacaagataaaaaaaaaaaaaacaaaaaaagatgtccatcagttttcctacttataactttctctcctggaaaacagtttaattacctagcatgcaatatttatttgtggggagtaacagtggattaaaactaatttttataaagctttaatgcctaaaataaacctttatgttctggcctttttcaatcctctggttctacatatgatcagcctacaaatgcagaaatgcttaaaactttcatttcctctttcatgccacacactgtgtgatctctgattcttacagcacataatcacacatattgggacattttcctcaactgctttttctttttatggctaactcttgctcatccttcatgtttcagttttaattatacattttacaaaaagtctttgcaccttcctctgccagtctctcagtgacattagtgtgctctctgcatcaccagaaaataccttaacttacattattagtttgctatcactaaagtactatttctatattaaaagtgaatattcagagcaacctttagcataccttctgagaatcaccaatatatgtattaataaactgttcatagatcctaggtgaacagtaattgcttatgacctcataaaaggaatttttgttcaaggaggagctctttcattgaatgtctttatttttgttttccaatatctcttaaaatgcacagaatatcaacagagattagatattatgcacctttaactccttgaaaatagccttctccaaatatgtctatgtaacgtgtgtttactctgctatcagttgcctaggaaaaacttattatatatgtttactggcacagtagcaaattatatatatatatatatatatatatataatttttttttaaatgcctggaattggggacttatacggctcctcaaacaccactctccaacactgctgcctgggagcatctcttacgtgctctccattaccatggtcagcaccaacattctggatccactatttttctatttttatttttcctttcgattctggctcccatccctgtggttatatttactgtggagcatacatctttactgctggcagctgctgcattacgttgttatgttaatgcctacagaactgcagacagtgccaatgcagaaatgtgcagaagctgctcccctgtgcctctgtttctttatggtgtgcgaccatccacagtagtttaattattctccagcagcgaccccaggattctaatgattcacagagatttttagtgcaacatatctttcaggttttcattcactgttatctctcccaaaaattcaaattcatgtctataggagttagaatgaataattaaatgtatccatttgcatagccatttgctcattcagttgacgtacttttattaagttcctgttaggtgcgaggtgcacacccaggcagtgagaacacgatgaagttatcactctctgccaaatcaagtgaacagtccagtttagcagaagagacaaatattcaaaaaaaataaacatagccccaaatatttacagaaaacttattatctgccaggcatttagaatggaataataaataaaattgactaaacccctgacttcttgatttagaagcccatgtcctttacagaggcagttaatatactcaaatagtagtagcaccatattatatgttgaatcacggctagagtgtaacttaaatagaactttctctctaaaaatacagcatttcaacagagatctaaataatgatagaaaaggtattccaggcagaagaccatcaggcaattaaaataaaatatgcaaatccattataattattacattttaagtagctcctctgaaaggtttttttgatcagtgtcatgatttattaaggtattatattctgcttccatgtttgacatttttgttaaaattgttatcctacatttttgcctcttcctttccctgttaaagttaaaactacattctggattaacctggacagcagaaagcaagtaattttaatttatcaattttctcaatttaaaataccaagttagttactagttaccaaatgttggttcaaatgctttcagtctattcttttcaaaaatcattaattctttggttgaagtcgataggcataggcaagctaaacattcacattgattaatcatcaactatttaagcgattcaatcaaggaagtaaaggataatcattctgggcatttgtaatagttaattagattcttttaaggccaagacattccaatttaactcttcatgaatggtttactttgaaaaactgatcatgattgcatgtgattattacagtaaagagatatgacacaagaggcaaattgacacaaatgtgttacggtttatatatatcatactaataagatgaacttcctagtttacacagaaccaagtaaactattcttgttttcttttcaatgcaatatacaggacccttcagtttacaaattaataatgaatattttttattaataagtattttgaatatatatatatacacctactacattttatttatctttggaagtttaatattatatataaattaatgccaatgaaaaggtttttttttaatttaagcgttaggtaattgagttgttcattaaaattaagtagtaaatatttctatgcattttgagctgcctatgtttttagtgagcaagttgaacactactttaggctatggcttgtgacatccccttttttttatatttaataataatgtgggttttgagtgggtttccaaaacccactcaaacactgtatatcctgaagtttgaaatgctattccttgggcactgaattctaggcatatttagggtcattttaggcagatggcaaatgcatgaagttagctccaactctgactcaggaattttgttgaacaaaaataaaatcagtgagtaagtcctcacagaatttcaagtaacataatctcatatataatttccaatgttggcattatttcaaaatcatagattgcatttgttatctattactatgctgcaaatcatcccaaaatacaacagcataaaacaaaaacatttatccttccatttctgtcatcagaaacctgaaatctcctcttggtcctgtggcacaggatttctctcaatgcggcaaaatcatgttgatgagtgaagctgaattatctcaagattgatcagctgttgcaacagaaagggataacccttgttactttctttctctttgtcttctttctgcataatgcctaacatggcgatatagtgaaagtgagtggcttttgcccagaggactaaaagatggaatgtttggaaaccgaaaaatttctgaaaaatcacagagaggaaagagacttttgaagcaggtgaaaggctttgaactcctgggcacaacttcatactgtgtatgcatgcatctgatttgagttagcaaatgtaagactttgtaaattgaaaaaaaaagtgtagatatccatcaacatctcagatggatcaccgtgtgttgttagcaccaaacaaaactaaatagctctttcgcatctttaaaaaattaaccttggaaccatagactacaaaaggtaggttataaagtgcagccccaaattgattgcctactaaggtaaaatatcagtattatatatcacgtttagtaaaataactaaagtcttcacctctgggtgaaggatacaatccaaaatagaagaacgtaaaaggaatcatgacaatttcaacttgaatttgaaaagaaaatcagtgaatatcagtatgatgaattaaaaaatggaaataattcattaaagaatataaagcagcttacaaaaatgctcaaatatacaaatatgaacactcgacataaatagaaaatatgaattctctataaataaaataataaaaatcaaaagctgtagtattaaaaagatataaaaactaaaatatatatctaaaaacacttaccagatggactcaatagcagaaacaaggggaagctatgtcagcaagatgagagaataaaaagtcccagcccaggttccttcacagacaaagtaaattaacaaaaatgtacagaccaaaaaaatctttatgggaattctaggaaccagttaagaatttgcagtatgccaggcaaatacaaagctcagaatagctgcattgaaataggtgagaagagttgtttaattttatctacaatattaccccttccacaagcccacacagctcagctcagtttgtaccttctggactagtgggtggagaatagtgaaatatgcattcaatgttgtagcttttatacagggctaccctgaggaacagggttctgtttgcctgactcaaagcactaatggaaccaacatagtttgaatgtctccaggctgctgaaagcaaaggtgggcaagggtggcttgttgcagcatcagacggtctacagatacagtgctacggatcagaaggtctacagatacatgtctacatatacagtgttacagatacggtatagctcagcacaacctaagggagtcgtggcctctctcacagaatggagggaggaaaatgaagcatgcatctagaattttgggttttctgatagcttctcaaggaactgaaatgtgtgttgcctgatttaggaaaatgatggagaacttgcataatttataagcctcagagtcactgagaagaaaggagagaggtatgccttacactgtagcaccagagagcctgacgtaccaccgacaggcaccagagggtgaaaaaaatttgtgagttcctgaaaaggaaaccagcaaacctctctaactgagaaattacacattaaatcccagagaatttgtatccccccaaaaggttgtactgcctccccaaatattattcaagctgattactgaaggtcttccctgcataaagcccttagtctataaagactggcagaggtggcagttgttttcaaacacataaaactcagcaaataaataagtaaagattcagaagacacacaggagaaaagagaaacacagcccaatcaaagaaataaaataaatctccaacaatgaaccccaacaaaacagagaacaactgattgtgttacatagaattcaaaataataatcttaaagaaggtccatgatctacaaaagaacagatagaaaattaaataaaatgaggaaaataatacataaataaaaagagcatagaaaagaaaaaagagataaaagaaagaaaatatataaaaaaggaatttatctagctaaataatagaagttgactacatggctacagatgtagacttgagtaaacagaagaaatagttttctagtttcagtaaactagaaaacaggtcattagacattaccaaatcagaagagaaaaaataaagtgaagcatgcctaaaacatatacgacaccaccaagctgaccaatatatgcattataggacatccagtagaagaaaagagaaaggggaagagagcttatttgaagaaataatgaccaaaaactccccctaactgaggaagaaaatgaacatccaaattcaggaaactcaaattactccaattaggatgaacataaaaaggaccacattgagacatgttataatcaacctattgaaataaaagacaaaggatcttgaaagcagcaaagaaaaacaacttgtcatgtacaagggaacttatattatcagtggacttttagaagaaaccttacatgtcaaaagagaatggaatgatttatttaaaataatgaaaatatacattgccaattatcctgtcagtcaaaacaaaagaatgctatatagcaaacaaaacatacaacaatataaagtttgctggtaaaggtaaatgtatagatacgtaggcaatattgaaatggtgatgtataaagcacttttaattctagaacagaatgtaaaagaaaatagtataccaataactataactataaaatgatgttaatggatacataatacaccaagatgtaatttgtgacatcaataacacaaagtgagggtggggagatgtaaaaaagtagagttactgtctacaataaaagctaatgtgttattaactgaaaatagatcatcataactatgaatgtttgatataagcaacctgttaatcataaagaaaataccgatgtgagatacacaaaataaagtgagaaaaaaaataactaagagagatggaggccgggctcagtggctcactcctgtaattcccactttgggaggccgaggcagggtgatcatgaggtcaagagatcgagaccatcctggccaacatggtgaaaccccatttctactattaatacaaaaaattagccgggtgtggtggtgcacacctataatctcagctactcaggaagctgaggcaggagaatctcttgaacccaggaggcagaggttgcagtgagctgagatcgtgccattgtactccagcttgggcaacaagagtgaaactccatctcaaaataataataataataataaagtaacttattactaagtattatttaattctacaacattttatttttaaaataatttaagaattttgctaaagtaactactttaattttaaatatcttaagcttcctaatcaagagacataaagtggctgtatagatttaaagatatatagaaccaaatgctttttacaaaagacttgccttagttgccaaggcacacagaaacctaaagtaaaagaatgagaaatattttccacaagagagcagcagtggatataggtacagataaaatagactttaagacaaaaactgtcacaagaggcaatgaagaatattatgtaatgataaaaaggtcaatttacaggaagatacaataattttaagacaaaaactgtcacaagatgcaatgaagaatattatataatgataaaaaggtcaatttacaggaagatacaataattttaagtatatatgcatttaatatgagagcaccaaatatatgaaatgaacatagaattaaaggggaaaataaacagtaacacaataatagtagaaaagctcaatgctttacttccaaaaaaaagacaaaataatgagacagaggatcagtaagaaatagaggacttcaggccaggcaccgtggctcatgcctgtaatcccagcccgttgggaggccaaggcaggtggatcacctgaggtcaggagttcaagaccagcctggccaacacggtgaaactctgtctctactaataatacaaaaattagcagggcatggtggtgggcgcctgtaatcccagctactcgggaggctgaggcaggcgaatcgcttgaacccaggaggcggaggttgcattgagccaagattgcaccactgcactccagcctgggcgacagagcgagactccatcttaaaagaaatagaggacttgaataacactacagaacatttgaaagtaatacacacacacagaataatctatgcaatagcatcagaatacacattattcttaagcacacaaagaacattcgccagaacagatcacattttaggccactaaaactggtatgacaaatttaagaaaactaaaataatacaaatatctttttcaatcacaagagaaaaaaactagaagtcaatagcagtaggaaaattagaaaatttatgtgaatattatgtaacccacttttgaaaaacaaatgaataatggaagaaatcaaatgaaattagaaaatatcttgaaacaaatgaaaatggaatcacagcacatcaaaactcatgcaatgacgcaaaatcagaactataagggaaatacacaatactagtcaccttcatttaaaaaagaagaaatatctcatatcatagaaaagatcaacagggcccagtccagtggctcacgtctataatcccagcactttgagaggctgagcagggtggatcatttgaggttaggagttcgagactatcctagcgaacacagtgaaccctatctctaataaaaatacacacaagcacacaaaaatagcctggtgcggtgtcctgtatacccagctactctggaggctgtaggcaggagaatcacttgaacccgggagacagatgttgcagtgagatgagattgtgccactgcactccagcccggatgacagagtgagagtccacctcaaaaaaaaaaaaaaaaaaaaatcaaaatttttagtgaaaagatcaaaatggatgatcttaagcaagattacctacagaaataagcgggagaagctcaaataaacaaaatcagaaatgaaagaagaggctgtagccacagatgtaaacatgactataagagaatactgcaaacaattatacgtcaacaaaatgaataacttagaatacatggataaattcttaaaagcatacaaggtaccaaaactgaatcaagaatgaaaatacaaagactgaagaaacagaaaatctgaacagacttacaagacataagggaattaaatcagcaaagaaaaactttccaatgcattaaaaaaatgtcatcaggacaagatgacttcacagataaattttaccagacatttaaagaagagttaatgacaatcctttaagaattatttcaaaaaattgaaggaaagagaatacttccaaactcatattatgaagccaacattattctctggtaccaaagccagacaaagacactacaaggaaagaaaattaaaggccaacattacccaataaacaaatacacgtgatttctcgacaaaagtctagcaaatagaagtcagtagcatattgaaaggatcatatgttatgaccaagacaaatttatcattgggatgcagggatggttcaacatatgaaaatcaatgaatataatacaccacaataagagaataagggataaaaatcacatgattttgtcccctccaaacctcatgttaaaatgtgatccccagtgttgcaggtggggcctactgggtggtgttggggtcatgggggctgatccctcatgaatggctggtgccctttctgcagtaatgagtgaattcttgcagttttcactctactagtttatatgagaactgtttttttaaaaaaagagcatggcatccctacccttttcttgcccctcctctggccatgtgacatgccagctccccttaccttttgccatatgtaaaagcttcctgaggccctcaccagaagccaagcagatgccagtgcaatgcttcttgtacggcctacataaccgtgagccaaataaacctgttttctttataaattactcagtctcacgtattcctttatagcaacacaaaacaaactaatatgcatgataattgcagacaaaataaacatcccttaatgatttaaaaaatacactacaatttagcactagaaggaaactttctcaacataataaaggtcatatatattagaacccacagatagcactgtattaatggggaaaaacaaaagctttccctctaagatcaggaggaaggcaaggttgctaatattcactgcttctatttaatacagtactggaagtcctaatcagagcataggcaagaaaaagaaataaaggaatccaactggaaagaaagaactaaaattttctatgtttatagattatttgatcttatatgtagaaagccccaaaaactccacaaaagaacggttaaatctaataaacaaatttgccaaagttgcaagatgaaaagtcacactcaaggtaggaattggtggctcatgcctgtaatcctagcactttggtaagccaagggagacagatcacttgaggtcaggagttcaagaccagcctgcccaacatggtgaaacctcgtctctctgaaaatacaaaaaaaaattagccaagtgcggtggtgcacacctgtaatcccagctactcaggaggcagagggagattgtttgaaccctggaggcagaggttgcagtgagccaaaattgggccactgtactccagcctgggtgacagagtgagactctgtctgaaaaaaaaaaaatcatattcaaaagtcagtcatatttctatactaacaatgaacaatacaaaaagctatgtaattaagcaattccatttacattagcctcaaaatgaatgaaatacttaagaataaatgtaaggggtgaaagacttgtacactgaaaactataagacatttgttgaagaaatgaaaaaagatacaaataaataaaaaggtatcacatttccatgatttgaaagactcagtattgttaaactgtccatactactccaaataatctatattcaatccaatcccaatcaaaattctagttgcatttttggaaaatacaggaaatatgggatctcaaaggacctcaaatacccaacaccatcttgagaaagacaaaggtctagaagcctcacacctcacactctgattttacagtatattacaaagctatatattacaaatcaaaactgtatggcattggcataaagacagacacaaagacaaatggaatataaataaatctagaaatagaaataggaagtccggaaataagccttcacatgcctggccatatgatctccgacaagactgtcaagactatgcaatgatgaaatgatgcttcaacaaatggtgtttggacagttagaatggctatttgtaaaaagtcaaaaaacaacagatgctggcaagactgcagagaaaaggaaatgcttatacactgttggtgggatgtaaattagttcatcagttgtggaaaacagttcgatttctcaaataccttaacatagagctaccattcaatccagtaatcccttactgtgtatatacccaaagaaaaataaattattctaccaaaaagacacatgcacatgcatgtttattgcagtgctattcactatagcaaagacattggaatcaaggtgggttcccatccacagtggattggataaagaaaatgtggtacctatacaccatggaatactacacagccataaaaaagaacaaaaaatcatgtcctttgtgcaccacggaagcagctggaggccattattttaagtgaattaacagaggaacagaaaaccaaatcccacctattctcacttaaaatagggaactaagcattggacacacatgaaccttggagtctcctagagggtgtagggaaggagtgggtcaagggctgaaaaactacccattgggtactatgctcactatttgggtgatgggatcatttgaaccccaaacctcagcattatgcaatatatttgtgtaacaaacctgcacatgtgcttcctgaatctaaaataaaagttgaaatttaacataaataaattagttaaaaattgcaaagaagaaaatcaataagtatctagtcttataatccatttgttaaatattttaatttaccttttttctttcatagagtgattgtggcaaggttctgaagtctggtctgttttagggtaattttgaacagaatcccagggcttaattttgagaatgctacccaggaaaagaaataggaaacgtatctttctcattacagctgcagaaaaatgaatacattcccattataaagtgtggtagataaactggtaagttgcaaacgttcataaaaatatgtttttcttttttttcagattggagaatttatgacagtggaaaatctgttctgtattttgtcatctgaatgtcagagtttaatgctaaattttatgtcatgagatttggtaactcctagaagtgttcagacataattgtttactaaatgatttgttacactggaaataagaattgaattacatgtcttaagtaaatagatacttttttttttcctgttgaggtaagaaatggaagtgttctacaatttccttccctcttagtaaacataaaaactgaatttgagtggttttacttgattcttcagaccctggatattttctcatttaaaactaagtgggtaaccttgaccagttatcagagacatcagcccaatgactcccagctgaagccaatcttgagcttgcaaaagatcactgaaggcccagttaattctttctggggatgttttctgcaggtttgctagctggctcacaccagccatggcagagcctttgtactgagagaagctatggagccctggaaagttagggaccaacaggcagatatggttggggttagtgtaattgtgaaggtgtgatgctagtattgagagtgtaattgttatcgtcctggggttgtttgtaaacattgtcaaataaaatgaatttgattttagataagaattgactttatctaaaggggtattgcaatagatgggaagcaccaagcaaaatatctgcaagtatttgaaaggttaagaagataaggggttccttttacagggaggagcaaaaaagatttgaaaaaagatgaaagctggagggcagtatggagtgtggcaaaattagatcccagatcagaggatatttcaccctgaagttagcctattcttaggaggaggcataaagataagttgtatgtaagctcagactgagggtgaatcaaagttcaaggcctgtgggaaggagagaatcttaagcaaaatttgtttaacaagtattttgttctgaccactgaagataaaattgttcatttgattgtggaagaaaaaggggaatttgcagagtctgtgtctggctttgtgatagttacaaagtgagcatcatataagtcatataagtcataatggtaagcatgtctctttgcagtaagctgctcttggagagcacaactgaagggggattttctcaatcatggctatttagcagggttacctactcgctccatctttccttgccatttacatctcttcctcttggctgttcctgaattgtatcctttatactaaactggtgaaagtaaagttaaacataaaacaacaacaagtggtgtttgggaaactgaatatccacatgccaaatatggagatgggtcttattttacaacatatatatacattaactcacagatttatgcataaggcctaaaaccataaaactcctagaagaaaacataagagaaaagcttcagggcattagaaggtccaatgaaaccaaaagcacaggtgaaaaagactaaaataaattatactacattaaacttaaaatattttgtgcagcaaaggaaacaataaagtgaaaaggcaaccaacataatctgagaaaatatttgcaaagcatatattagataaagggttaatatccacaatatataaaggacttctacaacctaataataataaaaaaaaactcaattaagaaatgggcaaaatacttgagatttttctccaaagaagctatacaaatggccaaagatgtatgaaaatatgttcaaaatcatattcaaataattgcaaatttagtccacagtgagatatcagcttacatctgttaggatagctgctgtcaaatgacaacaatgacaaacagaaaataataagtcatgagaatctggagaaactgggactcttgcacactgttggtgagattgctaaacaatatagccactatgaataacagcatgaatgttcctcaaaaaataaaaatagaattaccatatgcctcagcagttctaccacttttttcttttttataagatggagtctcgctctgtcacccaggctggagtgcagtggctcactgcaacctccgcctccagggtttaagcaattctcctatctcagcctcccgagtagctgggactacaggcacacaccaccacgcccagctaatttttgtatttttagtagagaggatgtttcaccatactggtcaggctggtctcgaactcctgacctcaggtgatccacctgcctcggcctcccaaagtgctgggattacaggcatgagccactgagcccggcccagtagttccatttctgattatatatccaataaattaaaaatagggtctcaaagagatatttgcacatcaatgtttattgcagcattattcacaatagtcaagaggtggatccaaaataaatgtccatctatgaatgaatgcataaagcaaatgtggtgcatacatacaatggaatataattagcctcacaaaagaaagatatcttggcatatgctacaacatggaagaaccttgagatcacaaaaaaactaataatgaatgattccatttatatgatgtatgtaaggtaatcaaaccagaaaaacagaaaatagaatagaggttgctaggagatggggttggaggaaacagggatttgttcaatgggtacatattttcggtactgcaagataaaaaagttcttgagatctgctatacaacaatttacatataattaacaatgatgtaatatacactttaaattgttaacaggttaaatttatgttatttatataattttaacataaacaatttagaaaaataacagataggaaatggagaacacaataatcagtaaacctgaaaatagattaacaggaattactcatccaaacaacacagagaaaagagatcaaaagaaaagaaatgaatatggtcaaatggagttgtataacaataacatatggtctaacacttgtgtcttggggtcccagatgaggtagaaaaacgtgtattgttgaaatatgtttcaactagtaatattcaaaaacccctcaagtttggcaaaagacataaaattacagattcaggaatcgtggtaaatttcaaaaaaagtacaacccccccaaaaaatacccagacacattataatcaaataaacacaaagcaaaaatcctgaggaagaaaaacaatggaggaaaaataatcctttgcttataggagagcaataatttgggttactgaaattctcgtcagaaatcatggagaataaaaggaagtgccacaatatttttaaagttgctaaaatgaactctggtatttatatatacagaaaacatccgtaaggaactaagatgaaacaaagacattctcagacgaaaaaaaaaaaaaacctctttgaagtaaacgaacttgtgctaaaagaattgctagagaaagttttttagccagaaggaaaatgataccagaatcttagaatttaataagtgaataaatagcaagagaaatgttttgatctttcatattatttccccccaaaaaagctttctcctaaattcctatgttaccactattcaaaattataggacataaaattcatattcatgttcctgtggttgtacaagctggcaagagaaacaaaagtaagagtaagtcgaatggtggatagaaatttcaagagctaagagaaacaattgtaactataaaaagaggtaaaggaatgtagaaggcaacacagaaatgatgcttgattgtgcaaatgtggtggtcctgcccacccttgtggtggctactgggtatctcactctgtccgtcaccccttctaaatggtatgacatgaaactgagagccagtgaagacaccatggccaccctctctcctgactttgccatggactccctgggcctttggtctgtttttcctgagacttgattactttcagtcacaaagatggtggcataatgaacgaatttgccaagttctgggagaagctcaccagtttaggttgttggttcatcattatcaaattccccatgagaacatgctaaccttgtttaagaattatttcagcattaagttccacaaggcataattttccacaggcagtctacctagaaatggatgtgaatcagtgccatggagcaacttccaccaactaaatactagcacccatatatctgtgattatttttccaaaagaaaatgagagtcaaacagtatcaaagagcagatgctatggaattacaatagaaaattaactagcaattagaaaataccaatgaaagcagtgagaaaactaattttcagtgagaaaagaatatataaacataatatattttccccaaaaaagctggctgtgagattctaaatcaaagtaatgggaggatatttgtcaacagttacaaagaggaatgatcttgaaatctgtgatgaacagctgcttattattatgacattaaaacaaccagaaaactttagttcctgagaagtcacagtaatagtcaaggtcacaaatttgtaaacacttctattaacacagatctcgtttttgtttttgtttttgttttctcatttggtgtttagtttgtttaactttgtatctgacggtactggtggttcatatgcagatatatcactccaccttttacctagtttattacaatggaaacgtcttgcggaattatagtgcaatatcacaaccaggataccaacattaatacagtcaagttataggacatttacatcactacaaagatcccgcttgttgcccttttgtagacacaaacaatctccatatgctcccattttcaagcccctggaaaccattaatctgtttttcatttgcgtaagtttttcattctaaagatctaatataagcaatatgtaatattttttagaattaggtttcttatctccgaataatcccctgaaaattcttccaagttgatgtgtatgtcaatacttcattactctttactgctgagtattattccatattaaggatgtatcatagcttgtttcaccaatccatccattgaataaaagatggttgtttctagtttaggtgtattataaataaaactgataggtacattcatgtacagctttttggtttgtattgcttttgtttttgcataaacataatttttatttttgtggaataaatacttaggagtacaatagtttggtcatgtgaaacgtgcatgcttagttttgtaagaaactgccaaattgttttctagagtggctgtgtcattttacattcccaccagctatttatgagtgattcagcttctccacatcctcataaacatttggcatttttttttaaattttaagccattcagataagtgattagtgatatctctttgtggttttaatttgcatctgcctaatgattaatgatagacatttgatgcattacttgacagccatatatccttctgattgaagagactgaaggttaatatgtctcttcaagtcctttgcccattttaaatggacttactagccttttttattatttagttgtaagtattctctatatcttctggatacaattttttatcaaatctataatttgcgaatattttctcccattctgtgaattgtcttttcactttcatgatggtgttctttgaagtacaacggttttaaatttttgaaaccactctaatttatctattgtttttcttccacatttgttcttttggtgttatatctaagaaaacattacctaacctaagttcatgaagatttactcttgtattttattttaagagttgcatagttgagctctaacatttataatttcttttgagttaattttatatataattagaagtaggggttcatcttcattcattcttttacatgtgtatgtgcagttgttctagcaccatttgctgaaaagactattctttccccattcaattgttttggtgcctttgtaaaaaacaagaccataaatgcaaaggttctattttgttgatttatcagtttatctttatgccagtaccacactttttttgttactgtggcatcgtagtaagttttcaaatagggaattatgtgtcctataactgttctttttcaagattttgttggcaatgcatattgttttaaaatattctaaaataaattaaaaagtaaagtaatcaaaaccaaaatttaaaataaaatgaaaacagtttttaaagcataagtcagcttggccacatatataagtaactaacatgtattcttacagtatattcttcatcttgaattctaagaataatattctgtgaaaaaataagaaaatttcttcatttttctcttttagtaatcaatattgctatgttaacttttataaatgtttagggtaggaaatagaaagtatataaatgaaattaggaataaaaatattcagaataaaactataacataaaggtttacatttgaaaaaaaatctgtattggacttggaaaattaaatttttataatcaacttaaaaatatattttctaatcttaggaataaaaatattcagagtaaaactataacataagggtttacatttgaaaaaatctgtattggacttggaaaattaaatttttataatcaactttaaaaatatattttctaatctttaccacagagagaacctagaaaatatgacactcggaagcaataaactacattccacccaggtattaatgtgaataaagaaacagactttggagatttggtaaatactctatgattgcacgggattttattgtgccaaagagcaaggacatctacaataaacaatagggttttccatcgtacaccagatacagctttaagcatgccacaatacttcattttagaaaatataaacataaaactaaatattcattgtccattggattaagagagaaaaaatatttccattattggaaacaccatgacaaaaactactttctatgaaaaaaacaagcagtagatgaaataaagatttaatacaactttctaaaaaaacctgttgttcacatttagtgaattcttaatacaaatttgtcaagtaattcactttttaaaatatggagagtactaagaaaatcatcatcttgctactagtgttgaaatgatagattcagcagaatcatcaatataggctacaatccttggttgaaagagaatgctttactattataaatattactaattgaaaaagggaattatttttatgagcaagagagctgaccatcattactttaacaaagtaattaaaattagtatcactgaaatttagacttcctaatagtgtgtgctgcctaatgagatgcaatattgagtacccagaatcactgtaaagaattcttgcccaaatttttaaacctgagttgaattaaagttaagaagttatcatccactttggatacagaattaaataatatcacagggaaataggaaaatccataatatttgatgcctaaaaggaaacttgcctgtttgctttaaaaatataaagtcactgaaaagaaaaacaaatgtgttaatattatattttaaaagaaataaagagacataacaacaatagccaatgaactattccggattctaaatcctagtttgaaaaaaaaaactgccatgtgtaaaagccaaatgcatgcatttgattataataaatgatattagaaaattgttcttttcctttggtatgaaaatgataaagtggttattgatgtaaggcagcattccacaaactgtggcctggagcaagggaaagcatgctcactaccagttacaaaatttcaggtctcttaaagtaatttctcctgtgatgcaacccactcatgtgcacgtgtcatctgggcacctctctgttgctcccatgagatctgtggacaaggggaagtaacttgtatgtgctgatgtccatgctgctttctgtgccgtgagcaatacttctgtaactcagaagtattgtgtcttctgttaggttccacaaagctgcagcaagctaagaggttaacttgtagtctggtaaaatctcagaaccttcacaaacttgacaatctaatgatcatatgttatttaaaaattactgtatgtttgcagtttctaatagaaagcttcaaaacatttctgtaattttttctcttgctactccgaaaaataaaaagttggggaaatcacatgactaattttgcattccattcaatcacatttgattatgctgattatatggaaaataaaaagactctcacaggcaataataagaatgcaactaggaaagaaggagcgagggcagtaactgtaatctatagacatatagaggggaaaaggcagaataaatgaccagcaacgatttttgagtttaagtacataaaatatttatttttgttgccttttaatatttttctgtaaaattaaggtgtttgtatgtttatttcaaatagagaaagagaagaaatagattaataatgtttattttcctgaccattcactcttactagaattttaaagacaatggtactcagtaacaatgaaagttaccaatttttattgtttctgactttaatttgaataaatgtaatatgtcagctttttaggatagatgttagctatgaaactcagagacagtattttttacatgtaaagaagtttcaattcttccttctcttattagtttcattaatgaatgaatcacagattttacttaaatgattgttagtttttaaaatgcaaggtttttccttgtgcttctccaataaaaaaaattatgtaagatatttaatattggattatttttagtgaaaaaaatacaattttattattgtggtatagtaatctttaaatatattgctaaatttgtctcctaatgtctaacttagaatttttgcatcttattaaaatgatgcattttcaattttttttttcactctgtcacctaggctggagtgcagtggcatgatttcggttcactgcaacctccacctcccagtctcaagtgattctcctgcctcagtttcctgagtagttgagattaccggcacgtgccaccacactctaatttttgtatttttagtagagttggggtttcaccatgatagccaggctggtctcgaacacctgacctcaggtgatttgcctgccttgtcctcccacagtgctgggattacaggtgtgagcccccatgcccagtctcaactttataatgtttttactagttttaatttcaagattgaattaggttttaaaaatacgttggtgacaggaggggctttgagatggcagataagacattttgtactcactccctccactaagaagaaacaaaatagtgagtagataatcacacttcaaatagatcatccaagaaagaacactggaattcaagagaaaagtatcaggaaatacttaaagcaaggatggagaatgaagcagggcagcctgcttggccagggttggctcgaagccgagatagactccttaatatggtaaaagtataagtgacattatacttagtgttccacattctttccacggactcctgtaatcctagccatggaagaaccccttgaccctcctgggctctgaaactaacataggaaactgccaggagatggtttgatggcactactccaggaaggaaggtctctgtgggtcccacaggctccctggacttaggcaggtacagcaaatttccactttagagcccttataaccagaagattgctcactgttctggagctcaggggtgctgtggctgaggtgcaagagaaatgtggactgttgccacttgggctgaggtgagagtggctacaggctaccacaatgagggctgaggcatgaccaaagcacaggctcctgtaccaggggctgaggcatgaccaaggcatggtctatcaccatgtggggtggggaaagagcaccaggtggggcaagagcaccactgggaagaatgtgcgagtggtgcatgcattccccaactgtcagcctagactgccaccacaaaaggtggcaccaccctcaccagtggcaaggtagtggcatgactgctgccacttcacatctgagcattctacagtagcctgaggtctttgcctaccatggctgatgatggtagagactatttaggggcctggggacaagcctgcccagcccaactttgtctgtcccagcactgctccatagaacacaatccaggggacagaggattacccagccaagtataaaattagtgtcacctgaatactcctctgcaggagctgagtttgggactagccagcaggctgctaccatttagctgacacttgcctgcatatgacacctgcaggcctgaagattggccttaactgcccattgcagccataaccaaagccagtatgcattgctcaggtcccaaagggtggtcctagcactgccatttccattgtctgtcccatgctgtctgacaataagcccaagaacctgcccacacacctagcccactgctgccactactaccatttgacaaagccacctggaaactcaataattcaccttattgtatctgctaacatcagtgcccacaaatgctgtcctttggcccaaagacatgcctgctcagcccattgctgccactatgggccccaaggcctggcctacatggtgtcctaacctccagaaaaacttgaccacatcatccattaataactgcacccttagcccctgaagtgagtagataccacaaaaaccactaaggctgtttatagctgaagaaatcatacagaggctacaacactgcatgcacccagaatcaaagccgaagtgccctacccaaccaagaccacagaaaaatctttggggaaatgctctccccatggaagaaaattcaaaaattgaaagaagcaactcttatacaagctgcaaaggtatcaacataagggcacaggaaacacaaacaagcaagaacatatgatacctccaaaggaacatactaatcctctagaaacaaatctcaattaaaaataaattcatgaaactcttaaaaagtattcaagttattgattctacagaagctcagtaaaatacatgagatttctgacaaacaatacaaagaaatcagaaaaactattcaagatatgaatgagatatttagcaaagatataaaataatgtgaaagaaatattattttaaaaatcaaacagaaattttggaaattaaaacctcatgaataaaatacaaaatacattaaaaatcttcaataatagagtagattaagcagaagaaataattccaaaacttgaagaaaagtcttttgaaataacccaatcaaacaaaaataaatttaaaaaaataaaaataaatgaacaaagtcttcatgatatatggcacactatgcagcaaccaaatatacaaattatgtgtcccagaaggcaaagagagaactaaagtttcaaaaatctaataataattaaaaacttcccaagtttagcaggagatttagacatctaaatacaggaggctctgagattctcatctaattacaggaggctctgacattaaacaccatgaaaaaatacaaaagtatacaactcacttgtaaagcaaacatacaaataagaaaaagaaaacctcagtgataccagaacagaaaaccaccaaaccacaacgacaaataataagagagaagaaaagaataaagaatacacaaaacaaccagaaaacaattaacaataaaacacaaataggctgggtgcagcggctcacacctgtaatcctagtactttgggaggccaaggtgggcggatcacctgaggtcaggagtttgagaccagcctggccaaaacggtgaaacccaatctctactaaaaaatacaaacattagctgaccgtggtggcacgtgccttgtaatcccagctacccgtgaggctgaagctggagaattgctggaacctgggaggcagaggctgtagtgagctgagatcccaccactgcagtccagcctgggtgacagaacaagacttctgtctcaaaaaaaaaaaaaaaaaaaaaaaatacacacacacaaataaaaccttacttatcaatagtaatcttaaatgtaaattaattaaaatatatacttaaaagatatagactggccgaatagataaaacaaaacaaaccaaagacaaaacaagactcaattatatgttgcctaaaagaaacatcctttacctgtaaagaggcaaatagattgaaagtaaagggatagaaaaagatattccacacaaatagaaactaagcaagcaagaatagctatatttatatcacatataagaaactttacttcaaaagccattttaaaaagacaaagaaattcattatataatgataaaggcatcaatgcagcaatggaatataacaattataaatatatatgcactcaacactagagcacccagattcacaaagcaaacattactagatctaaagaaagatatagacttcaataacatattagtggggaactgtaacaccatactttcagcattaggcagatcaccaatacagaaaatcaagaaagaatattgcatttaaatagaactctagactaaatagacccaatagacatttacagaacattttatccaacaccttgagaatacacattcttcgcattagcatatagagccttctctgggacagagcttatgttaggtcacacacacaaaaaaaaactcagcactttaaaaaaaatagaaatcatatcaagtatctactcaggccacaatggagtaaaactagaaacttataccaggaggaaatttgaaaattatacaaatatataaaaattaataaaggcctggtgcggtggctcacgcctgtaattccaacatgttgggaggccgagaaaggcagatcacctaaggtcgggggttcgagaccggcctgaccaatatggagaaactccatctctactaaaaacacacacacaaaaaaaactgagcagggcattgtctcacatgcctgtaatcccagctactcagaaggctgaggcaggagaattgcttgaactcaggaggcagaggttgcgttgagccgagatcacaccattgcactccagcctgggcaacaagagtgaaactccatctcaaaaaaataaaaataaaaaacaaatttctgctgtaccccattgtgtcaatgaagaaactaggatggaaattaaaaacaaaattcttgaaactaatgaaaatgaaaggaaaatataacaaaacttttttgagacaaaaagcagtactaaaatggaagtgtatagcaatagccaccacatcaaaaaagtaggaagatttcaaatataaaaatctaatgatataactcaaggaattagaaaagcaaagataaaccaaacccaaaattagcagacaaagataaatattaaaggtcagaatagagataaacaaaatgcaggccaaaataataataataataatacaaaagaacaaggaaatgaaaagttgcttcttaaaaaagacaaataaaattaataaatggctagacaaactaaccaataaagaggagcaacaacccaaaataagccaaatcagaaatgaaaaaggaaatactacaactgataccacaaaaatacaaaggattaactgagactactatgaacaactataccctaacaaacttgaaaacctagaggaaagagataaattcttggaagcatataacccaccaaaagtgagtcaggaagaaatagaaaaaaacaaacaaacaaaacaaacaaaaaacaaaaagagactaataatgagtagtgacattgaatcagaattaaaaatacatcttccaacaacaataaaaaaaacccaggcccagatggattcactgccaaattctaccaaatgtagaaagatgaactaatatcaaccctcctaaaaattatttcaaaaaatttcactctaactcattctgtgagtgacaaacaacaagataatttgctatcagcattacttggagagcaaaaccagacaaggacacaccacaaaaagaaaactacagactgatatccttgatcaacatacatacaaaactcctcagcaaaacactagcaaactaaatatatcacattgaaaagaacacaccatgatcaagtgggatttttccccaaggatgcaaggatggttcaacacacacacatgaataatagtgacactcacatcaacagaatgaaggacaaaaatctatattattttcccgacagatgaagaaaaagcattgacaaaatccaaccatccttttatgataaaagctctctaagactaggaatagtagaatcatatatgcaaataataatggtcatttatgacaaaccaacagctaacatcatattaaatggacaaaatggaaagcctttcctctaaaaacttgaacaagacacggatgctcactttaaacacatccattcagcatagtactggaagttctagctagaccaactaagtgagagaaagaaatgaacggcatctaaattggaaaagagaatgtcaaattgtccctctttgccaatgacacgttcttatgtttagaaacatcaaaatactccaccagaaaattattagaactgataaatatttaataacatcgcaggataccaaatcagcatagaaaaatcagtagcatttctataaaccagtaataaaatagctgaaaaatatcaagaagataattctgtttacaatagctacacctaggaatatatttaatcaaagagtgaaagatctccataaggaaaactgcaaagcactgataaattgaagaggacacaatcaaacggaaagaaatcccatattcatgaatctaaaaaaccagtattgtcaagatgaccatactatctaaagcaatatacagattcaatgcattccctataaatatatgtacatcatttttcacagaaatagggtaaaaaatcttaaagttaatatggaacataaaagtgcctagaaaatgcaatcctgagagggaaagaaataaagctggagacatcacactatctgacttcaaaacatattaaaaggctgcagcaaatgaagtatggtattgttataaaaatagatatttagaccaatggaatagaatagagaacccataaatagatccttacatctacagtgaactaattttctactaagatgccaagaacatacgctggggaaagggcaatcccttcagtaaatggtgctgagaaaactggatatctatatgcagaagagtcaaggtggactacattactcattatgtacaaaagtcaaagcaagaaggattaaacataagaccccaaatataaaaatattagaaaaaaacagaagcaaaactattcaggacattgggcttggcaaacaattcatggctaagactccaaaagtacaggcaataacaacaaaaatagacaaacgtaatgttattaaagcagaaaacttctgcacaggaatagaaactattgaaagagtgagaagacaatctcttaaataggagaaaatacttgaagtctattcatccaagaggaaactaatatccagaatataccaggaacacaaacatctcaaaaaaacaacaaaagcaatcccactgaaaatgggcaaaagacatgaatagacagttctcaaaagaagatacatgaatggccaacaggtatatgaaaaaatgcccaacatcatctatcaggaaatgtaattcaaaaccacaatgagataacatctcatcccatttagaatggtcattatttttttaaaaataagtaaaataacagacgctagcaaggatgtggagaaaagggaactcttatacactgttggtgggaatgtaaattagtacaaccactatggaaacagcatggagacttctcaaaaaatgaaaaatggaactattacatgatcctgcaatctatttggtatctattaaaaaaaatcatgatatgcccagtctgtcctgcagaccctggtcaacagatgaaatgagcactcagacacaggtatgcagtgtaagagcagctaggtgactgcctggctgtagtggccagagagcagctccaagaaggtggagctgcttgcttttattcagtgcaggcacaatgccaaaaacctggagccaacacaacctgtaggaaattaacatttattgttcccctttcagggaatgtcacacacagatgatcaaagtcagttcctggtcaacacaagtaaacaagcttgtttaagacaaattcccccacactcccttgtatctactacttgccctctgcctcagggttatagaacagctgccttcagctattctttctcagggttctgcagaaccttccgacctttcagaaggtatgtgtcctttccctacagtttttcccaccactctgactgatcccccacaaggatatcaaagggatatctgcatttccatgtttatcacagcactattcataatagcaaagataaggagtcaatctgagtgttcatcaatagatgaatggataaagaaagcatgctatacacacacacatacaatttaatagtatttcaccataaacaaagtaagaaattctgtcatttgtagcaacatagatgaaattgaaggttattacattaagcaaaacaagcaaggcacagaaagacaaatattgcatgttttcacttatatgtgggagctaaaaaatttgatgtcattatagtagagtaaaatgataaatactagatgttgggaaaagatgcagggaagtagggataaagagaggttggttaatgggtacaaacacagataaaaggtttaagttctattgtttgaaagcagagtagagtgaatataattgacaacaatgtactgtatatatcaaagcaactagaagaggggacatgtattgcttccaacacatagaaatgataaatactcaaagttataaatatctcaaatacctcgaactgattgttctatgcatgtaacaaaatatcatatgtattccataaatatataaaacattatgtgccattaataaataatgaaaacaaatacactggtgtatgttgtctctattctctgcttttagcagattaaattacagaataattattttatatgcataagacaaaaaattattattttctgttaaatttttgtctgatttcttttgttgtccttaatataatcaggttcatagaggttgcataattttggtataaaactgtacatacaatccacaattcatgcataatattagtagaaaacaaaatattggcgtaaataattcatctgtagagtagatgaactctgcagaaaatcaccacttcacttaaccatattaataatgtattaggaaataaaattaattactgacttttgaaattatgattactttgtggaataaacaaacaaaaacaggatttatagaatactaaaaaaatatcaaaataagattcaaacatgtatcaagatatttaaaaaattttgtttatgtaggaatatttcccttttgatattttacactgccttatataaactaaacttctatatcaataatttagagcatttttttctaatttaaatgttttaaaagcaacatttcaatttttagacatatttatctaagctatgcaagataactggccgatttcttccctaaaagtaaaaaatcatgatttttaaatttttatccattttcaaatattaagtctggaaagtatttttagacttcatatttattttaaatatttcttacatgtataatatcatgcctagatctacagaaaatatttaataattatatttatgaggggctacttaataataaaacatactggttctaataaatttgtattatatatttttgaacattctgaaagtgtatttatatttttagcaaaaaatattttctttccaaatttttattatctagtaatatttatttgccaattaaattcatcagaaccttcacacaaaaatattagatagtagtgagaaatagatattcttttatttcttcagtttattcaagtgagtcttctcaagacatccatgaattacaagcacacattattgataactgcatgtattttgtgtgaagggattagctaatatttatatagcagtttaaaatattttattcaaacattccatatataatacatcatataaatatttcatcataagttgttttatgaaataatggtatctctattttagatgtgttaaaatcaagatatagagaatttatgtaactaacttgccattgtaccacatattttgtatgtgtatatgtatttatgtgtatttgtatatatgtatacttacatacacatacgttttttatatatgtgtataaactcatatgtgtatatttatatatatgaagaattatgtggtctctatgtcttcgttgaagttaatgaacaattttctaagtagcaatgaaaatagagcataattggaatagtttcaacatttaatgggagatgagacatgaagacaagtagttcaaatcacttgtggattatgagaaggaagagagcagaaaacaaaacataacattttttaatttataaaataacacttccttagtaaaatcttatcaaaatattttcagcaatattgttattttttcagtgtatatcaggaataatatattttggttaactgtattttattctaggaattccacaatggtcttctttatgattgacttaagaatatacacgtatatattaattcattaaaattattaaaataattttaataattttaatttaaaatttttattttttaaatttaaaattaaaataattaaaattaaaattaaaattattttaataattttaatgaattaatctgattaaatacttttttgaatctcctctaatttgcttgtgtaaacatacccaaaattctatctcaaattttctcctatctactgaattcaagagataaccctctattcagaaacaagacaaatatacctgcttttatatcatgacttgaacattgtctgggaaatttacttatgacaataaaaaaatattaaaaggagggtatatgaacactttttctatgtattactattattagctaacaacagcacaaaaaataaaaaatataacactttggaagaaatactagaagtatagattggtacaaaggttatgcagagccattaagcaattgctatcagaattttaaataaaggttacttttaactgaacatttctaattttagtgtataaatgtatatttgtgtctgtattagtttggaagctgaataaaaagaagcaatgaaaatttttatttttctgatatgaaataatgaaaaccataactaaagaaatatactaagtatggaagaaatttaatgtatttataaaatatttaggaggtagaatcaaaaatatttcttgactgttttaatgtgaatagtgcatagaagatgcacctttacatttctttggggttcctttttatggtgactggcaataggaaatgtttatggtaaaatatggaatgtatacagtagaatatatttttcaaggattataatgagtttagatttggattagttttatgtgtaatgctcagggcacaactatttgcagatatgtagggcacaatcaaggaaaaatattgtaaaccaagcaaacaaataaataaactattaaaatatgtttcaagctagaggtcaggataaagatttatcctaaggttatagatttgggcatcagcatcatatagatggttattgaagtcatgactacaaatgagggcaccaatctgcataactttgtaattttctgcagtaagctgaacagtcaaggtgtaggagtaaagaagtcaaatatttatgtgtgatttatagctacatcttgactgcatacaatacctgaatcttaagagcagtcttcctttggacatcaaacatacatttcactaaactaggttaatgagttttcagtttattagttacatcctgcctaaattaaaactcacattcactcacatagattcacacacagaatgtgctactttcattttttaatagaataaaatgatattggaaatgactctagtatattattatttgttaagcaatgccacttttagcagtgtaaatctcttttgtatttaagaatgataatcatttgtggttaaggattatgttttacacagacaaagcagaatagcaggctcttatagtccatcaaatccttgctgagtcacatgaacatttagaagaattttgtgaatttagacattgctgaatagataatattttattgccctccgtggattccaattttctctaatatatcaaaagcaggtgaaaactatgcgaagcattatgaagaatcctatatgccaggaataattcaaatgtcagggaccagactggtaatttaaaatttgtagtggcaaatataatactaatgtgagttttgggcattctgtcagaaaagaagaactccacctagaggtggtaaaatggattttatttgagaaagggtgtgggggatgttggggggagaggagaggagggaggggaagaaagaggggatgaggagaagagttatttctgtccaaaacagcttgctctcaattgaatcttgctgactcttttctaataaaaataaaataaaaaagatataaagagatggatattgaattgtgataatttttctttgagaaatgtatttctaaaagttttggtcaagtagaatcagaacaaattgaataaatttaaattttttaattcaacagtggtgctattatatgcactgcattttacaaagactgagatccaatcacaaacatttctgacatgatgtaactggaaagccaaactgtaatgggatatgaaaattcaagatataagtgatttgaaggggaaaatacagtgtgccataggaacttatagaaaaatcaaaacatctatttcagccaaagatgctcaaggaaagctttccaaattaagtaatatttcatttctgatctggtagataaagaaaatcaagctaggcaaatccagtagacaaggaaaattaagaaaaggaaaacagtatgagtattgcctatattcagaagactataccgtattctggaaaattaaaggagtttcaaataattagaacgtaatgtttggaatctggagcagtattggcaaagtatagactggagaggtgatcaggacctgttgatgaaggactcaggaagcctggaaaaggcatttgggctctaccctgaagtcaaaggattatcttttaagaaggctgagcataaattgatttgcgtgctagaaatattattatggtgactttataaataataatttggtggggtgcaggtatacttgcaaggtatataatagctatacgttcaagcaacaatgagaagaaggctgttgcaagaagtcaggtggtggataatggtggccagaacttgagtaataacagtgaggatggagtgaaaaacaaggataaatttgagaggtatattttgaaagccaaattcatggtatatagaggttgattgtgaccaagacatccttaatattcccctaagcttcactaaattttataaatgtttcttcctgaccataagcgctagacctcccttatcttagagcattcactttaaaaacttaacattgcgaattcttaccctgaccccttcgtgaaatgtatacatattgtcttgaaagcctcttgccagttttacaacccacagtctttttcaaggacttggaagccatcctttgaaatgtactcatcaggaaagctagcatccaaatctcccagcttctgtgggagggtaagggcctaacatccataagctctaattagcaaacacaaatgacctaattacagagagaaacaggaatgaaaatgcaggaataggccgggtatggtggctcacgcctgtaatcccagcattttgggaggccgaggcgggcggatggcctgagctcaggagttcaccaccagcctggacaacatggtgaaaccctgtctctactaaaatacaaaaaattagccgagcgtggcggcaggcgcctgtagtcctagctgcttgggaggccgaggcaggagaattgcttgaacccaggaggcgcaagttgcagtgagccaagatcgcgccactgcactccagccttggcgacagagcgagagacaccgtctcaaaaaaaaaaaaaaaagcaggaataaatgcttgcttgatgcacccaacacattccattgaccaacccacccctgaagtcctccagttatttcacaactcacctcacaacttcaaaacccttcagccttttgtttcagagaagttgagttcaatttctccccacttactgcaaccgtgttgaataaagtcttccttacctgtttaattctgttaggtgtatgttttctttgacatttcaatagtaagaatagttgtagtatgataaatactcaggagacaagaatgatctccaggttcctgatatttactgccaggagaacgacagtttattcattacaattgcaggaaaataaattagaaaagctttgaaggagtaacaaagtgttagtaggagaaaaaaaaatcaaacccaaaccaaagttgcaaaaagataggaaggtaacatttccaaggtaaatccctccttcagcatgtgaaatataaaacgtctgtctctttcctcaaggaaaataaagttaaaaaataataatacccaacaaaacatacatttaatatttcaagatacattatttgaaatgtattgaaaatgtttccttggagttagaagaaattgtattttttcatgaattgcaataaacatatatttggaattcatcgccataaataaagtttacatcggcatttttactttttaagttatttagtttttaaggacactataggggttacattgatttttcaagtttttataaaaatgcaataatcaaattgtttatttggaaagaaatgaatattcaaatttaataatgtttatatttttaaacattagaatgttttaaaaagggtcaatataattcaactttgcttataaaattcaaaatatttctgatatctagtcttaattacacagactaatctattttttctaaatttgtatttgacttcttttaggtatattgaggaatacaaatgagtttctgaaacatatactaaaatggcaagaacagaagaagaacaatataatttgttgatctattttttgtttttgttttgatgattctataggtaataaattaggaaataactcagtggcaaaatgtgtattttagattataaacatgataaaatctactgaagaatatattttaaaataacaatattgacaagtataactaatttatatatttattgaattatttgggcttgaagtcaaagaatactttatctgagctacgttaagtaataagaatatttattagatcaccaaagatcaatctggagctttaatgtgattatcgaaattcaaaaatgttatcaaggaccaattattctttttgctgcaatttttacagatatgcaaaacttgaggttgattactgttaaagttttagttttagaattccagagagtagaagttgtggctaaatatttcctatacacaatgaacatgaaaaagcccatcttgttttccattaatatctttaaagaacatgaatattgtccttccatccttctattcctctgttcatttcttttactgtttttcattcttctgtattaaaataaatttttttacagttttgatttttatgggaggatggactttcttttcagacgattaaactctgttttttatgagctgattatttgcatggatacatctgtccatgagactgaagaatcccagatttccagatcaaccaagatatttgttcttggtgagggaggggtgaataagtgtattttttacattttactttaagttctgagatacatgtgcagaacgtgcaggtttgttacacaggtatacatgtgtcatggtagtttgctgcacctatcaacccgtcatataggatttaagccccacatgcattaggtatttgtcctaaggatctcccccactctccctccacccatggacaggccccggtgtataatgttcccctccctgtgtccatgtgttctcactgttcaacttccacttaggagtaagaacatgaagtgtttggttttctgttcctgtgttagtttgctgagaatgatggcttccagtttcatccatgtccatgcaaagacgttaactaatcctttttttaatgactgcatattactccatggtgtatatgtgccacatattctttatccaatttatcactgatgggcatttgggttggttccaaatctttgctattggacatagtgctgcaataaacattcgtgtgcttgtgtctttgtaatagaatgatttgtaatccttcccgtatatacccagtaatgagattgctgggttaaatgatatttctgcttctagatatttggggaatcaccacacagtcttccacaatggttgaactaatttacactcccaccaacaatgtaaaagcatttctatttatctacagacttaaatgtaaaacctcaaaccgtaaaaaaccctagaagaaaacctaggcaataccattcatgacataggtatgggcaaagatctcatgactaaaacaccgaaagcaatggcaacaaaagccaaagttgatgaatgagatctcatcaaactaaagagcttctgcacagcaaaagaaactatcatcagagtgaaaagacaaccaacagaataggagaaaatgtttccaagatacccatctgacaaagatctaatatccagaatccacaaggaacttaacaaatttacaagaaaaaaagcaaacaattccatgaaaaagtgggcaaagattatgaacagacacttctcaaaagaagacatttatgtggccaataaacatatgaacaaaagctcatcatcactggtcattagagaaatgcaaatcaaaaccacaatgagacacaatctcacgccagttagaatggtgattatcaaaatgtcgggagacaacagatgctggtgaagtgtattttttatacttcatattttctataaaaatctgaatatgacagaaatattaactcaaagaagtttttgtcacactaatttagaattgtatgattcaactttcttagcatacgatacataagatagatttgaaaatttatccagtgatcaattcttcaaagtttgggatacagaggaattgaaggtgttgctgaatatcagacaaatctcatataaatgacttagattttttcagtcttgaatttcttccaactctcactatttgttctgcaccagccaatacaacaaagatttttgtgtaagcttgagcagtcccaccatctagagttaaagcctggctccttcaactcttctagacttgaagaaagtatgaagggataggatatcactgctagcttcttgtgtggccattaaaagtttcaaatgaccaccactggaactgcaaacaagttaattttttatatgataaattttgatcactgtaggataggagataaaagttctgcaaaaaaaatgcctctctatatcttcttttgatagactatttctgtacaacctacccagatatgacctccatgctgatgaattggctatatctttttttaagcagtagacaattcagtaatgcactgctttgtatctgcttccattcttctccctttaacctcctgcccattttcctcactctttttgtgctagctatgtgcttcccaataaagcattagccttagccttcactgcaatgtctattttttagcgaacaccaggttacgaaatgctaactaaaagtagaaatcagataatcaaccagaggactagagatgtgtgtagtaaaaaatgaaaatgtgagggattgatagtcagtgtggcgattcctcagggatctagaactggaaataccatttgacccagccatcccattactgggtatatacccaaaggactataaatcatgctgctataaagacacatgcacatgtatgtttattgtggcattattcacaatagcaaagacttggaaccaacccaaatgtccaacaatgatagactggattaagaaaatgtggcacatatacaccacggaatactatgcagccataaaaaatgatgagttcatgtcctttgtagggacatggatgaaattggaaatcatcattctcagtaaactatcacaagaacaaaaaaccaaacaccgcatattctcacttataggtgggaattgaacaatgagatcacatggacacaggaaggggaatatcacattctggggactgttgtggggtagggggagggggtagggatagcattgggagatatacctaatgctagatgatgagttagtgggtgcagcgcaccagcatggcatatgtatacatacgtaactaacctgcacaatgtgcacatgtaccctaaaccttaaagtataataataaaaaaaagacaaatccaaaaaaaaaaaaagaaaatgtaagggacatgatagaattggaaaaaaccggggcataaagaaattaaaggtctcttcaaagtcaaaacacaggtatacttattactgcatgtgagggattttggaattatgttgaatagttgaagtattttaaaaaaacgatatagcggcattgagtatgtagaataaagtctgtagtctatctattctttacccatgggtctcataatagatgaggtctattagaataagctgttttattttatttgcttaataatctacattgctataagagaagcaaagtctcaattatgtaccaggagccaattaatcctaggtgtagaaaataatattcagtggaattttaaataatcaggtcagtttatttacaacaggtagaaggtttccaaaaagcggagtgagaattgtgtataagtacgaagtataaaaaaattagaaaaaatgattatggcttctgctatagtacccaagctgataggaaagagtggcatgaatggaaggaaattaccaaaattactaactttcaaaatatttttgtttctgttgtttatttaggatttactgatcccaagcaggatgacatgatctcaaagatgtgggctgcctgagacggtaagagggtaatgattggtgtgctgaataaggctgaaccctgtattctgctttgcagttaatgccttaagaatgggttctccaaaatatttttctaaatgagaatttaaaagaggggcaactggtcagaataacctaaggtaagtatgtaagctgattactgaaattatgctatcatattcatagttatacaattttgccttaagtacaggctagtatataacactttgattataagaaattcatggtggatgattgtaggggtcgtttccttaggaatgattctgtagaggttgttactctaaaactttaataacctctttcagaatttgctttacaatatgcagcatctacaaatatgtgataatgtttctttcactttttatctaatttagctcatattcactttgagcaaacagaacattcattatttcttcatttctctttaagataagcctctcagcattacctaaatcaccatcgtgtccattattatttttacttttttcatttgtttgcctttcaggaacactctccttagtcttattgttatcggtcccaaagttttcagctttactatctgctacactatctgattcatcattcagcttgctcctgtattatcaggaaacacattattaattttattgttctgtttctcacagctgacatatttaacaggatctgataaaattttcttttcttctttccagatgaagcctcacaatgttctttgctagtaatagcttacttgttaaatcaattcattcattacgattgagtttgctggactcggggtgggaatttgattatcaaaagacagagttttgtttctaatcccctatatgactataattaaaatttatggcatcatccccaggtaattaaatatatgcttaatgttaaagctcaatacattatcttttcattatcttacttttctaatttatatagtatttggtgtgtgttgtggctttgtttagattggttatcagtggttgtcacaaggctagtctgatgtttacaattgattcaacaatttaacatagcattggagggactaaaatattgtagtcacttttttagtgtatttgttatacatacattcagttgcaaaagtcatagtccaggaagatgttaaaatcaaattaattaatttattaaatatatttaaaaactgatttctatgtgtcatgcactgtataatgcataaaaatgtgaacactgaaaaacaatctattttctctttggaaggcgatggttgttcaggtaaatgaggatgaagtgctctaataggtttttcattgaaagtaagaaaaagtaatatttggagttgtcaactctgctgtgcttgtgggacatgcatgtagggagtttccagaaagagttgcatatattcttttgaaaatctacatagatgtctgagccagacctaaaattatcctcattctgacagttattgttaggagagagaatgcagtccctcgggtagcgtatgttatttgagagaacagtaggagagaatagtaggactattgaactctggaaaacacacagttttacatttatttcaattttgttttaattttatttaaactaatgaacagagtaaaaggagaccttgaagcacacataaaaaagtttacagagaatatagaaccttctattggtaatattttctgtgatgaaaatcaaagatatattttagtagagtgtttttttttaagatggagagttctaaattgatttcattgacaattgtagacagtctgtaatgaagaaggcaatgaggttcaatgtacaaaagatggacaaagagtgagtttagtgttaaattagcatgagatttacctcttatttgtattaattgagtctagaaatgttatgtgatgataggtctaataaatcattacacaaactaaacaacatactgatgcattaagaggagtttaataatagagccactataaatacaactctcttattctttatttctttgagagaatgtaacctaattaatgctgaaaggagcactttgtttaactttatttcctccattatttccctactattttgacctttatggttgaacaaaatttgttaattgttatgaactactagctgataagtaacaattgcccatttcttatctaattttaagttaaatattaaaagagtttttgttgtatatgtggtgcatatgtgtgcatgagcacctattaagtgttaaagcacaccaatctctaggagataaagagatgctatttcatacgctctaccaacaaaatacacttctttctttttttttattttaattttagtttaagttctgggatacatgtgcagaacgtgcatgtttgttacctaggtataaatgtgcacagtgattagctgcacctattgacccgtcctctaagttccctgccctcgcccaccaccccgcaacaggccctggtgtgtgctgttcccctctctgtgtccatgcgttctcattgttcaatgcccaattatgaatgagaacatgtggtatttggttttctgttcctgtgttagtttgctgaggaggatggcttccagcttcatccatgtccctgaaaatgacatgattgcattcctttttatgactgtgttgtattccatggtgtatatgcaccacattttctttagtcagtctatgattgtgggcacttgggttggttctatgactttgctattgtaaacagtgctgcaataaacatatgtgtgcatatgtctttatagtagaatgatttatattcctttgggtatataccaagtaatgggattgctgggtcaaatggtatttctggttctagatcattgagaaatcaccatactgtcttccacaatggttgaactaatttacattcccaccaacaatgtaaaagcattcctacttctccatagccctgccagcatctattgtttcttgacattttaataatcgccatactgactggcatgagatggtatttcattgtgattttgatttgtatttctctaatgatcagtaatattgagcttttttcatatgattgttggccacatgtcttcttttgagaagacatatccttcacccacttttcattgggttgttttttttcttgtaaatttgtttaagttccttataaattctgtatgttagagctttgccagatgggtagattgcaaaaattttctcccattctgtgggttgcctgttcactctgatgatagtttctttctgctttgcataaactctttagtttaattagatcccatttgtcaatgttggctttttttgcaattgcttttggcatttttgtcatgaaatctttgcccatgcctatgtactgaatagtattgcctaggtttccttctaggagttttcatagttttgggctttacatgtaagtctttaattcatcttgagtaaatttttgtataaggtgttaagaaaggcgcccaatttcagttttctgcatatggctatccagtttttccagcaccatttattgaatagcagatcctttcttcattgcttgtttttgtcagggttgttgaatgtcagatggttgtaaatatgtgttgttatttctgaggtctctattctgttgcattgagaaaggtatatggtctctaatatctccccagatatactgtggttcctctgtatttgttttgtcatatcttttatatataataaaaatgtaaccctactatttatataaattcttgcatataggtcagtaatctgtctcacacataaggagacatccacaaatattggatggcatatctactgaatttcacaggagacacaatgaaacatttgaagactgctaaacttgtgttcattgttctttttgtttttaggctaaattgacaaattagaatgcattactaaattattcaagcaatcaatttttgagtgggtaatccattttatttagaaatgtgcaataaaaagcaatgtggtgggttactgaaattcagtgtaagcttaaggctcttatgccagatgaagcacattcctttgtcttctgtacctcccaagacactaattaaataaggatatagaaatagataaaggagtaaacacataatgaacaagaagagtccataaacaaatgaaggattttacagtatttcagagagagagagggagagagagaagagagggactagaactagagaagaattgaaacagatactagcaacaaaattacaaagaatatggttcaatgatgctcaccaagagaaaaatgaagtctgcccaaggggactcagagagaatctgggttcaatgtcaggaggtcaggagaaggctgtaataaaatacatgttaaaaccaaaggaagcaacttagaatatgtattttaaaaccgtctttaatcttcgttgctatctccaccaggagcatacatagattatggagcctgcattatcctcaatctagctatgatgtgaacgattgtaaataaggcctccctattctagcatttgtggtgtcattatgggatgcccataactcaacaggatttaaacactctaatcataaagtgaatttttcctgttcctttccaaaaatgatagctagaaagcccacagttgttagcattctcattcagagaaattatctaacctgtaacagatctacttacagaaaagaaaagaaaaaacattcttgggctttacgtatgaagtaagaagaaggaaatattctcatgcttaccgaataatcctatgcagtaaaaactaaccaaataaaaaggaaaaactaaagcaaagctaataatgaaagtaaaagccaagcccaaaataaacaaagatgatttaagaaaataaaaagtttaaaataccctaaatttaaatctaatcaacacactcagatactggcaaaacatacatttcttaaacaataagacaccatgaaaaataaaaattaagtaaagcaagtttaaaaattctcagaaactaaaaatgtaatttctactttggaaagaaataaaagctgtaggcaatatgcatactttaaaaagttccataaaacgtagagaatgatgttaacggaaagcctatgaagtaaaataatagatataaatctagaagttgaacatcttaagtgtcagtttggatgctttcaactgcttatagagcaaatctgaggaacccatttgaagtgaacaaaataattaaaaacaaattgtatccatacatgtttgtaaaaatttaaaatgcaaaatacaaagagataatccttgaaactgaaagagagaggagaaaaaatacattttgatcatgagaatcaaactaacctcagagaacaatgaatagtacagataccaatatcttgctatcaaagttctgatagaaaagatgctttggaggccattgtctagaattctgttctcacccaaattgtcagtcaactgtgaggccatagaggatgttttcacatttaaaggacaaatcaaacttatgtcccacagaatgcaaactagtacagccactatcaaaaactatggggattccttaaagaactaaaagtagaactactattttatccagcaatcccactactgggtatctaccctgagaaaaagaaatcattatttgaaaaagatacttgcacatgcatacttatagcagcacaattcacaactgcaaaatcctggaaccaacccaaatgcccatcaatcaacaagtcaacgaatggataaagaaactgtgatatatatacatatatatatatatattccgctatatatatatatatattctgctatatatatatattccactatatatatatatattccgctatatatatatatattctgctatatatatatatatattccgctatatatatatatattccgctacatatatatatatatatatattccgctatatatatatatatatatatatatatatggtggaatcctacgcagccataaaaagcaatgaattaacagcatttgcagtgacctggatgagattggagactattattctaagtgaagtaactcaggaatggaaaaccaaacatcatatgttctcactgatatatgggagctaagctatgaggacacaaaggcataagaataatgcaatggactttggggacttgtggggaaaagtaggagagagggcaagggatacaagactacaagtatggtccagtgtatactgcacagttgatgactacactaaaatctcacaaatcaccactaaagaacttactcatgtaaccaaataccacctgtaccctaacaacttatggaaataaaaataaaaactagataaacaaaacttacctgccacaagcttgtttatgctctatcaaaactgggggggcagggaaacaaaataaaaggcatgtggcatgggaatcactgactctgacatacagagtgggacaaattattttaatagcctagtgggcatcatctccacatcacacaggatgctttgatagggaaatttctaagatatacgaaatctagataaaacactaagtgtgattaagagctgagggaaaaaagatactgatgaaggcacaaaaataaaaacataagaagaaaagcaatcacaaactccagtaaatatacctatgtataaaagtcacagttcaaacaagaagcagcataaaagatgtggtggggagataaaattggaagtggtacaattaaacaaaaatatttgtctttgaagctaggaatattcacatatgagtatcaaggcattgataataattaccatatgcaaataaaactagaaaatttatagtacttggatataattaaacataattatgtagtaaaattaatacaaaattatattgcttcataattttagtcaccttaaagacacagaataggaaaaatgattttcaaggtcgaatggaatgtaaattaaaacctttggcactgctaaagtaaaatttttgttggtagagattggggagattgagataaaaaaaattgcctcagtaaaggcttgcgattctgttggcaggtgattgagatagacataaaattctatgtgctaatttcaaagttgaaaccataatcaatagaaaaaaataatgcattaataaaaatatcagtcaagagggaagaagaataagataaagtaagccttataactcttatgtttcattggaaggagtcaatgcaaagtttcccacgttgataaatgaaggaagggagaaagcataccaaataaatatagaacaattttaagtaagagtttgaggatttggaattagaatgagaaaagggcattttgcagagataaacttttgtcctcctggtttattcattttcattttgttcatggaaaaaatacaattttcaaatcctcaagcctcaacatagtaccactcagttctaatatatcaatgaaatgggaacagaagtgaagtggacctctggcccataaacagttccctaaggttttcataattttttctacccatgtatggcaggcagaactataaggatggccaccaaccacaggagctcagttaagaacatccacatcagtcttcaaatgagaaaaaaaacaaaacaaaacaaaaaaaaaacactttatctgttaaattgaaggaatttgaggattgtattttaaaccaactggacataactgcactgattaattcagaatacaaggggattacatgtttatcataaacccttccaaaaatgaataatatccttttttatgtatctctctgacatttttttccacaatgtcaatgaaagcaaaaagaaacctttgctcttatttatttaaaggttaaacttgcaagcaatgcaattttctgaatatcattacatgcatcatgtcaggtctcagaactgtatgatattgaaagcctataacatcaacttctttgacaatcatactgtctatattttacaataaactaggatatgtatgtatgtgtctacatacttaaacgtaaccaaaattttctaaaaccatgaactcaataatattgtgtacttacaagtgagggctttctttcacaagctctaagataaggccatgtatttagcaaaaaatagattgaattaaagaggcccccccccaaaatatgtatctcaaataatattatttcaaacacaaagaacaccatatggatacattgaagatcacacaaaaattcatttaaaaaacaagttaaactggatgaactataatgatactgcaaaactgttctattaatgaagaatgtgaaagtcatgtttttaaatacatattttcaaaaccatagatagttattaattattctgcaatgcactctggcttattactaagcctacttcaatatccatacaacatattatcttttcactaacccatccaaatttaacctaactaaaaagaagtaatacttgctactattttgtttacaacatgtaaaaaaaatgagtctgcattggttatatttttctgcatactaaactcacacaaaacagtgacttaaagtaacaatcattttatttagcccataattctgtggctcagccatgtgatcctgctgagaaagttcggctgacctctgctgggttttctcatgcgtctattgccagactgtaaggttagccaagagaaaggactagtagacccaaggcaagcaagttttgttgtcctgccaggctgcttgacaggcagaggaggcagcctggcttacagactacagcagggctttataggccgaggaactgggtcagaatgtggggactgagtcagggctacaggtgtcctaaccgcatcctggagatgtttgttgccagctttgttatgcaaggtgggtaggtgttctgaccgcatcctggaaccgtctgccagctcagctgaagtcttttgaacaaacagttactggaagggtcagtgggagagggggtagggggcacagggtctacttctaaccttgggggagctgttggggggtggtgacaaaggactgtattggaagacttatgggaaaggaggagaatagtctagttgggttgaccctaacattccagccttctaacagataatagaaaagcagtgttgttctcatcagtctgctttaagctgagaaggggcagtggttagtgggagaggctgtaaggtaggggttggttttggttctggtttaaaaattgtcggtcttcttggagtaacatcatgtcctgtatggttctctgggtgaaggctcggatgcgattttgtaaaaactgagtgaataggcgcaagaggcagagcccaaaggccaggagaaggaggatagttatagcagggccaaggaggggaagtagccaggtggcccaagaactgagacaccaaggggaccaagggggccaagagggccaggcagaggagctgttttattttctgagcttggtctttgagcttcttgactgcatcttgtaccaaacctgattggttgagataaaaacagcactgctcatctaagaaaatgcagagacctcctttttcaggggtaagtcaagacctctgcagttttggaggactactgctgctaatgattccaattgtgattggaggtttgagacggcattagctatgccctctatatgtccataaggtcttttgagagtgagcgatagtaggtgagggaagtggataggcctgctattccagttcctgtggcagtggcaattcctagtctggcaagtagggatatgagttgtatggcttgacgatgttgaaccgaggcctgaattggggtaggcaggaattggtttcctggggcaatgtcaattttgggactaggaaacaccagagtgcaggtgacagtccaattggtggggatgtagagataagttgaggtgccacataggaagaatatgcctgggctagttaagcagaattggttatgtatgttaaaaagatttgtaagtttgttgtctttgtacatccatgcccctagggtgctagctaaggcggctgtggtgagtggttgtaagggagtgtatgggtttttttttggtagtttttgcctttactttcccagtggaaggggaagcattttgtgtctattaagagctggttagaggggttgtctttaaatgatgggatgaggaggcattcgtctgtagtaggggggatgagcttcacagggggatggagtccagggttggaggaacaagcagagtagtgtttttcattacagtatccagagtttatgttctgtaggagggtgatgttaactttgtgggggctaggggagctgaaaagcataaggtaaccctgaagatctggagactggtatggtcaactgggccctggagtcgtagggtaaaattacagtggcttgaaggtaggtgtcataggaggtgtccagagggtgggtggcattgaatacataaaggggcttgaagagttagaaaggtgttggtggttatgggacctaggatgggcttggtgtggttagcatagggggccagataatcgaaatagggatataataatagagctgcttgtcctattgcagtgagaggcttgtttgagctagaaaaggagttagaaaggtctattaaggcctttaagtctggaaattggagagggccacctagttcataatgggggtggaaggttacttgggttaaaacccagtcctgagctgaggaaggaattgcgctgtaagctgtagtagataggtagaaacagagccagcagttgcttgctagagtagggttaacttcttttaataggagtgtgtaagattgagggctttgtgaaggtagttaggtattggtggaggaaggagagctagagtgtgtggggggcaggaggggcagtaggagtaaacaggcaaagggtaaggataaaagtgaagaaatgagtttcatctggggtaaaattacagaaggtaccttggaaggtgaggtcagttatctagtcaaggaatgctgtgagggtgggttgttctaggtaaaaccatggaatgtcttctgtgaggcagtgaaggaagagggtgaaacggcaagacaggcaaaggcaggacatttaggagggacagttacttgttagtggctgttattcctgctataaggagaattatgaggcaaaaggctatagaaaataagattttctgtttgaagttccaccctgggggtgttacaatatatattcctatagcaaagagcagagtaagtcagtcaattcctgtaagggcagcgcagtaaatgattttcattaatgagggttcagatatttaacagtgaagggtggtaacttatctgttaggattcatgggtgagaggagtgtggggtcttctgggatgggcgtaaggtggagtcaggttggcccaaggagagtgctggagtgtttgcagggaacagctggttgattagtcggtggtgggtcagttgcaggagtcctttataatctggaaagatggtaccaagagttacgtcctgaaagtttggctgcagtgggggtagtgagaagaagttggaaagggccttcctactttggtttaagtctcattggagtgagggtttttaggaagacatactctcctggaaggagagtttggttggcggggccttggtggggttttgggagggcctgatcagcttctttgcagaggagatgacagatgagggagagcgttgggaggtattctcctaattgagagttaggaagaggtctgttttgtaagaggaaattgcattcatacattaacttgaatggactgaggaaggagggagcttttggactggctctgatgccagccagtgctgtgggtaaaagggagatctgtggttttttgacttcaagagtgagtttggttactgagtcttgagaatctcatttgcccttctgactttccagatgactgggactggtctgggatatggaattaccatgccaagggactgagagacttgttgggtgatttgggagatgaagctagggccgttgtctgattgtatggagcgaggcagcccaaattctagggatgatttctgttatgagaatttgagagacttctgcagctttttctgaaggggtaggaaatgcttctacccaacctgaaaaggtgtctatgaggagaagaagatatttattttttttgacgggaaggatgtgggtgaagtctacttgccagtcctcccctgggagtgttcctctaagctgatgtataatgatgaggagagagcagagggccccttgggaggaagtaacagatcatatatgatagtttgaggttatgtctttgagtgaggtgaatagatggggagaggagaaataagggcgaaggagcaggtacagggggtgcgcaccgatatggaaggattggtgaagagatgtcacaatttccttggtttgctcttgggcgaggacgagcttttgatttttgattatccagtctccttgaagggaggccccctgctgtagtagtgaaggcttttgggtgggagagtacttgggttggactgctgggggaatgaggaggaggcgggcagggacagaagaaagggaggcttcttttgctgcctcatcagcctttctgttccctcttgagatttcatctgatcctgtttggtgtcctcaacagtgtataactcctgctttagttggaaggtgtgcagcctgaaggagttggtaaataagggggccgttagtgatgggggttcctttggcagtaaggaatcctctctcttgccagatggtggcatgggaatgaagaatgtgataggcatatttggagtctgggtaaatgatgactcgtttgatttggagagggttagggctctggagagagctataagttctgctttttgggaggaggtttgtggggggaggagctcagccttaattacttggtttaaggtaactactgcatacacagcaattttgggacagccagtggctctggaagaggagccatctatgaatagttggtcatctggattagtgagaggctcggaggagacgttagggaagtgtggttgcaggtggtctacaatttcagtataggagtgggagggaagcaaggaagatattggaattagagaagtggggttaagggaacttttggcaagacagaactcagggttgtcgagaaatagagcatgaagaatctggatgcgagatggggagagaacgcttaatatttggaaggaaagcaggtcttgtagattatacggactgtggatggtggtgtcttgaccaaatattagctttttactttctaaggccagggtggcagctgccactagagctctgaagcaggttggccatcctagggcagtaatggtctagctgtttggaaaggtaggctatgggggcaaatgatggaggacttccttttgcttggccaaggacaccaagggctattccttggttttcagttgtgtagagggtgaagggccaggaaatatcaggcaaagataggactggagcacttataagggcagttttaagtttgtgaaagctagggcatatgttgtgggagggatttaggggctcatttaggggacctttggctgcttcatagagagggtgggctaagagaatgaagttggggatctatattctgaaaaagcctgctagccctaggaaggaaagaatttcactttttgaggaaggtgaagataggttgtctattaaggctgctcgtgccagggtcatggctcgggacccaggggagagttgaacccctaggtaggtcatggtaggggtagaaagctgtgctttggaggtggagaccctatagcctttatcagcaaggaaattgagaaacgtggcagtgtgggtttgggagttttttagggaggggctacagaggaggaggtcatctacgtattgaagaagatggctaggggaaaggtttaaggaggcaaggtcttgggctaggacttgcctgaagaaatgaaggctatccctgaagccttgagggagaatagtccatgtgagttgttgtgactggaaggtgtcggggtcagtccaggtgaaagcaaagaggttttgggaatcagcgtgtaggggaatggtgaagaaggcatcttttagttcaattgcagtgtagtgggtggtgttggaggagatgagagagagaagtgtataggggttagggactatgggatgagtagggaggacagcctgattgataacttggacgtcttgaacaagttgttatgagccgtcagattttttaacagggaggataagggatatagagaatgtattggtctaagaagcccatgtgagcagaaatggtttatgatgggctggaggcccttttggttgattagggagatgggatattggggaatgttgggaaatttggaggggtcttttaattggattttgatggggttatggtgagcagctatggaaggggtggcagtatcccacactactgggttaacaagagcagcaagaagtgggtactgaggagaggggtcaggggccggactagcggaaaggagcaggagggactctggttgacggaggcaggaaaagatgatagaagccttaaatttggctaaaagattgcagcctagaattggggtagggcagcaaggcataaggaaggagtgtgaaaaaatagtattaaacagggaacaagtgagggattcagtggcacgtggacgtgagatgagtctgtcaatccccatgacagagatctggaagggatgagtgggtcctgaaaattcaggcaaagctgagtaggtagcctcagtatggagatcgactgacttgctcctggcagaggtaccctgggctatgatgcagtgatgactgatggggccgggggccctggggtccgtcagtcttcagtggccaggccaaggagctgcgggagggagtgtgagtgattcttcactctttgctttgccaggacttggaggagccaacctgttagtctacttgttaagaggacgatcagacttccagtggccagtgtgttggcaggctgggcaaggagtttttggcactcgtggggtacgacatgcccacgcccgatggccctctttgctgcacttaaaataaggcctggggcaatactgctatcgggtcttttgtgcccttgggtgctatggccaggttggctgatagttgctgcaagaagctggtatttagcacgatctctttgggctttatctaatttattttagtcatccctgttattgaagactttgaaagccaggttaaggaggtcttattgtggggtttgagggccgtcttccaccttttttagtttgcactgtatgtcaggagcagattgagggaaatgggtattaagaacaatatttccttcccaggaggtggggtcaatgcgggtgtatttttggggggcctctgtaaggtgggagagaaatttggcagggttttcactggctctttaggaaattcatttgagtttttcaaaatttatggccttatgggcagctttgctacagcctacgatgaggcaagtgatcatataattacgagatgccctgccggggctcatgggttggtattcccaggggggttcctccctgggaactgcagtggctcctacagggttagtagggtcttgccgatgaagattgttggcatgagcctgagctacgaaccacactctttccttatcttccaggtggagagtagaagagaggataatataaagatcacgccaagtgagtttgtaagattgggtaaggtatttgaactccttaatataagtgtcgggatcagagaaaaaggactccagatgtttttcaatttggaaatggtcagagagggagaagggaacatggaaatgcaaatgatcccttcagtcccagccacctctcaaagggtaagtatgggagctggttgttgggcatgctgagttcatgagtgggtatcaggtggggatggggaggaatcagaatcagaagctgggtggctggagatagtgggagaaagagataaggcaggatcgggagcatatggtggaggatcgtgatgctctggcagaagattatgatgttgttggggaggaggaaagcgggcagagtcaaaggaggaggaatcgtcagaaggagtggtgaggtgggtggctgaggatgggtcaggcttggagcagggaaggagggtctggaaggcagaacaagactgacagagagagggatggctatggagggaaaaaaagcttgaatataaaggatctccgaccactttccattgtgatggcagaagttgtctaggtccctgaggatgttagaatcaaaagtgtcattttcaggccattgggagccattgtccagtttatattgagaccaggccatgttacaatataatatgagccattttggccaaattttggaatggaggccaaaggcgttaaagttgtggaagagacatccgaggaaggatgtctttgagggagtggactgagaggctcccatggtggaatgagtgagggaggggtggagacaggagacttggccgaagactaggatggtggaagaaggcatcccccgtgccatggttcaagttggagaggagtgataatcacccgtccagacatccctgaaagggagatattgagggcctgcaggcaggaaagaggaaacctttggcccagtactgggtctttcgagaaaggaagagtggacaagggttccagacagaaggcagaagtctcctttactcatccctgaggcggccctggtgttggatgtgtttgtgagcaatggagtggagtaggaaatactctgggtctctggcaggttctggaagggggagttcggctggtggaagaggtggggagggaaggagaaagggagaaagggaggctgaactctaccaccttcccaggttttggcaccaaaatttaaggttagctgagagaaaggatgagtagaccctaagtcaggtgagcaagttttattgtcctgccaggctgctccttgacaggcagaggaggcagcctggcttacagactatagcagggctttatagggcgaggaactgggtcagggtgtggggactgagtctgggttacaggtgtcctaaccacatcctggagatgttttttgccagcttcgttatgcaaggtgggcaggttttctgacagcatccttgaagcatctgccagttcagctgaaatcttttgaacaaacagttactggaagggtcattggaaggggggtcttattctagcctcgggagagctgtgtgggggtcacaaatgactgtattggaagacttatgggaaaggaggggaacagtctagttggcttgaccctaacagagacgatgggtcatctggctgctaaatgttataggatggtctcactcaaatttccatcagttaatagcctgatagaataagagcatatgctgagccaaagtgtttctgctcttcatgattccttctaattaagtaggttaatatgagcttcttcctgtagtattccatggcaggctcaagattccaaagggcagtgaaaaagcatgtgttaatgtacaaatattttcaagtctatgtttgcatcacatttataatgcctcgtggccaaaacaagcctcatcacccacctagagtcaaggatagacaacacctctacttgagagaatacacaatatgcagtggcatagtcaagcaaggttgttttttttaatttgctgtcattttacaatctaccacaaattgcatcttgcaaaaaactaagtgctagatgtttatatacaccatgtatatgtatgtatttaggtacatcttggaaatatacgtccttgtatacaaatgtatgtatttatatatatatatatatatatatatatatatatatatatatatatatatatattcataagctataagttttttagcattaattcataacactatagagtcctctctttcagattgctctcatggatcttcagccaaggctagaaatcaaaccattctaggattcacctggaagtgctgggaaaattgtactgaatttgctattccagggatagctctgtcttagtctgttctcacgctgctactaaagacatactttccttataaaggaaagaggtttaattaactcacagttccacatggctgtgaggcctcacaaccatggcagaaagcaaagaaggaacaaagtcatggcggcaggcaagagagcttgtgcaggggaacttccctttgtaaaaccataagatctcctgagacttattcactaccatgagaacagtatgggggaaactgtccccatgattcaatcatctctacctgtctgcacccttgacacatggggattactacaattcaaggtgagatttgggtggggacacagtaaaaccatatcagctctttactcattccatgactatctattatagttatcatttgtaagcagtatcagagacactaggtattcagtgacaacagaaaagaaatctttgtgacctcattgagataatctttttaacatggaaaagaatgtaaagttgcaaacaattgaattgcaaaggaatttttcagattttgctgggaagatttttggcttagtatatctgaaaatacccacattttcaatttattttaagatataaaatttgtaggtactacttttgtgatatttgacgccagatacttccttatggcaagatcttttcctctgtacccctagtcctttgctaaagaggggaatacaagtttctgtattaccagcctatagtacttgcgggccaatgagaagtaaaatgcattaagtagtttataatcctgcagtaccccttaaggtttctttcttctattataatattatgacacaaatgtctggtagtaaatagatgtgcaaatatagtgaaattattcttgttctctaaactatcttataataattatatttacatatcttgttctttctgtgttggtcagatagttgaaatgcatagttgttctgaaaaagggcctataaattagggaactttgaacaaagatgacatcagtatttttttttatatgatagcaattttagtggttcatttctgaagaacttaatttgtttagcttaaaaacacaagatacttcacttaaaatatttgtgaaaattaagagcatcattaaaataagcatactctgttgtttttgtaaatatcaaacataaatatgaaacatggcagctctatttataattacaaaacttggaagcaaccatattgtttttcaataggtgagtggataaacaaactttgataaatcatacaatataatattatttagtgataaaaagaaatgaaccaataaaccacaaaaagacatggaagaaaattaaatgtatattacaaggtgaaagaaattagtctaaaaaggctaagtacagtatgattctcaaatatatgacattatggtaaatgcaaaagatagtaaaaagatcagacgtttccaggggctttgtgaagagggtatgaaaggtgagagatggaaccctgagcattttcagggcaataaaactattctatatgatgctgtacagatggatttataacattatacatttgtcacagctgtagaatgtacaacttaagagtgaacactaatataaactatggattttccttgataaacttgtaataatactggctcctgaagtgcaaaaaatgtaccatactaatgcaagatcttgataataggggaaactctgtatatgtgtgcatatgtatgtgcattgggaggagaatgtatatggaaactgtaacctttgctcagttttttttgaaacttaaaactagtttaaaagaataaagtgtactttattatttatttatttatttatttatttatttatttatttattttgagatggagtcttgctctttcacccaggctggagtgcagtggtgctatctcagctcactgcaagctccacctcctgggttcatgccattctcctgcctcagcctcccaagtagctgggactacaggcgcctgccgccatgcccggctaattttttgtattttcagtagagacggagtttcactgttttaaccaggatggtctcaatctcctgaccttgtgatacgcccgcctcagcctcccaaagtgctgggcttacaggcgtgagccaccgtgcccggccaagaataaagtatatttgtaaaaataaaaatttatgtaacaatcaactggcaaagtaaaattaacatgcaaagaaactaatacaaaagaaaagtgtaatcagaggttagaaactcttatgttacatgggaaatgcaatggtttctgtttttcttcatattgtgcaggttcatatttattttgcacctctattagaaaagtaccattcttaataacaggattaaaacataattctttcaccttggagcacaaaatattacatcacagggattaattcaaggtgttagatactcaaaactgctgttaccatagtatttctaatagttactcagctggtactactatcaacaaggatgatgatgacagtgataatgataacattaatattgatttagctgttagggagaagttagtttattggtccgttttcatgactaatcttattttattctaacaattctgtggtgccaatctttacaggagaaaaaaaagagaaaagaatggagtctttaaaatatacggcagtttgctcaacggatttggtggatggtctctccaattacaaaattcaatttcacatactttgagacaagaaacatctttttgttgatataatttatttaagagattatgccatttaaaagtttgtgtttatatatatgaacagacattgaaaaacgtaccctgagcttagaatgagaaattttaattgatgagataataatataatatcctcattaaacatagataaaaatatcagcggaacatgaaaagatgtcttaaaaatctgcaaatgtcttggccatattagattaagaattttaatacatcctttgtaaggaagtattttttagcttacattatattctatagatctcattacatcacttaaaatattggtttatagttcttttgcttttaaaggaatataaatacatatctatattttatgaaattattaatttaaatatatacatatatcatgatgaatgtgtgatacggtaatagtacatattgttttctataatgttgctttatatgtgagatgttaacacttctcttttcacaattatctacctgccatatttgcaaaaatggctgcccaatattgcaactaaagcatgaaaaatattattgtcactttttaaaaaaaatagggatcctgtcttatacaatttcaacccatcctccttcaattatatttttaatctctagaaagtttcaagagagatagtattagctcacagggaaactaaatatactaataatgttagaattgtcaaattttttaaacattgtacattctgtagctgtgtctgcttcaaaattatagctgcacgtggtaaatgtaaaggaaaatacagtattagagcatttcccagtactgtctaagatatatcatttaaatggggtttttgttctgtaaattgaatcaaagcatttacaaaatagtgttttcatactcgtattgatggatgtgaatgaattctctatcattgttgctattgtaccacagtagagaaatccaaacagacaggtacaattttctctaagaacaagatcaatttcactttttggtagtttctaaattgtgtttgtcaattgttagttgaaattatggagatggatgatcactgttcttgacctttcattattctaaggccatagtgtgaaggagcaggtttctgctgtatagttctcttgctttgtttcaatttacaggatataagagttatttttcaaagagcacagtgaaataactgtctatgaaggcttctggaactcccacacttacaatttagatattatttctaacttctagatttttacaagtcttttcatactattatttttatttagatataagttcattttaattacattacatagacagattgcttgatataattccacctggtcatttcacttatgacacttatattgaatttgtttaattaaataagattttctttgtactcaatatcctacaaagtatttcaatcttagatttttagcagcaataatacttccaaataacttaaatctaaaaattattaacttaattgttatacagatttttttacatcagaaattattgcaaaaattagttaatggtgatcctgaaacaatgctgtacacgttcataaacaagtttaatttgggctgaccttgcagccatggaacgtatttgtattgtaatctatattgctgaaataagttcaatatgaatgcgctggtatcacccagtcgcctatagccatgaggataaaaatataaataaaccactagttattcaaacatttcagactcatgaacttacatttaatttttgagggacacatatcaccattccttctgcccttgcgcagcccacacacacacacacatacacactgaaaggatactttgaagagaagcattctataccctttggtgaacaattcatactcataactcagttcctacagaaactgatatattcacaatgccagaagttcccacttacattgcaaaggcagacaagctgacctattattttaaggtttgagggttgttgcagaaggactctattttcttaaaagtattttccttttatattgaaatcattcagttatttcttggattagttatcctttttctaagaacgtctataaatttaagatacccccaggtagtgttcttatttgtttccatccatttttatttagggtacagaattattatcatacacttcaaaaattatccagaaataagagttccatgtcctgaagcatctagcgttaagacaatttttggatataagaaagtaccatctagtcatcacctcataacacccactaatgacaatagagaccattacaaactttgcaaaaacttttctaataaaaagtagtgctgttagttgagatttaaactttcttagctaaaggtctgttttttataacatcattatttttaaatgtctacatttatgttgtagttttgtatcactacattgttgaccataccttaagtcttaaatggtatttatcgtggttctcagtgttagcaaatagacaaggatgaaaaacttcctccaaaataatagaagagaaaacaatgattttatctagatagattccaaactcagagcacctgtgttcttcttacccattcagttcattacagctcctctttttttatgtgctgtgaaaagctaatacaatttagttagtttttggctctggttatttatagatcatcatttcatgcaaattcttctgcgacaacaatcattatcattctcaccataaactttttaaaagatcatgtgatttgtgctgctttgccctctacagagtagattattggaggacaggatctggtttgctttgttatcatctctgtttcttttttaataatcagcaatgctaccccagttatctctcacataataagaatttaattaatacgtccaagaaatgggagcactcttgaaaagtttcattccgcatttgttttcaatagacctacatctcaactgttacagaggctgttttctaattgtcaaaatcactccccaataaatttctaagaaacaaaagcattttacttctaattcagtaaagaactgactaaagaaaattgttaattcaatttatttgttattatatttttacaaatctaatatatgctaaaaatgaatctattatgttttagtcttttcaatttatgcttctagtttttacttatgtgcaagcttttctatttacgtttgtgttcttatttatgtatgtgcataatagaaagcaaaatgtattgtacgctttcaatgatatttatgttacctttacactaactagctattgaaaaaatgaagaaagaaatgccttaaaatgtagcaaagggaaatggagaaaatgtgaaaaaggataaacaaagtggaaagctatgtactttgcttgggaggctcatatagacatataatatataacctcacagcacctgacaagcatagttgaccatttttaccgaaatgtctctaattattaacaaactggtttttcagttagaaaagaatgcttaccatcaaaaccaaaactatatatgtattaagtagtagaatactctacaatgaacaaaagattatatttagtattcttccacaagtttatttctttttttatacaagtaatattagaaactttaaacaagttttgtttgggcatttatatttactttagacatactaaggtaaaaggaaaaacaattataaattatatcttaatatatttctttcatttaaaaaaatcttaaatgaagtttttgagcatggagataattttgttctaaattgtacacaaatgctttagggtagggtcccctctaccttgttggcattctcaggagaatgcaatgctgtggggatctctaggaacaaaacaagcttcctgaggactataccattccataggactttcccagtagagtaaaacaatatcattctatgcttgcaaactagctcaccacatcaaggaaaataaaatatgaaaagaataccatgtcttaaatgtaactggaaaacacctacaactgtctgccaaaagttataaagggccaccaggtgcaatgaatgttagtgttggttgaggaaggaagctaggctctcatgattaccaaaagtctgtcatgctcatccaaaagagccaaaccaaatcctcctgaaattgaagagttaagatctgggttaaaggagaaacagagataattttttaatgtatttcttgaagtaaactgatataaaatgatgaaggaaaataagtccaattagccatgaccattaaagctggtggttctgacgagtgaaagatattctataaatcaattcacaaaagaacctaattggcaatattttccaattaaagcaaatgatctgcttttgttgactggagacacagggaataatatataaagatgatgtataagaaacatgaaggtaggccaggcacggtggctcatgcctgtgatcccagcactttcggaggctgaggcgggtggaacacaaggtcaggagattgagaccaacctggctaacacagtgaaaccccgtctctactaaaaataaaaaaaattagctgggcgtcgtggcgggagcctgtagtcccagctactccgaaggctgagacaggagaatggcgtgaacccggaaggcggagcttgcagtgagcccagatcttgccattgcactccagcctgggaaacagagcgagactccatctcaaaaaaaaaaaaaaaaaaaaaaaaaaaaaaaaaaaaaaaaagaaagaaagaaacatgaaggtaaagctaatagaaataaaaactatttcctggttaaagtgagtacatccctaattcccacttagggagaaaatgtcagaacaaagtaaaattaaaaaaaaaaaaaaaggggaatacagaaaatgttcaaacaggcagaataaaaaggatggagggatggaggtgggacacacaaagattattctgtggctcatgtcagtaatcccagcactctgggagaccaaggtgggaggatcacttgaggtcaggagttcgagaccagcctggccaacatgttgaaactacgtctctactaaaaatacaaaaattagactggtatggtggaatgtgactgtaatcccaggtactcaggaagctgaggcaagagaaccgcttaaacccaggagccggaagttgtagtgagccaatatcaccccactgaactccaccctgggcaacagagcaagactccctctcaaaaacaaacaaacaaacaaaattgtaatacaattgagtccatctttttcctttaggtaaaagagacagcagataaaaagagtatagtatctggaggttgttgaggaaacaattggcaatctagagtttgatgctcaagcaagatatcattcaagattgattcaaaataaagttattttcagacttacaacaaacatttaattatttatatttatattatataaaatggacttcctaaagtataaacttgagttcacaatgatgttgtgtttggaagcaacactatgggtaaaagaaaaacctgttgatacgtttcaataatatagaccctgaaaaacactaacagtagcatttagcttatttaaagtcaaacagaaacagaagaaccataaattcacaacaggaaggtttcagctattaaagaaaaatttacaacaaatgcacttagaatcactatctaaggagtcagtaaaggaagagagacagagacagaagacacacacagatttagaaagaggcagaaaaagagagatagtaattttactctccaaaagctataattaaaaagtcttcaattgtcaagacaatcctccctctcttcatcagttaagaagatgtaacaagtacatttcaaaaattactttgaacagacaaaccctatcccatacgagctattaacaatcataagaagaaagcagcacaaaacaattttaactttatattgaactttaacatacatgcagaaacatttacatgtcacaattaataaatagcataagctgagtagaatttatatttacctgtgaccacctctcttatttgccttaaatgtgaatgatttctctccataaataaaataccggggaaaaaataaataaataaaaatgtgcacaccacaggggaatgaaaaagcaccaagagacctctgccatccaaatcccataagaggcagtgaacttgctcacacaccaaacacattggtgctacaaccagcatctgagaaagccatcgtatgaagactctatatccaaggaattcatacagtcttcatccctgaaagcaccaagagccaaattaggctacaataaactatcaatattaaagttatattcttaagggggaaaatttaaaaaaaacacagtcatatcaaaaataaattcaggaataattagaaaaaaatagtatactcaaatgagaagaaaccagaaaaataattctggtaatatgagagagttctataacacatctaaaagatcatcctaaccctccagcagtggattcaaaccaagataaaatctttgaaataccagataaagaacttaaaaaggtggattaaactactcaaggagacaccagagaaaggtgaaaaaacatacagaatttaaaaacaattcagaatgtgtgtaaaaaatttctaaagagagatattttaaagaaaatccaatcagaacttctagaaatacaatagacacttagggaataacaatatgcagtggattttttttatttaacattaattttaagttctgggtacatgtgcaggatgtgcaggtttgttacataggcaaacgtgcgccatggtgatttgctgcgcagatcaacctatcacccaggtattaagtccatcatcaattagttattcttcctgatactctcccttgtcccaccccctccaacaggccccaaagtgttttgttccccttacatgtgtccatgtgttctcaaccttcagttcccacttataagtgagaacatgcattattttattttctgtccctgttagtttgctgaagaaaatggcttccagttccatccatgtccctgcaaaagacataatttattcctttttatggctgcatagtagtccatggtgtatatgtaccacattttctttatccagtctatcactgaggggcatttgagctgattccatgtctttgatgtttgtgaatagtgctgcagcaaacatatgtgtgcctatatctttataaaaattatatttatttgggtatacacccagtaattagattgctggatcaaatggtatttctgattctagatctttgagaaattgccacattgtcttccacaattgttgaactaatttatattcccaccaacagtgtaaaagcattcctttttcctctgcaatctcaccagcatctgttctttctttactttttaaaattgcattctgactagcgtgtgacgctatctcattgtggtttagatttgcatttctctaatgatagtgatgttaagctgtttttcatgtttcttggctgcataaatgtcttcttttgagaagtatctgttcatgtcttttgcccacatttaatggagttgtcttattcttgtaaatttgtctcttatgggattgggatggcagaggtctcttgaaggtttttcattcccttgcagtgtgcacatttttatttatttatttttccacagtattttatttactgagataaatccttcacacttcaggcaaataagggaggtggccacaggtacaaactggctgtggctaaagcacgttgttaaatgcagtactcaaattcttgtaaatatccttgtatactctggatgttagaactttgttagatagattgcaaaaattttctctcattctgtagattgtgtgttcacgctgatgacagtttcatttgctgtgcagaaactctttaatttgattagattctatttgttaatttttgcttgtgttgttactgcttttggtgttttcatcatgaaatctttgccaatgcctatgtcctgaataggattgcctagatttgcttctagggtttttatagttttgggttttacatttaagtttttaatccatcttgagttaatttttgtataaggtgtaaggatggagctcagtttcaattttctccatatggctagccagttctcctagcatcatttattaaacagggaatcctttccccgttgcttttctcaggtttgtcaaagatcagatggttttacacatgaggttttacatgtgaggtctaatttctgagttctctattctgttccattggtctgtgtgtctgtttttgtatcagtaccatgctgtttggttactgtcaccttgtagtgtagtttgagtagcatgatgcctccaaacttaatcattttacttaggtttgtcttcactatacaggctctttcatgaattttaaattagtttcttctaattatgtgaagaatgttaatggtagtttttaggaatagcactgaatctataaattattttgggcagtatggacattttaactttattgatttttcttatccatgagcatgaaatgttcttccatttgtttcctctgtgacttccttgagcagcggtttgtagttctccttgaagaggtccttcacttctcttgttagctgcattcacaggtattttattctcttagtagcaactgtgaatgagagtttgtttacaatttggctctctgcatgcctgttgttggtgtataggaatgctagttatttcttcacattgattttgaatcctgagacttttctgaagttgcttttcagcttaagaagcttttgggctgagactatggggtttctacacataggattatgtcatctgcaaacaaagataatttgacgtttaattttattgaaggccttttctgtgcctattgagataatcatgcagtttttgtctttatttctgtttatgtgactaattacatttattgatttgcagatgttgaaccaactttgcatcccagggatgaagccaacttgattatggtggataagcttttcattatgctgctggattcggtttgccaatattttattgaggatgtttgcattgatgttcagcagggatattggccttaagttttattttcatgttgtatctctgccaggtttttgtatcaggatgatgctggcctcacaaagtgagatagagaggagtccctccattttaattgtttggaatagttttagtagaaatgataccagctcctctttgttcttctggtagaattgtgctgtaaattcatctggccctgggctttttttagttggtaggctatttattagtgcctcaatttcagaactcattattggtctatatgaggattcaatttcttcctggttcagtcttgggagggtgtatgagtttgggaatttatctgtttattctaggttttcaagtttatgtgcatagaggtgtttactatattatttgatggtttttgtctttttgtggggtcattggtgaaataccacttatcatttcttattgtgtctatttgatttttttctcttttcttatttactagtctagctagtggtctatttaatttattgtatctaaaaaaaacaagctcctggattcattaattttaaagggtttttcgtgtctctctctccttcagttccactttgatcttggttatttcttgtcttctgctagttttgggggaggtttgctcttgattgtctggtttagttatgattttaggttgtcactttgtgacccttctagttcttgatgtgagcatttagtgctatacattttcctcttaacgctgttttagctctgtcccagatgttttgttatgttgtctctttgttcttattagtttcaaataacttcttgatttctgccttaattttattatttacttagaagtcattcaggagcaggttgttccatttccatgtaattgtgtggttttgagttagttttttaatcttgagttctaatttgattgtgctgtgatctgacagactgtttattattatttcagttcttttgaatttgctgagaagtgttttacttcccatttgtgatcaattttagagtaagtgccatgtgataatgacaagaatgcacactctgttgttcttgagtggagagttttataggtatctctcaggtccccttgagccagagctgagttcaggtgctgaatatctttattttctgtctctgtgatctgtctaacattgtcagtggagtgttaatacatccgattattattgtgtgggagtctacatatatatatatatacatatatatatatacacatatacatatatatatacacacacacacacatatatatatatacccaataaaggaacacccagactcatgaagcaagttcttagagatgtacaaagagatttatatatatatatttatatatatatttatacatatatttatatatatatatttatatatttatacatatatttatatatatatatttatatattatatatttatatatattatattatatatatttatatatattatatatttatatatataatatatttatatatatatattatatatataaatatattatatatataaatatattatatatatatttatatatataatatatatatataatatatatattatatatattatatataatatatatattatatataatatattatatatattatatatatttatatatatattatatatataaatatatttatatatatatttatatataaatatatttatatatattatatatatttatatatatataaatatatatatatttttatatatatatatatatatttaaataaaatagctcttcttgtttaattggtccttttaccattatgcaatactctcttcgtcttttttgatctttgatctttgcttccttaaatctgttttgtcagaaactaaaattgccacttccgctttttcctgtgctctaattgcttggtaaattttcctccatccctgtattttgagtctatgtgtgtctttgcacatgagaggtgtctcttgaagacagcacaccaatagggctttattctctattcagcttgccattctgtgtcttttaagtgggtcatttagcccatttacatttaaggttaatattgttatgtgtgatgttgaccctatatcatcatgatgttagctgattattttgcagacttgtttatgtagttgctttagagtgtcactggtctgagtattttagtgtgtatttgtagtggctggtaatggttttccaagacagacctggtggtgacaatgtccctcagcatttgcttgtctgaaaaagatctcattttgccttctcctatgaagcttagtttggccggatatgaaattctgagttggaaattattttctttaagaatgttgaattttggccccctatctcttcttgcttgtagggtttctcctgagaggtcagctgttagtctgatgggcttccctttgtagatgacttggcctttctctctggctgcccttaacattttttctttcatttcaaccttggagaatctgatgattatgtgtcttcgggttgatcttcttgtggagtatcttactgatgttctctggatttactgaatttgaatattgacctgtctttctaggttggggaagttctcccagatgatatcctgaagtatattttccaacttggtaaaagattaaaagattcacccaatctttttcagttaccccaattaatcactgggtccatcttttttcataatcccatatttcttgaaggttttgttccttttcattcttttttctctattcttgtcttcctgtcttatttcagaaagataatcttgaagctctgaaattctttcctctgcttggtttattcggctattggtacttgtgactgcactatgaagttctcgtgttgtgtttttcagctccatcaggtgatttatgttcctctgtaaactggctattttgattaccagcttctgtaatgttttacaatgattcttagtttctttgcactgggtgagaacatgctccttgaaatcagtgaagtttgttattgtcaccttctgaagcctatttctgtcaatttatccatatcagcctctgcccagttctgtgtccttgctggagaggtgttgcaatcatttggaggagaagaggcattctgacttttagaggtttcggcattgttgtgttgattgtttctcatctttgtgggcttatctcccttggatctttgaggttgctgacccttgaatggggttttggtgaggtcttttttgttgaagctgttgctgttgctttgtgtttgtttgtttttctttaaacagtcaagcccctcttccatagagctgctgtggtttgctgggggtccactccagaccctaatcacctcggatcctcccacacctggctgtatcaccactgaaggctgcaaaacagcaaatatggcagcctgcttcttcctcagggggctgtgtctcagtggagcactgacttgatgctggcccagatgctcctgtaggatgtgtctggagacccctgttgggatgtctcacctagtcaggaaaaactgaatcaggaaccatcttaaagaaacaatctggctgtcccttggcagagcaggtgcactgtgcatggggaatcctccttattcagaccactaagactttccagagcaagtaggcaggaaaggctgtcagtttcactgcagatatggtggcaggtctccccttagtggctccgtcccagggagatatcagcattctgtccataaaattctggctgaagttgctgaaattcttgcagagaggccccacctggtgagtaggaatggatcaaggtcccacttaaagaatcagtctgtccatgatctgccacagtagctgtatactgtggtgtggggaattctggtgtggactgtccagactccccagggctggcaggccaaaacaaccatcttgagccacagagatggcagctgcccctccccctggaaactagttcatctcaggcagtctccagtctgctgccactggctggcttgtattgcaagtcagtgggtcttaacttgtgatgtgccatgtgaatgggtcccacagaagaatgctgcttggctcccttgcttcagccccctttctagtgttactgttggtgtgtcttgactatgagccatccaggtttttggtgttttgaacaaagagttgaacaaaacacacaaagcaatgaaagaataaagcaacaaaaagcaatgaaagaataaagcagatttattgaaacaaaagtacactccacggagtgcgagtgggcttgagcaagtggctcaagagcactggttacagaattttctgggatgtaaataccctctagaggttttccattggttacttggttacagcctatgtaagtgaaggagtggcccacaaccagtcttattggtggtggaaggcaaccaataagaggctgaagtgaaaatacaaaatatcttaaactaaaaaaaaatgactcacaagaaaattgttagtaacttctatgcttagcttctagataaattccttgatatgcctgatatatttacaggctctttatatgtcaactaacagtactgttttcaaggcatacatcagacattttacattaaaaaataatgtattttaattaattttacaggtttcacatgatattgaatttggtcattgtcaaataaatgtaaactaaaataacaaggtgatattttaagtgttagtattttaaatccaaataacttataatacatatttacagggagagtatgaacaaacctgcatttccatatgttttttgatacttcaaagtttttctatagtatttttttttggggggggagtgtaagaagagctgggcaatacctggtaatttttaaaatatacatatgctgtgactcctcaactacgtctctaggaattgacctaatacatatattgatatgcatatattgatatgcaagtgcagagaataaatggtaatatgttctttttagcattatttgttattgtacatacacttatctcagcaaatgactgcaaataacttgttgacattaaaactgctatacatcatcatgacataatgcattacatacacagtaaaacccagtgaaaataataagtatgtgtaatttacttattttcagcaagtttctaatgattctatcaatatcaagttctcccttctgccaatccattagttcatctgcatttatccattagtagattaataaatgttaataactaaccaatgattcattagagaaaacctaaacttcattactattcccatgtaagtaaaaagacaatgctgaaaatggccatagattgtaaaatcctcagttatactgaaccatgtaagcttgtttcctcaggtcacacttacatgattatgtcttatgacactgatcaaaaatacttgatcaactgcctagacaaacataggataagctctgttaaatggatgaagggaaaattaacctaattgcacttaatgtatttaaataaatctatttagatgatttaatttgcaaacaaactggattgtttactctttcatgaaagctgcaaattataaaccatatggcttgtcttaacatgccttgagaaaatgtgagctgaaccatttttactaaaatgtgtgtcaataacctattaaacttttagagagttttaattgctcagtaaaaagtaatatgtaagcttatttatttagcataaatttaaaatattaatgttttttgctttacaatgcttataattatcttcagatatgacatttatagaaatatatgttttcttactattattatttcacagttgaaaatctccattcgagaaaatgtaagggagttgtttatttaaatctttaatcatcttttggatatacctattaatatattatttcactctaattttcaacaactgaaagagtactaaatgactatatttacattgtggtaattttttaaaatattcttaatcaaaacaggagtatatatatgcaaactccatttttaaataattgtcctgtctttttattttcaagagatctatttgatattgccaataattatcatcctatctcctgtagagtaacgattattcaactgccttgataattattgaattattgctgtttaaatactgtgcttatgcttcttggtttaagaatgtatgctatcacaatagaatatatacattaaaattaaaatttattgtaaatgtttccactgattatctctaagtgtctacctatctacttatctaggtataaataatttaatatttggaaagtaatataaaatataaaatatttaattttctataagtatttgatctaatttttatgcacatttggctcttcattaaaattggttcaaagtaattatatactttggtcatttagagttaggcagattaaatacactaaagctagagagtggatagataaatatttaatagcagaataagtagttctttacctatgtaatttatttaccttaaacatgctctttgatgaagtcagtttgcaatgagtcatctaagatacaacacctacaaatgaatttattataaataacttatttcttgtctctggtagcttttcagaaggctaacccaaatagtgacaatggaaatttccagaaatggtcccaccactatgtgtgcaacagcaatctaaaacaccattttaaattattaaaacactgtctctcatcctatcagaaactggtatcacatgatgcatatttattttcctagtaatataaccatgacccatacaaccaaatcctgattgttgttgcacctttcatttagtacattgttgcaacacataaaggttgtcgggtattgacagataatttgaatacctcacccaactaaatactcataattctatatttttctttgtattatattcaaaagaataatcaaatatttataacctacatatctttctttcttcctatgcaaatattagttcttaagacatctaccattttccttcatgtcagcccattttctgaagctataacagaataacgagactggataatttataaaggagggtggtttaagttcattattctggaggctaggaagtccaagatcaggccacagcatctggtcagcttttgatgaggctctcatgctgcatcataatacagaagagaagaagaaggagaagcaagtgtatgcaaaaagtgaccaaacacaagaggcggtcttgctcatcgcaattcgttcttgtggtagtaactaatccagtcctaggaaagcagatctcgctctctggagaatggcattaatgcctcctaatggactaatcacttcttaaaaacaccaccttccaacactgccacactggggatcaagactcaacatatgttttggtggggacaaaccatatttaagccataacacttaagattaccattgttttataaatagataaagtgagttgagttgtatttgacagattctactcaagccctgaataaacacaaagaatttattgggtacatttaacataaaaacctaaattacgtaacactttgtagttttttcttcataaaatgctgcatctaatttctttctttagctgaaatcttgtcatcaagcaaacaaaaatccctttgtagcatcataagtgaaattttctcacccatccctgcataatttgcaaattctgttgtaaacctgcaggaacactttcagaaatctctgtgggcctcatgtaaagcaccattctgctttaaagcccgagtaatcagcatgcaatctgctgcaatcctttttctggaaggtctctctgttattactatatctctgtagacatttaatacctgaatcccagttgatatttgtctttgaccattttgtgctgctataactaacagaataccacagactgggtaacttataaagaacagacatgtatttacttgcagttctagaggctgggaagctcaaaattaaggtgctggcctttttgctgtaacatctcatggcggaaggtggaagggcaagagtgtgtgagagagcaaaaggggtctgaacctcatcattttaaaagaaacccacttcagagaaaaaagcattaattcactcgtgagagaagagcccttatggcttaatcacctcttaaagatcttacctctttatactattacaattatgattaagtttctaccgcctgctttttggaggacacatacaaaatatagcatttcctttattccaaacctataataaattcagaaagaaacaatagtatttatcatctatccaattctccagaatttgtccctcaacttccttatctgtaatgacttacatttacactcctttatttcagtaattctgtggtagacccattcggattgggctgtgtgtcaaccttgcctccactacttgccaaatgtgcaaatttctaaagtacactgtaaatcagtttccttagctataatgctgaggatgataaaataatagcattaagtttatgttcatataatgaacttctattcaaccatttcatataaatgatccctagaattttattcttatttcatccactggttctacacaatttaaatgacttcacattgcccaaagaataacataggaacttgttgatttgggtatgtgaaataattcttactttgtccttgcttacctttcttaactcttactatgtcacactttttcatttatcgtatacagtggctacactaaaaaactttacgaagttcttctacatctctattcaatatacaactaaaatgttcatttatcctaagaaactcattttttacatacaagctaaagtgtaatttaggcaaaatgttagtaaatgtgagaacttccacactaaagatctaccatacatttagttttttttttattattttgaaacatttattcttacagaaaactagacaaattacaaatgcccggcttgctgaattatcacaaacatctgtgtaaccacaaatccagccaaaatgtggactcatccatacttggacatattaaatacccatttttctgctcttacctcaagtctattatactaacccaagttaattagcttttgaaatagctgatatatttatatatagtttttttccacctctaaaatttgcagttcagttatgatccccattcatttttaaaattcctattatacttacaaataactttcccagatattttcccaaatgctttttcatgctttggagggaagtattatcacataatatagataaaaattaaaagcaaacaaaaaaaaccatgttgttatatttgctcagtcaccttgatttgcatctttgtgattagttttaaatccctttagcacagacaatcaagagtgcttagttggcttttgaaaaaatcaggaattttttcccctgtcaatggcaacaaagatgttggcataccacatcctagctatatattttggtgtgtgactgaactaggaggtaaactgaacgcaactagttttattgcacaagtcctgttagatctgccaaaaggtcagagacctagttttcatcaagcttataaatcaagttctgtagttatttccttaattgttcactaattaatattcctatgtgtggcagaattcagcctgaaattcattttcattgtatcatattgtgttatagcatgcttatgggaatgaagctgagattatgaatttaaaatatacattacacgtgagtaactcaactgtcctaggtcatttcatagcagcctataaggcaaatctttattttctttaatattgcatatttctacgcctcctctcccatcctgccttgatttactccttttaccaggaatttctttcattttaaagatctcgcctaattgaccaacatccaggacttttttgatatccaattaaatttcatcctgcttccaatactcagaagagagaaaacttgggatctaatcaatttggtaccgctgctacttcccagggacttgagttagcaagtttgccggctgcccctgacttttgtgatgactattcatcccctactgatgagtgacttctgcttggtccaaatcacttctgagtacattggcttgtataagcacagcagctcatacacattcaacaattattcttacatttctccaaaactctacgatcacccttagccatatgatttgctgaagccagccttcctccattaaatttagtttattgtattgatcatgaatgagagtccagaagctttcatagtgcttgatgttttcatgatgtgttcttgttatgtgtgtactttcctccaccaccttattcctttggaggagtcttgaaaatgtgaacaatagagtggaaggagtgaaagtatcacgccctttcctcccaggaggctacttggtcagcatgcagactttccctctcttttctttgtgacagctctgcagcaagaaggttttgtaagaagctgcctttgtcaagacacaataggtcctttttttaccctgaccgtgtataaatgtgcttcctggcataatatttgcatgaataaaagggaataatcatatgacttcttagcagaacaaagatgatgtgctccaaggtgactttctgtttctagacacagaagacaaagaaaagcccagcataaaattttgtcttctgacacttcatagttcatgtctattctttcccatctaaaatcatcttgcatgtttgaatggttcattttccttcaaattactatttaaataaatagatataaatactaaaacacaaatgtcagtgatctatttttatcacagttcttacctaaatgctacaataatgaagtactgaacttttttctatgtatcaagttttacatatatataataacatatatatacatatatacacaatatatatatagcaaaattaagaattttgaaggacagcaatttacttaactaggtaacactgaaaagaacattgattatgtattataaatttcaaacatttacagtattcagtatttccattcatattaatatgcacatagacacccaaatatacctgcataaacagattatccagctgaaaaattttaacactttttacagaaagatttgactgtgcattcattttcctgcttacattgaaatgccattattcagcagcctttttattgtcttattacttacggagagaaaacaaattagggacccattgtctgtcatgcttcaaaactctgaatattctgagttttcaatcgttagttaactctacagactaatattttcattcctgagcaatctctgcacttttcgttgtccactttcaaaagcagagcctgatccattctaggattgctcctggatatgtctgtcactttcctggctgaaatttagtttctatctattttttatctctggctacagttctttccaaagaaactttcctggagctaattttcgctttctgttgcatcccatacacatcaatgtatctgggtgaatatcatccatagaacaaatagataccttgtttctgattgtctcagggttatagaggcatttctaattgtcacaattcaggtgctttacaatgtgttatttctggattccaataatgaacataagtcatggcttgcctataatgtctttagtttacttgtgttattcctaggtttttcctggttcagaatttatatcaaaatgttagctgtctaattgtgaaatgttattcaaagttacagtaatgtaagccatggtggttttgcattgtatttccaatttttcctatgcccttgtctagtaaggtgtaagatgcatgttcagtgaacacatggctaaattttaaaaccatcagtaattcttccctcttttcttggatagattctggctcaaggtaactcttttggtcagctcggtgtgcaacaaaaaatgccatagattggaagcttagaaaatcagaaatttatctatcatacttctggtggccgggaagtccaagactaagtaactggtagattaaatgtctgatgaggaccaactccctagatggccatctcttctctgtatcttcacatgttggaaggtgcaagggagctgtttggagtctcttttctaagggcactaattctattcattaagtctcaacccccatgactttatctaaacttgattaccttcaaaatcccacttcttaatatcatcacattgagcaataacgtttcaacataagaatttcggtaggacacaagcactcagtccataagagtaattaaaaattacatttcaagggtacttgttcactgataagatgaagcattcttttgtaaaaatagtgaaattcagtaacaccatccagcataatgggagacgtattaaaatattgtggtcattaaaggtcccttgttaaactaaccagaagtcaggcttaaaatccgtgaaaccagtaaaaaatgtagaaacttaaactttaaatgtaagtaaatataatgatcaataaaaatgtctttcaccatttgtaaaggaaaaagataacatgtccctacttaatacccacctaagtgtgactaaacattaagcaggtttgttcctgactctaggcccctgaccactttttcttacagcatttaatttagaaaattctcaatggtaaattatttctcttccttttgagatataatctttttccagccttttgccagttatgtaactcaggaatgtgtttctcaaggacctgggaaaaatttctttgcaatgcaattatcaagaaattagtaccccatcttcttagtctctgtgagacagtataagtctaacttctataagtaccaataagcaaacacacttggcctaattacattgaccaatctctcctctaatatcctccagtaattttccactacctcacctcagcactcaataactcttccaccttttgttttgtggcattgaattcaatctcttcccccaaaccttattgcaatagtcttgatctctattgcaatagtcctacataaagtttttcttgcctgtttaatacaatcaggtacatttttttaatccacttccctctttaaaaaaattgtttccttgaagacatactgagttagagtccttactataacctgtgaaatagagataaatctcgccaaggattaagctagatattccaggttttacaatgaagcaatagctccaagtcggcagactcaaaacctccagctatgtgaaaatgtatcactaaaagtggcccagtgatatctcacaacatgtaaaggaaattgttaggaggtctaattctttaagttattctttcttctgtttgctgtataaaatgtgtaagattttatccttagtgttaccttttgtgatcaattacattcatataaatctattaaagtttactgtggtcaaaggataatggaatttccttaaagtccaagccctaataccctgaacctgtaaatatgtgcgtagtaaaaaggaatttgcagatgcatttaagtcaagaattttaggatggggagtgttttagtccctctgcattgctattaaggaatacctgagaataggtaatttataaaaaaagaggcttattttggcttacggttctgcaggctctacaggaggtgtggtgctggcatctattcctcgttagggtcctcaggaatcctacaatcatggcggaagatgaaggaggaccaggtgtatgacatggtaatgagaggtgacagcctgccggcagccctcacagccctcgctcactctcagcgcttccttcgcctctgcgcccactctggcagcgcttgcggcgcccttcagcccgccgctgcgctgtggggcccctctctgggggctggctgaggccagagctggctccctctgctggcgggaggtgtggagggagaggcgccggcggtaaccagggctgcgtgcggcgctcgcggtccagcgcgagttccggttgggggtgggctcgtcgggccccacactccgagcggccggccggtgcccgcgcagtgaggggcttagcacctgggcgagcagctgcagagggggcgccaggtcccccagcactgccggcccgccgtagccacgctcgaattcttgccagcctcagccgccttctcgcggggcaggtctcaggacctgcagcccgccaagcccgagccccgctgaggtggcctcctccacgcggcgcccggtcccatctaccgcccaagggtgaggagtgcacgcggggaagggtggggcggtgggggcgggactggcgggcagctccacccatggccctggcagggacccgctatgcgaagccagctgggctcctgagtccggtggggacttggagaacttttatgtctagcttaaggtttgtaaacacaccaatcagcactccatgtgtctagctcaaggtttgtaaacacacccatcatcaccctgtgtctagctcaaggtttgtaaatgcaccaatcactgctttgtgtctagttaatctagtggggacttggggaccttttgtgtctagcttggggattgcaaatgcaccaatcagcaccctgccaaaatgggccaatcagctctctgtaaaacagaccaatcagttctctgtaaaatggaccaatcagcaggatgtgggtgcggccagataagggaataaaaggtgcccaagctagcattggcaacctgctagggtccacttccacagtatggaagttttgttctttcactctttgcgataaatcttgctgctgctgactttttgggtccccattgcctttatgagctgtagcactcacagcgaaagtctgcagcttcactcccgaggccagcgagatcacgaacccactgggaggaatgaacaactcccaacgggaagaatgaacgactccagaaacgctgctttaagagctataacactcaccacgagcgtctgcggcttcattcttgaagtcagtgagacaaagaacccactaatttcagacacagtaagacaggaagcaggagagaaagaggtgaggaagttctaggcgcttgtaaacaagcagatctcatgtgaacccatggagtgaggctcatttgttactgcgaggatggtaggaagccattcatgagggacctgaccccatacccaaacactttccactaggcctcacctccaacagtggagatcatatgtcaacatgagatttgaagaggacaaacatttaaactgtatgagggagagtatgctgaatcatccaggtgagcctaatgtaatcacaaacatccttctaaggagaagagaggcaagatatttagagttgaaggaattagtgacaaaagctgaggtctaggtctgtcagttcaggaatgcgaactccttttggaaatggaagaaaaacaataaagcagatatttccaaaaactgtacagaaggtacacagccctgccaacatcttggttttaggacttccaatatccaaatcattaagtaagtaaatttatacagtttaaacctcagtttgggccgggcgcggtggctcacgcctgtaatcccagcactttgggaggtcgaggcgggcggatcacgaggtcaggagatagagaccatcctggctaacacggtgaaaccccgtctctactaaaaacacaaaaaattagccaggcgtggtggtgggcgcctgtagtccgagctactcaggaggctgaggcaggagaatggcgtgaacccggcaggcggagcttgcagtgaaccaagatcgcgccatggcactccagcgtgggtgacagagtgaaacttcgtctcaaaaaaaaaaaaaaaaaaaaaacaaacaaacaaaaaaaaccacagtttggagtaatttcttacaggaataggaaactaacataattatccaataataaattgtgttctttttctcttctgtattgatacaaaggattctttctattggtagcactattttatttttataacagtacagaaaatagaagctggataattatatgatgaatataaagaatagccagggctcacatctgtaattcccagcactttgggaggatgaggcgggcagatctcttgagctaaggagtttgacaccagcctgggcaacatggcgaaaccccgtctctacaaaaaacttagctgggcatggtggcacacgcctgtatttctagctactcaggaggctgaggtgggaggctcacctgagcccaggagacagaggtttctgtgaactgagatcacaccattgcacaccagccttggcaatagagtaagaccctgtctcagggaaaaacagagaaatagactgaaagctcctgtgagggtgattcatcacttcttcagtaaatcaaatctgaagtttctagtgtattttcttagttgatgcattttttaaaattctgtagtaaatcccgttgctagacgaagagctaacaaaagatagtgcttttaaatgaaatgtgtgcactattttaataagaatgttcatgatgagcatgtcactccataaaatattttttgacaacagctgtctaccatggcagatggaggtggtgaagatatcactgaactcatgaaaccataggaatcaagtcttctgaagtagcaccattatcaacttccacagtgagtatatattctaaaaacacagtgatattacatgtgcagctgcagaaaaccattcatatattatcttgatgattattttgatcaaatgacttttcatctaaattaattataataatttttatcaaagttttcatgtgcacatagaagagtgaattgatatttgtgaatgcatgagttgaactggcagaagaaaatatttgcaaacagttaaaagctgaaaattttataccaatatcatctaatgcattaagtagaaaatcagctaactgcaaaaaatgattcaagtgttttcattcaatttaggaactcaaagtaatgttttgaaagtacatttcaataaggtagattacatgacattttaaagtatgttatgataaatccagtgaaaattacatcagtaatattatattttttcttgataaaatgcattgtgaatttggtaaagcaaatgtcattgtggaaacaacattttcataaggccagaattaccgtgcaataagttgtaataatttaatccaaacaaactttaatagactaccagttaagaagaagctgaagttattaaatttacacacacatacatgtcacatcacaactttttaaaaatatgagactgatgccaatgctaaatatacaaaattactccagtatgacaatatttactttctatttctgctgcccattgtaaatttgaatgtataaacttttgaagaaatgattatctataatgctattcaacacttttattaatagagctgataaaattgtttttatttacttgcattttgtcccaaattgacaaataaatctccagaatattcaactcttggaagctttctagtgaattgcagttattcaaaacaaacatgcaaacaagaagcgattgtagtttatcccacaaaagcaagacaaatctaaacaaatttagtgatgggaaattatttaatttgaaaattatctaattgaactttagaatatatggacatgtggggaaaatccatttatttccttaggtctttaagtggataaattgataatcctttactgaataaattgaaaatgataaagtcagcaattttgaatcatctacattttgcaatatactctaaaatttataaataatgataatttacttgataaattttgtcatataaaaactatttgccaaataaagattctcggaatcagggagggaaaaccccccaaaaaacttgtatttgtgaaagtatttgcactgcagtatttatagatctcaattaaaaatggaattgagtaattcttgtttttaatcgaatttattctgagcatataaagtaccactctttatttagaaaaatatttttttcaaaaaaatattattttctacaaaaaaggttaattaaacttttaactctttcaaaaattttaaccataaaaataaatgatatagaaaccttttggcaattatttaaaaattaatcagaattagatcagtttgaaatgtaatttgcttttaaagaaaatgctctgaatattagaaacagctaggctcattaactcattagagaatggaaatatatagtaataaattactttttaggttatcttttaatattcagatggacaacatactttagtcagtcaataaaacttatcaaatgtgttcattttattacaccttttcaatctaaaacaatttctggttttgaaattaaatatattatcacttcaatcacatctttgtcttatttgcataaagtaggagagtgcaagaggtcttggctcatattacaaaatagatgattttccagaaaggggtacaatttatcacctaggaccactcccttccttgacccttagaatctaccctactctgtttttcctgacttcacagatgatctcctgatctcccttcatatttacttatttctgataaagattatgtgaatctgtgcatatacttttttatatatttccccccatacaatatgtttaatttctctatttttttaatgtgtgcacgtgcacatgtttatgaatcttttggtcgaatggaggtggagattgtgggcatggcttacaaataaacagtcatgttgaatggtcattgttgtgctgtatttaaaaaattagtagagaatccatatcatagtgaaagtgagtttttccttcatgtatttatcttggtctttttcgcaagcatacttcctttacttctagcgtctggtttctccattcatttctatcccttctgcaatgcttcaaatacctccagatgtttcattagaggtataaacacagtatgcagaatataggagataaattctcattaattataactagccctttttatttcgtatataaagaaatgtcattttaatttaaatgtattaaatgcaattctaaaaaaaaaagtgcttagtgacgatagagtaaaaaatacagcctcgaagttagtcaaaaagattttacaagtatgtagtacaatttaaaaattaagttgaattaaatgatatctcggcaacttgaagcattgcaaagaatggttataatatttgacgtattaacacataattatgaaaagattatgattgttacaattcataattatttttgatgagaattattgtattttatatctactatggcttttagtgttgtaatcttgagaaaaaaaatttagactgaattacattttgcaagaaaatataaaatatactcacaaacctataccacagaaaaataatttagacagaatattgactaacatttaaaaatcttatactactcttaaaaatgtgcatagatctcataatggctcgttcttgaattttgccaaataataatgtaggtaaaatcggactttagtaaattatttcttataaaatatatttcaatatagtagtcatgtatttgtgctaatatggaatttcaaaagagtgaaaagcttttaaaaaaaacctaaaagctattttttatacttccactcttccctaatttgtttttaatgccaaaaatgattttagatagcctaagctaaatgttatcagcgtttatgtacagagcaatcttctttcccgtttatatgagtttgaaatgcagtagagaaagaaggaggaagcagtacttcgagtacatagggccacaaaaaaaaatcacaatcatgcaggaaaaaaaaaataatcaaagtaatgatgccgtccagtctctatctttcaagtctccagtttctctctgaatttcagactgtgagaccattctgtctttcagctgagcaattactctgtcagggggtatgttcacctagggtcaagccctgctgtgtgcatagagaaaaatccctgtagagattcttctttcaaaaagttttactctactttttgaataaaaaaaaaaactgacagttatctcaagaggattttcagaggaaaatatttgacctatattgcttgaaaaatgtcacttgaggaaaagaaattaaaaagttatacttctccagggtctttttgagcccaaatatctcacatttttgtggattgttagagtcacctagaattcctttgaggttgtatggacatttgtcttccagattaagacagagaaaattcatgcaatatttgttgttctgtaactggtttattttacctagcataatgtcctccaggtctattcatgttgtcacatactgcagaatttctttctgttttatggctgagtagtatttcattgtatgtgtagaccacattttctttccccttttatgaatgaatgtttaggttatttccacatcttggctagtgtgaataactctgcaatggacatgggagtgtagctatctcttcaagatccttacttcagttcttttggataaatacccagacatgaaattactggatcatatggtatatctatttttaactttttgaggaatgtgcatgctgctattagtggctgcatcattttgcattgttgggcaagcttttcaattggtctgaaatgtattgtttcttatgtatgaaataaaattaacagactcacctacaggattatagtaagaattagatgaaacaatgcaatttcctaaacttctagatattaaaatagttaattacgtagactcagaatagaatggtggttgccaggaatgggaaagaggggaaatgagtagttactaatcaaggagcatagttatgaatgaaggagcaaaatgaatataatctggagttctgctgcacaatattgtacccatattcaacaataatgctttacgcacttaaaatttgttaagaaggtatatttcatgttaagtgtttttatgacaataaattttaaaagttaacttacatttaataaaatgcacacattttaaacttaacaaaagaagatttaaaaaatcctgaagaattcgacttaaaaagttttaactttgaacaacagcaaaaatacctatgaggtactcagaaatctagcatcaaaaattaatgattttttaaaaataaaagcacattctatgatatggtttggctgtgtccccacccaagtctcatcttgaaacgtagctcccacaatttacatgtgttgtgggaggaacttggtgggaggtgattaaattatgagggtggttgtttcccatgctgttctcatgagattgaataagtctcaccagatctgatggttttaaaaaggaaagtttccctgcacaaagtctcttctctgtctgccaccatgtgagacattcctttcaccttccaccatgattgtgaggcctctctagccacaaggaactgtaagtccattaaaatttgttttcttcccagtctcgggtacagctttatcagcagcatgaaaatggactaatatagtaaattgttactaggagtggtgtgttgctgaaaaggtacctgaaaatatggaagcaactttggaactgagtaacaggcaaagggtggaacagtttggagggctcagaagaagacaggaaaatgtggaaaagtttggaacttcctagagacttgttgactggctttgacaaaaatgttgatagtgatatgaacaataaggtccaggctgatgtggtctctgaaggaaatgaacttgttggcaactggagcaaaggtgattcttgttagcttttagcaaagagactggtggcatttttcctctgacctagagctttgtggataccagattcagggtatctggtggaagaaatttctaagcagcaaagcattcaagaaatgacttgggtgctgttaaaagcattcagttttaaaagggaaacagagcaaaacgtcttggaaaatatgcagcctgacaatgtgatagaaaagaaaatcccattttctgagtagaaattcaagccagctgcagaaatttgcataagtaacaaggagctatatgttagtcaccaagacaatggggaaaatgtctccagggcacgttagaggtcttcatggcagcccctcttatcacaggcctggaggcctaggaggataaagtggttttatgggccagcccccaggtctccatgctatgtgcagcctagagacttggtgccctgcatcccagctactccagccatgatgaaagggtccagtgtagagcttgggcatggcttcagaaggtgcaaaccccaagccatggcagcatccatgtggtggtgttcctgtggtgcacagaagtcaagaattgaggtttgagaaccttcacctagatttcagaggatgtatggagacaccaggatgtccaggcagaagattgttgcaggggcggtgctctcatggagaacctctgctagggcagtgcagaagggtgatgtgggtgggagcccccacacagagtccttactggggcactgcctagtggagctgtgtgaagagggtcacttccctccagactccagaatggtagatccattgacagcttgcaccatctgcctagaaaagccacatgctcaactccagcctgtgaaagctgccaggagggaggctgtactctgcagagccacaggggcagagctccccaagaccatgggagctcacctcttgcatcactgtggcccagatgtgaggcatgtggtcaaaggagatcattttggaactttaagatgtgactgccatgctggatttcagacttgcatggggcctatagcccctttgttttggcccatttctcccatttggaacagctatatttacccaatacttgtacccccattgtatctagaaagtgactaactttcttttgagtttataggctcatagttggaagggacttgtcttgtcccagatgagactttggactctggactttttagttaatggtgaaataagttaagactttagaggactgttggaaaagcatgattggttttgaaatgtgaagacatgagatttgggagaagttaggggtggaatgatgttgtttggctgtgtccccaccaaaatgtcattttgattgtaactcctataattcccaagtgtcatgggaggaacctagtgggaggtgcttgaattatgggagcaggtctttcctgtgctgtgctcatgagagtgaataagtctcaccagatatgatggccttgttttgttttgttttgttttgttttgttctgagacagagtctcactctgtcacccaggctggaatgcagtggcatgatcttggctcactgcaacctctgcctcctgggttcaagtaattcccttgcctcagcctcctgagtagctgggattgaaggcatgcaccaccacacctggctaattttagtatttttagcagagatggggtttcaccatgttggtcaggttggtctcgatctcctgacctcatgatccacccaccttggcctcccaaagtgctgggattacaggtgtgagccaatgcacctggcccagatctgatggttttaaaaagggagagtttccctgcacaagctctcttctcttctctgctactgtgtgagatgtgcctttcaccttccgccatgattgtgaggcctccacatccacaaggaactgtgagtccattaaagcttgttttcttcccactcttgggtatgtctttatcagcagcaagaaaacggactaatacactatataattgcatgctactttttttatttacaaatcttttggcaatacaaatttgtacaggccctgtattagtctgttctcacactgctataaagacatacctgagactggttaatttaaagacaagagatttaattgactcgcagactcatagttctgcacagctggggatacctcaggaaacttacaatcatggcagaaggtgaaagggaagcaggcacatctttccgtggtcaaataagggtgaggggtgctacacactttcaaacaatcaatctcataagaactctatcatgagaatagcaagggagaagtcttcccctatgattcagtcacctcccacctggcccctctttcaacactgaagattataattcaaaaagagatttgtgtgggaacacagagccaaaccatatcattctgccccatcccctcccagatcgcatgtttttcttatatctcaaaacacactcatgttttcccaacagtccctcaaagtcttaactcatttctgcattaactcaaaagttcacaatccaaagtctcatcttgaacaacacaaggcccttctgcctaaaagcctgtaaaataaaaaaaaaaaagttagttactttcaagttacaatgagggtatagtcatttggtatatgcttgtattccaaaagggagacattggccaaaataaggggctacaggccccatgcaagtacgaaatccagcaggtctgtcattaaattctgaagctccaacacataatctcgtttgacttgatatctcacattcaggccacactgatgcaagaggtgtgctttcacagccttgggcagctttgcccctattactcttcaggactcatctctcatggctgctcacaagaactggcactgagtacctgtggttttttcaggtacatggtggagcctgtcagtggagctaccattctggggtcttgaggacagtggctgtctcctcaaaggcccactagacaatacctcagtggggactctgtgtgggggctccaaccccatatttcccctttacactgccctagcagaggttctccatgcaggctctgcccctgcagcagacttctgactggatatccctgcatttccatacatcctctgaaatctaggtgaagtctcccaagcctcaactcttgccctctgcacaactgcaggcttaacaccatggggaagccatcaaggcttggggcttgcaccctctgaagtaatggctcaagctgtatcttgtccccttttaggcatggctggagctgaagcagctgagatgccgggcaccatgtcccaaggcagcaaagaacagcagggccctgggtctggtccacacaaccatttttccctcctaggcctctaggactgtgatgggaggggatgctgcaaaggtctctgaaatgccttggaagcattttctccattgtcttggatattaacatttggcttctctttatgcaaatttctgaagttggcttgaatttctcctgatttttttttctaccacatggcaaggctgcaaattttctaaattttatgctctgtttctcttttaaaggtaagtactatttgcttatgcaaatgagtgtagcttttagaagcagccagctcacatcctgaatgttttgctgcttagaaatttcttccatcacgtatcttaaatcatctctctcaagttcaaagttcaacaggtttctatagcaggggaacattgccacaagtcttgttgctagagcatagcaaaagtgaccccttctccattccccagtaagttcctcatttccatttaagacatccttggcctccacttcactgtccatatagctatcaacattttggtcacaatcattcaaccagtctctaggaagttccagactttccctcatcttcctgtcttcttctgagccctcaaaactatttcacctctggccattattcagttccaaagctgcttccacattttcaggtatctttacagcaatacccttctgctctggtaccaatcttctgtattggtctgttcttatactgctgtaaagacatacctgtgactgggtaatttataaagataagaggttgaatcagctcctgttctgtgggctgttcagacttctgcttttggggtggcctcaggaaacttacaatcatggtcaaagttgaagaggaagaaggtacatcatcacatgacctgagaaggggagacagagagagagaaggaggaggtggtacacaatttcaaacaaccagatcttgttaaaaactctatcatgagaacagcaagggggaaatccaatcccgtgattcaattacctcccacgaagaccctcctccaattctgagaatgaaaacttgacatgatatttgggtgggataacagagcaaaaccatatcaggcccattataaatttaaacaagtagtagtatatatatatacacacacactttttgacatgttttagtactgtcatctgaaataacaagcagtggcttataaagtttatatatttttataaataaaagttttaactgatacattttcatcctgtcaacaaaagatccaaaggctttaaatttattagtggagaaaattggagattacttattctggtcagatttgttactaggaaaatcatcctccagaaacactgagatatactagataaaataaaaacttaacatacagtaggctataccatagtcatgaatgtatagggatattattaatatcatttcactaaattgttctatgtaataaatgtgacaccaaaatctaaacaatgtatgtaacaaactgtctaaaaagtgtatatgaataaaaaagtcctaatagaaccaagatatttaaagagttgtttaaaatctatggctttcacagtaagacatttacattaattataaaactataataattaaagccatgtgtcattggcacaggaagaaatgcagaaatgtatctatatataattggaaattggtatatcaattcttaggtatgctccaagtaattttatgtcacaatactagtgttattgcagtaattaaatcataattatgtaaactcaacatgtaatttaacagaagtcttcttcctcacactcagcactgctccacattgaaagcctatagtgagaaaaaaataaaaggatatactaggccatgtgcttctccttgtcttctctttgtctaggccattgaaagcctatagtgagaaaaatagaaaggatatactaggctatgtgcttctctttgtcttaactacataatcccattgtctctctagcctaggttcaatatcatccaactaggtaacagttgcagggaagtaggaagttttattggtgagtagatttgtaatcccacaatgaaacctttttggatgtgtagactgacaactgctgactttttgcttttggtcactttttgtgacttgagaatttttggatgatgcaggtagtctgaatttgaaacacaaatgcatttgtaggctagtctatggtaacatattcctagccaagaatttgttcccttcactcagcactagttttccaggagacagaatctctttataagccatattgcaagatgaattcatatctaattcatcctaatatgattgtgtagacttttgtgatccatgtttccatgtgaaagtttttatttgacactgaactttgggcgagatctagaattgactctttcttccataatttctagtggtcttcaaaagagaaacatattctttagtgtaaagcaaatgtttcaaaggtaaaatgaaggttagaactacgtgtcccctcagcattcacaatcacatttttatttttattttggcttctgagaatctttacttttgggctctaagaatttttatgtatctatttgccaggtgttttctctctctctctgtctttcacttttcttccatccctcccttcttctcttttcctgtcttcatcgctacatctgtcatcaacctactacattttaattatatttagtgacgatgtttgtgataaaattaacagggtgattctaaatgatatggaattcttttgctctgttgccataatacattttggaatcaatctagattctaacaatagattcagataataattcatatttgaacttattatttatgaatattctaaaagatatatgtgataggataaatcaatgctggctaaacactattttaaattcaactcttttctctttttctgtataatttcatccactcttgaagtaagaaaataacatgttcatttttcattttcaagaaatttgagtaaaattacatagagacagatttgaataagagtacatgttcaatgttttgagaagtgccacgtttaagttagcaaatgttgggaaaggtaattctgaaaatcacagtactcttatacacttggttagactattataaaagactagaactctcctcccacaaaattatacttcagattttctttgttcatggccttaaaaacaaccgtgtaatcagtgccagatttttcaaatcagcctatttgttacaaactaggcaaagggcaattatttatactagtaaatggttaaaaatgactatttctatacttagtaatactgatatcaagttctacaccatccctaaattttagtaatgtagccaacctataagactatccttaatcccatgatacgaagaggtcttggagaatgaataacaagtttgtttgtgaaaattaaaatatgcttcatttggtttattcaggacaataggatgtgtgacagattaaatgatctatatagccccaaaacactaaattagcttgcagcaatgtagcctgattgctcagcattgctcagatccttgactctgctttaaagcttaaaaacaaatttcattatctactcaattatggtgcaaacattgctgatctgatgccatgataaactaaaccttgttcattaatatctcatggcttgtcaaacatcacattatagtgtataagcacaatgaatttcatgtcaactcattgctctcttcatagaaggattaagaatgtggactaactatatgaaaagatagcattgttgtcacagatttggtgtgttttcttattcttatgcttttgggttagaaagtagagaatggttagatttggagaatcagagaaaatgtcatcaaccaagctgctttgactttctcctgcttttgactttttacctcccaacctttatcacgtaggactgtttttaataattttatgttgttattagattaatattttaattttatatttcaagcaaattaaaagaaactcagagttattcaattggaatgaaaaggcaaattaaatgagaaattgatcattcttttcatgatagcagaagaaagcaaaactatgaagatggtgatctatgatattataaggttttcctctctctttttgctttaggtaagaatccaggcacaaagttcatgactcatttatcattttttcttatatgtggctgttaatttactctggtactatattaacaaatgatagtatctaatgtttatttgtattctaaaagtttaagaattgaaaattttgattcaatataaaaatgaaggagagcttttgaaacaacaggcccaatcaatagtattaagtacaccctccccatatataacaaggtaaaagtctgtgaatcaaaacatgagtgggtttacacagactgagagaaaatcttcacaatctatacatcggacaaaaaacaatatccagaatctataaaaaactcaaatcagcaaggaaaaaaaaaaaaaacaattccatcaaaaagtgggctaaggacatgaatagaccattctcaaaagaagatatacaaatggccaacaagcatatggaaaaatgctcaaattcactaattatcagggaaatgcaaacccaaaccacaatgtgataccactttattcctgcaagaatggccataatcaaaaaatcaaaaaacaatagatgttggtgtggatgcattgaaatgggaacacttttatactgttggtgggaatataaactaggacaaacactatggaaaacagtctggagactccttaaagaactaaaagtagacctacagtttgatccagcaatcccactactaggtctctacccagaggaaaagaagtcattatacataaaagatacttccacacacatatttatagcaatacaatttgcaattgcaaaaatatggaaccagcccaaatgcccattaatcaacaagtagataagaaaatgtgatagatagatagatagatagaatgtgaatgccattattttgttccttttcatggctgagtagagtgtgtgtatatacatatatataaaatatataatattttatatataatgtataatatatattttataataaaaataaaattatatattttacaataaatatatatttatataataaatataaaaatataataaatatattgtatatattatatataaatattatatagatatacactgagtagtgcatttatatctatatctatctatatctaaatctatctatctagcaacttggatggaattggagattattctaagtgaagtaactcaagaatggaaaaccaaacattgcatgttctcactcatatgtgggagctaggctatgaggatgcaaaagaataagaatgatacattggaatttgggggcttgagggaaagggtagggagtagtatgggataaaacactacacactaagtgcaatgtacactgctcgggtgatgggtgcaccaaaacctcagaaatccccactaaagaacttattcatgtaaccaaaaaccaactgttccccaaaaacctatgaaaataaattaaaaaattgaataaaacaaaacaaaacgtgagtgagtttaatttttaaagcaccatgaacatcctgcatatggaaagagattccattagatgatttcaattatattaactttttaaatttgttccatgtcgctcttcttttatttatgtgaattaaattttctggctgaatcattttccttctacctgaataactgttttaacttttttttttcttttttgcagagcaaatttgctagtgatgaattaccccagtttttgtttatatgagaaagcatttatttctcctttatatttaaaagaatattatactaggtatagtagtgtagcatggcattttgttttgttttccttgaacattaaatattttgttctacttccttcttgcttccatggtatctgaacacaagtctactgtaatacatatttttgtttctttataaatttgtacattctttctttcctctggcttctttcagtattttctcttcatctttaattttctgcagtttaaacatgcaatttccaaatgtggggtgttaaggtgtttattctgcttggtattctctgagattcttatatctggtttggttaactattattaatattgtaaggttctcagtcattattacttcaaatatttgtttcttgtctattctctttttcttcttgtattccaattacatatgtgttatggatttagatattgttcaacaatatctattgatattatgttatattctgaatattctgttctattttttcatattttttttctttttgcatttcagttataatatttcaattgacttattttcagagtcgatgattctttcctaggtagtgtccagtatactgatcaccccatgaatgctaatttgtatttccattgtaagattttttatttctagagtttcattttagtactttcataccttattcctctttctgagtacattccccatctcttcttgcatgatatctgcttttcacatccatcacatttattttaaattttttgtctaacatgactaatagctatgccttttgacctgccttgcaatttttttgttgaaacctagatatgtcatatcaggtaatagaaactgagataaagagacttccagtgtgaggacttatgttaatctaagtaggaatggagctgtttttgatgtttgttgttgctacaggtatcagatgctacaattctttcagtgcctttgtttttgtctttcctcttgtttgggggctttcctgagtaattcttcttagagagagtccacactttgcaagactttcagctctaattcacttttattgtaatggagccctactgatgcgacagtagcatgtgcagaaggaggattattccataatcttctgaatacatttaatcctttggccaatctatatcttaagactatggctttgggaagtgcttttattcagtggtaaagcactttctttttctttttcccccactgcttcttagtttgacttcagtttccaaatatattttcttgaactcctgttccaaactgaatatattccccctttctcctccaagtgagacagaaaagctgaggaactggagacaaaagatatttctttcacagttgtgttctggtgaagtcatttccccggagaataacacttcattatagagacaactctttgaatgtttcacaatgatactcttctcttcctttttccagagtgacaaagggatctttctgggcccttcaccattaaaacctggtggagattctgggggtaaagctcatgaaagtatgcaaaccctctaagattaagctttcaggagtttctcactctcaactcagtgtacacccaaacttttgtaggttgaaactcaaactccataaaatttgtgaaattataatataaatgcttctaccattttatggctttagtgacttttgctacagagctcctgtttatctccagatgtgcttgtctcttcaaacttggggatgatggtttactctgtgacttcagttctgtcgtggaccagaaaagtcattgatttttcacattgtctattttttcttgttgtaaggacaagagtgattgcttccaaacttcttacatgtcagaagtgaaacagaaacattgttttgtctactgtgattactaaacaaaacaaaaaacaggagcagataatttgaatgcatttgctgctaaataaaagcatgtatttatcttcttgtgtccttactctcacttgattttacagatactttatagataaaattaagataaattttattgttaaaatacatagatctgaatattacagggaaagtctgagtagaccagcacagctgcaacccatacttttgtttatattaattttatgtggaacaaaccaatttttattacattttgaaaccccagaatagcactatgtttatcaactacagcaactgattgactcattggagattactatacatatatatatatatatatatttctatggaaactagtacctaggaagtaaagaaaattagctaaaatatgcctgtattgttctgctattgaagtagaaatttgagttggaataaatatgttaaaaatgtgccctgatgaagaattattttaaaaagatagaataaaagtaaagagtggtttttgggaaatgacaaaaattaataaaaatatattaccaactgtaattatttccagattattatgacagaaaaatatatgagccactgcacccggccataccattctatatttttttaaaaatccatgtaagataattagtgatatttttccaaagttttaaaaaatctttattatttattttttctgaattttggggggacatactaggtataaatatttatggggtacatgaaatattttgattcaggcaaacaatgtgaaataagcacatcatggagaatggaatatgcatcccccccagcaattatccattgagttgcaaacaactctattacactctttattttaaaatgtacagttaaattattattgaatatagtcactctgttgtgctatcaaatagtaggtcttgtttattcatttttttttttcggtatccattaaacctccccaccttcccacaactccccattacactttccagcctctagtaaccacccttctactctctatgtccatgaattcagtcgttctgatttttagatcccacaaataagtgagaacatgcagtatttgtctttctgtgcctggtttatttcacttaagctaatgatctccagttccacccatgttggtgccaatgagtgaatctcattctttcttatggctgaatagtacaccattgtgtatctgtaccacattgtctttatccagtcatctgttgatggacactgatgttgcttccaaatcttggcgattttgaatggtgctgcaacaaacatggtagttcagatacctctttgatatactgatttcctttatttggatatataccaaggggtgggattgatggatcatatggtagctcaatttttagttatttgagaaaccaccatactgttcttcatagtggctttactaattaatttacattcccaccaacagcttacaagtgttctcaattttccacatcctcaccagcatttgttattgcctgtcttttgaatagaagctgtttcagctggtgtgagatgatatctcattgtagttttgatttgcatttcttttatgatcagtaacattaaggaccttttcatatgcttgttttccatttgtatgtcttcttttgagaaatgtctattttaatattttactcatcttttgattgcatcattaaattttttcctatagagttttctgagatctttatatatttggttattaagcaataattaatggtacttttacaatattattgtccttataaaaaataaatttgttaggcttttatatacaaattttccatgcttaaactagatacaaactttgtagacccaagtgaaaagaatctgattgtataagtactaataattataaacaaaactcacaaaatttctgacttcacagaacaaacagaacttttaaattttaattattttcatctactattgtttgtatcttaaatcaatttctctcttctttctttacagaagcttaaagtatatagtgttatctaaatatttcgcacaattacccagatgtagactaacccaatcagacaaatcatctttttactttaggggcatgttaattgaaaaggcgttaataattaagctagataatccaaagaaacttttgcttgaaatgctgcttcaaatatgcttttcaaggtcatggtgaaatatctgagtatctcacggtgttcacttctatcttgagaccataaaacttgctgctgtgatttgagcatttgttttccaaatgtcaagttgaaatttgatcctcagtgttgtggtgtaggaaggtggggctgagcaggtggagtctggctcatagggaataatcccttggtgtcatcctcacagtaatgagagagttttcactattagttcccaggataactgactgttaaaaagagcctggctacctcccacccatctccctcttgcttcctctcttgctatgtgatctctgcacatgtcacctctccttcatgttctaccatgagtggaaatggccttaggtccccaccggaagcagatgctggtgccctgctgcatgtacagcttacagaactgtgagccaaataaacctcttttttaaatgaattacccagccttgggtattcttttatagcaacacaaaatattaaagtattaaaattatctttaactcattattaatagaggaatggattaggtgtttacagcatatttaaaggagaatgcaaagagcaaacacatttatatatcaagtatattaaaataaattacaaatgcctgccacactggcttttttctaagtttgggagatggaaagtaagtctctttacaggataaaaatgtttgcatatgacttgccattgttttcttcagtataacttgctttaaaatatcccaaagtcaatgaaaggatagaaatggctaagccaggagggtattcttgctccaaacaatgatcagttttccactgagacattgtacatggaaataaaaattattttaacaatttataaaggtataagggaccattttccctttgttcttcatttttttgtagtgtttccttggagacagtgaatctgactctaacatttgacgtgaagataaatctctttaggaattattcccaggccctggtttttacaaagttgatttattgccaagtttgcaggtcaaataatctctgaatatataaacatgttctaccagaattagctcagatgtctcttagtacaaaagactatcaggaggtgcagactgtctgtatcttgaagagataagagaagttttcattgttctttattctgctttactacttaaatttgtgtgatactctatacatttttgtatttgctttcatgctctcatacatgaatgtaaatcagttaacctttattcagtaataaattgtttttctgtctcttttctatgctgctatagaggggttctttgttggcaggtgcgttttattttcctgataaaactcagtaatcatttttgcatactttacactttcttatatttctcagttgacacatatgctctaggtattatcattatttttattttttcaatttttatttattcatttattttgtgacaggatctcactctgtcaccctggctggagtgcagtggtgtgatcatgattcactgcgacctccatctgctgggcttaagtgatcctccctccacaacctccccagcagctaggactacagttgtgcattatcacacccagctaatttgtgtttaataatttgtagagatggagtctccctatgttgcccagactggtctagaactctgggctcaagggatcctccctcttaggccttccaaagtgctgggattacaggtgtgagccactccacctgggtagcattataattctttaagtgtctttaaaaacaagataaagattcggagaagtatacatggatccactttagctaaattcttattgtgaaatagttctttaaaagttaatttaccctcaggttattttttattaataatattcttatttatacataattttcttgttaggtagcttaaaactattccctctaattaagatatttaaatatatttatccagaaatatacatactaaactcctatatcttacatcttttttctagtccctaatgatttgtttacaaaaattaccaaacattttatttgactttcactaacttctttatatcatttatactttaaaataaagtacctacctatccttacttggaaattttcacttttaaatttttttctgaataattactttatactcatccctttcaaatttattaagttgaatgttcagttgcctattattaatgttaaatggagagcatatttagatattttttctaggaaactatttttttttcaaaaattaaaataatttttttggagagaaaacggggtgagctggctaaatagaactctccagtgaacatcaccccgtaggaacaccaaatcgaacaactctcccgacaagaaagcaccttcatatgaaccaaaaattgcttgaatgacaacagtatctggttttaacattatatcaagaaaagaggcaatgaagatggtaggaaagacagtcttgaattgctgacaccacctttcccccatcctccaacacacagtgtggtgaggagagagaatcttgtgcttgggaagggagagtgctgtgattgtgggaccttgcattggaactcatcactgccctgtcacagtggaaagcaacacaaggcagaagttgcctgggactcatagaggaagcatttagatcagccctatatggaaatcattgatctcagggctcagaacatgagtttttgcaagccttgccaccataggctatagtactctggggttttaagtaaatatgaagggcagtctaggacacaagttaaaatagcttatatccaaaagacaggcaataacaatgctactaaggatgtggagaaaggggaaaccccgtacactttggtggcaatataaattagtaaagccactatggagaacagtatggaggttcctctaaaaactaaaaatagaactaccatatgatccggcaatcccactactaggtatataccccaaagaaagaaaatcggtatatcaaagatagtatatgcaccctcttgtttattgcagcactgttcacaatagacaagagttggaagcaacctctgtgaccatcagcagaggaataaataaagaaaatgggattcttctacacaaagagtactaatcagccataaacaagaataggatcctgtcatttgtaacaacatgtatggaatcagagcatattgtgttaagtgaaataagccaggcacagaaagacactcttcttcccatgttctcattcattttggggggctaaaaatttaaaaaaattgaactcgtggagatagagagtagaatggtggttgtcacaggctgggtgagtagtacagagagcgggacaaccgggatagttaatgggtacaaaatatggttagaatgaataagatctaatattttatagcacaacaggatgactacagtcagcaataatttgttgtacattttgaataactaaagaagtacagttagattgtaacactaagaaattagaaattatgaatgcttggggtgtcaaatagctcatttactctgatgtgattattacacattgtatacttgtatcaaaatatctcatgtgccgcataaatatataaacctactatgtacctgtaagtttttttaagccaacttaaaaaatgctttaaaagtgtaccaacaaattttataagcaatattattcaatagtcatctggtaaaacaacctgtaattattatttggtgttcatgcacaactacgtaaaagttcttctttctttaattaaaaaaaactctaatatgtgcatgttttcagttcaaatgttttattacattctgggacaattgccttgacatgataaaacatggcctcagatattttatattttttacatttgttgatattttggggaaggaaatgtatacttcatttgttaattaatttttaaaaaattattagtctgtatttgttggaaaccatatcctatatgtaacttgaaatcaaaataaataatgacattagttctaatcagtacttctgaatttgttttaattttaaaatgtcatttatagcaagtgttttgggttaaaatatcttattgatatggtgagtctgtcaaatgtccttcatattcatttttaaaaatttaaatttttatatataaatgtatatatatccaatataacctgaaaattaaacattaatgagagctatagctgataggtatattaaggaagctttgataacataaattgcttgcctgccatttaacaatttttgaaatgaattattgtctgaatagtttcaatatatgttttattttatgaatttaacaaaattcttttttcttgatttagctaattttaatagagtgttttcttatcaaacatttacttatcttctaaaactccattcttgcaaactgtttggagggatttgtttttatttttattttgtagtatagctcatgtatctagaataacttgttatgtttgttatttcatcatcataaattggcttatatttcatatgcttgcagacatatagaataatcgaaaacaacaaaattatatgtatatacatatgcatacacacatatgtaaaatgtgaatgttttttatgttttgccttttattacacgttctgccttttattacatgttttgccttttattaaatctcactttgctcttcctcattcttttcggggagacatactttttcttttaaattctactactggctccttacaaaattaactatcctttaaagtttatttattaaatttatagagtcaagtttgaaaaattgttttatttcatcctttatgcaacaaggtatttattatacttttatttttcatcatctgtgaatatttagagccaaatttttatggtctttgtggttttattcttgctatattatctctgtctggaatatttatttatgtatatatttattaaataagatttacataaaaggttgagccatttattttagaattaattcaaagctctttggatgtaattttattctaaggctttgttattcttaagttcttaattttaattcctatcactgtgatttagaataaagtgatatttcttcaataattgaaaactctgtcaggcatggtttctttttattgaaatttgcccagaatatagtataccctatgaatcttcataaatatatatttcaacctaagatatttatttatttttattaacataataatatacatacctttaggataaaatattaccaggaagctttaaaataaaatacagcagccatttgttgtactcttctatttttgctatgcagataatacattatttgatatttttacattccttgtaacttttacttctatatttcaaataatatatttgataattgttccttgtgctttgaattcttaaccatattgactgcaaacagtaagtaacaggcagtatctctgaaaccatccaatgttgtttctcacctataaaaaaaatttccttatatttaattatttatttactgtagcaatcactaaatcatcaccaaaatgcttaatatacagtgtctttagcatagtgtaaattatctataaacctcatgattttttgaaaagatgtttactgtacctctttagcctcttgtttcatttgagacttttattattagcacagctgaggtttgccaacctaaagcaagctcaaaccccagaagtgcggcagtaaactcaccaggaggggcaaaaactacgacttgagtttcactcctaaccagatatcttaacaaccacaattctttttatctcagaagaaatataagttcaaacaaataaattatttgtcatgtaattaaaagcaagcacagtgaacatctcaaggtaatccaacctgatattgaaataatgaagcaagaataattttataaagaactaatcagagattcaaaaaatagacaaataggaattggtataaaaaactcagtggatgatttgagaacagaagggttgccaaaaataaattaataatctcgaagatagttggagaatcttatctggatgatatcaataaggaaaaaagatggaagaacttaactaaaaaacaaatttgggagaagtatatatcacaaaaataggtatgaaataggtcaactgcattccaaaacttttgcctattaaaaatcatctctcatctgcggtggacatgtcttcacatatctccctcacccaggaacggccactgtcgccctgcttcaataaaggcgctgccatatcttccagccccctgggtgcctaatcctggagccatggcaagctctacagtgctcaaactctaaacacaggctctgtggccacactaggcttacccacatcttaggtattgcaacaatcatcacagtgagctaatttgcactccgagctctggaaccaagctcttgctacaagtgactgtgctccagacattggctcagctgccatagagagctaggccccacccttcccaatattggagccactgtaaacatgtgtacacctatgttcccatactcagcttcctggctacttcacaggcaactgtgcttcacaaacggttaccaaagtgacagcaggatgcctgcacccaattaccagcacagctgccctagacagcttggctctgtctccaatcccatagccactcttaactctgtgaatgcccacactctcaatgccctgattacttcacaagcatttataccttgcattctattaccaacagagcagcatgggtgtctatatcccaagcaccaatgccattactactgcaaatcccagagccataggctttctatgcatacccatgcttcaggtcttaactgtgtggctgctctataagcagcattcattcatcagacactaatgctgcctccacaatgatcaggcccacaagccagatcagtgttaagagaaatgacccctcttagacacaactttgctagtgaaaggaaaagagaccaaaggtaccttagcagtcatcaccaccaaagactctaacaactctcacagtcactgtgaatatccatagcatttgtgattgaagattcctacaaactctgtttataccacctcagttcacagagctgcagagacaccataaagggactcccttactggtgctagaactgctgcatcccaccttgaaaatgtcttcacacctccaatagggaaaaatcttcctcaacaaaactggtccatcatgtctgcaaaaggtgacagctccaccaaatatgcagacatcaacataaggcaacaaaacatgaaaaaaccaaggagacataaaactaccaaaagaacctaatctccaaaagaacccaataatctcccagtacctaactcaaagaaatgaatataaactacccaccaggaattcaaactaaatgttttaggaaagctcggggccatcaagacaacacagtgaaaaaattaattggtatcaaagaaaaaataaatgaccaaaactagaaacttaacagagattgaaattatattagaaaatcaaaaattctggaactgaaaaatacaatgaataaaatgaaaaaatgcaatacagggtctcaatagcagaattggtaattggaagaaagaatctgtaaagtcaaatacaagttcttagacagtatacagccagaggagagaagagaaaaaatataagaagaaataaggaaggcttacagaaagcttacagaattcatgagacatcatcaaaagagcaaatatgagttcacataggaaaagagaaaaaatggtggaaagattaagaaaaagtagcaaaaaactttctaaatcttggaaatcctagaaatatttaggaattggaagcttaaaggtctccagtaagactaaatttaaacaagattagtacgaattataatcaaactgtcaaaaatcagagacaaagagaggattgtgaaattgccaatagaaaagaagcaaatcacatataagaaattttcaatagggctagtagcagattttcagcagaaactttacagaccaggagagggtggtatgtcatattacagtgctgaaaacaaaaacaaaaacaaaaacagtttacctggcagagctgccctttagaaatgaagaagaaataaagtcggttccagacaaacaaaaactgagggagcttttcaatctcagacctgttttataagatatgcttgaggtaattatttaagctaaaaagaaataaaagggaagaatgataattagtaacgtaaatatatatgaaagtataaaactcactggtaaaggtaagtatatagtcaaattcagaatactctaatactgtaattgtagtgtgtaaaaatcaattatatttagtataaaggttaaaagacaaaataaaaataatagctacagtaatttttaagggttatacaatataaaaagttgtaaattgtgacatcaaaaacataaaatgtgtgtgtgggaagagtaaagtaatggagttattttatgagattaaagtttacttgttatcagcttaaatagcctattaaaattacatttcctgaaagcctcatggtaactatacagcaaaacctaaaatagatacaaaaaagttaaaaagtaaggaatcaaagcatactaccagagaaaatcacatcacaaatgaaagcagggagagagaaaaacaggaacaaaggatctacaacactaccagaaaacaattaacaaaatgacactaagtctttagctatcaataattaccttgaatgtaaatagatcgcatttcccaatcaaaaggcataggctgaatagatttgaaaaacacacatagaagcaataaccactataaacaacaacaagacccaaacaggacctctttatatactgtccataagaaactcacttcctctgtaagagcaaacgtagaatgaaagtaaaacaatggaaacatattttccatgcatgtggaaaccagagcagagcaggagtagctatactcatgtcaaataaaatagacttccagtcaaacactataaaatgagataaagaggttattatagaatgcttatgagatcaattcatcaagaatatataacatataaatctatatgtatccaacatcagagcaccttaacattaaaaccaaatattaatagatctgaagagagagatatactgcaatacaatattagtagggaaccaacactcaatttctgaaataaaaagatcatccagaaagaaaatcaataaggaaacactagacttggacaacactttagatcaaatggacctaatgaacctatactaatcattctgccagcagcagcagaataaaaattcttctcaagcacacatagaatattctcctggatagatcatatgttaagccacaaaataagtcttaacaaatttctaaaaaatgaaatcatattgtttcctttttaaccacaatggagtaaaactagaaatcaatcataggaaaaatttggaaaaatttacctgtatctgaaaattaaacaacatgcttctgtacaaccaatggattaaacaagaaatccaacaggaaatttttaaatgtcttgagacaaatgaaaatggtaatgcaacatgttaaaatgtatgggatgcagtaaaatttgttctgagggaactaatggatatttatgccaataaatgtctacatcaaaaaagaaaatgttcccaaataaacaatctagcattacagctcaagggactaaagaaaagcaaattaataataaggaagaatataataaaaatcaaagcagaaataaatgaaatagaggctagaaaaacaatagaaaaggtcaacaaaacggaattggtttttgaaaagattaaacaaactgacaatttttagttacactaagagagaagactcaaaagcaaacatcagaaatgaaaggggagatattacagctaatatgggtgagtagcacataaatacaaaggattgtgcaacaactttgagcaattttatgccaacaaatttgataacctgaaagaaattgtgagacacacacaatttaccaaaactgaattacgaagacgtagaaaatttgaacagaccatgaatgagcaggaagattaaaacaataattaaaaaatctttcatcaaggagaagccctggacctcatggcttcaatggtaaattatacaaaacatttaagggagaactaatgccaatctgtctcaaactcttccaaaaaatagaagagagaatactcataaactcgctttgtgagaccagcattccatgataacaaaccattccatgataagaaagccagatgaggacactataagaaatgaaaattacaggccagtattcttgataagcatagattcaaatatttttgacaaaatacaagcaaattgaattcaagaatacattgaatgaataattcaccatattaagagaaatgtatctgtaggaagtaaagatggttcagcatcatggatctataaatgtgaaacaccacactaactgaatgaagaataaaaaccatatggtcacttcaatagatgcagaaaagcagctgggcaaaattcaacatttttccatgataaagcctcaacaaattagttttagaaggtgtgtacttcaatacaataaagaacatatctgacaatcccatagctaacatcatactcagtgttaaaaacgttttctctaaaatcaagaataagacaagaatgcccacttttactgcttctagccaatatagtcctagacacagcaattaagcaagagaaagaaggaaatgacatcattcaaatcagaaaaagaaatgttaaattgtttctgcagacaccatgatcttatgcataaagatttttataattccaccagaaaaatggttagaactaataaattccagtgggttgtaggatataaaatcaacatatcaaaaacaattgagattttttcactaacaaactatctgaaaaagaaattttaaaaaattccattcacaatagctacaaaaaaatgaaatatttagacatcaatttaaccagatttaaaaggcctgtatactgaaaactataaaacattgatgaaggaaattgaagatgacccaaacaaatggaaagatatccttggttcatggattgaaagcattaatgttgttgaaatgttcacacaaccctataataaataataaactaactttagcttactgtaacatttttactttataactttttaatttttaaaaacctttttgattcttttataacattagcttaaagccaaacacattgttcaaccatccggaaatattttctttctttgatctttattttacaagctttttctatttttcaaaatttctactttatttttacttttaaagcatttttgttaaaaactgagacacaaacacaaacattagcctagacctacacagggtcaggatcatcagtatcactgtctttcacttccagcttttgtctcactggaaggtcttccaaggcagtaacatacatggacctgttatctcctatgttaacaatgtattcttgtggaataccccctgaaggaacagacaggggtcattttatacactctaatgtaatgatgaaaattatagtataataactcctaggcgatacgaatttttcagttcaattataatcttatgacatcactgtggtatatataatctatctcattgaaatattgttttggggtgcatgacagtgctcaaatatccttattgctcttaatctcccaataataaaacatttccaactatcaactgtactttaatgatgtttaagagttaaaccacttggtgtttttatagtttacttaaacagcctcacatattgaaattaattctaaaattgtttattacttttttttttttttttgagttggagtcttgctctgtcacccaggctggagtgcagtggtgcgatctcagctcaccacaacttccacctcccacgatcaagtgattctcctgcttcagcctcctgagtagctgggattacaggcatgtgcaccacccccagctaatttttgcatttttagtagagacagggtttcgccatgctggtcagggtggtctcgaactactgacctcaggtgatctgcccacttcggcctcccaaagtgctgggattacaggtgtgagccactgcatccagcctattttttttatatcatacagttttttaaatctccattcttagtaaatattagaatatcctaataaaaatatatttattttgctttcaattcacataaatgcaatttaccattctaagcagtgttttaaagtgaatgtgggcaaacgcaataactacaactgattcaataatcaatttgtcacaattttccacttttatgtttgcttggtccacaggtacacttgagctgtgccctggaaaaacaaatatttgtagtgttgctgtgaaggacctttccagaagtagcaaatactgtgtcttgtccaaatgcctgaaacttactattttttcctgtacatcagtcagacttctaaatgcaaatctttgtctgagatctgtctctgaccacttgagtgattacttgcagggaagtctgaaagtgccatgggtttaactaatgattaatataattttctggataatctatcaagttccctctttctcagataacatcacaaatggtagacggcaaaccggtagaagaaaatacactgggcaaagcaatatgttttgcctttgagaattttcagggatagagaattctaagagtagtgaagtcagtacttttttttttttaagctatcgttatcatgctgaggagtggggccttggagagtcaagtaagccaaataacaactaaagggacagtgtgaaagtcagatgggctttatatgagcattgaaagatctctccttgaacagccagagagccaattgtgatagaaaatcaggctgaggatataatggaaaaatagctaaatttctaaactggctgaattcactgcctatatgagtcccaatgctagagtcagtttcttaaacggaaggagtgagttgcagtcacataaaatgagaatacatgagtggatgtgccagagaaactttaatctccagattcccttgaaacctcgggtaagcacaaatgtattccttttccttgctatagaacagttttcttttgtttgtctggagactttgcagaggattacctgagttagatatattgctagaggatgtttgttgtattaggaattgtgaagtgtctgacattttttctatttgccagctactatgttagtatgccacggttttatggattcaaataaaaaacataagactcctatttcagaaaaaaagatagtattactcacaccatgacaaacatcagcatatttgcctttttcccttagtatcacaagatcccacacactttcccagcattcgcatacatcaactactgttcaacagacaaaatcgcggaacgtatccttcccctctgagctaagaaaaatgacagcttgcgtgtttaatctgaaaatatgcacatgtatgttattgatgtaaaaaacagtggaaaatacgtcaacaacgcatggtgtccagcactgtgatatgtgtgactatcatttacctccatggtctgtattagttaagattaggctacactgttgatgataaagaaaaaaatacccaaaataagtgcagcttaaaatgatagaaatttatttaaatctagaataaaagcgcagaggaatgagattatgagaaaaaggcaaactgctacattaggtactaagagaatcagtatcacggttttttcaccactccaccttctataatgtggcttttgtcttcattgtccacaactctgacaacatcccagcgagaaaaggaataaagacaaggaatgaagcaaaataaacaaagacgattcacaaactactttctaaagaaaggttctggaaaccggcacacaatactcctactcattccaaactggtcaggattcagccatatgtactcatgtagctacaaaataaggtggggagtggagatttcattttagaacaccatttgcaaagctgaatattttgcaaagaagaacaatgaaaagcatcgacttcagaaacagtgatctatcagttgcaattcagatagctgatttccaccccaacacctcatcgcttccttcatctaacccacagagcacattcagccccacaacaagcatcccaacaaatcactgtatttggctcaaagcctattatatacagcttatatagggtcttttcaataaagtctggaagtggctcctgtttttctgagaaactgccataaacaagagaaccctaaggaaagataacaactaaatgttatgtataataggagcctgggacagaaaaagaaaatcacatgaaagcgaaggaaatctgaataaattatggattgtaagaaaatagagtattaataatttttaatcattgtaaaagctgtaacataccattattatatgtgaatattagagagaaccaggtgaggcatgtatgccaactctgcgctatcttgttattttctataaattgaaaattattcaaagaaataaggtctatttaaaattatagaaattagtagagtaggtgatcaataaggacctgctaagatacatatggatttggaatatattttgatggtaaacgaagaatgtattccagttgatcagaactgtaggaaaaaggaataaggataaattatatgtgcatactgtgaaaactgggaggaatgtaccatttaccaaagtagggagcaccaggaaagtatctcattatagggactgttacttggagttcttagaaattgtattatgagatacccattagacatcctagtggagatgttgtttgtgtagtttggtatctaagtttgaagctcaaagagaaagtcaagattggagtcatcaatttgaaagtcaccaccccatagacaatggattgaagccatagaactatggaactatgtggatttacaatatctatcaaatttgaatgtgtctatgtttcttttttttattgcctttggcacgtcttttaactttttgttgaaagtcaaacatgatgtatgatgtagtaggaactgaggactttactgtgagtttttaatgttaatgtggctagaaattaagctataattttgtttgctctagctgtatgtgccagaggcttaaattcttctaatgtctctgcccttgtctcctcatgaagatttccctaataactttttcttaaatagagttggtaccttccagctctttttgctagaatccattgtttttttcatctttattaaggtatacttgataaataaaaacttacatacagtacattcgaggtgtacaatgttatgtttttgatatatggacacatataatgttaaataattaccacaatcaaactaattaacatatgcattaccccaagctgttatattttgtgcgtgtgtggtaaaaatacttgagatcaatgctcttaacaactttaaagtatacaatgcagtgttattaactacagtcatgatgctgtaaatgagaactctagaacttatttatctgtcaaaactgatcctttgtattcttgaccaacatctccacatttctcctgactcccaagtccctggtaaccaccattctattatttacttttatgagtttgatatttttaggttctgcatataagttagattatgcattattggtctttctctgtctggtttgttcatttagcatgatgtctccagattcatccaagttgttgcaaatggcaggattttctcccttattaatgcaaaatgaaatttcagtgtgtgtctggatttgtttgtgtgtgtgtctccagtcatctgtgaatgaacactttggttatttctatatcttggctattgtgaataatgctgcaattaatgagggtgtacagatcacctcaagatagtgattttatttcttttagatttatacccagatgtaggatggctggatcataaggtagttctatttttaattttatgtgtaacctttacactgctttgcattatggctatgctaatttacgttcccaccaacaatgtagaattttctttacactttcaacatttattatctattgtcttttttaataacagccaaatgtgtgatgtgatattttactgtggtttgattttcatttccatgataattagtgatgttgtgcataatttcatttatctgttgccgatttgtttgttttctttagaaaaatgtctattcaggtttgtccatccatttttagtagggtcatttgtttttttgtttttgttttggtttttgttgttttgctattaaattatttgacttccttatatagaggactttcaaaaatttcatgggaaaaatttgtattataaaaataattatgcatgaatttaaaaaaattttaccaaaataaacttgtacgagttacaataaacttgttgtaacatgtataacaggatctagtttgagctactaagaaaagttgaaaagattccctatcattgcaacatgaattctgctaaaattgaagcaagaacaaacatcaaatttatgatgatgcttgagtagaagaaagtaaacttatttgctctttacaaaagttactagggacagtgttccaaataagtcagaagtttacaaatggataactcattgtatgaaagaaagagacaatactaaagatgatgcctgtggagcaaaccacccacatcaatttgtgagaaaaaagttttcttgtttatgtcctaattgaagaggactaacagttaacagcagaaacaatagctgatgacacagacatctcaatttgtttaggttatgcaattctgactgaaaaattaaagttgagcaaactttctactccattggtgccaaaacccttgcatccagatcagctgcagaatagagcagagcttgcaacggaaattttaaacaagtgggattaagttcttgaagcatttctttgaaaaactgtaacaggagatgtaacatgccttcaccagtgtgatcctgaatactaagtgcaatccaagcaatcgttaccgagaggtggcagtggtccagtcaaagcaaaagtggattggtcaagagcaaacgtcattgcaacagatttttgagatgctcaaggcatattccttggtaactttatggaaggacaatgaataattacatattttgttatgaaagtgttttgagaaatttgccaaagacttagaaaaacaccaaggaaggcctcagtagggagagccttctctactatgataatgctcctgctcatccttctcatcaaacaagggcaattttgtgagagttttgatggaaaattattggcatcctccttgcagtcctcatttggctccttctgccttctttttatatccttatttaaaaaaaaattaaaggccactcattttttctttcatttagtaagataaaaaatactttattgaaatggttacatttccagggacctcagttctttaggaatcaaaaaaaaatgactggtatcatcacttacaaaagtgtcatgattttgatagaacttatgttggaaaataaagtttatattttaatttttatcttttaattctatttttttcacaactgtttgaagtcccctcatcctttggatatagctccttattgggtatatgggttgcaaaattgtctcattttgtggtttacctatttgttttgttaatttcattcactgttgttataatgaactctagttggcatggtggtaagctgtggagaaagggaagcattctatatccagagtatatattgatttaagtatgaaggtagaacacgaaaacatttatatgagcaaggtgtcaaaaagctcaccctcccaataaatattttagaaaaagctactgaaaaatgggcttgacaaatacaagagattaaactaaaaaagaggaagagacaggatctaaagataaggagatatatgtaagataaaggcaatggaattgtcaggttaatgatgatggaaaaccccaagatgactagtgtgaaacagagaccacatttcaaattagaatagagcagcaagttgtgaaaagatttcttcaagaagatgaagctgataagctgcctgatgtgtctgtgtatactgcgaaaaggtttgtgataacaggaagagtttgttgatgagtttataagttcatagaaaactaagcaaactgaatacaatacattttttaactctagggaaacaaaaataatagatagtacaagtaattttagcatgcaaacatacacacataactaaaatcaacaaactttatttctaaaatgtggaatacaattgccagttttcagagctgttaggctcaaattcaataagcacaacattaggcacgtagaactcacacaatgtattctgtaattataataaagtgagttcactggatgcagattaaagactggaattaacatacactgattaagtaagttattgaacaaataaaagtaattgttacacctcatgaactgggcattatcgttagattattgtgggaatatgcaaccctggaaaaataaaataattcaacgtaaacataaaaatggaaaattattccatttctagtttacttaatatgtgtaaatgtaacacattgcctataacacatagaatgctgcatattgtgacttctgtaattttttaacagaaaatgtattagattgaaaattaatttttaaaagtttcagttttctatttcttgggtgaaagaatgtatcactgtatatttgttgagtgttggcatgactgggtgcatgaataataattttgcatataatatttttaaacagatgccaagttagcattttttaatgcattcaaagattgtttggaatattaaaaattcaggtgaattatctttttcttacaatctgtcaatacctgacacacatatgttatgtactcttcataaaatagtccagaagatattgatttgaagcacaattataaactttatgtgaatttttacttgtatgtataaacaatacctggtatagtttattgataatcttttttgattacataaagttactcatatggcattggatggcacttaactatttaatcaaatataatgcctttaaaattccatctgtgctgtctgaagttatgacagtaggctcatgtttccctggttctgtatttactactttgaacacgttgatttagccttcagtgtttggttccttatctttttcctgtatattatttatttttaggaattagtattacttaatgactcaggagaattgtatgcttacaccaagaaaacattatttatttggctctaagagttatattttgttaacacatatcaaataaacaaatagtttgttttagcaaaatggaataattttatgaatggtaaaaggtgatattttgacagccaactgaatttttcccatgtgttaatggaatacatacacatttatttattttttggcttagctagcgattatgctctaatcttttagggttgtgatactaattagttttttatttatgagaaggtagtcaacaaaataaactatgtaattaaaaagtcctggcactgcaaaaattaatgttgttaaactgtccatagcagtcaaagaaatctacagctttgatacaatctctattaaaatctcaataatattctctaccaaaatagaaaaaaaaatcctaaaatgattaggaaactacaaaaaacctcaaatagccaacacaatcttggtcaaaaaggacaaaattctttgtcctttaggcatcaaattacctggctccaaaagatgctacaaagctatgtgtggtaatcaaaccagtatggtaccagcataaaaacagacatataaacgaatggacaataggacatccaaaataagtccacacatctatggttaagtaattttccatgagggtaccaagaatgcacaatggagaaaggctaaccttttctacaaatggtgttggggaaactgagtatctattataataaaagtagaaaaataacattagtaccttatctcacatcatatacaaaaaatcaactcaaaactgattagacttaagtataaggcttgaaactgtaacactactggaagaaaacacaggagaaaagatctgaaatattgatctgatcaatgattttatggaactcaaaagcacaggcaaccaaagcaaaaattgccaaatgaaccatgtaaacgagaggaggttaatatgcaaaatgcataattaactacgagaaataattggcaaaaaaaaaaaacctgactaaaaaatgggctaaggaccttaatacacatttctcaaaagaagtcatacaaataatcaataggtatatgaagaaatgcttaacatcattaagcttcagagaaatgcaaattgaaatcgaaatgagatatcacatcatgtctgttattatcaaaaagacgaaaggtaacaaatgttcatgaggatgtggagaaaagaaaacttctcttgtgcattgttggtgagagttaaaattgatacaaccattttgaaaaactgtatgaagtctactcaaaaaattagaattactgtataatgcagcaatttcacttctgggtatatatataaataaaatcactatcttgaagagatatttgcacttccattttaattgcagcattattcacaatagtcaagatatggaaacaacctaagtgtctaccctcagatgcatggataaagaaaatgtggatatatgtatatacacaataaaatattatccagctttaattaaggaataaattctgccacttgtgacaacttgaacctggaggacattatgctaagtgaaataagctagagacagaaagtggtctccaacgctcatggacatgatcttacctctatgtggaatctacaaatgtcaaactcagaaaagtaaaaagtagaatggtagttaccaggatttgaagagcagaagaaacataaagttgttgctcatggatacaaaggttcagttatgaaaaattgataagttctggagacctaatgcacagcatgcttactctatttaataatactgtattgtatacttgaaattcactaaaacaattgatattatctattcttaccataaaaaatgtaaccagatgaggttattgatatgttaattagcttgtttttggtaattattacataatgtatatgtatatcaaaagaccatattgtacatttgaatataaaaaaaattttatttgtccaatatatttcaacatagctgaaaaatataaaatcatagcatgtaggaaaaacacatctttttatttgaattgacttacatttattcaacttaataatacaaccatattttatgaaatgatcactctgaggcaggtagcataacaagtatctattggttgcagttggcagcaaggcatttcttgccaaaatggaattcaatatttcatgggaagttagcaaaaatataaagtaataagctccagaatagagatgtatgcaagtaactgttggatcacagaaaatggcatatctaattctgcctaagaataaaatgcacaaagggaacagatgttacccagagtagaatgttcaagaaatagtaataatttggcatggcaagagccatttatacatagctgtaaattttttatgcataggtgtgagctttcttgaaagagagccctcagttagatctcacatggaattttcaccaccctatgtattaggttttttttccaaaattccttagttaaatataggtaaaaggtaacaaagtattttagctctttgtccaaaattaaatacaatttattttcattgtccattttatgtgcaattaggtcattatatagattttctctatctttttaatgaacagcatgcatgggcgataatgtaaacctttttagcattccagtccatctacttttgaggttatgcttaattctaagatggctcctcaaaatcctcattttctagcacacacacactttctccaggctatccaatcaaacaataatctaggtgcttcagcaaaaagattttgctaatatgttaaatgtcccaaatcagttggtgttaaaatggagatattatcctcagtgcatttaaactaattaagggaatacttgaaagggaccaagcttttccttatgaaagagatccaaagcttgaagggaagttaatgagtgtaatattcctcattgctggttttcaatatgggatcatgtgttgtattagttttcatgctgcttataaagacatacctgagcgtgggcaatttacaaaagaaagaggtttaatggacttacagttcacatggctatggaggcctcacaagcatggtggaaggcaaggaggagcaagtcacaggaggagcaagtcacatcatatgtggatggtggcaggcaaaaagagagagcttgtgcagaaaaactcctcttaaaaccatcagatctcctaagacttattcactatcatgagaacaacaccggaaagaattgcccccatgttcagttacgtcccaatggctccctcccacaacatgtgagaattcaaggtgagatttggatagggacacagctaaaccatatcattctgccttggcccctctcaaatctcatatcctcatatttcaacgtcaatcatgccttcccaatagtcccccaaagtcttaactcatttcagcattaactcaaaagtccacaatccaaaatctcatcagtgacaagtaagtcccttccacctatgagcccgtaaaatcaaaatcaagctagttacttcctacaaacaatgggggtaaaggtactgggaaaatacagctgttccaactgggagaaattggccaaaacaaaggggctacaggccccatgcaagttcaaaatccagcggggcagacaaatcttaaagctgcaaaatgatcccctttgactccatgtctcacatgcaggtcatgctggagacaaaaaggtgggttcccacggtcttgagcagcatatagcccccctcctggctgctttcaaagggtgatgttgagtgtctgtggcttctccaggcatatggtataagctttcagtggatttaccattctggggtctggaggatggtggctctcttctcacaggtccactaggcagtgctctggtagggactctgtgtgggggctctgaccccacatttcccttctgcactggcctagcagaggttctccatgagggctccacccctgaagcaaacttctgcctgggcatccaggtgtttctatacatcctctgaaatccaggcagaggttcccaaaccacaattcttgacttctgtgcacctgcaggttcaacaccatgtgaagttggcaaggcttgaggcttccaatctctgaagcaacagcctgagctgtaccttggcctcttttagacatggctggagtggctgggacacaggacaccaagtccctataatgcacacagcagagggaccctgtgcacagcctgtgaaaccatttttttctcctgaacctcttggcctgtgacgggagaggtttctgtgaaggtctctgatgtgccctggagacattttccccatagtcttggcatttaacattctgcttcacattatttatgcaaatttctgcagccagcttgagtttctcccgagaaaatggaattgtctcttctatcacattgtcaggctgcaaattttacaaagtatttatgctccgtttcccttttaagattggatgcctttaacagcacccaagtcacatcttgaatgctttgctgctcagaaatttcttctgccagataccctcaatcatgtctctcaagttcaaagttccacaaatctctacagctggggcaaaatgccaccagtcttgttgctaaagcataacgagagtcaccattgctccagttcccaacaagttcctcatctccatctgagaccacctcagcctggatttcattgtccttattatcagcattttggtcaaagcaattcaacaagtctctaggaaggaagttccaaactttcccacatttttctgtcttcttctgagccctccaaactgttctaaactctgctggttatccagttccaaagttgcgtccacattttcaggtatcttttcaacagtgccccactctactggtaccaatttactgtactagtctgttttcacatggctgataaagatatacccaagactggacaatttacaagaaaaaaaggtttaatggacttacagttccacatggctagggaggcctcacaatcacggtggaaggtgaaaccacatctcacatagtggcagataaaagaaaagcttgtgcagggaaacccctctttataaaactgtcagatctcatgagacatattcactatcacaagaacagcacaggacacacttgcccccatgattcaattacctcccactaagttcttcccatgacacatgggaattcaaaatgagatttgcatggggacacagccaaaccatatcatgtgtcaaggaatgtgggagggcgctaagacttgagagtaaaaccaaacggacaatcaacaaataatcaagggatctgtcttacaactgccagaaaaaaacctttgacaatttgagtgtacttgaaattgattctttctcaatgccttaaaaaaatacagtccagattattatactttgatgttaccctgtgagtctctgatcagagaaacctgttaaactgtgactagactttaacctacagaaactgtgagataatacatgggtgctgtttacttctctacgtagatgtttactacggagtgaaagaaaactaacacatttgtctccataatttttctcaatattcaatgttaggagtgatattgtcatagtgcctgggaaatcaaatttctgatttcatatccttaataagtaaacttaagtaataatgattggtaatgagttaattattaagtaacttaaaaatattagagagatgttttaagaagttaataataagaggaatttaactgcatgcactatgctgtttgtttctacatattctggagttctacataattaaacacttagtagttaggagcctcattacttagtatgtgaatcactctatgcattaaagtgttgcattaatgttacggaatccttggggtgtcccttcactgatcagaaacctctgtgtccactggcacctttgcctgagttttgctctggactgcagggctcattctgcccactcagcctggcagactgcactcagctcctgctaccggcctggatcctatgcctgccaaggtcaagacaggcacgaagcagcaaggagtgcgtgaatgaggatggggaatggccagtgagcacagccgggcacactcgctgtgatgggacatgcagtcccaggcattgacacgggtgctggctccctacaaggctgtggctacaccaggcataccataagcaacttccacagctgacaccaggaaatgcagtggctccaagaagcttggagatgccagaaactgcagaaccccaaagaggatatcgtagccctggctcaggaagcttctaggtctgggctctccaaagggctgcagctcttctctctttctctcttcttgttgcctgcaatgtggtaagcaaggaacgtgtttcagccctgtttgtgttacagctcctttagccctgccattgagcgggtcctggtgagaggaggggccagctgggcttcctggatggagtaagggctccaaaagctgtgaaactcactcatttcctgcatcaggacttactttggtcctggaagaataatattgaagatatatgcttaaactattcctaacaccaggatttgtgcgtttgttttcttcctcaagaaaaatataaacagcgaaaatgttgctgtaagtttccctgtgtcctctctccctctctccattccccctccctcaaaactaaagtaaaaggaatgttaactgcccatttttctgtggccagcagaccttatctctactcccaattccaattccttgtaaatatactttgtaaagtcctgtgagatcctgtctcctttgccatgccgctgcaaggtcataaagtaaatataacctaagttgcaattctggttttcctcaaaatctaagacatgtcacaaaataatttacttcctttttttctcgctctagtaacatcttcctgccgcacgtatttcctgccttaaagagtttaaaaggcaatcacccaaaaccagcagtggctaccggttcgggaccccttccacactgtggaagctttgtattttcactctgctcaataaagcctacagctttttctctctatcggtctgtgtctctatcacttgctgtgatcagctaccacaccaattctttggcatggcgaagcaagaaccttgccgttacactgggttctttttgtgtgtcctggaagaatgacgtacacagacaagtggagggtgaacaagatgaaaggagctatactgagtgatagaacagcttagagaagaccagcagtgggtagctcctctttgtaggcagggtgtcccaacaagtgttcagctctcagcagagagggtagctcctctctgcagctggtcatttcatcttctctttagtcagcagagagggtagctcctctctgagggcaggtcatccgatcaattcttcagctctcagcagagagggtagctcctctctgcagctggtcatttcatcttctcttcagtgagcagagagggtagctcctctctgagggcaggtcatcccaccaactcttcagctctcagtagagagggtagctcctctctacagctggtcatcatgtcatctccatcctctccttgagtctggctgagtctgggggtttttatgagcctcagaggagaggaagcgtgtgctgactggtccatgtagcgggggcattggcagcaccagaaaaaagtaatgcaagatccctctccagactgcaggactggcagcccagccccaggcttcaggtccaacctggcttgaaagtggggcttcactgggaccactcccttccattcagaagcctgtctgcctcatgcctgttcatggtgcccaggcttttcatatcaaggagtggctgcatgctagtactgggctgtcctcagcacctcctcaccctccctcccatgcttgtcaatgcccaaagtccacaggggcctgaggtggcagggggctggtgtgttaacactgccctgagcatgtgcacatccagcctggctcagacagtgcctgggcttgccccaactttgccctgagatcagagtgggtgctgatagcagggagaagccagacactgggagcaggcactttcaaatctgcggggtaaagttggggggccttcctgggcctcaaagaatgcagagatgcctgggtccgcaaccatgggagggtggctacagctgcacccagggaactcccatcccgtcagctcagaaggaacgggttcctgcttgtccccagctcctgtcagctctgaggagcatgcagccccagctgggcctcaccacagcttggggcgggggcttcgtgtcctcactctctgggcctgggctgtcatcctaggtggggtgatgttgctgtgagttctttctgtggccccagtgcttaggggtggcctgggtctccccctctcccagctgatggccctgcttgaggggcgcctccaggagcagatcatggccctgggcccggccatggggagcgtcaggctcagtggtcacctccatgtggggcagatcctagggacgcagccctgggcagccctgcacaaagcctcttgttgaggtgcaggaacttggtgctgtcgatgggttgggtgtagtgcttgcatcctggctgggttcttgaagcctgggatgctcccacttgccacacaggcctctgatgcacagctccagttccaagtctcagggctgacccaggagttgctgcttccagcccagctcctgataaccaccattctgctttctatgaattcagctttcttaggtttcacatatgagtgagatcatgtggtatttgccttttggtgcctggcttatttcacttatctcaatgtcctccaagtgaatccatgtgcaaaagcagcacctccctgggcccagcccagccttggggcctctctctgttcactcctccatggccagccacactgctttcacatcagggggtgactgggcctggccccaccaaagtggcttccagaggtgtgttcccagggcagcaggccctagggagaagctccggggactacctgccttggtgtctgaatctgaggacttatatcctgggcctgtaccccactgcagctggcatcatggcagcagctgcttcagaggggctgccactgccatcattaacactaattgttaccaattgctaataaaagtaatatcttggtaattaactgaaaaactaagtgaaagagacagaacaaaattgattagtatttaattacacaaaaaattaaattttaacctatcagttcaaaatacttcatgataaatctattacttggctccacatgggaaacttggctattttgcaggagatataggtgcagtaaccaaaagtaatggttgcaatatacagttaaatattcaagttatatctggatacgatccctttatctttctttactcatattcaactctcttaacgactcttcaaataaaaaatattttttaatgcttactaggtaccaaacactgagatgtattagctttgtttcagaatttagaaactaatcagcttgtttactatgtgtatgtttctgtgtgttggagatgggagggtggttggaggtgggggatgtggtggataagtctcacagtatattttaaagttaacatctataattgtccttgttatacaatgtaaataaatagagccttttacttttactcattgacctgggctgcatgttgtaatcttgtttcagtagttaaattcttacctcttttctgtgtgaatccatgttgtttgcaggtctgataccctgattctccagaatattaattcacttttgctctactcatatcttccttgataagtccatcttttccaataaaagtagtttctagatgtactccgcttgaagatttaaaaattttaacagataaaagtatgtatttagtgcacaatatgatgttttgacatatatctacattgtgaaataagtgaatctagctaattaacatatacattatctcacagttttcagttttttgatgagaacattttacatctctcagcattttcaagaatgcaatatattaaatatgatggattgcttaaagtaattcctcttatctaaataaacctattcatatgtaaaattttgttatcttttaaccaacatcttctaaaccttcccctgctaccctaccttccaccccagctcctgataaccaccattctactgtctaattctatgagttcagttttctttggtttcacatatgagtgagatcacgtggtatttacctttttatgcctggcttatttcacttactcaatgtcctccaagtcaatccatgttgcaaatgacagaattccctgtcttttaataattaaacagtattccattgtagttttacagttttataatagtatttcatatatatacatgtcacattttttatccattcttctactagtgcgcacttaggtggattccataccgtgattattgtgaataattctgcttgcaaattcaaacagttaaaatttccttattcacatggccaaactactgctaaaatccaatttttgtaacattcatttttattttaaaatgtccactttccactgcatgtttgtatgctgaattacataatctgtaacaaataatttgagcatctgttgcaccttgctctactcactgaatacttggcctccttgtatcaattttctctagtcattggcctcaaataattatttcttttggactcttaaatactaggggaaaatgtctgtcttttttttgtgtgtttgataaaaataagtctaagcaaagctcaagttaaaatagtgaagtttttgtctgatatggtctttgaatgtgttaccatttcaaataatcctagtttctgactccaagttattggataagtggacaaaacaatagtattaagtgggttgaatcagaaatttatatattttttcaatttaatgtaaaaaaagtaaattttcacacttttaaatcctatttgatatgctgtgagttatgtttacacaatgcaaatacaaacaaaggtaatacaaaattttggtcattaaagctatctactgtcaaaatgattccaaatatattttgaaaaataaacataaaggtaaccaaatacattcttcatagctacttgttttatggtcttggagtctgttaaaactgatttagataaaattatttattagagatttaaactcattccactaccaaatagccagttttaattatatttttcaattcattgtatataagctttcaaatttattcaaaataaagtgacttttgatatttttaagatattcaacacagatgccacttttaattattgacttatcctgttatggctaattaaatatgcaatacaatgttatgaaaataagttaatacctactctaagacaataatatatattgcgtgctggcattagacataacaaaatagataaatgatttaaaattttatttaagtgttgaacatttcaaaaaatttcaaaagactattaaggtgatttttctgtcacaaaaaaaagtgaatctaaaataatctcaacgaagctctcaatttgtgtaaggcttttttctccctctgaaagaaaaatacctttctattttctcgacttaatttgatttccaactgaaaatttattatgttcctatgtccttctgattttttatttttattagagatcattatactactgggaaattatcatgtctcagagacaatgtaagcagggtcttctcaaccttgattacatttcattgtgtttttaaattaatgtctgtacactgagatcaattaatattttttaagaaaatactttctgcacaacaaattacatttaaattgtgtgcagttcattgtcataaagtgtaatttaggaaaatttttatcacttcttggttgtgatgaaaggaaaagtctgataaatattagcccctacaaatgataagaacataagaaatgaaagttctctttaaggtgtttaaatgttttagaatggattttatttcctgaggatttatgtgataacataaactaaggcaagatgcttaaataataatggggaaaataatagtgtgcatgggtgagttgagtatctggaacattttgcatgatgactagcataactttctctcaagcagtaatatctctaacacaaaattcagaggttttttttcagatggataaaatcaagtatgaacatatatttttcatacattgaattagagaatgaaacactgttgaaatgaaatcattttccttagttatgcctgagtttaaactgggaaacaatctttgtcccttttatccaatgagcaggtgtttcaaacaaatttggagagttataaacaacgtgaagaaaataacactttagcttttcacacaccagtcatcttcatcattgaatcccaagttaaagttctgaaaacagttttgaaaaatgctttttcctttggccacaggaatagctactgagagcaaccctgaggatgatactggatgacagtcttcgtaaaatcacttgaaatattagttcagtttagccttgggttggcttccacttaaaactccatgttaaggaaaaatagcacctctttctaatattaaaacacacacacacacacacacacacacacacacacacaaatgtacataaaactgcaacatactttctgcaactgacatagaacactccatgttatcactggcaccatagtttataaagggaaaatattgtctgggtcattggagacatttaaaatttcagtcttttggggagagctttttaaaatcctgcttctacattcagtatttgttagttatgtttttattcagaactaggttctctggtagtttgcacattttgtagcttcccagcacaaacacaaaaacgttgtaagttctttatgactaatctaatatatagtctagacacatattgctgtgtttaataaggacatgatgtagaaaacataagtatatgagtactgaatttgactaaactgtattgttacatcagatgtcaatggtattaatggataaatgtcaacatgttattaagtggaaatattgggtatatatacatttattaggggattgatctcaaatctctgtatcatgatgtttaatactgcactcgaaaaaattgaaattttagaaaaaactataagaatttaggagacataaccatgtaaaatgttatgttatgctgagggaacatggccgacaagaagcagttagtgtgagtcattctcatggcaagaaagaaaagtgatgagtgaatataccctcagctgaaacattcaggtgcactcatttggattagtcaaggaaatagcagagaatggataggagcaaaacaggatgaccgtccacctgagagcaacaaggaaccaggggaggctcctcaacccagggaaatggtgagtgagtgggagaccctggggtcccacacttcttccatggatctttgtcaccttggggtcaggagatcccctgtgaacccatttcaccagagccttcagtctgacatgcagagatacatggtatcttagcagagctgcttctcagacacatgcagaatcctagaagcagtggatccctgggcatccaggcaataagtagctggagctctggcaaagggggatattagccttccttatcttaccccaaaaaggggctgagtgagggggctaggcagcaatggtatgcaggcttcacttgcatgacatcttacaaagtccaagacccactgacctgggattctagcggccccccacagtgttctcaagccttcacccactctgcacttccctgagatggagctcacagagggaggggtgggctgtaatcttttccattccgcagccttcgtctttgctgtctccaggctctggagagtctcaaggggaagggggggctggtgtggacccctagcacagtacagccgccacacacaaaaaagcgatgggaatgtcctccacagaggtcccagactttacttctccttactgggcagagcctcttgacctgggactccagcataaccaccacaccccctacctgatcacctaaatcagaggtagctcaacatttctctgaggaggaaatcccagagtcaacccacagcctctccattattgcagctgcagtggtaacaccctaaccaccctccagctgaggaaggaacaaaggcttagtcactacacaggcatcttcagcacagagcacacaacgtactgtggggagcccagtccttctatcctgggaaaccccacccaaaacattcaactaggcaggacccccagctcaggactgcagaacagaagccccacagactgagcatacccactggtagtgactctgagtttcactggggagaggctcccagaggaaacaacagcccctctgccactgccactgagaggtgaagccagctggacttcctgggtcaggtggggacttggagaattttctgtgtctagctaaaggattgtaaatgcaccaatcagcactctgaaaaatggaccaatcagtgctctgtaaaatggaccaatcagcagcacatggttggggccaaataagggaataaaaactggccatcccagccagcagccgcaacccactggggtccccttccacgctgtggaagctttgttctttcgctcttcacaataattcttgctgctgctcactctttgggtctgcaccacctttaagagctgtaacgctcaccgcaaaggtctgcggcttcactcctgaagtcagcgagactacgaacccaccggaaggaagaaacttcggacacatctgaacatctgaaggaacaaactccagacacaccatctttaagagctgtaacactcactgcaaaggtctacggtttcattattgaagtcagcgagaccaagaatgcatcagaaggaataaattctggacacaccacaacagtggttccactcctgttgcccttggtctggggaagaaacaaaatttgagggctacaccagagcttacagtatgccatcatcaccgtaagagagatcagtctgtcctatctgtgagctcttcatccatgctccacaacaagtggaacccccagctcatgctagcagtgcagctgcctcacccgctggctgaacactccctgtagcagtatctttgtgtctgtcagaggtggagctcccagggcaaccaaaagcccctccatcactgcctctgcttttcttagactggagaaggaacaaagaccctaagttatttatccagacctccagcaagctgcagtaaccctaaggagaggaggccagtctgtcttccacaggtcccaaccactccccctgcttggcaccaggcaaggtgccctcgctaagcccccacagcttgggcccagagtacagccccttatactgggccaatggggctgtttggtgacagctctgcatgtctctggggtggagccccaggagaaaagtgaaagacccttgcccacaagcactgctaagttccctttctctggtacttgcaagttgggaagagaacataaaccttgagattgccccagggctgtggtgggcagactgggagtgccaagccatgaaatgcagttaacactcaaatgttaaaggagcacatactttcagtgcattgagagggagcatggctgcaactgtaaggaaacacagaggagccatgtggttgagcaagagtctacctactctacattatggttaagtgctatttactggatcatattccaaaatttaaatgtcaaaaatactttactaccataccacactgtgaaaccaaatacaaggagtcagctacacataaagacttttcacagagcttcagccctctggaaacatccaaaaaaaaagaattcaactgactgtactcaacctacaccacagctaaaggaacacccacagagatgagaaagaaccagcataagaactctggcaacttaaatggtcagagtgtcttctgtcctcctaatgaccaaactagccatctcagcctagttaaggattcttattctccaccaaatgtccttaactaggctgaaatgccagatataaaatcagaatatggaaagaaacaaagataatggagatacaggagaatgtcaaaccccaatttaaggaagctaagaatcacaataaaatgacagaagagctgacagatgaaatagatagtataaagaagaacctaactgacctggtagagttgaaaaacacactataagatttttatactgtaatcacaagtattaacattagaattgaccaagctgaggaaagaatctcagagcttgatgactggatctttaaaataagacaatcaaacaaaaaataagaaaaaataaaaggaatgaacaaaatgacatcattatgtaaagaaacttgtgattatataaagagacccaatccatgaatcactggtgtccctgaaagagaaaaagagaaagcaagcaacatggaaaacatatttcaggacatcattaatgaaaacctgcctaacctcactagagaggccaatattcacattctggaaatccagacaacccttgaaaaatactacgcaagatgatcatcccaaagacacataatcatcagattttctaagatcaaaatgaaagaaaaaatattaaagacagagagaaatgggaagtcacctacaaagggaaccccaaaaagctaacagcagaccttcagcagaactctataagccataagaaattggggacccatattcaatattttcaaggaaaaaaaacctctaaccaagaatttcatatccaaccaattcaagcttcattagtgaaggagaaataagatctttttcagacaaacaagtgcttagggactttgttaccaccagacctgccttacaagagcttctgaaaagaccactaaatacgaaaaggaaaaatggttaccagccaatacaaaaacactcaagtacacagatcaatgacaatataaacaaccacacaaacaagcctgcataacaatcagtgaataacatgatgacaggatcaaatttacacatatcaatactaactttgaatttaaatggactaaacatgccaattaaaaggcacagagtggcaagctggaaaaagaagcaggacacagtggtatcctgtttcaagagacccatctcacatgcaatgacatccagaggctccaaataaggggatggagaaaaatctaccaatcaaatggaaatcagataaaactggggttgcaatcctaatttcagacaaaacagactttaaaccaacaaagatcaaaaaagacaaagaagggcgttatgtaatggtaaagggtttaattcaacaagaagccctaactatcctaaatatatatgcattcaacacagaagcacccagattcatgaagcaagttctcagggacatatgaagaaacttagactccctaacaataacagtgggagaattcaacacctcattgacagtattagacagatcatcaagacagaaaattaacaaagatattcaggacttgaactgaaatttgatcaaatggacctaatagacatctatagaactctttatcccaaagcaacagaatatatattcttctcatcaccaaatggcacatactctaaaatcgaccacacaatctaacataaaataatcctcagcaaattcataagaatcaaaattataccaccacactcttagaccacagcacaataaaaatataattcaatacaaagaaaatcactcaaaccatgcatttacttggaaattaaacaccctgttcttgagtgacttttgggcaaataatgaaattaaggcagaaatcaagaagtcctttgaaactactgagaacaaacatacactacaccggaatctctggcactgataaggaagtcttaagaggaaaattaaacctaaacctctacctcaaaatgttagaaagatctcaaattaaccatctaaaatcacaactagaactagagaagcaacagcaaaccaacccaaaaactagcagaagataagaaataaccaaaatcagagctgaactgaaggcgattgagacacacatgcagaaaaaagtaaacattcaaaacatcagcaaatccaggcatttgttatttaaaaaaattaataagaagacagattactagctggactaataaagaaaaaaagagagacaattcaaacaaacacaattagaaatgacaaaggggatattaccacttaccccacagaaatacaaataaccatcaaagactgcaatgaacatctctaggcacacaaattagaaaaaatggataaattcctggacacgtacactctcccaagacttaacccaggaagaaactgaatccctaaacagaccaataatgaactccaaggtgaatcagcaataaatagcctaccaatcaaaaaaagcctaggaccagactgattcctagctgaatgctaccagatataaaaaggagagctggtaccattcctactgaaactgttccaaaaaatctgaggaggaggagctcctccccaactcattctgtgaggccagcatcatccttatactaaaacttggcaaagagaaacaacaaaaaagagcaaacttcaggccagtattcttgatgaacacgatgcaaaaattctcaaaaaatcctagcaaatcgaatccaacagcacatcaaaaagctaattcaccacagtaaattaattaggctttatccctgggataacaggttgattcaactaatgtaaatcaataaacgtgattcatcacataaacaaaattaaagagaagaaacacatgattatctcaatacatgcagaaaacacttctgataaaatacaatatcctttcatgttaaaaatcctcaataaactaggcatagaaggaaagtacttcaaaacaataagagccatctatgacaaacctacagccaaaatcctactgaatgggcaaaactggaagcattccccttgaaaaccagcacaaaatccagacaacactattcaatatagtattggaagtcctcaccacttctattcaatatagtataggaagtcctggctggggcaatcaggcaagagaaaaaaatgaaaggcatccagataggaatagaggaagttaaactatccctgattgcagaagacatgattctgtatctagaaaaccccatagtctctgcccagaagctccttaatcttatacataacttcagcaaaatttcagtatacaaaattaatttacaaaaatcagtagcatttctatatgccaacaacatccaagctgagagccaaatcaggaacacaatcccattcacaagtgccacaaaaggaataaaatatctaaaaatacagctaaccaggggtgaaagatctcgacaattaaaattacaaaacactgctgaaagaaatcagagatgacacaaacaaatgaaaacacattccatgcttatggataggaagaatcaatattgctaaaatggtcttgctgcccaaagcaatttacagattcaatgttattcctatcaagctacctatgacattcttcacataactagaaaaaactattttaaaattcatatggaaccaaaaagagcctgaatagccaaggcaatcctaagcaaaaagaacaaagctggaagcatcacattactcaatttcaaactataatacagggcttcagtaaccaaaacagcatgaaagtggtaccaaaacagacacatagagcaatacaaatgaatagagaccccagaaataaggccacacatctgatctttggcaaacctgacaaaaacaagcaatgaggcaaggactctgccatattcaataaatggtgttgagataactggctagccatctgcagaagattgaaactgaaccccttccttacacaatatacaaaaatcaactcaaaataaagactaaaatgtaaaacctaaaactataaaaaccctgaaaggaataatcattctggacataaaaactggcaaagatttcatgacaaagacaccaaaggcaattgcaacaaaagtaaaaattgacaaatgagatctaattaaactaaagtgcttctgcatagcaaaacaaactatcaagagagtaaacacataatcttcagaatgggagaaaatatttgcaacctatgcatttgacaaaggtctcatatccaaaatatgtaaagaacttaaatttataagcaaataacaattctccattaaaaagtaggcaaaggataagaatagacacttttcacaaggagatataaatgtagcaaacaagcatataaaaatgctctatatcactaatcattagagaaatacaaatcaaaatcacaatgagataccatctcataccagtcagaatagctattttttaaaaagtcaaaaaaataacagtttctgtcaaggttatagagaaaagggaacacttacacactgctggtgggagtgtaaattagttcaactattgtggaaagcagggtggttatttctcaaataactaaaaataaagttaccatttgacccagaaatctcattactgggtatatacccaaaagaatacaaaacattatacaatagccaggcacagtggcccacacctgtaattccagcgctttgggaggatgaggcgggcaaatcacaagttcaggagtttgagatcaacctggtcaatatggtgaaacctcgtttctaataaaatttaaaaaattagccgagcatggtggtgggcacctgtaatcccagctacctgggaggctgaggcaggagaatcacttgaactcaggaagcagaggttgcagtgagccgagattgagccactgcactccagcctgggtgacagagtgagagtctatctcaaaaaaaaaaaattgcaccataaagacacatgtgcacatatgttcattgtagcactattcacaacggcaaagacatggactcaacctaaatgtccattgatggtagactggataaggaatatgtggtacatatacgtcatgaaatactatgcagccataaaagagaatgagatcatgtcctttgcaagaacatggatggagttggaggtcattattgttagtaaactaatggaggaacagaaaaaaaaatatgtatgttctaacttataagtgggagctaaataatgagaaccaatgggcatgaaaaaggaaacagccaacactgagacctatttgagggaggggattgggagcagggagaggatcaggaaacttactattgggtactatgcttagtaccttggtgacaaaacgttctgtataacaaaccgccataacatgagtttgcttgtattaataaacctgcacatgtacctctgaacctaaaataaaagctgaaaaaaaaattgagtcacagatcctaggttaagaaaaacaaaaaaatagttatgttaaaaatacaaaaataaaaacaatattgctttttgtagatataaatactgaaaaaacaaatattttaaatgcagcatttttttttttttggttagatggttactaaggcaaaaagtacaaaatgcagataaaaagaccttagcgtgaatcacagatctgcactaaaacattcatataaaacttagcaatttaattaactcccgtgtacttcaatattattattttaaatggtaatgagaattcagacttcaaacatttattgtgagaagtttatgagttaatgcaagagaagaatttctggtggctaatgaacatgcaaaagcaaatgtttttcaccttacaaatatataatgttgccttaacagtactttttataaaaaaaatttaataagtatatgtaaaaatcataaaattaaattaaattgaagagatttaaaataagtgtatgtatgaataattaagagtagattattaaaatgcaaaccagaaaaaatagttgctttatttttactcaatttttatgtaacttcttcccatatcattttgtatgtaggtgttaaaaaaagactagtacaattgtataattctcccaacattaattttcaaatattacctgtaacataaattatttactataaaatattgtatctacaacttcaatgtttaagttttttatttgtagtttccctcttgaaaagaaatctgtatatattcggtgcagttttagaaatacatatcaaatcttgaattagataacatttggctttttcactattccaactctttctcatagacattattatattggttatattatgtatacgacaatttgaataaaaataacgaagtgggaaaaatgttctattagaaacaaatcattaatataaatttatattaagaaggtatggtactaacattagcatagattaaaaagtatataaaaatatactctcacgtctgtgctgttgtatgaacgttcgtatctacctcaaattttcagtgttgaaatctaatcccaaggtaatagtattaagatgtaaaggcattggggagtgactaggtcatgggattaggactcttataatgggaatagtgcacttatagacaccagagagctaattcaccccttcgcattgtgaagacacagctaccaaatactgtctatgaatcagaaattcctcatcggacattgaatctggtgatgcttttatcttggcattcctggcctccagaactgtatggaataaagttctgttgtttaaaagtcactccgtttatggtattttgttatagtggcccaaaaggactaagccatctggtcacgtaatatatagaaaagggtggttttcaaaaagagtagtgtatattatagaagtttcactaatggtgtttattgaattgggaatccgtatgaaaataaatgaactacactttcacttttacagtaaaataatttcagtagattaaagatctaagtgttaaaagtgaaataatcttttaaataaataaaacacaattgacatgacttaaagggggacagggaacaggtctttttttttttttgagacagtctcgctctgtcacccaggctggagtgcagtggtgtgatctcggctcactgcaagctccgcctcctgggttcatgccattctcccgcctcagcctcctgagtagctgggactacaggcacccgccaccatgcccggctaaatttttgtatttttaatagaggcggggtttcactgtgtgttagccaggatggtctcgatctcctgaccttgtgatccatccacctcggcctcccaaagtgctgggattacaggcgtgaaccaccgtgcctggccagggacaggtcttttttctgtttttcagcaaacacaaaatcactatggagaaaaatatttcaaatttgactatattaccttaaaagttagaaaaaaaatctttttcaacgaaaatataagtagaatagtaaatctaaatcaccagctagggataatgcatgccatacatgtaagcagttaaatttttgatagataatacataaaaggctcacatctcccaatacagagaaacatagagaattgtgtaaatgaatgggcaaaagacttaaataggcagttctcaaatataaatataaaatgagaaacataatgcttaatatcattaaaaacagagaaaatagaatctaacaatcaaggatatgccaagaaatacccataacatttaagttgacaagacaagaaattctgcaaagccaaaggttgtgggggcatgtagagtagtgagaacttttatgcatcactagttgagttataattggattaacaaccttggagtactatttgcatatttgatgagtgtgaatatgtatatattctgagacgcaagtattccactcccaggtatcacctataaaagtggttacacatatgtgaaaatattcatagtagcattgtataaaaccatcaaaaattattaattcatgcatttgcccattatgaaaaattactttgctttctaaaggtaggatagacccctgtgagtcattacagtaacttgtactcaatatagaccaatgtgttcttgaaacagtttatactaatgtgtctgactcactactacagtgaaaaagaaataaatctggggccgtgcgcagtgactcatgcctgtaatcccagcactttgggaggaaaaggccggtggatcacctgaggttaggagctcaagaccagcctgaccaacaaggagaaaccccatctctactaaaaatacaaaattagccaggcatggtggcacgtgcctgtaatcccagccacttgggaggctgaggcaggagaatcgcttgaaccctggaggtggaggttgtggtaagctgatatcataccattgcactccagcctgagcaacaagatcgaaactccgtcaaaaaaaaaaaaaaaagagaatgaaagaaatctggataattcaacccattaaactagtcaggaattacaaagctgaagttgtgtcctagaagtagtcccttgatataataggaaaataaatcaaaatttatttaaatatatatatatatatatataagtcatggctaatagcttatcttgaataagttatacctttctaataaatactttaaaagcagtaacgatttttgtgataggccaaactgtaacatgactccagtgtttctcttaaatgaacagtcctgtatttttttgagttggagtctcactgtgtcaccaggctggaatgcagtgctcactccaaactccgcctcctggattcaagggattctcgtctctcagcctcctgagtagctcggattacagatacgcgccatcacacccagttaatttttgtgtttttagtagagacagggtttcaccaagttggccaggatagtctcgatctcctgaccttgtgatctgtccgtctcagcctcccaaagtgctgggattataggcttgagccactgtgtgcagtctaacttggttttaaccaatagaatatgacaaaggtgaagcaatagcactcctgtgaccatgttttgttggagtatagccaaggtaaaaggattttgaaaatttaataaaggcccctaataagttgactttaagttaatagaaagtaaattatcctccttaggcttgacctaatcaggctagccctttaaaagacagtctgaaaatcagagatttttttctgctgtctttgaagaagcaaaactcttctctgatatataaggctttgaggaaattcattctaccaatactgtgtaagcttggagcttggagatgacctagaacctcagatgagtccccagccctgacaccttattgcagtgatgaatgccccagtagtagacccagttttgccatgcccatacacttcaactatggaaactatgtgataactaatgtccattatttatttccattaaatttgtgagagcatatagagcatatatagaaaagtgagttactcaaaattaaaattaaaataatgattacatatcttctcaaataatttaacaaatatttctcatttctgggctggtaaattaaatttttataactctatggaatattagttttgtatctttctcttttctttatgttccccatctgagcctggctggtcagaatctatattttaaaaaagcagcagtaatatgtctaatctactcctgttcaataaccttggagaaagctttgaaattcctttggcctcagttggttttctggcaatatggtggtctccaaagggactatgtgaatgttaagtaggtgcacaagctgctccattgttggttgaagagatactgtgagggcatttatttcatttatttgtcattgcaaactattaaaaatccagttttcagattgctattatttaaatgatacatttctatgattatgtgcacattaatcttaatgatgtcattcaaaaacaaaactacctacccaaacactcagcctagacactgacaacataaaccatgctttactgtctatattaacataattctactattccatggtcttcattagcattattttaattttcctaaatgatccttcccaagaagaatggtttgcatattcattatagaaagtttctgaaagacttatgactcctcaacagaaagtatcaacaatttgggggctaagttgctataaattcctcctcttaaaatccttttcatacattcccaacaatcctatgttggttttattagctttaccaaatccaatcaagtcctctccttgaaccaccctcctttaattgaacttccaaatctgactagattcagagtttaccttctcagagatactgacagagctttgaaacatggtgttttcccttatcaatggagacaataaattcaacttgtctattaacttgttatttgtttatattaggagacaaatgacttaaggacaatataatatttatgaaacattctaactctaaagttctgcactgattaaaatgatttcatcctttagatttttgcattcctaaaaatggtattttcttttgtattttgaaccatttatctttctcttgcttgcattgaatgagccatgaagcaatgttagtatggtagattttgaaatattttaaaatgtcttaaagtcctattcttgtacatttaaataaacaattttagaaaaaaatgaacagcaatattttcgaaagttctaataattattttgttacttaataacatttacattttcaattcaaatttacaaaattatttggagaatgtatcctagggataccacacattaaggacctgatctcccacaataaactctggacttggcttttatttgtctttatcatttcagtagtgcatgacacatgactttatatgagatattcttaatatgaccattttgaattacagttttaaaagaatgatgattatatggcaattgccctgttttaattctttatatacagatatttaaaaaatatttatatatatatagcttgtagcaaaatcagagataagaaataaaaacacgagcaagtgtatcataattgttttttggtccataacatctgcaggaaataactgaacgtttcagggacatgtatgggtacttggttttagataggaggtctcaggtccccgtgtagtttttgcagtgaatcatgtaacatgttaaaacatggtatgttatgtaaaatattaaagcactgtgataatatttcccaaaattacctgtatgctacagactaatattccctattacattatattaattatttataatattattaaataagtaaattactaacttgttaagattataaggaatgacttaaaattataaaggttcttttcaggttaataaagatgtatattatattgttatatatccaagtaatatatcaacataatactttaaaaataattaatatgttgctatagggaattatttctttaaaattcagttaaattagattgttcaatattttatttaacttctcacagacacaagtagctaagaactgaaaggagtaatttgcagagtaaagtcaagactgctgcaaatccccacacctgctaaaactcactcctctgctagccacagctggaggaagaaaatgactcctgatttctattttaccttccaaatctcaagcacatgcttttctttggcagaatttaaacttggatagtggtgtcaaacgcttctgggaaatgcaattccaagtcatccattctctgtgtaactggggatattataggtgtagggaaaaatagtgttgtataccaatggacattcttgaggagttcaccaatgctcttcataaacttgatcttgaattactcagtgtcatacctcattttatcatttaagtgttgaggtataaaaaagaatttcatcatttaaatcaatattgtatttatatttatcaccactatttagacatacttctttattattaaaaatttagtactttagtccttttgtttcatgcaatgttttattgaccaaatatgattttggaaaatgcccaagctccaaattagctccactggatttccaaactgcatgtataacaacttatctgacatttcccaaaaaatgtctaatagacatcttaaactgaacagaccaaagagaccaaagaggtacattcaacttccttctgtacttttcttccttatccaggaaaggacataattttatacacttagttatcatgtcatgcatcacctaattcaggaaactcttgaaagtaaacggggatgctactattaattaggttgagataatagtcataaagcagcaaaatatctgcttgatatctctgtctatttgcaatggctatcctgtctgctctaccaccaaaagacgtctttgtaggctacactaacatcaacatgacatttcatttatttatgtagaatatatcatgaaatgctttttatactatccacagagttatgtagccagcattgaaatatatttttctgcatatcttacttcctgaaagcaactctgtgcccataacagtcactccccagctcctcactcccttctattccctaccaaccactaatctcctctttagcctatatacttgcatgttctggacatttaatgtaaatgaaatcagtcaatatctcatctttcgtgactgagttcttgcacttagcataatattatcaaattttctccatgcatcaatacttcatttttttcaatgccaaataatattcagttgtttggatatacattatacaagtgccttgatatatgcagggaattgttccaggactcccatgtgtagcacaatttatacatactctagtcctgctgtaggcactgcaaaacccatatattcaaaagtaggccctccatgtatgcaggtttctcattcagtgaatactgtattttagaatcacattggttgaaaaaaaaatgggcatataagggaacctcatatgatttggctgtgtcaccacccaaatctcatcttgaattgtagttcctataatccccacatgtcatgggagggacccagagggaagtaattgaatcatgggagcagtttcccctatgctagtctcatgatagtgaataagttctcatgagatctgatggctttatgagaggcctctgccttcactcagttctcatttttccttctgccaccacgtgaaggacgtttgctttcccttttgccaggattataagtttcctgaggcctccccaaccatgctgaactgtgagtcaattaaacctctttcttttataaattacccagtctcatatatgtctttatggcagcatgagaacaaactaatgcagtaaattggtaccaggaggagtggggcactgctataaggatactcaaaaatgtgaaagcaagtttggaactgggtaacaggaaaaggttggaacatttttagagctcagaagaagacaggaaaatgtgggaaagttaggaacttcctagagacttgttaaatcacattgaccaaaatgctgatagtaatatggtcaatgaagtctaggctgaggtggtctcagatggagatgaggaccttgttgggaactgaagcaaagttgtctctttttatgctttagcaaagagactggtggcattttgtccttgtacaagagatctgtagaattttgaacttgagacatatgatttaggatatctggcagaagaaatttctaagtggcaaagggttcaagaggaagcagagtataaaagtttgtaagatttgcagcctaatgatgaaatataacagaaaaacccattttctggggagaagttcaagcctgctgcagatatttgcataagaaacaatgaggagcagaatgttaatcaccacaacaatggggagcatgtctccagggcatgtaagacaccttcatgacaagtcctcttaccataggcccagagtcttaggatggaataatggttttgtggaacagggccaggcccccctgctctgtgcagcctcaggacatgggtgccctgcatcccagctactttagctgaagccatgtctaaaaggggccaacatacagctcaggccattgcttcaaagggtgcaagccctaagccatggcagctttcatgtggtgttgggcctgtgggtgcacagaagtcaataattgaggtttgggaacctcttcctagatttcagagcatgtatgaaaacacctggatatcctagcagaagtctgttacagggatggagcgctcatggagaacctctgctagggcagtgtgaaagggagatgtgaggttggagccatcacacagagtccccactggaaactgcctaatagagctgtgagaggacggccaccatcctacagacaccagaatggtagctccactgacagtttgcatcatgtggctaaaaaagctgcaaacactcaatgccggcctgtgaaagcagccaggaggggggctgcaccctgcaaagccacaggggcagagctgcccaaggcaatgggaacccaactcttttttttttttttttttttttttttttttttttttgagacggagtctcgctctctcgcccaggccggactgcggactgcagtggcgcaatctcggctcactgcaagctccgcttcccgggttcacgccattctcctgcctcagcctcccgagtagctgggactacaggcgcccgccaccgcgcctggctaattttttgtatttttagtagagatggggtttcaccttgttagccaggatggtctcgatctcctgacctcatgatccacccgcctcggcctcccaaagtgctgggattacaggcgtgagccaccgcgcccggccaagcccaactcttacatcagcatgacatgggtgtgagacatggagttaaaggacatcattttggaattttaaggctcacagatggaagggacttggcttgtctctgatgagactttggacttggacttttgggttaatgctggaatgagttaagacgttgagagattgttggaagacataattgtgttttgaattgtgagaacatgatatttgggaggggccgaagcagaatgacatggtttggctgtgtccccactcaaacctcatcttgaattgtagctcccataaaccccacgtgtggaagctaattgagtcatgtgggcagttcccccgtgctattctgcagatagtaagttctcacgagatttgatggttttataaggggcttgaccctttgctctgttctcattctctctcttgccaccatgtgaagaatcccatgtttgcttccccttctgccatgattgtaagtttcctgaggcctccccaggcatgctgaactgtgagtcaattaaaattctttcttttataaatgagtcagtctttggtatgtcattacagcaggatgagaacagactaatataaaacccctgcagtaacctctgtttttcaagggttaattatatcttgtttatgcactatttgatatgctgttgaggtatttccccctttccattgttatagatgctagtataaaggttcctgtacagttatttactagaaaaatattttcatttgtttttggtatataactataaaaggaaatgttgggctctattaactctatgtttaacttgttgagaaactgtcaaatgattttcaaagtggctgcactatctcacattgtaaatcacagtataagagagtgctcatttcttcatatcaacacaaacacttgttatcatcagtcacttttatttagccatcctagtggatttaaaatggtatttcatttgcatcttaacctctctaatgactaatgatgcctagtattattttcatgtgtttattaatcatttgtatctttgacttggagaaatgtctattcaaattcattgaccatttgaatttggttattgagattaattggattattggcctgttaattaaataacatgtacatttaatgtacctaaaagagaatggacaagggtttacaaatgaaataatgggacgaagattttaataaaacctatgcatctctttcttgactaattgggtgtttgtctaatatttcatggtaggaactgagctgctgagcctggtgaaactagtagttccagttatgaattcgcatgctttatgatgcatttttcgctacacacatcactcacctgaaaaaaatgcataaattgtcatatgctattttaaaccaagttctgctggctacaatagtgctgtaagttgtactaattgatttatatggtttgccatgaaataccttatttataaattataacattgaaataatttaaatcaagtttacttactacaatttagaactaaacttttatcactaagatttaagttcaattgttaagacaaagaggggaaggggtagcattttttagcttcagtgacctgtagaattctttccaaaacatctttaccacataaaaatgttaatattatgggggctgaggttatatcatttacaattatagctttaacctgaatgtcttctgtatttactattaaatatatatgtcacatcttccagaaataaaactaataatatggtgtttacctgtcttcttgttgagaagcaaaacaggcatgggattctggacaagttgattaaagtcattgggctgcctcttccaaatctttaaaattaagataataaatgtaattatctcatagggttattatgcatataaaatggtcaatatttgtgaaatggtaaaaagtgtatctaacaaattttaaccattaataatactaaaacaaacaaataggtcacttgaagatacatttttgtttcaggcattcactttaacaaaccaacaacactcttttttgctttaccaagataaaaaacagccatattatctattttataaaataattatagtgttagccgggagcgatggctcatgcgtgtaattccagcactttgggaggctgaggcaggcagatcacaagatcaggagattgagaccatcctggctaacacagtgaaaccccatctctacttaaaagaaaaaaaattagccgggcatggtggcgggcacctacagtcccagctactcgggcggctgaggcgggagaatggcgtgaacctgggagggagagcttgcagtgagcggagatcatgccactccacaccagcctgggcgacagagcagactctgtctcaataataataataataattattattatagtgtcaatatacatataactattatgatgtacatattttattataccaaatatgaaaatacattgcaatgctaacaaacaggaatttaacatcttacttttctaaatgtaacttctataacatagtattaatttaggataaaatcaagacatagtaaaactaagtaattgagaatgttttcctttaattagaaattttaagctcaattaatttcccttcatgggggaaaccagaattgataaaaaatgagactactttttattaatttgagagggaagagataactttttgtttactatatgcttagttatttacattttcatccagaatatataataggaactaatgttgaatgctagctatatacgatacatttttaatcactattctacaataaaacattttaaaattatataatattatctcctaatctaggacattagtataagatatctactaactatgcatgacaggatattagcctctttttcttttcacttaactacatttttatcacaaaatgtaggatatttatgtatgcatatgtgttttataaggaagacctatgtaatcagatttctagggatctatttgaatgaaggatcaaagtgcctctgggaaatatcttttcaatgaaacagcaattttttgtttcaaggcacgacatatttcactatgaaaaaaacatagccaaaacatgggatttataaccaacaatacactggagaaaaacgcacaaaacacaaagctaatttcgtattaaactagttgggagaataaggcctagaaatgttgactgaatgtatccttcattgtctcctctgtagaaaatccttcaaattcacttgtatctttttcttagcacattgaacccttaaatatttaataatgaaataaattttatttttatttcagttaaatttgatgggatagactgccttttaaatgttatgttaccatcctgtaatatattaatggaccaattcacttaacaaaatgaagtttcttgggaatattttacaggaccaggagaccaagagtcacaaatttttatgagaacgatgaaccagtatgaaaagatatataggaagggagattgcttttcaaatcttttgatttgctacaactttaaacttacatggtcattgcaagaataatacaattaattttcttagaacatgtacccagttttatagttgttaacattttatctcattctctctattcataagtttacatgtatacatatgtttgtttttcagaacctcttgagagcaccttggatgtgctggacccctttacccctaaatacttcagtttgtatgtttaaagaaaaagggaattttcttacataacaacagaaatgtaaaatgctagaaaatttaacattgaaacaccaccaatgtaacctgtagtccatatttaaatatcaattgttccaataatgacctttatagtttacagttgctgcttccaggattatgtgcagaatcacatatggtatttagctgtcatatcttttaagcatctattaatctggaacatttccacagatttaatttctgtttcttaaccttgacattgttaaaaagtacaggccagttatcttttgcaatttctctaaattgaccttttctgatatttcctaaagattagattcatgttatgcagtttgtcaggcataccacacctttggtgctatgtccttctcagcacatcatagctgaagacatatgtataatgtgcttttcatccagtattggtaacattagcttttatcacttaattaagaaggtgaccacagttttttcctgtaacattaataagtgcaattaatgaataagcttgctgtaggtatctaacttgagattataaaaaaattctgttgtttatcaaatttgaaatatttgaggatttttttggtatacacacacacacacttatatacaattttaacttctgctataagagagatctttcctttatttcctttttatctgccctcccccctttttccccgtccttcttttcttccttttttccttccttgtttccttatctttctatttaatgggttattgttttgtttaatgagtggtattacacaatgtggcattatttattttgatgctcaatttgtaaggaaaattattgagtagaaattcacatatactctctcaaattctattcttgcctattttccgtggataatatttgagtctaggtacaagacgttgcaaataaaagctgaaagggttgaatgaaatctgaaagaaaaacatatttttacaatttatgtaacagaatattttttaaagactgaaggtaagagatttgacttccagaaaaaaatacacgatgtaaatacacatagttgatctagtgttttgtataccaaaggaaaccaggctaatatcttgggcagcaatacaaaaataaaccattagccaaaccagtagctcctttgacatcaagctctgattgccctggtacaaacatggaggaacatttactatgcataacactcttgcaattcaaatgaaatcccgtaatagtgacacctttagcaatcattgccagtcatgatcattctggggctttcagagtcatgaccattaaggccgtgaacacaatgaccgaaagcaagagagaagaaagttagtgacagctatataggagtgatatgagtagtgccttcaaagtctcaaattctaaactgatacagatataatataaataaacaagaaaggccacattaaaatataaaaaaacacagcaatttggttgcttactattatgtgaaataatatatatttattatttttaaatatatttatttaaaagtaatttgccatgtctttctcatcttcaattgaaatgttcatttctaaagtaacacatattaaaaacaaactaacaaagacacaaactaaaacactttgggccattgttgtgtagatttgtctaaatatttctccttctataactctaatttttttttttttttttttttgagacagagtttcactcttgttgcccaggctggagtgcaatggcacgattttggctgactgcaacctccgcctacgggttcaagcaattctcctgcctcagcctcctgagcagctgggattacaggcatacaccaccacgcctggctaattttgtatttttagtacagacggggtttctccatgttggtcaggcttgtctcgacctcccacctcaggtgatccgcccgccttggcctcccaaagtgctgggattacaggtgtggcccaccgcaccaggcctccttctgtaactcttgaatgatagtcagatgctcacatatcttctctatatgataccatacatctgtctgagtaactgaaatgtgcagttcccttttttaaggttttatgacttatagataaaatttaaattatgtaataaatattgaatattgagttacctgtcacttcttttatatacctctttggaagctcttgaacttatcattgtctcgttcaagctgctgctaaagtgatcaaatcactatgtgttccaactaattaatgcaagtgcaactgaaaggacctcacctcatatccataccatgtgaatctcagctactgccttgaggtatctatgaatgcacaactcagaagtgcctgacatgtaacatcttgggagtaaaacacctacaaatcagacactagagctgaagaatcaagtctttcccatcagtttcctgggagtttcagggattcttagaggacattcctaccacatcttccatcagttgccacggagccagccctctccataacctatttgcacattggctttctattccttgctcactcctcatgttcccttttgttttcttggattactttccttgacaaagtgctagctaaaatgacattgtttcaggccgcacattatgtgaaactatttgaagaaaatatgactgtctttttgcattttacagatgtcaatttagtcagcaacataattttaatttgaattaaagactaaaaaatgaggcataaactatactgaagaatttgttttaattccctgaaatttttatttttttttgcctttttctaagacagtctcttgctataataaagaaaaaatgcatgactaagaagcagtctcttaaagtgtcttttgcctttaatcagtattgtaccaattatgtttctgagtatataattgtctttgctctcctgaaaaggaaaaataatcagttttcatgagacaaaaattgtgtccccaaatgtgaaaaaaacaatttctttaaatttctcaaattataatcatgtaggtttccttgcaaaccgtaattacacagtctccctataatttctttcagtacagatttagctcaagtcttctgtatgatcattgtatagcagtgatacaatagcatctcctcacatagctctgctgtggctaagatttcctggctcatatttgcacaaaaggcatgggaagccaagaagctggaaaaaccaaagatacataagaattcatttaaaaaaaagtaacagttttgaaagccacatttgaattcattacttgcagttcctataaaaataccttgctactgtgcatacttttcttagttcttggtgaaaaaatcttttatttatacatcaactcctcaaagcagctatgaaaaaaaagaaaattattaacataacacttgctaacattccatattttccttcactgagtatattaatataatgttttaaagaggcatatattctaagaaaaacactaactttgctgaaaaacattagttactatactagagcaatttgaaacaattgtatgtttcctgtaaaattcatattaaaatatttttgccatttcttttcagttctatgtaacaccagcaggtggcaggattaaggcacaaaaacggcaaaatctttgagaaatgtaaaagaaatacattatgcttttttcaatgtcttaggatggcagtcatttttctttttgtgcatacaggttactaaaatcattcatggctactagtccttagcagacacatcgttttccttaaaccagctgaagctgtgcccttttaagactcttctgatcacaaatcaccattgtgctgcagtaattttcagcttttaccataaagtgagtccaaagcatatggtgtgcataaatttggattatcttcatacagacaaagattctttgcttgaccaaactttagtcagcctccggaaacttttcctaagcctgcctgtgcacttccttgcaaaatccagctttagcaaagaaccctgctaaatcaggttagctagaatcaatctccctctccctgatgtctaatcgcccaaaatatttaatcgggttcttcattcgctgtcctccaggagatgtttgatcgccctggcctgccttcagcaggaatcctgctaggtcagtgtagccagaatacctctaattcctgatgtgtcctattagtaatttttcatccactgacttccaccctgctctgtggctataaagtcccacctgcccacgctatattcagagtggagtccaatctctctcccctactgcaaaatcccattgctgtggttcatatgtaccaattgtgatggttttgaataaagtctgccttacaataccttaacaagtattgttgaataattattctctctttaacaatactagattacaacaagtattgggaaaattgtttgggaaaattgtttatatgatgaggacaagactaaaattaaactactttgctttttaatactctaagagtttatagtgaatctctgataggacactttgccacagttttggggcaagccagataatgaggttatggattacaggccttttaaaaactggctaaaaggggccagacacagtggctcacgcctgtaattccagcactttgggaggccgaggcaggtggatcacctgaggtcaggagtttgagaccagactggccaacatggtgaaaccccatctgtaataaaaatttaaaaaattagcccggtgtggtggcgggcacctgtaatcccagctactcaggaggctgaggcaggagaattgcttgaacctggaaggcagaggttgcagtgagccaagatcatgccactgtactccagcctgggcaacagatcgagactcggtctcaggcagaggcacttctttttcccagaaattctctcagatattcctacttctattttccttgtcaacaaacgcacacatgccttggtggtagaaatggttctttacagtttacttatagtcagtgaactgagtaatgtctacatttttttaaataattatattccctgagttccctaatcggtcacttttcttaaaggaataactcttcctatattctttccttaatatccttccgctttgtatataatctagttagaataccacatgctaaactaataaaaaattgcttctacaaaattgtgtttaataactacttgttaattagaggaactgaaacaactacattttagtattaccaagttcaggaaactttgcaaatacttgtttaagaattaagatgagatgataactttaaaatgtctggacacattatctttaacatactccttctataataagagaatttgcaaattcttgttttactgaagtaaaaatatcttctcaaataaagtactatggaaaaatttaaacatatattttctatgttatgaaataaaaggaaatcattttatgctaattatagaggtttgcacaatattatcaattgagatattagataaatatatgcaataagaaaaacagtctgaagatttacccattgagtatcctgagactggagtgataatgcataagatgtaagaggccactatacaagaaaacagcaatatattatgataagaatgttacaataatactatgcatggagtgcttatcatgtgttacaatatagaaggtaagtgatattttccttagtttaaattgatgctctctataataatgcaacaaatttaaaatcaacccagccacaaaaggaggaaatgacattgaaactgaagaggataggattaaaagctgttgccttgtcttgtgcccatgttactgttcatgataatgtgtggttctgcattcatgcatttattttgtattccatttttcatccccacaatttcagctcaaaacatagaatttgacactattttaatatcagtatgatttctttccctatgatgtttttcaaaataacaatggaattggtgttattcaaatatactattacttatattgtattatagtaaaatgtcatgcaattattgatgaatcagtgacatgatttgtatgtaagagttgtagttctagttttatgagaactattagttttagttttatgcacaatacctgatttaattcttgcaataacactataaggtaagcactgtttttatcctcaatttttagcgccaacaattgtgaagaacagagaatttcaagaacttgaccaagatcacacagccactgtggaacaaaaatttaaacctaggcaatctgagtccaaaccccattttttttttttttttttttttggtctgacaaagaaaaactcagtagtgcagatactgtgtttgtaggagttattggcaaggcatctttcttttgagacctgatacttggaaacagtttctaagcgttaggcaatcatcacaacagaatacataggtggtgagggcaagagtaacctagaagtcagcaggaaggacagtaatggaggtgatgcttacctagtgggaagagaggtgcaacaaaagcataaggaagatggctgccaagacagtgaacttcattttcacactcttctgaccttgggaaatggccaggccatttgattaggaagaaagaaaacaatcattgccatccttaatcatatggtgatctgacaagggaagctgtgaaatgtgatttctgaatcagcatgtaattggttttgtagacaatatgaaaagacttacagtggtataaactctattagaatggccaaactatatatagcccatgtcacattctgctcaaaaggcacattacatattatttttctaccttaaagtcttttaagtatgattattgtttttctgcatcagaagttgtggtatctaacaaaaaaattaacacaccttattatttacttattaaattttgttaagctttctttaatctaatgtgagactcaaataatatatccctctatgaatgaagatcaaagaaagtcttgctggaatttaaaagtatccatatgccacaaggatataagaataatacctcgtgttggtatttgcaaaaataaaatgattttttaaatttatgtttgagcttgtttgcaaaagtttcatgaatttcaaatctatttaagtttctatggggacttgcttgtagtagtttcaaacttaatagaattcagattaaatattttgagttcacttatctaaattttttgcattagtaaattagtaaattatataaatatatcaaagtaacaaaggtttccaaagtaaccatatgtcacggtaaatgcacttcttattatgatcttttctcatgataaaccagtatgagtgtgctaaaaattttaaagtgaaatgcaaattgaggttaaaatacttgaatctattgagctttttgttctgagactcttgagtctattacattttttgctctgagactgtgtgatgccccaatcaagtatttctatcagattaaaaaaatattttatatatagcagcaaactttccagaagaaaatgaactatcaaatagatggacttatgtatgtaatctgtattttaattatctttttatttgggctcttgcagaataacagaaaatctgaaagtagcataggtcataaccacataaatagagcatatagatattattataatctttatgaatacacctttaacagaaaaatattgacatattctgatgctatagatggcacttaagaagtatagaaaaatatgactcttataataaaataaaatgatcaaaaatattttgtttcctgatgtgactaaacctgtatataaatagagcatttaggacaccaatagaactatattgaatttctgctataggaaactgaattgtcaaagaagtttttttttttaatctcacataaaaacaatgccccaatattgaacaagccaagattgacactgttctttaccttaatgatatcatcaatgtatttgcactgtttatctttttagtctacctaccttcacatggattttacagtctcatgtccacaaaatgggctgaaaactccagcattgcaaccacactctaagcaagaagagtagaacagacaaatgaaagtaaaggaggttacaaaaaaaaaaaaaaagcaaaatgagtacacgagctaattatttaaccttgtcaggagaacaatcaggttgtctgaaaatcccaccagtagacttccacttacatctcatttgttgcaagtatgttagatttctatccattacttcatgggaggctgggaaagtaaccattactctggacactggaccgtttgcttccccaaagaaacttgggaatataataataaggtataagagactgatcagttttacaaaggcagctagctgggtttgacacaaaatatctcacagatgtaagaaaaaaatataaacagaatgagataacaacaaatgaagtcctaaatgcttatatgtgattaagatttgtatatcttcttagtcaatttatctctttatgttgatctcatactgttttaacagatcttttcttcttaattttcaaagaggttaatactgactcaggtgaagacttttgttccagaggcaacataggaaaccacctactccatttaaaatgtttttcataaagtatattagttattcaattttatatttttgaatacaagacagaaagctgcttgaattacgagtaaatttctgagatttctttttgcgtttgctcacagtgagaatgcaattttgaaacatgttgcaattttagttacttagcttaatggaaaattggtttctcatagtcaaattagttaaattaaattctggattatattgcataaactcaatagaaccattgacatatttcagtctgtctctaaaatttcatgattaattattatctcataaataaactaacacttcaatcacgtactcaaccactatatacttctcttggggacattgtggcactctacaagaaaactcagtaaggtatttctccatgactttgaaggaagattttttaaaattaaaatttgacaccaatatagaatattattaaagctcatattcattcacctgaaaaataggaataatactattctacctactgaattgtggtgggacatataataagaaaaatattttgaaaatgttaagttttaaagaaaaacaataaagacaagggtaagaacagacagaaatgtaaacatgggagagtagtagacaaagaaaagaagaaaattgtttcaggagatgcaattttttctcaattttaaaaagttttatttgacagataattgtatacatttatggagtacagtgtgatgttgtcatatttgtatacaatgtgaaatgacgaaatcaagcttactaacatatccatcgcctcacatacataacataatttgtagtgagatatttaacatttactctcttagcacttttgaaacttataatacattatcattaactatggtcaccatgctatgcaagagatctcaaaaaattattcctcctgtataactgaaactttacactcatctccccatttcttctctcaccttccctcacccctggtaaccagcattttactctctacttctataaatttgacttttaagtaagtcacattttgcagtatttgtctttctgtactagaagcataatgacttctagtttcatccacgttggtgcaaataggaagatatgcttcaatggtattactaatatttaatcttcagatttataactcatgagatcttaaaggctatcttttgttttccttttgaatgggagctctccatcttgcaaacaacaaattcaaggtcttgccgtattgtccaggctggagtgcagtggcatgatcacagggcactgtcactttgaactcgcgggctcacgcaatcctcccacttcagcattcttagtatctaggactacatgtatgaaccgccatgccaggctacttttttattattcattgtagcgacagggtcttgctactttacccaggctgatcttgaactcttaggctcaagtgatcctcctgctttggcctccagaagtgctgggattacaggcatgagtaacagcatctacagcacctggcttacttttttttttttttttttttttttttgagacagggtctcattccctctctcaggctggagtgcagtggcatactcatgacttactgccgcctcaacttctcggggctcaggtgactctcccaactcagcctccccagtagctgggaccacaggcctgtgccaccacacctgctaatttgctttttttttttttttggtagagacaaggttttaccatgttgcccagactgatctcaaactcctgggctcaagcaattcgcctgtctcagcctcccaacatgagattacaggtgtgtgccaccatgcacagcacttgcctacatttttaatgtgtacctttaagcttttaaacactgacactttcacaaaaagcagggaagcattcatattttaatgagattttaaaatatttatgtgaatttaataccttatgagttatgccacatttttgcatgttttgtataacttgcttttatgaagttctcatttatttattccacatcacagttgctacagcaaccgattactgtaacatttatttttatggcttttttgataagactatcttcaaattacagcatgtctagaacttgttggatcataatttaactttcactgtgaagagacaacatattagtcctatcttggcagatttatattggcttcctgtttcaactagaattatctccaagctattaattctggaggattttgtttttcttttggtgattaaatggactagaatcaccatatctttcagggtgtccagagaaaaataccatttctgcaaccttgttcttctgatcaatgcttttgtgaattatgtcactttcagctagaaaatgtatgcctcaaaggctttcgttattgttcttgttgttactttttctgttgacttcaagggtgtcgtcttcattaccaaaagtaagaattattggtcatttagaatattttaaaagtttttccactactttgagatatacttgctttacatatagatagatagatagatagatagttgaatgattattttggtttagatgggtttagttacatacatataactctccctctctctctttctatatatatatgtatatacacacgtacgcataactctctctgtcgctctctgtatatatgtgtatatatatatatataaaatatctctgtctagatatctacttaatatctctatatatggagagaaagctgtatctatgtaatatatatatatatatatatatatatatatatatgctaacatagacttagattttatgaaaatgctaatcactttttttttttttttttgagacggattctctctctgttgcccaggctggagtgcagtggcacgatctcggctcactgcaagctccacctcccgagttcatgtcattctcctgcctcagcctcccgagtaggtgggactacaggcgcccgccaccatgcctggctaattttttatatttttaatggagacgggtttcaccgtgtcagccaggatggtctcgatctcctgatctcgtgatccacccatcttggcctcccaaaatgctgagattacaggcgtgagccaccgcgcctggcccacatttttctactttggctatttcacagtatttattagcctcacttaccttcctttgaacctatttgaatatatattttaaaaacatgatagaaaagtatgactctatgatagattaatgatttactccaaactacaaacaattctggataacccttgcgtgatgtgaaactcagaacagtcttttactttcattccactcctttttttaggatttaccttcttacattgaataatgagaaagaacaagaaagtagttgtcaaaggaagatagcaagctaaaaaaaaaaaaaaaaggggggggtgggaacatgacttacaaagaagattatcaggagagtccagacttcagtactggctggataaaaaaaaaaaaaaaatactgagtttactgccaatttgtaatttatttgtcaattcacagtggaaatttatttgtcagttcacagtggaaaaattcgtaattttcttctattattatgatatttgtaaaggttgtaacacatccacaaacatcagcgctgcaaatgcgtttaatattttgttagcaaatttgtttaaggttctactagtttgaataccagtcctatacagtttggcaacatatttgttattaactatttttcagttatttttaattgacataaaattgtatgtacttattatgtacaacatgatgttttgaagtatatatgcattgtggaatgacggactctggataattaacatgcgcattatctcacagagttattatttttgttgtgagaagactggatgttattgttaattaatatgaattagtaaagtgttgcttttttccttcctagctaggagatgtattatatatgcttattcaaaatggagagagagctaggtgttggttttgtgtcatcatttgtcattctgtcaccttctccgtatttttttttttactgctgtccccactttgacctggatagcagctcacttactctgtggctattcatcttctcaatttattggacaaagtgcctttgagaaaatgctgatccttctcaatggatgttaagggggaaattaatgttgggtagggtatatattcctttgctattccctctcattatttcccatcatccacaaagaaagactacatgtttcagatttactgaagtttgaggaaaatataaaaatacattataaatagtaaaaattctattatatgttagataccacttcttttataaaaataaatagattacatcttcaaagtcaaactatcagtctcataaatgcctcctttacaaacttagcattttttcttcaagtttgactgaggagtgtacaaaatcacctccttcttctaatctcatctggccccaccaacagagaccacttttctctcaacttgcctactcgttttgattttccaccccatagtacatttcccttaggtatttgttgtagaattttccacaggggcttacagaaggattctcaaaggttgataaaacagttatagattggtgcatactagttatgcccaccagttaaacatttagattagtattcaggtcagtttattcttctaatagtcctgagggtaattagtataaaatatacccatacgaaaataaagccaaatacacacaccaaccccagtcccaacatacatacacacatgaaacacacacacacaaacacacacacacacacaccagtctcgaagaaatattttttaatatagtagagttctcaagtaggatttaacattcaattgcagggacccctaacataatggaattacgtcctgtcatggataaatagtctttgtcaaaagtccctccaatataaagaaggaatgtaacctaccaatgttttaccaatcagacccacaggcattttagataatgtgggagctatttaagaaaaaggactcttcataagtcatttatgtaatgaaaagagatgttttagagaagcctggcaaccaaaagcatcaatagaaattttacatgatcaagtgtactggtagatgtagaggttttattacaatcacattattgtattgcaggtagtaatgacagtgttgtctttcaaatcaatttgtggagtgattctgattgtctttatcaaaattttctatgagcccttttctctagctctattaatgattctataagctttctaatatatattaatcaatacatttttccatgtagcaaatcagaatagcctgctttgactgcaagttagaatcttaattgacactataaacagtaaatacaattactttatgaaacagatcatcataaaaatgagaataggtattggtaaactaagctggttgagcttaaaaataatttatatgaatatatgtaaccatggtgttccatgaaatcttctacaatgaccacctgcacttattgaaagtgaagtccatcttgaagctaaaaccttagttactaaatagctgttgtcatggaacattgtgaaccacaagataaatataagaaccgtgggttgagtggtgcttgtgattgcactgagagcttgaaaaaagtacattagatgccaaaagttttaaattctcagttcaaggaaaatcaacatttaaataagtgtcccaaatgaatcacttttgtctaattatcatggagttaaggtagtgaaaaaaattataatctgaccatgtacattattaaattattatactaatcaaatttaccaatttaccagttcttttatatgaaaaatagaacaatgatcataaaccaataaggaatgggaattaaaatagggactctggaggggatatgggatactcagagcatcccagtttccaaaccaaattgagctgtccttaatagccaaaggagccttttcattcctgttgaggcagaggcctctatcttctttggggacttggaagaatattgcccaaggcaatgacttttcaaggggaagctaatagccctcattttgtaacaatgaaacaaggaaaggactagcctaactccatttctattcaaagggcctttgctcgtccctgctagtaggttaggataattttagactactgagataacaggcagtaatggcaatcatgtagtttttaaaaaataactctggaattaaaggagacgtatgaaaacaactaactatcttttattaaagatttagaggtgaattgtgacctgactaagggcaaagaagttcccagtttcctcagaccctccctgtcacccagatatctgtagtcatcagttgcctcttgatgtcaacccctgcctcttctctctgtccttaatgtagaaagagcctaaaatttgtactgacttaagatcgtacttctgaattttagttcatgatctttttgattttgctggtttttctgggtaaacctgcttttcctcccactgatacaggagttattaagaaataattctttaggcagatagtaagagtaaatgttctcggtggaaattttcctgtaataagaaacaaaccttaaaccatctcttttctaacagaaaaggctgcttgaagggccaggctggcaagctttgatatgcaaatgccagccattagaaactgggttcactcaatgtggcaattcctgctgtcctttccttcttactaggtgtaccaggtgtcatggccacctccagataacaccatgtgtttgaaacatcatggtgacctgcgtttgcatatgaaaggactaaggtgggagggccacatttttcacgggctacgtaaatgacacacttggtcaaaccaatcccctgagccctatgcaaagcagacacagcctcctccagcatcccagtataagcagccacttttccgcctctgcacatggggttttctctttgttcgagtcccccctccctctgtctctgtatgggggacctgttttcttccttccttctttcttgcctattaaactttttgctcctaaaaaccactccacgtgtgtctgtgtcattttatccaaaccggcgtgagaccaaggaccctggtgttcctccaatcatcggagccatatcaataccaacccttgtctttcaagtgtggtttttgagcagcaaatggctgaatctggttttgattacaatttctcagctctctcaacttttttttagttctaaacatccagagaagcctagttgtgaagtaaagtttaacatctaagtccaatactaagtgatgctttaacatctgttgaaatcagaagggtctcaaatggcgtagccacaacttcctctcctccgctcatgtgggtaaagtctcctaaccaaacaactctccttatcaacaggaccaggtgaagttcctgcttatccctgagcacagaagatttcagttttctgtcagaccatagatcaaatgaggcaatcacatttttcccagggaatgaaaaaggacaagcaccctcttgaaactacaaagcctgctttccacagctgctgcttatccactctgtttcaaggacacccccatgtaaccctgcatgacatgctgtgcccttctccctgggactgtgagtctacgtgactaaaacactgctgtccatctcatctgtccaattgcaggtctcatgtgttgagtcattctcataccctggagtgggaatcccttcctcatgaacaagaagagaaaaggattgaaacactattgaataagactaagccaataggagaaatacaacaaaagaatttggttatttaaataaaatacatggaaatttgtttaacttttttttttttttttttttttttttttttacaaaaaacaagaaggacttgttttgcgatatatttttagggaattacattttaagtttatgtttagggcactaaacataagtttagattgtaatgaattcattaacatgcctgcactatccagagattctgatttttgaaacctgtacttgatgggggccaatggaaaatgaaggtgaaatgctagatatgtgtttggttttattttgcaatacataagaatttatcctaagtactgcgaaagtggaaattataaagttattcacacattccctcattatggccctgaaggagaaccacaaaagccttgtttcaccaaaacacaaagaaggacattggtgaggaaaaggtcagtttatttgaaaagtactctgttggctattcatctgcaggccagagatgattctgcgatggaagtgggttcccagtttcaatagggaagataagatatgtgggtagtacaatccaagtagctgtaattgaccttcaaaggtaaggtaggaatagtagcagtaattgactgtcaaggtgggaattagaatagtttaagctgcagagatttttgattgccgataattatttatggcatcctcatgactaaaatataaagaaagtttatgaaagtctcacgagatctgtgaaatcaaactaatttgattctgttaaacagagattttgcttaggtcaatgcagtatataaaaatctagacctaaaccagtaacaaagaaccttgaaataaatgaaggcccgatactagtaagaaagaactctgcaacaaatgcacaagtatatacggtatatctttcttctactatttctgaataatctaaatgtacactgaataaagggaagtggagagaaattttagatataattgatattgaactgggttgatgtcaataccttgattaaaaacagtactattatgtgatactggtcagagctgcagctttgtagaggatcacaagataaatacattctggccatagtttttcttgtggtagaaacattcccccacacttctattgcatagcattgcataaaatggatgtttgccatatgtatatgaattttaatgtgagcaaacaatttacaatttgtttatgaaaaaaacatcttcattgtgttcacttttatatgatttatggttcccttgacttctcacgtggaatagaagttgattagggagataagcaatagattttatttcctgtactatctctttctctacattagctcaaagataaatttatagtaggctctttcgcattaatcatttgctgattacagaagaggtaaataaatattcagaaatagcatatttgatccaaatattattgttaattcaacttgaataaaagtgattaggagaaattcctatagaaaaaaattaatattcaataaattaagatcatggctgcctattaacaattcaactttgattacataagtataacttaatatatctatgacgtaaaccaagtgattatgttaataaaatgtcaaaatcaaattcatcatgaaatcaaaatagaaaattgtagcctattgatttctaaataccatttatctacaaaatataagttaatgtcatttatttaagggaaatgaatatttagtttataagtagctgtctccacaacttgtaatttacaaattattactggaaagaaacacttttcctgtcagccacacactcagatcaaatgttttaatcctgcccttttctgccttgttctgtgccctgagaaacttccctctgtggactgctcagtgtggtctttcctcccttttacattcaagttgagtatatttgataagaatcaaagattatcagaagaaatagatcatatgtaagttgagaatattttttatttattactcattacaagcgatcagttttagcatgatagatatatgctagtcttaagttcactagcaaaggggaatagactgcataaatgaaatgagcatggtcaaaataaatttaatagttggtgcagtataatggaaagtaaataaaggagatcaaaaaaagaagatgcaatttcagtgtccctataaacttgtctcacacttactgagagtttacaatagtgggtaggaagtgattaattttatcatcttaaagcaacaccttttctattgttaatcgaaagaccttctgagacagtgactagctaagggcagtaacagtaaagatctgtttcagatagttagaaaagaaaatagaggtgaacacacacatacacaaatagaagcaaggaaacgatgacaagaaagaaattaatgaaacaaaaaaatgcatatgtagtagcaaaaacgtcaaaatttagtttttaacaagactaatacattgataaatcctaggaagggggtaaaaaggaaaaaacagaaagggaaaaaaagacaaaatcagaattaaagaattctgcaggatctattctgctgccatagattctgcagaaatctaagaatgataatttagtgacaaaatttaccaactaagttgatgtgttttataaaaaaaaaaaaaaaagtgcctgaaaaacacagcacaactgacaggagaagatacataaaaattctgaaaagtactgcatctataaaattattttaatctgctattaaaagcctttccagaagaaaacttcatgcccaaatgatctcaccatgaaaaaactaccaaataattaaggaaaaaaatagcaaatctttaaatgatatttgccagagttaaataaggaaaaaaatgcttccatactcagtatgaacaatataatcctgacagaaaaggaatagaaaaatactaaaagaaaaaaatgttggttggttgggggcaagtgcaaattgttaatgggtactaaaatacacttagaatgaataagatccagtatctgatactacaacagggtgaagatagtcaacaagaatttattgtgtattttaaaataacttggctgggcacggtggctcatgcctgtaatcccaacactttgggagggcaagtctggtggatcaccagaggtcaggagtttgagaccagcctggccaacatggtgaaaacccgtctccactaaaaatactaaaaattaaccaggcgtgatggccagcacctgtaatcctagctactcaggaggttgaggcaggagaattgcttgaacccaggaggcggaggttgcagtgagccaagccaagattgtgccattgcactccagcctgggcgacaagagcggaactccgtatcaaaataaatagataaataacttaaagaatagaattaaaatgttcctaacaaaatgaaatgataaatgcttgagattatggataccccaattaccctgattttattataatacattgtacgcctgtatcagaacatcacgtgtaccccatgagtatatacactcattatgtacccataatagttaaaagttacatttttaaaagttaaaacacagtgcaactaaatgaaattctaaaaatatgttttacaatatccatcaatagattaaaaacaaaaaataatgcatcacatacagttaggatatccttcaggaatgtaaatagcttaatatttttaaaactttttggcaattctgaaaattccttctagaacaaggaagataaagctattacctaatattacgttaaaaaccattgaataaagcttattcattacacaaaactgctagaaagttgaatactaaagagatttcttacactagaaaaggcaaactatggcccacaggaaaaatgtaacccattcttgttttctaaataaagttacataggaacatggccacagttattcatttgattattatttctgatagcttttgtcctgaactgacagagtttcatagtaatgacagagattatgctctgcaggtctaaagatacatacacccgactcttcatagaaaacatttgttactccctcacctacagtaaaatgtctaaaatttctcagcgagtttggaataataaagctagctgctactctcttccctattttattagaagatgtagccagtacactaagacgagaaaatacaatcatgggtataaagattggaaaggaataaataaaaacgccattattcatagatggcattgtgtaccaatagtataactattgcatacactagtgtatttaataagtaaatgtatcaaggccattggataaagatcagtataaaaaataaactttatttctaaactccagtaagaaaatattagatgtgaaggtttaaaaactctagtgttcattatattaaagaaatttaatcacatagaaatagttctactaaaatatataccagatatttgcacatagaaacataatattattgagatacaatataatagatttcaataaattgaagtgtataccatgtttgtgtatttgaatgctcaatataaaaattcctgtctcccaaattgatctatagattcaatggaatctcaacaaatggaatattttaagggaggatatatggtagcagtttgacaaagttgcactaaaatgcacctgaaaatgctaagaaaccaagatactgaagaaaatcttgtaaaaaatctttttaaaaagggtggatggctataccaccatattcattatatagctaatgagatatataaatcattttatgaagaagtttatttaacttgttgaaagcctttgaagaaaatctaaattaattagaacatctcaatatttttaccagagtaagtctctatatcatgcacatgtctattttttcccaacaggaagtttcataaaactcaaagtcaattctaaaacatacatcgaaaagcaaatccccccaagcaaccaagacactttaaaataaaaggaagtagagcaaatgtctggctggtttctatctgtatcacgaaacaatttaattaagacagagcggcgatgaggttcaggacctcctaccccatacagcacattggcatttgagaaaacaacagaatcagaaaggctgccctttgactttctctggcctttttctcttaaagcaggacataaaacctaggaaagattttccagctttccctagaagcaggtcataagaccctcattggaggggtatcctctataccaagaggaaaggagcacccttatctctgaggacacaagaatacaaagtagaatctgaccaaacagatcttgctaagttccccccagtttattgacattaaatcatacattttgtccaatcatatttctctgatgtccactctttgtaaaacctgtaaaaaatctacaggtttacccatttctttgggccttcatttccttatgaagactctcaagtcatgtaaattttctatgaaatatatccatatgctttttcttattaattgtcttctgttatacgggcttctgtgaacttaggacgggtgaggtaaagatattttttcaacccttcagaaagatattttttttcttgtccttcgtgttagggcaaggttagagcggtagatcaatggtactgaatagaaaagccagatacataaatggatataaagatagataaatagacataaagattataacaaagagaaaaatctaacatcatgaggaaagagtagtcttcttaattcctctgattcaattgggtatccatgtagaaagaaaaatataaaaattgaccctactcataccataaaatattaaattgagttgaattgcagacacaaatggaaaaagttaaaagagaaaaaataaaataatacatttgagaacattctcatgaacttgtgggaaaagattttaaggtgtttacccaaacctctaagcataaaataaattactcatttattcatttagatacattaaattagggacttctgtttctcaataggaaatactaagaaaataaactgtgtaacagagggagaaaaatatttacaaaaattatacataatataaattttacatttacaatgaataaaagactttcatataaataagaacaagatagataacccaataaaattaaaagtacaaaaaacatgaacaggcacatcacaaatgaaggtatccaagaggccaacatttgaaaacatgctgatttctattattcatcaaggaagtgtaaaataaaaattggggaatatcactactcacctacaatcatagttaaatttcaagattttctactggtagaagtgtaaatattttcaaaacctgtgaaaaacattttgaccacagctactaaatttgaccctgttctttacctgttactcaacaaatccctgctggaataataaaacatatatacaagaatgttcatagaagaaccatctataatagtaaaaaaccaaaaaaatcacctagatggccaacagtatattagtaaatatatttactactgaatagtggatggtttatacagcaataaaaatgatttaactaccgttgcacaaataacagggatgaatctcaaaagtataatgttgcaagaaaaatgccagaatatacagtttgtaccaaatgactccatttttataaatttcaataacaaacatacttatttataattttagaatttggggtcatggttccctctggagaaggggtagcaattgagggagtttctgagaggttctgctaaaaccatgtggtagtttatgttaattcatccagctgtatactatcatattactgtgcttttccaagaaaacaagaagaaaattcaccattatcgatataaaataaacttgcagttaaggatgcagattccggatgcacaatgttttgatttgcatcaagaatctgccacttactacctggataatcataaacaatttacttccttctccattcttcaactcccgttcatcatttgtaaaataaaggtaatataattcccaccggttttgaaagttttatgagtaagtgcgtatggtattttctcaatgtttatattcttccaaaattcatatgttgaaatataacagctggtggtggtggttcatgcctgtaattctggtactttgggaggccgaggcaggcagatcacctgaggtcaggagtttgagaccagcctggctaacgtaatgaaaccccgtgtctactataaaaatacacaaattagccgggcgtggtggcggagcctgtactcccaactactggagaggctgaggtgggagaatcccttggatccgggaagcggaggttgcagtgagcctagatagcgacactgcactccagcctaggcgacacagtgagactccgtctcaaaaaaaaaaaaataaaggaaaagaaaagcaaaaagaaacttaaccatcaatgtgacagtattaagatgtagggtcattaggaggcaattaagtcatgaggatccagccctcatggatgggattagtgctttcataaaggagaccctagagatatgatttgtccctttcactgtgtgaggacggaaagaagattccatttatgaaccaggaagaaggtccctaccagattgtgaagttgggggtgccttgatcttgagcatcaagactccagacctgcaagaaaaaatttttgctcttttttttttttttttattatactctaagttttagggtacatgtgcacattgtgcaagttagttacatatgtatacatgtgccatgctggtgcgctgcacccactaacgtgtcatctagcattaggtatatctcccaatgctatccctcccccctcccctcaccccaccacagaccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagctctttataagccacccaggtaatagtattttgttacagcagcccaaatagactaagacaacacgtaaagcctcagaacagtgcctaccacatataaagctctaaagaactgtcaaatattgctgtttattaagactcaactctaatcatggaataattgttttgagcaaggctttgtaggaaagctgattggtttagatttcttctccatatggattcgtggaagttgaacaatggaagatgtaggcaggggtgttgtttacggtattaacagcattaggaaaaaggggccagtgaaacgctgttcctgttcttacgggcagaagggggaaaatatgagataatctttgaaagattggaagcatttgattcatccaatccaacatagctcctcagaacctcctaaaacagggctgctgccttcccagacatgtaacttacacggcgtcacagggctccacacacggcttaatgttgtgctattgccgtcttgaaattcttaaacatttttcaacatgaggctctttattttcttctttccttttttattatttatttatttatttatttattttgagacggagtctcactctctcacccaggctggagttcagtggcgcgatctcggctcactgcaagctccgcctcccgggttcacgccattctcctgcctcagccttccaagttgctgggactacaggcgcccgccatcacggccggcaattttttgtatttttttagtagagacgtggtttcacagtgttagccaggttggtctcgaactcctgccctcaggtgatccgcctgcctcggcctcccaaagtgctgggataagaagtgtgacccaccgtgcctggctaaggctcttttttttcatttagcatttaacactccaacttatgtgtaaatcctgcgtgtaattgttttgtcaaatgcataatctgtatcatgtttatttatttgtttaaagctagctgtacaaagtgtggagctgtgtatagttagggaagaaaaaaagaggtcagatttttgcctatttcgccaatgactcaccattcttatctccagccacctgcagagtcctagagctcctgagaaagtatgaatgctcgtgaataccctctctcttaatgggagatgattctagtcttgaagaaaaagttgtgggagctctttaataggagctggctattaaaaaactatactctgaatacaaatctcaggttttacaagaaaggggtagaagacatatctaaatgtatttgattgataagtttacttttgtgaaacattactgacaatatgagaaattcaataagaaactgaatatttctttcatagtaagttctggatgataattgaatccgaatctgtatcaagtgttgatttattttaaatgaatatttcaccaattattttaacatgataaaaacacaatttaaatatatgttaacaaagttaaagtgtaaaatattactgatctattgaaataagaacgaaggacttaagatttaaagggtgacttcttatgtctcctcaagaaactttaaaatctgctcgtattgtacagagaaactacattattacttgactttttgctatctgtattgaaaaccatagaaagcctaaatgtaaaattcattaattagtaaaaataacctttatattgaattttaattaccactttactaaagtacattttccattttatacatttattatggttagagtttgagaacaaattataaattgatcaacttctttaaataatgggtattttgttacaaatgtagaaaaacaatatttaatctaagttgtcacataacacatgacactcactttacccatataatagagattcttatgattgttgaggatgtcttttgtagatgggatcaacactatgcacgtgtgtgtgtgtgtgtttctacgtatgattggtggaatttatgttacatgttgtatctatagagcatgttggatggaatgcttttgcaaaaaatgttttaagttccttaaacagcacaaatttaacatagaatgaaatagaggatagaaataagcatgaaattatacatacttattttgttgctctatggatgcctatgcctactatatctagtttcaactaaagctaaaagacaaaaaaaaaaaaaaaaactcactgaaactgacaaatagaatgagtcaggtacctatggaaattccaacacagtgatggaaaaaaatcaatatgactaagatttgagttttaacaaaaccccaagtcaaagtattttattagttcagtagaatcagtgatcacttccattatctaaataacatttttttctaatttctagacatctttatacaaatatttatattacttcttccagtttatttgaatgaaaatctctaacctgatgaaaggatggaaattcacgataaactaaaagggacaacttttgacatataataagatctgatacacatatatgtgtatgtataattattcaaaatttagatttttttaacaatactcatagaatactatggtaatgataaaaatcctgaagaggttatgagtggaatttgaaaatagttctctaatttgctgcagaattacctgccaccacatcacttttatcctaggcaaaaatctactcctattcctaagattagctgtcctgtctaagatcaaaggcttttgtgaactaaaaaatttattgataaataagtgatttctgagatctagatcagtagcacgtgatgatgcaattccaagttatagcatttgacagtattttgcaaagctagaataaatagctctaatatatttcacagtcttattggattcatccctgttactaaatccctgcatttaacttttctgattagcacacaactattccatttccttttgttagatgtctgtctgaatggttcacaatatggctgccctcacttgaaagctgactatctcatttattttcttggttgtcatctctctacatttacatttttgtcctgctccccaagcagactggtacatggagtgagttcactaatgttaaccattgaaatgtaactgcatatatggctataattttagtatactgtgtatgagtttcttaatgctgtcagaacaatgtacaagaatttgggtggcttaaaacaattcatttattatatatggttctgaatgctagaagggtgaaatcaaggcaggatggcctctttcagaaagtagtgaagaagaacctacttgttccatgtttttctcctagcttctggaagcttccagcaatccatgttgttacttggctctagatgcatcaccctgttctttgcctccatcatcacatgacattcccttcctctgtttcttagtgtcgcctctcttctgatatagacaccagtcatattgaattaaggcctaccttaattaagtatgacctcattttaacctgattatacatgcaaagactctatttgcaaacaaggttacaattgcaagtactagtgattaggacttcaacatatttttgggggatatacataattccagccagaacactatgattcaaaaacctaacaaaaacatggccagccactgtggctcatgcctcatgcctgtaattcaagcactttgggaggctgaggcgggtggataacccgaagtcagaagttcaagaccagcctgaccaacacggtaaaaccctgtctctactaaaaatacaaaaaattacctgggcatggtggcatgcgcctataatcccagctacgtgggagactaggcagaagaattgcttgaacttgggaaacagaggttgcagtgagctgagattgcaccactgcacttcagcctgcacaacaaagtgagactctctctcaaaaaaaaaaaaaagagaagaaaagaaacataataagagctaatatatgagcatttattatccatcagaaatcctgacatgacatataatgcatcccttacaataaatatggaaaatagtattattactataattcctatcttacaggtgaataaagtgatgtattagtatatttattgcctaacatcacaaacatgatagagtaagttacaaatgcctgtgactttaatattcacatcattcaaataccaaaatttacacatacatctgagcttatgccaaaatctagccgagtacttttctaacataaagcatgtctaaaattcatatgtttaaatctaatattaaattttatattatttaggtttaattatttgtagtcaccccctttaaataacattgcttctgacaattcctaatataaaaagcctattttctatattgactatatagactgcagagaaagatgttttctctggacaggtaattcaaaactgttagggactgtaagtaaaaatttgtgaatcttggagcaaagaaaatatatatagttatgtgtgcaatgtgtgcatgatatacaaaagtgtagaaaaagatctcaaatccaattaagaaaacatacaatgtaaagcacaaagtgaatacaagggtaacatatagcaatttatgtacaagaatataaattgccagaaattcaatctatcacacgtatcaaaaatgaagctccttccagaatatgtaaaacatgtgaatgcatctaatgcaagaggttactttcttaaaatctacaggcaacggggtgttaaagtctcccattattattgtgtgggagtctaagtctctttataggtctctaaggacttgctttatgaatctgggtgctcctgtatttggtgcagatatatttaggatagttcttgcctatcttactcactgctgtatccctcagttcttggcatagtgtctggaccaagggagaacttaaattgtgtttctgaatgaacgattgaaagacaggcactggccatgcccttgcagagcttaccggctaatgagagagaaaggtagggaacaatcatcacctcacagtaccattagacagatcaatgagacggaaagttagcaaggatatccatgacctgaactcagctctgcaccaagtgcacctaatagacatctacagaactctccaccccaaatcaacagaatatacattcttctcagtaccgcatcatgcttattccaaaattgaccacatagttggaagtaaagcactcctcagcaaatgtaaaagaacagaaattataacaaactgtctctcataccacagtgcaatcaaattagaactcagaattaagaaactcacttaaaaccgcacaactacatggaaactgaacaacatgctcctgaatgactactgggtaaataacaaaatgaaggcagaaataaagatgttctttgaaaccaatgagaacaaagacacaacataccagaatctctgggacacatttaaagcagtgtgtagagggaaatttatagcactaaaagcccacaagagaaagcaggaaagatttaaaatcaacaccctaacatcacaattaaaagaactagagaagcaagagcaaacacattcaaaagctagctgaaggcaagaaataactaagatcagagcagaactgaaggagatagagacaaaaaaaaaacccttcaaaaaatcagtgaatccaggagctggtttttgaaaagatcaacgaaattgataggccactagtaaagctaataaagaagaaaagaaagaagaatcaaatagacacaataaaaaatgataaaggggatatcaccaccaatcccacagaaatacaaacaaccatcagagaatactgtgaacacagctatgcaaataaactagaaaatctagaagaaatggacaaattcctggacacatacaccctcccaagactaaactaggaagacgttgaatccctgaatagaccaataacaggctctgaaattgaggcaatagttaatagcctaccaaccaaaaaaaaggccaggaccagacggattcacagccaaattctaccagaggtaaaaagaggagctggtactattccttctgaaactattccaatcaatagaaaaagagggaatcctccctaactcatttatgaggccagcatcatcctgataccaaagcctggcagagacacaacaaaaaaagagaattttagaccaatatccctgatgaacatcgatgcaaaactcctcaataaaatactggcaaaccgaatccagcagcacatcaaaaagcttatccactctgatcaagtgggcttcatccctgggatgcaaggcgggttcaacatatgcaaatcaataaacgtaatccagcatataaacacaaacaaagacaaaaaccacatgattatctcaatagatgcagaaaaggccttcgaaaaaatttaacagcccttcatgctaaaaactatcaataaactaggtattgatgggacgtatctcaaaataataagagctatttatgacaaacccacagccaatatcatactgaatgggcaaaaactggaagcattccatttgaaaactggcacaagacagggatgccctctctcaccactcctattcaacatagtgttggaagttctggccagggcaatcaggcaggagaaagaaataaagagtattcgattaggaaaagaggaagtcaaattgtccatgtttgcagatgacataattgtatatttagaaaaccccgttgtctcagcccaaaatctccttaagctgataagcaacttcagcaaagtctctggatacaaaatcaatgtgcaaaaatcgcaagcattcttatacaccaataacagacaaacagagagccaaatcatgaatgaactcccattcacaattgcttcaaagagaataaaatacctaggaatccaacttacaagggatgtgaaggacctcttcaaggagaactacaaaccactgctcaacgaaataaaggaggacacaaacaaatggaagaacattccatgctcatggataggaagaatcaatattgtgaaaatggccatactgcccaaggtaatttatagattcaatgccatccccatcaagctaccaatgactttcttcacagaattggaaaaaactactttaaagttcatatggaaccaaaaaagagcctgcattgccaagtcaatcctaagccaaaagaacaaagctggaggcatcatgctacctgacttcaaactatacaacaaggatacagtaaccaaaacagcatggtattggtaccaaaacagagatatagaccaatggaacagaacagagccctcagaaacaataccacacatctacaaccacctgatctttgacaaacctgacaaaaacaagaaatggaaaaaggattccttatttaataaatggtgctgggaaaactggctagccatatgtagaaagctgaaacgatcctttccttacaccttatacaaaaattaattcaacctggattaaagacttaaatgttagacctaaaaccataaaaaccctagaagaaaacctaggcaatgccatgcaggacatgggcatgggcgaggacttcatgactaaaacaccaaaagcaatggcaacaaaagccaaaatacacaaatgggatctaattaaactaaagagcttctgcacagcaaaagaaactaccatcagagtgaacaggcaacctacagaatgggagaaaatttttgcaatctacccatctgacaaagggctaatatccagaatctacaaagaatttaaacaaatttaaaagaaaaaatcaaacaaccccatcaaaaagtgggtgaaggatatgaacagacacttctcaaaagaagacatttatgcagccaacagacacatgcaaaaatgctcatcatcactggccatcagagaaatgcacatcaaaaccacaatgagataccatctcacaccagttagaatggcgatcatgaaaaagtcaggaaacaacaggtgccggagagaatatggagagataggaacacttttacagtgttggtaagactgtaaactagttcaaccattgtggaagacagtgtggcaattcctcaagaatctagaactagaaataccaattgacccagcgatcccattactgggtatatactgaaaggattataaatcatgttgctataaagacatgcatacatatgtttattgcagcactattcacattagcaaagacttggaaccaacataaatgtccatcaatgatagactagattaacaaaatgtggcacatatacaccatagaatagtattcagccataaaaaatgatgagttcatgtcctttgtagggacatggatgaggctggaaaccatcattctaagcaaagtgtcacaaggacagaaaaccaaacaccgcatgttctcactcataggtgggaattgaacaatgagaacacttggacacagggtggggaacatcacacactggggcctgtcttggggttggaggaagggggagggattaggagaaatatctaatgtaaatgatgagttaatgggtgctgcaaaccaccatggcttatgttatacatatgtaacaaacctgaactttgtgcacatgtaccctagaacttaaagtataataataataaaaaaaatctacagacaacacaggaaatgcttaaaattctgtgttacatggattgaaaatgaaactgaatttgttcaggaattaaccaaggtaccattaaatccgaatcagcaaaaaataccttatgcacttcaaaagaaggggcctctcaactaatgaataaaaatgtcacattttagccacaatacaagaagttgactttttcctcctttctggtaagcctcatttttggtgatggccaatttatttgccatcttttaaaggaccagaatgagtagagactaccaaggataatattgtagtgaagttacccacacacaaattaattttattgtttcttctcatataaccaatgcaaaatgcgaatatagctttctaattcttagtgtaaaactttgaatttataatctttatccatgtcttaggttagactccaaattttcttattttccccccaaaaatattcaacttatgaaacaagatcatgaggtgtcctaatttagactttgaactaaagtcaactaggtaatgattttagattttttctccctggaaaagggggagttgtttttgtttattcttgccattatatgtaaaaggtatttggttttagaaacaaatatttaaaaaacagtaataatttgatatattttctgccacaactagtgtattttgtccctttttaaaacattcttagctttttttcttctgcaacgctttcctcaaggtccgttttgaagttatttttacatagacaagccagtcaagtatcccagaaagccatggagatgcccatagttctcaatccctgaatacataaacttttttagttttgtgaaattaacgatagatatatcctgagtaatgaggacagaagataaagctgggggacagtcttgtggctgcactgggacctatttgtgtttttatcaaataattagacacctggcatgtatgaatggtggttttacaaattaaatgcaacttgaggtcaaagcaagtgtattgtgtatacatgatgatcatttgttagaacaagtaaaatttgtttttaaagctgcctagccttgatgagtcataaacaaaattatgtggaatgtgaaaataattgaactacttagaactaacacccactcagtgataggtgattaatcctgctttaaaagaaaaaaaaaaaacagtctcaaaaccgaaggtcacctccaggcatagctatgcttatctacttggagcagattttttaaaatcctatatttaaagatacctgtgattgatatctcatactattcactagaaacataaccctctctttagtcaagcgtctaatcaatggcatctctttaggtctaagggtctccaagtttattacacataagagttgcttgagaagcttgttagtgatgcagattgccaagacccactccaagaattttgcttcatttaatgggtttggagggtgcagtaagagatattataacaacttccaaagtgacttttttgtggactatgcttgtggaaacactgtcatcaggttaacccaaacccctttaacatcctttgcaatgacctttcaattaaaattatcttgtccataaccattttgtaaatagacaaatagtggaataaagaaggaaataagaggcaaatatctgacctctagactgagtctacagattcctaggtggacttcaggtcattttactttttaatatgatttaatttgttttattagatttcatttctttttcaaataaagtagaaaaatcgaatgttatgctctcaagattatataaagaattacagctttatgcttctgtatttatttttaaatataacccttttaaattagctatataccagttactaactatacttttaaccatatatttattatttataatattatgttattatttatattaaatatattatatttattattatttattatctgtgttatttttttctaagacagttatctccaacttccttaagatgcagctccttctggtacccttgggtatattatataatcaccccatcttattgggcattctggttttcagttacaataccttttaaaatggtttattttgctggcagctgtttactcattcttaaacactttgaggacttctcattcatattctctctgtatactgagattaatgctagctgactgttgccctaattattaatagtcacatgattgtactagttaatatcacacatttgtctattgttcttaaggctatgcagtctcatcccattgagatattctgggacatcttattttactaatttatctatttaaacttacccatttccttaggaaaaaaaacttggaaaagtaatattctactaacaattcttcaataaatggctttagtgatagttcatttaggagataaagaactactcttaagttattaaaacagtgagaatttgacatagataacttgtttcatagataataaatagctgagaaaaagaaagagtatcaccagagcccagaagacaggaccaacatacaaaaggtagaatcacagggatctgcttgggcatctcttaggcacccagaaaaaaaggcagcaatgacaagaagaggctaaaagcaaggaaaggaagtaccagcctctctgaccctctcattttgtaatatcttaccagcacccctcattggagaaaatcagccagaaatgagttggcatgaactttcacaggacacagctcgtgaggttcactcaccctgtgatgcttagcagaaaaagtaatagagcagagaaagtgtatgagggcaaaatgttcacacttggcacacagagtaagtatactgccacactaccatatgcattgtaaaataatgttaatggcaattattattagataaaaattaattgatataattaattttagaatttaaaaaggtatatttctcttatattgatgataagcatttggatatagtagttttacttatggggacactcaaataatataaagtattgagaagaaataggaaaatctgaattaaatgttcacatgcaacggcagacaaattgtgtagatttgttaaccaatagctgatggcaatggtaaactaagaaataaaaataaaattagaaaattaggcttcaattctgattcatatggcaggccaagataacacagatttctctccaggcaaaatagcacagcatttatggctaacaaaatacatagtactatataatgaaaatacaaagttgagtttgaaaaagaaaaatcctgttgtagcaacaatcataagagggaaaagaacgtaaaaccattattataaaaatattaaatgcattcaaaatggagatgaatatattaactgggaacgtgaaagttatagtaaaagatcctccacatttctagagatggaaaatcaaaggtctgagatgaaaaatagactctatggagtgatgagcagttggtccacaaattatatgtctatgttttaatccccagagcctctgaatgttacattatttggaaaaggaaattttgtagatgtcgtttagttaaaaatcttgagatgaagatttcatcctggattatctgggtaaagatgcagagttaaaaagagctacacagaggggaagtcgatgtgaagaaggaatcaagagtgcaataaaccgagggatgctgaagactgccagaacctggcaggggcaagaaatgaacctccctgaaatcctccagagaacgtgtgggcataatgacacttcagttttgaactcctagcctccaaaactgtgacagagtagttttttaaagccattcagtttgtggtaatttattacagaaccttaggaatttaatacaggtattagcagaagattagatagtggagaaaaaaatcttatttacagctatagaaactatcaaaaatgaaacaaatacgaaatataaacagacaaaatgaaaaaaatagcatcggtgagttgaataaaaaaactttaagatacaataaagatgtcctcagggaaagggaatgacagaaaaaaatctgaggaaatagatatcaaaatatttcctaatttgataaaaacaataaatccatctatcaattgagtaacacctcaatgcactttacaaataagaaacagaataatacatgaactcaaaacataaccaatttccttaataccaataatgaaaaaatatctttaaaacagagaaaatagaaacattgtgtacagaggaacaaagaacaacagaagagttctcactgaaaataattcaaaacagaaaacattacataaattttagtaataaaatctattgggaattaatgttagtaaatggtcagataagttttaaacaaattgtattgtataaaatctgatcataatttggtgatacgcttatagatttaaaatctgattataatatgctattttctttacatttttaacatatagttataatgtagcattatgtttatatttgtacagtttaaatgaagggctgatgatattacatttcccattttttattctgtttataacaaaatttaattttattttataaattaaaattagttttcttttggagactgcacattgttctaatgaaggatgtaatacgggcttttagtattaatcatgaattcttccatatcgcctatgtccacgtgcatatattaaattgataacatgatatataagaactctgaagttaaatgtacacatgactaacatggcattatcactaattttcacatatgcaaaatttcttttgtaagtgaacagcattactctgatacgaaaacccaaaaaatacagcaccaaaaaaacccactacagatagatacccctaactatatagattaaaaacttatcaaaaacaattagaaaatgaatacagaagaatattttttaaatacaacttccatacgtaaaaggaatgcattatcatcccattttgtaacaccaaatatttaaaaaatgatgtatacggctgggtgcagtggctcactcctgtaatcctagcactttgggagaccagggcgggtggttgaggtcaggagttcgagaccagcctggtcaacatggtgaaaccctgtctctactaaaaatacaaaaattagctgggcatagtggcacatgtctgtaatcctagctactcgggaggctgaggccagagaatcggttgaaacttgggaggcggagattgcagtgagccaagactgtgttccactgcattccagcctgggagacagagggagacttcatctcaaaaataaataaataaaataaaataataaaaaataaaaagatgtatactccaaggtccagaatttataaaattattaattttactgatatatcaaagacattcttaaagaaatcacacaccccatacccactacaaatgtgtgtaatatgaatgctaatacaatttgatgtgtcactgccttgatttttgataaggtgccagtagttttaaccaccatccactttgacaccgccagtataaatgtcaacagagtagaaagggcaagtaatgtgttgctattattattaaaatagtttgccctcactattttttaaagaaattaatatttcctttatgtgaaaatacttatctgaatctcagcaatttgatcagattgaatttagatcagattgaatttagtgtttttatttattccctacattctgatgaaaatatctgtaatttaaaaatagcagctttaatgtgtcttcacatttaatatatttgtctatctaggcaaatctgcacatatgcataggggggtacatggcatactcttcaaaatgttaatgctttttatatctgaatggtaaaaagtgtgcatttttttgttattgctaacattagcaatgagtatttttcctgctgcatgtattaaaaaagaatacctttcaattttacaaaaatagtatcattgcacaataaagtggaaaagaccctggaagaaaacagcagcaacagttcgtaatgtgtaacagctactttgggtcagaagcgttgtgggaacttgtcagcccagcatgattgttttagttccctgatgtactgaagagtatcacagctcaattcaaagctagttgtgtcaagcccttcagacttgtttctcatttaacaactgaagttatctaaattggtctattcccacatgccatactatttactaggcactttgttaggaactagggatgaagaagtcaaataagattttgtccctgactgcaaagagcttgtaacctaatttacaagtctaaatgtaacttctaagccttatggtgcctttcagtgtaaaaaggggttgacaaccttctaacacctaatgcaaattgatatgcatagtaacattgctttcggaaaacgaggcaatcttgagatctagtgatctataattagttaccatatattgtacattttctgcgtatcaggcattatgataagtactatgtaacaataaaaaacaattattttaaatttgtaaatagcgtctgagatacatttgaacttctcagttttacgttggtgaaaactgaggcttagagagaaaaagtaattttcccaaggtctcctatacatgcatggcagattcagatcaagtgactcactccacagtccagcctcttctccattctattatcctgcctttctgcttagctagctcctcagaggcaaatccacttatgatgatgagagttaagctatctctcaaatgttcccagaaatagtgcagatttgttttaatcctcaactcaatacatactgggaacgcagacgagacatagtctgcaaaagcaggtttattattttgattgatgccaggtgagtatcaggggttctaagacctttatctgaattgtatgaagtatagctcacattataatgaaggttgcttgacaattgtcctttatcaacatatttccaataatccccacggtagttatatttttgagaaactgagaaatagcaatgctgtcagacatattatgtttagaaatgatgtaaatctaaagataacattgaaactaggaaaatcacagctttgttcttacttagacctgattttcttctattggattcggaagcatatccgattaacatagagtttgttgtttatttgcttatttttcgttggtatccattttttaaaaatcatcattgcttttttattcagagaccattgcagaaactgtacttgacatgaatgaaatttattcctagatcttgcaaattgtggtctatggaaactttatgactaattcaagcttggttttcactcctctttggctacagctggtttcttttccttgctgttcatgaaataggccttgatttttttttccttctgacttatttataaggttctgccatttgtgcaaagtatgtgttctacaaactatttaatggccagcacaagataaacctgcctgctgatgtcttctctgatttatcatgactgagactgagtttgtccttactttaagcctattaccacattctcaaaacgttgacattagctttgaagtctaaagttatttcacatgtgtttatttgatctattctaatacataaattctttttgatatctatctgctatcttatactgctttatgcagtcagggaaaattcaatagattcttaggaagtgttatatgtgagatttattaaaaaacaaaaccaaagaacacatccacttttacaatcatccaaatttatgctaaatgttctattatttttattataatccaattctctttagtaaaatcacacttttacttacctcacattatagtttacaaactaaagcatatattatttcaatttgccttagctaaatttctggaaaataacaaaggttgatgtcactttttcctaatttcatggttgaaagaaacaaacttaaaatgttaatagatttgccccaaattatataaaattcagattgagtctggttctagaaatcaaatctttcaatgtcaaacctagtgttataatttaccttgatgttttctacttcttaaggcatatgatcatattattttagtttactcatcactcagcttataaaatattgaaaaaaaccagtaatacttcgtgttgtcttaaatcttgaaactgtatattatacacattatgcatctgagtcagtaaaaatcacagtgatgaagtaaatgttatttaaacttccatcatgggttgtagcctacttcattacaggccatctattcccaaatcctacaaaataatttcttccaaatgttaaacctcttgtcagtcttttagcattcaattagttccatttgcagtagatgtaacccagaagccagcctttatattgcacttctaatggtgagagtgagatgtgagaaaactgttattctgcaaaagtggccctggataagtatgatcaaaaagaactgaaaacatttgatcttggaacaatgcaaatcatttccaaaacaaagtttcctgcattgacaagtacatttacaggttctcaccttcagtgtttcaaaatgtatttataaggcataatacatgagatagcccagattaagaaatgatatgaaagaaagatttttatctgaaaacttttttttcaaaaatttccaaaatgctgggaccttgcaattttaagttttatggaagccagttattctgtaggacagtagggtgtttgttaagtttgacagtgttattatatattagaaagatgtcagcacttggaggcaggaaaaggattttgccatcaagtaactgagatatacaagtgttctaggtcacctggagaaacctaaaaagccaaacagcgtccactctcaagaagctctgcctaatacaggaattcatgacaaatgcagacacagaatctacatgttagaatgatgcagattcagtattaggaaggttcaactgaaaaagagcttcacttcaatattaaggtatgcggaaaataattttgaacaagaagatagctgtttagagggtttaagtatacattgatatttaacttgtacagagaaaaaaaattctgaataaagaaaactgaataagcagagaaatatatataagaagttataaggcatatttggcaggaaataaatacgtcaatttatctggtacaaagtgttaccggaatgtgagtctgcagttatcctgagaaactccagaggggagactttgcagatctcagtcctttgtcttctggaaggaaataattcaaatgagatacacaggcaagctttaaagcaggagggaaagtttatttcaagagaagtgagagtttcttggagaaagtagattacacctggaggatagccaagcaggcaacttgaaaaatcaggtgccttggctgcatctttgttctgagtttttataacccttatcttttcctgggctctttgcctccacccttcgttcttcctctgggcagtctgtcgctcaattatggtgtattacatggttctgccagcactttgttggggccgcatgcgcagtgtgcttactgaagtcatgcgcaggcccattagaggcaattcgtccttaaaggtcaagggcccacaaaggaaggtcaggtactggttaaatttgacttttttgcacttttactgtacatgctggaaaccttgtcaggcttactaacttcaggtgtcctctgtctgttgtaagacccctgttattcccagcgccagtcatgggccatttacaaccttagaggcctagttttatgcccactactcttcccctcgatgagaatcagacaactctggggtccctaccttgtcctgctcaccatttcagagtacacatttataactgcctgaccctggcttgacaaatgcccaacatttctgggccctctctcctgccctgcttacatctatctacctactgtaacaaaagttaccgtggaaaggaagctcagaagtcaggtagaggcaactgtttgggacaattcaatagaacagatcatcatgaatgcaaaacgaaagaattaggtcttcctgtagaaaataaggaggcattgaatgttttaaacagaattagaattactcttgggcaagttttatctgccattggcatatatttgttaaatgaattagaaactgaaagtaaggaacttagctgtgagccactgcaacttaaattacccagatcggagatgaaggatgctagaagcagggaagagggttggtctcaggaattttctagaaggaaccttgacaaagtatggtaacagatggaattatcacaacactcctaaattttttttcaggtttgattcatctcaaatgtgatagaacctgactgagacagttttaataccacaaaaagaaacccttaaaactcccccactattaatacaaatggtagccactatttgttttctatatactatatattttgttacgtattgtacatatattatcttacatcgtattctaaaaattttataaagtaagtattagacatattttgcagtgaggaataaggactcaaaaacagttaacaatttgcccatatatccgagaaagcacatgacagatgcaaggttcgattttcaattctttattcacagaagaatgaaataattttcacgttgctccttgcaaataattcatccattatttctttccatccatcttgctaaccacaaactgtcgagtgaatgtctgctaatctgcaaccaattttgatgctctttgtcctgtgattaatatttaccatactttctaagaatctgaagaaggaatgcttaggagaaaaaaactccacctgacatttcttaaccttccttataaaattttaaatcttcttgtgtcccaccaaaaacccatttttaagatgttctcacttcaaaatatttttaaaagatttagggtaaaagctttcattgatttttcctcttccatgtatctcttagaagaaaaaaaaatagaaaatacagtaatcttggtgaagggcagaaagggaactggtttgggagaaggagggtgaggaaacacaagggaatctgactggagagtttttctctaagaattgtgaagttcacttttaatattcaaataaatgctagcaattttaggcttgcatttgaaacgattgataaatgagactaagaatgctgtaagatttgaaacctattaggttttacaaagcaaaagaatattatgggttgggcatgtgagagtattatggtcagaggtgatcattctatcaagagcaagaaacttgagaaccaaagggcatattgccaagttcaaatgatcctcatgttttatttgtatgactttttttaatgtctctttattttctcctatctagtataaggtcaaaataatcactagcatttgagctatattatttaaattttgtttttttgtcatgtttgccaaaagcatacactctgctatattcctctttggttagtctattaactgtgagcattacagcaatttatttttcataatttcaaacatactttgtcataaatgaacattcaagttggttagaagatttaaaaaaaattttcaaggcagcaatatgattccatttttctgtgaaggtattatgatgttttattttagctttaatgacttggacttcaagtggtttaatgaatgtgtaagcgggacatcttctatagatattcattctttgatttatttggccagtatagaccttatcagaaggatgaatttcattcataataaacattgtaactttatccaatttgaaaatactggcacaatataaatattaggaaattcatttatactgtaggctattaattgaaagtatagttggcattcaaatacttccataattaatccaaataagctataaataaataataattatgatcacttatcttttaggtcttccttgttcagcagttgattttaatttgcttaatgaaaactttatccacagagcagaggtaaggaaattcgacttaaatttttcttctcataacactactcaaatcttatctaatcagtaaaacgactttgagaaacaaatcacaactttattggataaagcaaatagaataaagtcaattatgacttgttaaattaaaatcctacactcaaaatgtatattgtccaaatagagaggatttcgcattaaaattttgtttttctgtaagatcctagaaaattatgttatgttatttacaataaatatattgattgaaatatttttatcctttacaatagagaaaaataatggcctaagttattatttataatatattgtctattataaataagacataataaatatcaaattttataatgtttttatcaacagaccaacaattgtgtgtcttagtgagagcagagcaaatattcgaggattcaaattcaaactgtaattcatttatttgttgtatctcatacccatatctttattaagtatatctttattaatctttattaagtatatctttattaagaatttctaggtattttcaattaaagcaaaagtagcagagtaactatcctcacctagctgccagtgtggagggagagaatacttaatagttaaaccaaagcttagtactcagttatgacaattgctatttctcacaactaaaaccaaagattatcagtctgaattagtgattaagatttagctatgacctctgtagtttaaaagcatggacacaaaatattgaaattatttaatataaatgataaagaatgtataccaagcaaatactaatgcaaagaaggcttatgcactgatatggtttggctgtgtgcccactcaaatctcaccttgaatcatagctcccatagttcccacatttgtgggagagacccagtgggagataactgagtcatggggctcccatactgttcccccatagtgttcttgtggtagtgaatacttctcatgagatctgatggctttataaggggaacacctttcacttggatctcattctccacttccaccatccgtaaagggaatgacatgctcctgcttgtcttctgccatgattgtgtggactccccagccacttggaactgtgagtctattaaacctctttcctttataaattacccagttttgggtatgtctttattaacagcaggagaacagactaatacagtaaattgttgccagtagagtggggtgctttgtaaagataatcaaaaatgtggaagcaactttggaactgggtaataggcagagtttggaacagtttggaggactcagaagaagacaggaaaatgtgggaaagtttggaactttctagagacttaaatggctttgaccaaaaggctgataatgatatagacaatgaagtccaggctgagatggtctcagatgaagatcagcaacttgttgggaactggagtaaaggtgactcttgctaagtttcagcaaagagactggtggcattttgtccctaccttagagatttgtggaattttaacttgagggagatgatttagggtatctggtggaaggaatttctaagcagcaaagcattcaagaggtgacctggtgctgttaaaagcattcagttttaaaagggaaatagagcataaaagtttggaaaatttgcaccctgacgatcacatagaaaagaaaaatccattttctgaggagaaattcaagccagctgtagaaatttgtggaagtaacgaggagccaaatgttaatagccaagacaatggggaaaatgtctccaggacatgttgaggtcttcacagcaggccctcccatcacaggcctgaaaacctaggaggaaaacatggtttcatggaccaggcacagggcctccctgctctgtgcagcctagggactctgtgccctgcatcccagcccctccagccatggataaaagtggcaaaggtacagctttggtgttgtttcagaaggtgcaaaccccaagccttggcaacttccatgtggtgttgagcctgaggaggtaggaaagttaacaattgaagtttgggaacctccaggtatatttcagaggatgtatggaaatgcctagatgcccaggcaatagtttactacagggttggggccctcatgaagaacctctgctagggcagtgtggaaggaaaatgtgggggcaaagtccccacacagagctcctactggggcattgcctagtggagctgtgagaagagggcgacgttcctccagaccccagaatagtagatccactgacaccttgcaccgtgcacctggaaaagccacagacattcaatgccagcccctgaaagcagttaggaagaggggtatttcctggaaagccaaagggggcagagctgcccaaggccattggagcttacctcttgcatcagcatgacctggatgtgagagatggagtcaaaggagatcatcatgaagctttaagacttgactgccccactggatttcagatttgcgtgggtcctttagccccttgattttggccaatttatctcatttggaatgggtgtatttatccaatgcctgttcctccatcatgtctaagaagtaactaacttgctttgtttttacaggttcttaggtgtaagggacgtgccttgtctcagatgagacttttggactgtagacttttgagttaatgatgaaatgagttaagattttgggagactgttgggaaggtatgattagttttgaaatgggagaacatgagatttaagaggggccctgggcagaatggtatggtttatatgtgtacccacccaaatcttatcttgaattgtagctcccacaattcctgagtgtagtgggagggaccagtgataggtaatcgaatcatggggttggcctttctcatgctgttctcgtgatagtgagtaagtctcatgagattatgtctcatctcatctcatgatggttttgtaaaggcgagtccccctgtactttctgtcttttctgctgccatgtaagatgtgcctttgcttctccttcacctccaccgtgcttgtaaggcctcctcagctgtgtgcaactgtaagtccattaaacctctttcccgtataaattacccagtctcaggtatatctttattagcaatgtgagaacaggctaaaacatgcacctaatagataaaatagattaaagtggtacagttattgatagtgataaatactgttgttacatgagaaaaaaattttcaccaaaagacataatttcataacgctaagctttcaaaaatacaccttcagatatataaagcccagataaaaataaattgatcactttttaaatcatctatatatagttctactttagagcttctccatagatcaaggagagaaaatgctctataaggacagagaggatttgaaaacctctatcaactttactggcctaatggatatattgaaccatgtaataagcaaatggagatacttcttgcataaaactctagctaactgagacattttattaggtgtttggaacacaagaactatatgttatcaattacctgtactgtttctcattttcctttaaaagttgaaagagttttctacatagaacacatccattattttctagtacatgtagctgatgatcgatatgattccaaagacccaatatagtattcacaaagtgtctcaaataccaggataaactacatctcacattaatagaaagttacaataaacaaatttaatctttaattataaaaaataagacaattattaatgacttgtttctatgtgcctgaaataaattcatattgcctaggtaccttgtgaataatgtaactttatgcatcttagtagctatatataataaattatttatttctcctgaattaaattcttggctcttcaaatgattaattaggtgacacaaatattctgaatatttttaaaaataatttattagattggtagatctatttaatctcatctatttaatacaaataacaaatatttgctattgactgaagtgtatcagatactggaccttgaatcctggggtacagataggactatggcaagaaacaacctttaaatatgtactgctttcaacattcaaattagggaagtgtgggagagaaaataagtttttaatatgttaaattgtgctggttataatacaaatatgctaaagtgggacagagattaatgggattatgcatttcataatatggttatggaagacaatgatgaggtggacctgcaggaactgtgattgcatgcttccagggaaaattaatagcatgtttggtgtgtcttaatgtcaaagaatatatgaggaaaactggaggaaaatgaagaatggggagtaataagccaataccagagaagactgaaagagtagggaagagactttgtgtttcactcgtataaatagaaatgaagtggtgaattttgagcaaaaatatgatatgcagtaaacaatgttatgagtatcactatacctgctgtgaagattattgaatgtaaggggggaaatatggatgtagaactattatatacattttttcattatttatgaggaataatgtagacttaggaaaaaatgttagaagaacctgatttaaagctgtctaatctggatatgttttgataatagagcccacaggatttgctcatgaatagatatggtgtgcaagagcaagaagcagaaaacttttgatgtgagcacattaaaaaagggggtcatggatttttaaaaatggaaagctaaagagaagcagatactaaaggccaatacagtacacttctgttgtttaacaagatgaggtgacagaaaaattttacacgtaccatcacttgacagaaataaaaccagacaaacaaaaactacagttttcaaacattggaagtcatgtcatgaaacacagttatcctagggagacatgaaagaaaccagatgaggcctataattggcagtagccttgacagagtttccaaactgtggcaaaaggagaggtaatccactgaactctgagatgaataaacatagtgagaattcaaggagaacaagatagataggaactgaagaaaagagcagtagaaagaagataaaagcacaaagagaaaaaccatggatacctacaaacaagttcagcttgagttctgctgaactcaagcattcagcagaacactgattagtgcatgaatgtgaaaaaaaaaaaatgttcaaggctagagaaaaagtaaccaaaaagaagtactgcgattcgtatctggaggcgacataagacttgagataatgcccattttcacaaacccgttagaaagcctcgaaagtcatggaatgtaaaatagagcagagagaagaagaattggagacagtactgcagaatcattatggctagaataaattatgctcttgtctcacctaacaaatcttaaaagtagggacccacaatattggaatgtttttacgtttcagagaatttaaggctgggtgcagtggctcatgtgtgtatcccagcactttgggaagctaaggtggtggatcacttgaggtcagaagttcaagagcagtctggccaacatggtgaaaccctgtctctactaaaaacacaaaaattagccaggaatggtggcacacacctgtagtcccagctactcaggagactgaggcaggagaatcgctcgaacccaggaggaggaggttgcagtgaaaccgtattgcgccaccacgtgcgcgcgcacacacacacacacgcgcatatatacatacatttataaacttagttaaaacttcaaaatgtaaaattcaccagcatccaagtgaaaactggcatccaagaagaaattatctgacatacaagaaataattatcaatcagacaatgagcaaagcagaaaaatatgacacatatggcggagagaaatcaatcactaaaaactgcactcaaactgataaagagtctagattgcagatagggacttcacataaattattatatatcttattgataaaaattagagaaaagattgaacatgttaaacagatatgtggattctacaaaatatgtgaatcaaatttctagaaataaaaggaattaatggcagaatgaacttttttcagaaaaatagaataatggactggaagtcaagaagagaaaatacacaaaaggatacaaaaagtagaaaaaatgcaacaataaaatacaagcaatatcaatttaagcttggagtaatttctaaagcctaacatattgtgtaattggtatggacaaagagaaaaaaaaggagaatagaaaatctgttttaagaaattataacccaaaatgctctgacaccaaaaacatacacaaacattccaagaaaagaaaactatatatcaatcaagaacttagatgcaaaaatgtttaacaaaattttaacaaaacaaatctaacattatttaaaatgcatatgcaccgtgatcaagtaaagtttggactaagattgtaaagttggcctcctatttgaaaatcaatcaatgcaagtcatcatagttataaaccaaaatgaaaaaaataataattattgtagaacatttaaaatgatgtatttgtcaaatcttggatcaattcctgatagaaaacattcttcaaactaggaataccctcaacctgataaaagtcacctaaataaactattgaagcagcgtcactgtctggggtaaatacaggaggttcgtggtctcacactaaggaaatccagtatgctgacacacaagaagtgggtttaggagtagaggtttaataggcagaggaaagagaaaggagaataactctctctcctgagagagggtgcccaagtgggacttccagcccatgtaagagtgtgtagggttttatagacaggcttgaggaggtggtgcctgatttacttagggccccaaaactggttggactaggtgtgaagttaacatagcagacaaagaagctggctgcccgtccctaatctttttaatatgcaaatgagtttttacttggcctgcaccgtgttgtcctcttcctactgcacacatgattggcaagaagggaagatggagctgtgatgttgcacatgcctagtccccaggtagccttttcctattgacacggctgctggccttcacgcatgcaggcttccatcttgcttgtctctgtctgcagctctattatacaggctactctttgttagacaagaaaatgatttgagggctgcttttcattaaatggaaaaccttatcgaggactcccataccctcagtaactgcctaagtaatttctttttaactcctatatcactatgtctaacataatacttagcatttcaatttctaatgcttttctcctaaagtcaagattaaggcaagtatttccaatcacatcacaccgcatcaacattgtattttaggttgcaaccattgcagaagccaaaaaaagaaaatgtaataaaaggagtgtttattgaaaggttcaggtaaactcttttattcacagacaatattgttacttataaaacctgatgaaacccacaaaaagctaccaaatctaacaggtgatcttggcaagataatagaatgataataatattatcattaataataataattagttgcatttctttatatcaatataagtaatcagaaattaaaataaaaacaggctgggcactgtggctcatgcctgtaatcccaacgctttgggaggccgaggtgggcagatcacctgaggtctggagttcgagacaatcctggccaacacggcaaaaccccatcgctactaaaaatacaaaaattagccaggcctggttgtgtgttcctgtagtcccagctactcaggaggctgaggcaggagaatcatttgaacccaagaggtggaggttgaagtgagccaagatcatgccactgaattccagcctgggcgacagagccagactccctctaaaaaaaaaaaaaaaaagaaagaaattaaatagaaacattaccatttataagaggacacacaatattatatattaaacaaaaatgcaatagctgtacactgagtacttgaaaatgttagaaaatatttctaatataaataaattggctaatacctaaacaaattgaattgaaaattttaacatattaatgtttcctctgaagactcagtattgttaaagtatcaatattctccaaaatgtggtcacggtagaaagtgttaaagagcttactgttatcagtttctcctttggtagagaggtagagataataagctaaagagaataaggcatactcctaagttgttagcagttttatttcctcaatgagaatgatatttggaagaggaagggcaataagaatcatatttcctctgaaacttgggtatgtgtttcttttccagggagctgcatttctgggtattaatagaggagtatcttacatctctctattaaaaaatcattatttaaaaaaaatgtttaattcaattttaattgcttttgatttgggcaaaaaatgtttttgaaataaagttatctaatatgcatatgaatttcccttttttaaaaagcaccaataggtgcaggggtattttattacacaagtaattatccatacagataaccagagacgatgtcccttttctaatgttatttacatttatagcaagatcacagaatatttgacctgaaaacaaacttagatagcatctagtttaaacacttccttgaggaagagagacaccaaagaagaagttaggcaattagtggtaatgttgaaacttcagtattcactttattttcttctaaaattctaaacaaaatgatttgcttgtatatttatttctatttgtcttaaagtactctagcttttgttaaaaatacttgttgcatgatttctgctctaaattccccagaacaatgacaggttatttagtttaagaaatttaaaaatttgtcattgcattttacatttttattgttcacttctattcattttttagtctcactgaaactgccttaaataaactagcaaaactagaggcaagaagcaagtactatcacatgaatatatgatttgaagagcaatcttgtttgtaaattagatacttgacaagtttagtaaaaactgaaatagttttagacatttttttagatccttggatcaaagcttctacagatgaaacatttgcaaaattattttctccataaatgctgaccatacaaatctgatttctttattcacactttatgcttcattttatggaagactcagtaacccataacaaatttcaatcctgaacaataagaaaaactttttaagttttcttattatgctttctttttaatgtatagtttgagcttcttttttggtttattcgttggcttgggaatttttattttaaaaatatatcttacagcagaattcttagacagtttgcttcatattttaagcaatatttcaactttaaaaatatagtttaaactattaaatgtttaaaaaatactcactgaggttcatttacttatttataccaaaatatttgaatttaattaaaaattataaatttcatggtatagttctattaagtaaagatttttttacagtaatgagtaagctcttagagagtatgggttaagaatatggattctggaattacattttgcccttttagcctcatggagggtttgcaaatgatgaaatggttgattgaccctataaagctgtttttttagtttgatgctatattcaagtcagtatgctaagtctcatgcccacaacacaggacatgtttattgaatgacagtataaataatttaatgttatcttttttcagaggtcagttaaatgattctttgtagttttttaaaaaattagcagttgttatggaaatttttagatacaatagtaaaaaaaaatgttataaactaccagcttcaaatttactcattactcaggttcaacaattatcaatattctgccatctgccatacctacatcagctcctcactcctctctagataatagtgattattattattttataggtttttaaaattcaaaattgcatacattgaaatatcgaatttttagctgtatatttttaaaaaatgagtatagctatatgaatctcactccaatcataaaaatctatttccaattattcaaacattttttcttgtactttgctaatttctcttgcccacatcccactctccacagacaactgattttttatttaccatatactttttccagttataaaatttcatgtagattgagtcataccgtaatgttcgtgtgtgtgtgtgtgtgtgtgtgtgtgtgtgtgtatcttctacttcatataatgtatgaattcctcaatcaggttacatgtgtcagcagccctctttttattgctaaataatatttcactgtaagactacacgatgatttgtttattcaacattcacttgatggacttacttgtttttagtcttggctgttatggcctagaaaactgaaatgacaaaaatttttctttatatattttaaatatgctttttggttgtcttctcacttcttatgcaaattagccatcgtggctatttgttttttctctgtatgtaatgtgtggttccacatatacttttatgttttcaagattgtatgtgtgtatgtgtgtgtgtgtgtgtctgtgtgtgtttaatatttagattttagcaatatgactttgtgcataggggtgatattctttgtgtttgtcctgcttgggttgtattaaggttttgagatatataaattatgtttcactatatttaagtaaattttggccattgtatcttcaaatatatttctgctccatcctatgactcaaatatatttctgccccatcctatgactcctctttgggaaatcaaattccatctaagctctgaggctccagctttttatatttaatatttgtttcttcttcagatgggtaattttaattgttctatcttcaaaatcactgactccgggctggcccacctgcagtctgctctaatccatcaacaggatatttattttagtgctagtatatgtcgtggtcactgtctgaggctggtgcgtgggtggtaaaggaatttaccaagacagtaataagtttagaaaggcagatttatttagaggaaagggggagatatgttgcaagggaacaaagggcaagacagcaggaacaatacgatctggaaacaggcagggcctcgagttttgtaaggtcatgctgtttaggctcagtgcttgcagacaggatccctgggttcaggtaggcagtgatctgggtgcttgtaaggatgcttgggtgctagtgagctgttgaacccatttcttgaaacattttatctgccctctacctctgtttctatttcttccagctaagcccatttttcaattatcatttaactccttaggtgttaaattcaggtgtattttgttgttgttttttctgtaatttatagtttctatttctctactgaaagtttacatctggtcattcattgcttttccccccaccccaaacctggaacataggtataatatctctttataagttttcatcttataattgcaacattgaggtttccttagggtcattttttattgactgactttttcttgaacatgggttgcactttctgtcttgtcttatatctgttttttgttgaaataaggcccatatgattaatatcctgtagatacactggattatgttatgttctattaataggaaatcgtatagtagcagggagttttcttgactggatgtatggtacagattctagtctcctagtagtagagaaaaatctaacatctagtatccgtttttttttttttttttttttccagctttcagttactttcactagggctatggtgatttccagacaggcattgtttagtgttcaggcaagttatttgttgaatgttatatgcaaattttggtcatgccatttatgcagcttgccttctttcatgataccccactaaattcctgattgcttttttagccccaaacctgtctatattaaaactttaaaacaactataactaaaatatcatggcaagatcttgatgtttttgagagacttacatttatgaccctttattatttttatttctgctacacccattttaattctcatttactgacgtgatttccttgtactaatgaaatggaaagtgttcccttgtcccccttgcagggcatgcgatgcacgtatggtccgcttttttggtgccccgctgctccaacctctagcgggagaatgcagacgggacagattgtggggctctgatcccacagcagtgtctaggggtgaatgtttacagctgaagccccagtgggcgtgtgttacaggtgctctttcagtttagctgtccataggcagcttgtgttagtcagctcaattagaccccccagcttatcacaagtacagaaggctttctgtatcccgggctttcttgccttggggtactgaaagaatcgggtcacacatgggcttggagaatgagtgcaaggttttattgagtggaagtagctctcagcaggtgggggagccagaagggaaatggagtggaaaggtggttatcccctggagtcaggccacttagtggccaggctctcccctggccaaactactcatcattccactagtcgatggcctgtccgtgactgttggtgtgctcctatgtaggtgcgttcctctcaatgtccagctgcttgtgtcttcgactggtgtgttcctttggatgtccagctgcttgtgtgtgtgcccactaaagtctcggggtttttataggcacaggatgggggtgtgatgggccaggatggtcttgcggaatggaacatgtgggcaggaaaacagaaatgcctgtcttcacctaggtccctgggcacaggcctgggggtggagacctagccagggaccatgcctttcccttcccagcccttccctgatcccctcccatatcactaattgtgtattttgtatccataaacttggaataatcattttttacttcttctcccgtccaacctctccttttctgttgtttctgtttttgatgtttgtgttttgtttagttcagttctcctactatcttaaccaaagcttgttcttccaaacattgccatcacagggatttaaaagagaaatgtttacaattttagccttggtcatcagaccaattctgagcataaacatttttttttaatcagttgatcacactttttaaatctcaaatacgaaaagacataaacttagctgaaatcactatactgtacattatttttactgtaactaattccaaagtggtttagaaagttgtattttgcttccattgacaaaccttaaatctaaaacttcaagtacattcctattctaatttggaagttgcctgaaattggtgggttaagacctgaaattaaagaaatttttctctacctttgatatatcctcaaaaattcagacatcatatgccccttataatattcctcctacataaaagatttaaattactgaaagtttcctacgtagtcttttacactcttaaaccaattatttaccaaatatttgtctaatgtctcttgaaatcatttacttcttatctgatatgctttttttgaaaaaaatagcttattgtgatctcttgcctaaataattgaaatcgcctattaataactctcccagactatagccacacttttctccatacaattttaattgattattctaaaatacataatttaatatttcagttctcacttcactttttttaaaaaaatctgtcagtgccttctcatctttaacataaatgcactttttacaaagaacatgccattgaaggcaacactcctggttatcataaattatatgatccagtcataattaattacttgtagcttttttttttttttttttttttttttttttgagatggagttttgctcttgttgcccaggcaggagagcaatgatatgatctcggctcactgcaacctctgtctgcccaattcaagcgattctcctgcctcaaccttctgagtagctgggattacaggcaagcaccaccacgcctggctaattttgtatttttagtagagacggggtttctccatgttggtcaggctggtctcgaactcccgacctcaggtgatccacccgtctcagcttcccaaactgctgggattacaggcatgaggcttttttttttttatgttctccttgtctgcaacactctcccttccaattgcctagctatcactatttcattttgctgtaatcagtataaactgttacaggtgttgaatcagtatgggtctgtagcaacctcaattcttgcttcctcagaagaaagactttgactgaggagcataaggcagaagaagagaccaaggcaagtttcagagcaggagtggaagtttatttaaaaagctttagaacagaaatgaaaggaaggaaagaaagtacatttggaagaggtccaagcaggcaacttgaaggacaagggcaggttttgaccttttgacttaaggttttatatgttggcatacttctggggtcttgcactcattctcccccaagagggtgggttgtctgcatgagcagttacttgctagcattctggaggggagcatgcacatcgtgtttactggagttgaacgcgtgctcacctgaggcgttcttccctttcccttttccaggggaatgtcccaggaaggtcatataccagttaaactctaccattttgcctcttaatgcacatgtgggagctcactcaccaagtttctgagatcttattgagaagctgccaataaccattgtcaggtgtttttatctgtcaggaaactgcctttccctggtgctggttgtgaccaattattattttagagaaacaacaacctgaccctcaccttatggtcacctgactttcctggtggtgtaggaggagccctttccagccctgctgtattagtccatttttcacactgctgataaagacataccagagactgggcaatttataaaagaaagaggtttaatggacttacagttccacatggctggggaggcctcacaatcatgatagaaagtaaggaggagcaagtcacatcttacatggatggcagcagacaaacagagagaatttgtgcagggaaattactgtctataaaaccatcagatattgtgagacttattcactatcatggaaacagcattggaaagacttccgccatcattcaattacctcccccggggtccctcccacaacacgtggcaattcaagatgtgatatgggtagggacacagccaaaccatatcacctgctcacacctgactagctacctactgtaatataaaccacattttcagatgacttctgaaactgatgaaacacttctcttctataattatgaatctttttggcttttattaatatcaaaattgattataattgattaaatttcctgttgatttctcttcctcccatatgagtttgaaagcatcctgaaaggagagactgtgtcttattcattaacaggcatgtggaaaatagaaagtatcaaataatttgcataataatgacgcatgaatgagtacctgtcatagtaataaactatcaaaacaatccaaattattgtgaatctgtaaaattaagtggtatgtttttcaggtagggttacaatgtaaattttgatataaaacaaatctggttgaagaataataatagttattaccatttcgacataactaaatatacaaccatcattttcatatagtaagtaagtggagttgtaggttactatctttacttattaaatgagaaaatagaacttcagaaatgaatgacaagtaactcactgaagattattgttgcatttgggattcaaattcagcacttagggaggcagaggagggaggatagcttgagcccaggagttcgagaccagccaaggcaacaaagcaagatgttgttctccacaaaaagcaaaaaagaaaagattcaaatccagctctctcaattcatagtgtgtggatttcaccaattgtttttgtagctcttatatgaaatgcatgaccctttggtgagacaaatccaaataataatgagcaaaacatatttctgccatttttaaaggtatcgtaaatgttatcttctctgctttcagaaatgttatgcctctgccagatctttatttgttaaaaataattataacaaattatttttacagtacagtgttatgttactatattatatatgttcgaatatgtatttgttttatgtgtgtcagtatatatgcatgtatattatatatacatgcatatgcataaggatatatgtataggtatgtgcatgtttacatgtgtgtttgtaggtatatatttataagcagatatttcaccatctgttgagaaggtgaaaaatatataaaaacttataaaataatatataattgatcttaacttttaccagctatttatcaacattttttctggactttttgctgaatacatgaagtagaataatattgactttgggatatttataacatattcttaatcattttttatttgctatatatttttaatttgtatgatcttagcaaatcattaactggaaaagttactttgtagaggtctgctctctttctctgataatgtttattactacattagtattgttaataatatataacatttatcaagttagtatatgatatgaaatatttttataacacttgaactataaatatactagatactaaatattaaaatacactgttcatcacaaaaatatttagtcatcacagaaatactatgaagttagttgttattttgatccatattttattgatcaggagcctcagtcataaagaatttaaataaagttaagttcacatagctggtcagttctgtagctgagtttccgccaggcactttgactttacagcctgatactacaataggatgttcctgcccagtagggcaatgattcgcttagtcacttttaggatgtgtagcatgatgattatttaatcgaattcagtttctcacaatactaattattcagggaactgaagtgttttcatctagcttggaatacacctcggggtaaatctgtctcattcaggttacagaaaggaaagtcattatagaaaatatcttgcttcagatcaaagtttttgagcctgaaggcagtgtattactttttccatactgttacctattgcattagaaaatcatctgccttgtacttcttctaattgcatacatttgtcagctcaaagttgtgcttgcatttgccttcttttagtatttcaaaatatagtaataacagatgtgtgggtatatctatatctatatacatatttatgtatcaatacatttatatgagaactcatatgtgtttgtaaacatatacatgacacatataagcccaatagattagtttccaaaaaacctttgcagatatctagttcaagttctggataaaatattgtagttgattccatttttaacaacattaaattatcttagatttcattaacattttaaaatcaatttgcaaataacttgaatattaaaaagtacatcagtatatatttatatatctgtttatatatatacacacaaacacacatgtgcatacacagtcacaatgtctaaagtatctgcaattagatatatatatataatgaaataaagtttaaaacgattattttcagtgttttctgattaagaaaaacttattgatggatttcaaaaagtatgttaatcaatatttttcttaaatctgtttgccaacatttcacttttaggagagatgcaattggggttagtaaacaataatgtattcaccaaaagaaacaaagcactttctatgcaccaacagagtactgtacattccatattgtacatatttattcttataaccttggtaacatatgtatatctctctctatataattacttatataattatatatctcatctataaatatctattatgtataatatataacatacataatgcatatatttattgtaaccattatattgtgacatttgacttgttttcaacgttaactactagtattcatgtctttaagaacattgttgtaaatgtcttttttccacttaggtataacttcacatgtacatttaagaacggaattgctgggtcacagggcatgtctattttcaaatacaaaatatttctaaactggttggatttgcgaaacataaatactttaaatggcattaaatatgtaactattatatttatattaatttagtaatacatatattatgtaattaacgcagtaataatttgtggactacttactacctgctgaatgcaaatattctaaaactgaataaaacatggtccctttagggatgtcggtaacaaatttgttgcagttaatcaaattacaataatgtattcaaattgactgtgtctttggcatgtgatatatattactaaaatactctttattgaaaagtttcagtcaaacagcagatggttgtgtctactaaaattagtaatatcagaatgaataaaaactattttttcatttgatccagatacctgccttgtacaaacaacactgaatcataattttccatttagatttaaattctgacatcttattcaattccaggttttatgaaaatcagcaacaacaataaaaaaagctagctatgatttcacagatatgtatagctgaatagacagataaaccacacatagagcaaataaaaagcaccaatattccatttgaaattcaaacacatatattctttaccaccaacggtgcatatatttacgcactgttatactgttaaatcttggacgctatttatctaagccttgaaaataatttagaagattatttagatccacaaaatatcattaccttatttttaaataatctttaatggacacatgaccagtctcaagcactgccaaaaacatgcatgtatttagacaaaatatattacatgaagaaatgtagcctcatatgttctcacacctatatgagacagcttaattttactcaaatattgcatctaattggtccaagaattttatgtatttttgctgattatcataaaggaaattcatcaaaatcatttactctttatggcattagctcaggcctctcttctagtttgtttgtactattacaatgaattcctgattcatctgctgtcagtctttttcaacttcattttttcatatcttctcctccatttattctgaaatgtgggtatcgtcaagttattagctggtaaaacacttgaagagctctcaatccatataaatgtaattcacacacccacagtattgcacagtttcaaacactaagcatggataaaaatatttgctagggtagtgaatgcaaaatagaagaggcaatcattaaaaactgttataaattaaatatttcattaatagattccagtttctttcatacaacatggagaatttaaattctcattaaatttatgtttccatcttatagaaaattatttcagttactgcccaattcccaggcaagttttttttttcccactttatgccaaaaattttatactacctcaacaccaaactttgtaatttttggacaactctgagttagactccaattaggattagtgtgtatatttctaaagagatgtttataataactgcaattaggtttaaagttatgatttatcctaaagccacatattttttattttgcatatacttataatgctatatgataattactatagcgattagcatgtatcattataagtcatgctgattgcactgactaggatacaatagtaggtcaagcatatttagcataacttactcatcaaggactcatttgatagatattgagtacttatcctgtgtcaggcatcattcatgtcaaaatttgtattaggcggcccagttatttgtgttactataaacatcattgcatctccaatcagaatcaaaagaaacatgtaaatacaaatgttcttttgtcatgtgctgtattaatatggaacatttttaaagtaatttttatgtctttacatttctatcactaccttttatgctttaagtgttgtaaagagatcaaaccaacaaaagatatttattataagccaatattttttttcagaaactactaatttttgctggtttgtttccttcttattcccacttgatgcttagaatgtggcagtatgatttgatatctgaccataagtttaaaaaagtaaagaacaatctaatcatagcacaaattcatggggataattcatttagtagaaatttagacaattgtaataaaattgcaagtttcagcattaaaaatgatttttagtttttgtggattcgtaaatagaagttgaaaatttctgtgtcagattcttagagctgtacattgtataacactctcttgattcacctgtacaacattttatcccagttttttggattacattgagttagaaaaatatccctttgggaaacttgattttacattggaattgaacatattgtatttatagtttttctatgtattttaatattaacagttgaaggaatgctaaatgttattaagtctaaaatgcaaaagaacgtactacattttttactgaattatgtttaattttcaacatgcttatagtattgttgaatgtacatagctttgaaaaaaactgtacaatctttcttcagttgctttaatacaaagtttattttaaatattaccaagtaaaaggattaattttagctgaaattgaagtcacttaagaaacttagaagggaattaatatgatacatatgcttatctcttgccattctcagtaaaattattgttattattattattattattattattggatcaatttttatttgggcttctcacagtggttagagccactctgttttcagaacaatcacagcacaggaaatgtgtcactgagactgcccagagcagtctgaccagctgtatcttatcacttaaaatgcatatattcacaatcactgacaaagggtaaagtgcctcacacaggaatgtgtttatatttgcaaatcttccgaccgactgtagcatcaaaccctccaccaacctcattcacctggaaaactagtctcagtcacatctccctggccccctaaggactccttcagctccctattaaatctcttcctgagtagggcagcctcctgcagtgggggccagactgagactctggaatcaatcccagctctgcaggttgcatttcagtcttccggtgcctttagggtaagatgcttcaatgaatcccacagttaacagtcacccagttccccactctaactggggaaaggaactcgagagggtcagaattcatccatttgatcaattcactgaaaagggattaattttggtaaaacttgtttgcctttgagacacttcagtcagatatctaaaacataagacacatactaacctataattgttatatttttctattggtattaaatagaaataaagatatacataagtacttgtaaacagatcataaacaattatatttgtgctatagccccattgacttttttattatttctagaaataatgctgatcctttgtaacattgtgatttgcatacaaattgtggttggttgatatttatctattaagtttgaaataaataagatcacatatatgttataagtgcatgtgatttattattaaacatgtctaatcatggcagcaaagacttaacatgtttctataggttgctatgttccctgcaaaactcacactaaaatttgattcccaatgtggtaatgttgggaggtgtggggcccagtggaaggtgtttgagtcatgagggttgatctctcatgaagagattaacgccctcccacaggggtgaggaaattcttgctctctcaaggttgagatgataaaaagagtctggcttctgtagtttttctcttttgcttccgctctgaccttgtgatccttttccgctttgtgccttgaggtgtaccagcctgaggccctcaccagatatggacatccaatcttgagctttccagccacaagaagagtcagccgaatagtcttttctttataaactccatctttatatctcagtttttctgttacagcagcactaaatggactaacatatgtgtcaaggacttttattaggttggcgcaaaagtaatcgcagccttcgcaatgaaaagtaatcgcaaaacccacattattttgcattaacttatactatacaaataattagaacattttatctgagaaagttttttttgtttgtttgtttttgtttaagaaagagtcaaagtctagtgcctgtttgtgggagatggagtaaaatataccatttttcttctaatagcctctttaattatttaccaccattaccaacattatatgactctttcattttggtccctaatttcataaataaaacattataattttactaaaataaaataacttcttcatagggttgaaaaaagaatgaaaatcaataactgttgatgtgtatgaagtattcaatacatttacctttattaatattattatcattactgattatttctatgtgtgttactctacaccagataaaaattttaaatctaagtgaggtataatataggttctttcattaaattattataaaacgtattttggaaccaaaatatttataaatagattagaatacagacacatacatatatatgtacatgtatacatatatatgtacccatattcatgtataaataaaaacatttagataatagctgaattataaaaacttttataaactatgtgttttcataaatttttctaaaattataatttctaaaatcatacttcttgtccagtacatattatcaatggaagaaatgtacaaaacatattgtaattcccattgctaaatgattagatctcaaaacagaaagaaaaaaaaagggctaagaatgaacaagtttgaaaggggagtttggctttctttgttttctcttttcttcttttttaaatatccacattagacatgtgactgtcttcctcttacattggaaaagtaaataactccacctgggctattctgcatacccggacagtcaacacagacaaatttgaacctccaccgtgcatatattttctgtcagggattgcattgttatcctcttgttgttaatttctcgtcagtcttaaatcaaaaactgaagggtgagaccttttcattaccttataacttcctctatagacaaaatggtgaagtttacacaaaaataatggttactttattattaataattattatttttatattgtttatcttcttagagaaaagtaatgcttacaatttctcaaagacagaatcattgttggctacagtttttaaaagagagaagttggagcaatggtaggactgaaaaaagaataagctatatcacccccacctggcaaacaaagttgcgactaaattctaggttctaattttcaatggttttgtagagcctgcagtctccttctagggtttgaaactgtagcaacaccagacctatttggtttagcttttatgtgacaaagtggtaagttgtttttcacttgctgtggcccctcagattggtggaaccaagcctgtaacctcagggggaatctaagtgctaggactgaggagtggggacagaattaagaagtggattccacatgacaggatccaagatctaaccagatcaagctctggcttcaccccatggcaggatccagtcaggtactttctcttgacatcacctcattgcaagatacaatcagatcatgcctcattttctgatgtttctgcttacttgcaagtaataaaatctccttactaaatcctccttggttgtgatcattgggctgatacccaccaagtgacggaattattagtgagcatatagtctcactctggagtttgattaaaatttttgtaatagaaatatacccacagataattcctaaagcttgatttcattgatatttaaaaacaaatatatttataaacattgtgtatttaattgtgagtcaagaactcatttttaagactttcttttcttattatattagcattctaaccagaagtgtgtttttattttcaattttttttcaaaatactatctcaaatgtaataatattaccctatggaaatcctttttaactgcaaatattcagcattgagtcagaatttatcgaaaactgctatttcagttagcatcccatcataaaaccaatagtctgttccaagtaaagtaattagtagaaaaatttaaggggtcatttatgaaagagtggatgaggtatagaagaacacaaaggagagagcagttactgtcatggagctgtgactgcttcctggagaaagagggttcatgctggttactagaatctagaatccagaaatacagtactgtgtccttgaggaatacagtgttctgggaagaagtagtaaattacacacaagtgcatagcagaagtggctattgaacaggagagactcatgagaataaataattgaatctacacttattccctttctttagtgttcttctagggctcctcattgaccaaagcaaactgaaagccagagatcaaggatgctactaggtggagctcatataggtcagccgctcaaaacacagggaagggtgaagaagaatggataatagatcctggatgtgaaaggaaaaaaaattgtgacactccgtttttaataagaatgtatcagttcaatcactatcagtttgcagatgtacattaaataataacaagcaagttacttggtttgaattagatatgattaccatatagcatacttactttcaaaaaccagaaaatacgtaaagaaaacttacagtaatatgagtgtcataacaagagtggaaatgaaaaatactataagtactgtaaatagagcatagaacaactgatgacagagtaaatcaatctctacatttagcaaaaatgtttataacaagaagaaagcaaatgaagattattttgttttaatcttaagatgcattagttaggagtttgaaaagaaggtaatactaaaagtgaaaaataaaatctctgtgtaatggtttgtttcacattgcttgttcaaccccaaaactggggttctacaaaattctcctatttagcttgactgacctgcatatccaatcttacgcgatgctggtattgtcctgagttccactttcatcagttatccactctgtagctggacagtgattacacagtcaaaagttgattaccattagtttttataacttcactgtctttcaactagattcctaattatttgtccctgtatatatgattgtataagtgtttgcggtattttccccgtaagagtaattctctttagagattttctctgttgattcagagccagtcttggcagctacactagtaatttttctttaatttcaacaaatgttatagaagaagatatgccaagttgtgacttgttcttttccaggtctaattggatatatccaaaatatatcacaacttctgtcaaagtgtcaaatatgaacataaaaacaatctcaagtttagatccaaagtgtttgtatttgacttaacaggttgtaggaaaatatgtaatattttgaagacatagtaggaactgagctttagagaaatgattaagatgataatatattatcttattatcaaaaaggtttgggcaatttcagaatggaagttggcagggaaactataagtcagaaaaggtttgagtatgtgaaaggaaccaggaacacacaaacctcaatggattaaaataattaaattatttttataatacatttccatcatatttcagtgaaaagtctctgctcattgtggtctttgagaaatgtaggtgacaaaagctacatctcaaaacatgccaccgtgattacaaaagcgggggacagaagataaggtgaatagcactaacatgtctgcccagaatgatgacacatcacttcaacttacgttttcttgggttaaataaaataacatggccaagtctagttcttatgggaaaagattaaaattatatgtacaaaaaagcaaaatcaggcacccaatgagaagaccgcacacaacttagagtcaaataataagagttttctaaagagagttggttgcaatgataatgtcaagaataaaattgattaaataggaatttttaggtacaatctgtaggacatgagacagtgtttgcacttttgcttagatctatttttagtatgtacatgtgtttcctctttgcttcctaacttctaacttcagcatctaatacagacttggctaccaatagggtatgagagacatagaataaaattaactaaaaaaaactttgcacctcacaacctgactatccaaatggctattggtgcaattgttttaaaagaaacaaattcttgcttcttttacagggaactcactttacagaggagctcacttgaagaaaaaagatacacttttaaaaattttatttcatttcgtgtattttactttattttattcacattaaaatacacagttaacgttattaggcataaagaaaatacttttttttctactcccacacccctgcttcaaggaaaatacatattaaaatcagaattcaataaagcctataattttttgaggcagaaaatgacaatttttggtaagactgtggagcaattgatttctgtatattgctggtaggaatgtacattgatacaattattttgagaattgtttggcagtatttactcaaactagacacacacccaccttaggacctagcaactccacacataacaactgcaatcacgcatttattctgcaaaatatatggacaagaatattctggcccacgtggtggctcactcctgtaatcctaacactttgggaggccaaggcaggaggatcacgaggtcaggagatcgaaaccatcctggctaacacggtgaaactccgtctctactaaaaatacaaaaagttagtcgggtatggtggcacgtgcctgtagtcccaactattagggaagctgaggcaggagaattgcttcaacccgggaggcggaggttacagtgagccaacatcatgccactgtgcttcagcctgggcgacagagcgagattctgtcacacacacacacacacacacacacaaatattcttagtagtgctatttataattgcccaaatctgaaaactacccaaatgaccatcaagagcagaatgaataaataaattgtgctattttttcatagtggaatataaacagtaataagaaacaaactacagctgcacataagaacaaatttcccaaacatattgaatgaaaaaagtcatacacaaaataatacattttaggtgattccgttagtataaagatcaaaaccagacaaagctaatctgtgatgtaaaaaatcagaaaaagtgattttcctctgggagaatgaagtgacttggaaggttttcaaaaatgtttctgggtattggtggtgttatgttttttggtcttggtgctggattacatgtagtttctgtaaatttattcatctgtacattttctattggtatactttatgttatgctttagcagaattttattaatgttatacagatttaatttgattaagagtactcttataaatttagtaataaatagtgtttattttgaatgaaaagtctaagtgtattttaaaatacaacagattttacttttattttctcttaggcaaactaacatattgagaataatacaaagtagttacggatgcaaatgcttacatcagacaaaatgtgtctcccattttcactttttactatattattgtactgtaaatatttgattttaaataagaaaatcacatgctcaagatggaaagattaactttttaggtatccagactgacatggaaactgaacagggaagtgaacctaaatataaatataaacattttagaatcagtagcctgaaagtaatagttaaattcctgacaaaccaaagtctatttactcactcaatttgaaatgttatcaaccagtgatctggaaatctaggtaaaaataacaattcttttatttttattttttattttttttttattttttttattattttttattttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccaggatggtctcgatctcctgacctcgtgatccgcccgcctcggcctcccaaagtgctgggattacaggcgtgagccaccgcgcccggccacaattcttttaatgacctaaaattctgtaactgtatttgactaaaaaaagagggagatttttcaatgtgattttaaactgtaaactcaaattagaatacaacaaccaaaattacatgaaatcacatcttatccatctgtctgcttgggagttaaatcaaaatactttgcaaggtggagataaatttaacttttatgtctaatttaaaatggagagagttggaatcacctgttttaatgtcaaaaaagaggcaaatataccaactgaagttacaatgctccatgattttttttctaactattatcaatgagatcccgtcttttgcaatgacataaatggaactggagatcattatgttaagtgaaataagccaggctcagaaagaccaacattgcatgttctcacttatttgtggaatctaaaaatcaaaacaattgaactcatggatacagagagtagaagtatggtttccagatgctggatagggtaggggaggcctgggggtagggaagcggggatgggtaatgggcacagacaaacataaaaagaatgaataagacctactatttgatagtacaacagggtaactgtggtcaataataacttagttgtacattttaaaataacttaatgaaattggattgtttgtatctcaaaggataaatgtttgaaggatggatacttcattctgtgatatatttatttcacattgcatacctgtatcaaaacatcccatgtaccccagaaatgtatacacctgctatgtacccataaaaattaatttttttaaaattataaactttataaaaatcatagttttttcatctaatcgatattaaaaaacattgcattatgacggtaacaactgaaaaagccatcttggaaacacaggtatcatttcactttatatcaattgattctaccgacagctaattcgttagcactaaaaatcagcttcattttacgttctttttagatcagattttagataacagtaactgaccagaaattggatttgttaagctattagttagattaacaaagaaaaaataataatctgacatgacattcctcctttttaaagaaaatgatatatgaaacttggaagctattactttaataattaccgtagcttttatttatttattaaatttatgattggcacataataattttacatatttatggggtaaacctattgttacaatacatgtatgcattgtgtaatgatcaactcggggtaatcaacatatctatcactttgaacatttatcgtttatttgtgatgaggacctaaatcactcttacaggtattttgaaatatacaataaaatattgctaactccagttattccagtatataatagaacaccaaaacttatttctcctaacaattgcttggtacatattggtcaagctctcaccatatccctcattctcataacctccaaatcctctggtaaccactattatattttctacttctatgagaacaactctttaaatttcacatataagtgaaatcatgcaatatttatctttctgttagtggtttacttcactttggataaacttggagaacattatggttcagcttttctcggatatttattctaaaacttttggatgtactaaaccaactcaagcactaattttcttccccatatgctaaatacctcatgaagaatactgtaaacatgtataaagcataattttatgcatatatgattttaagctcagctaggaaagtattgaaaggtacttgagttgtatgtgtgcattataagccacatattaagtaagccacaaattcacaaaagagggtaattttgcttaacaagggtatggaaattgagaaataggtcttagaaatgagctgttagtaatatcagtaatattttcagaataaatagaggttgaattatcagcaaactagaatgaatacaattcgttagaaggaaatgagcaaaatgtaatcaaagaaactgaggttgatgtaaataatgatgatagagaactatgtacccaaatagaacatggcatttgtatttacaatatgatggaaaagttaaccacatggactcttcctttcaaccataagagagatcatgaaataaagcatggagaagtgtggcaaagtacaacaaaaccaaagtgtaataatttattcatagaatgtttgaacaaaaagagctcgtttctgcttaatgttttatgtaatcccatcttttccaaatgaaaacctgaaactcaaatctataatctgatcttactgtttataatgtttggataattggttcccatagtgaaacttttcatttgtaactgattaactgtactttctgcctgtgaaaaagaataattaaatactatttaccactcaattatttacagcagtagttaaaatgtgaccaaaaatagttaacaaaattattataatgtacctaattgatagagaattcttgttgagttgatgaattttgaatgtctatattaagaatagaaatgctttaaaaatgctatgtatacattttatttgtaaagatcacataaaagtattataaaatgttctatgagcttttgtgcaaatatgttcaaatatacacatataggcactcatgaatacatatttatatgttagtttttttaacattaggaactgtactgttcatcacatgtgtgagtctgttagataaactgtattctcaaatgcaataatgacaaacacaaaaatagaacattttagcttaaaataccaataaaatatttattatatatggaagtaatttagttttcactttttacactatgtattttataattataatgtaggatattaaatgatggtaaattaacataagtagaaatttcaatatcccagcttttattgttgaataataccaatataaatgtatgtttttttatctgcctaagtgaaatcaggaaaaaaattttaactcacagtcttcataccgaaatatgttaatatctatttaacatttaataatgtaaggattattaaactgtgactaaatgtgaactaaatttacttgaaaattatttcaaaagctatagcctactatttttctaaagatgatataaaagcaagcagaattgaactggtttgcgtactagctgaattgtatttaactctaattaatttccattggtgtattccatatatctggaaaaccagactatttcatacttcgagaatatatagttcaataattttcagtgttaaaagtgataaatgttatttctgatctatacttgttttttctatgcattgtaagtgcattattcataacttttacactgggagacattgtaattaacatagcaaaaatttcttgatgataatttataaatcttgcgtatagtagtgtataatatagaaatattccttattagcacaatattttaaggcaaaatctcccatctgtgttcttatgaaagattatgtgcacaagttatgaaagatcttaataaaatctttatgaaaaaaaggatttcacaagtaaactgggaaacaatgcatactatatccctgcttgatgatttgcagtattctgttattaaaatctataataaatctgctgacaaaaatacacttaatagagctaacatggtattgcctatatcaattttagggcagaagtgttttgtcgcaatgtttatagttattttgcagaatattaatttacagtcctgttactgaatttttacagatgtccacttaaagccaattaaaaaaacattttaaaaatactgtatgacaggtattgttttaagcattttagaaatattaactggtttaaatctaataacatggctatgagggaaattagaaagctatgagggaatttttacctctatttcaccagccagaaaactgagttagagacagataaagttaattgcccagaatcacacaatgaaaaagctgaaagattgaggatatggacttggagtctgtggttccaccattgggctcgattcattgcactgggtattattcttatttaatctctgcttaattgccttttggccttttggctaagatctgttctgatcagtctaatctttatttagttcaatttagttcaattcatttatcttattgattgtagcaagtagaatttgttgtacaaattagattaactctatgtatgtacatctacatctgtggtaggagaccattgtgaattgcacaatagtgatgcatttcataaagaaagtggttgcaggtggagcatgggctacatttttaagaaactgatgacagcaggagcattagcaaatccccatgaaatctaacacatgtaacgagagcagctcaaacactgaacatgactaactgtagtggaggtatttgtgatcctgtagagaatactctctgaaaacttttagagtgggaattgagtaaatgctggagattctctattaagcgtaagaaaattggccaataaaattagggtgattactgtagctatcagcacacaactgtattcacacacaaggtaattcttggagagtctactaccttatactcttcttaactctgatcaaactgaaacatatgcaaagcaatcacattcatagaagtaggaggaataaattctactgtaaactagaaaggtgttagataagttgcaataaaaaaatctattgcataacttttaaaaaatgaaaatgatattattcttatttgacatttgaatcaaatctgcccaggtcagcttgtaattatggtactagcaactgatccagttggaacaagaattgagaaattttgactttatataatcttgtcgttactaaataaataggtcaatagtctctgaaaaaagttggggtcaccaaacctggactcgaggctgactttttatgtttgatctgtcaattactaatgatttgattttttgatatattacatacttcctttgttgcttagtttcgccccctaagaaaatccctaagaaaatgaaactacataatttccaaagttttttttttataagttcaaggttcttattgggccaaatattaaaagactctttcatgtgtttgaaatcacatgtcttctctttacgtggtcaaacaccaaaggaagttagagacagtttcctttaagtcttttgttaaaactcaatgggtttaccaaaaaaaggtgttgatagttgtgtaagtcaccttggtaatctgccatacatccaaaatgtattaatcaatttccaattatgtaccaggtattgtgccaccctagaaagacagcgttatgccatacacagtctcagctttcattatagttacacaatatttgtgaaacctggcacgtaaagagatttacagccaagagctataaatgctatgatagagataaacacagggaaggggtaaactagatcaactaacagatgttatgagtcattaagtattgttttctatgtataatgacctagaaactcagataggagggatacatgattattaaccagatgaagaaagaacactacaagataaagggaaaaaatgctaagatctcgaggtgagattaatggggtgcttgaaaattgtaattaaaatgtggctggaatgttgaatttaagaatcacagccaggcgcagtggctcacacttgtaatcccaacactttgggaggccgaggcgggaggatcaattgaggtcaggagttccagaccagcctggccaacacggtgaaaccccgtctctactaaaaatacaaaaactagccaggcatggtggtggatgtctgtaatcccattgaacctgagaggtggaggttgcagtgagccaagatcagagatcgcgccactgcacttccagccagcctgggtgatagagtgagactcagtctcaaaaaaaaaaaaagaatcagaggtggtactgttgaggaagcatttgttgaaaggttggtctgaatttttgtcaggatccaggccttacagaaatttcctgagagatggcattaaagtggcatcgtctatgtaaggtatagcagtttatctctataaaaaagattaataataagaaaaacagtgacagtacttgtttttgatttctagtgtcctttccaaaccaagtaaaatttaaaaatgtaagttctgtcaacataaaatattgctctgattctctttcttccttcccctcaaccttttgtctcagagatatgggatttctcatggacatataaaatgtcattgatgtaaaaatagctgtgatgtaagtggtccctctcagttaatgctaaattgcttgaactgaatctggtgtgttgtaaaaaaaaacctaatgcaaatgaaatttagtagagtttacttgagcaaagaacaatttgtaaattaggcagcactcagaactagaagaggttccaagagctccacctagcaatgtgactaatcaactttcatttcacagaaagaacacagatgtgaagtagggaaatcacctgattggctacacacagctagatgtttgcctaatttgggcatggtgtgaagagtgggctgcctgtgaacggctgaagcccaactgtttgtgatggccaagatgtagccatttgttataatcccaaattaggttgcggtttgtacttaggaactcaaaatatgggagaccatctcatgctagtggcctcctgcttatttaatttgagagctaccctaggtttgcctctctgttggcacaccaaggaattcaatctcagtgggcatctctggaacacaggattctcaaaaaaagggcatcacatgtcttttttttttttgagacagagccttgctcttattgcccaggctggagtgcagtgacgtgatctcggctcaccacaacatccgcctctcgggttcaagcaattctcctgcgtcagcctcctgagtagctgggattacaggcatgagccactacgcccagctaattttgtatttttagtagagatggggatttctccatgttggtcaggctggtctcgaactcccaacctcaggcgaaaagtgctgggattacaggcgtgagccaccgcacccggcccacttgtcttttttagtctagagaatttattaatgttttttcattatcacaatggtaacattttaagatctgtcaatttaaaatattctctgaagtctttcttctacatgtattcattgagagagaagagatactttgacctctaccacatttgtttgatattgaattttttttttaaacattaacttctggtaaaaatctagcaagggtaaatttaatttgtcaatatttttcctacactgtgtcttccaattttgcaaataacatatttaaaagtttaattaaatatattttatgaaatatgaatatttcagagaagaattagaatgattgctttattaataatttattcaattataatcagacaccaatcttagcataatcacaagtttgggagtaaatatataaattggactgaattttggagtacactggatataagacttggggtacactggatataacacagctgatgttagctgatgtcactaataatgactaatatttcaaacccaattcagtaacataactgccatttacagttgacccttgaataacttgggtttgaactgtggtcaacttacaagtttttttttttttttttttttgcctctgctatctttaagatagaaagaccaacttatcttcctccttcttggcctactcagggtgaagatgataaggacaaagacctttataatgatccacttccagttaatgaataacattttatcttctttatgatattcttagtaacatcctctaggttatcttctggtaaaaacttagtgtttaatacatataacatataagatatgtattaattgactgtttattttatcagtaagccttccagtcaacaacaggctattaaaagttaagttgttgtggagtcaaaagttatagatgaattatcgacttcatggtgtttagcactcctaatcctcattttgttcaagggtcaactgtattagagtgttataaataaatcacagtagcttttggctatttcaaagagtaagtttgtgcactgatgggaatgaaagtcttacactaaacaaatacaaaagaaaagatttttcagagcaattaaacgatagtttgaaaactcttttgaaattctgacctatttatttgggtcaatatggtctctaacgtttcactttgaagaaggtagtactctggaaaactgaatttaccaacttttggtgtcaaacattaatatcaatattaaaatgttaaaatgcattttatataaatgctctttagaaacttgttcaagcataaaaagcataaaaggaaagtttttctttgagatgtcaattatagattctattggaaatactacatagcttattaaaatattcaaaatctcatttaaattgaaattattatgtataatgccattaaaatcacaggctctcctggtaatcaatgttcaatggaagaatgaataagctcaaagtttaaagaatctttcaatttactgccgatctttaccatgaagactattaattacttttggtacactccaatttattattcaatacagaaaaggaaatgatctatatagtacaattggttctaatatcattggattacacatcaagtgagtgttaagtatgagaggtagcaattgttcgaagttttaaagcagatgttaatacagaatatcaaaattttatttgcatttcagcgagtatctctatgtttcttaatctacaaaatggaaatgatgatactatttcggatttttgtgagtctaacaagagaaaagtacgtgtaaaggaagtatttatcaactacacaagcaaactatatgacttctcagtaattggcaaaattatcataatggttatgggacagttttgaagattaaatgagataacgatcaagtgaacaacaaactgtcatattggaaacactgaagaaaagtagatatttgtcatagttaaaaaatgatcacatacctctttgaacttttatttataatatatatttttagaaagacatcatgttaaatatatcacatgtcatttaatgaaagaagaatgttttgtttggaatgtgttaattggatttattatatattttctatgtcaaacctaaaaatattaaacagtaagaattttatcatggactacaatttgtagataattatcagcctttctccagtttattggtctctgttacagaaacattgacactgactatttctttttcaaaagaatcaaccatcactcccaggttaatatttagcagctatccagtgactcatgtatctaaaatggcttaaaagcattggagtttgttgggagacagaggcgggcggatcaggaggtcaggagatccagaccatcctggctaatatggtgaaacctcgtctctactaaaaatacaaaatattaggccgggcacggtggctcacccctgtaatcccagcactttgggaggccgaggccgccggatcacaaggtcaggagatggagaccatcctggctaacacggtgaaaccctgtctctactaaaaatagaaaaattagctgggcgtggtggagggcgcctgtagtcccagctactctggaggctgaggcaagagaatggcgtgaactcgggaggtggagcttgcagtgagcagagattgcgccactgcactccagcctgggagacataaaaaaaaaaaaaagcattggagtttgtatctcactttgttttatttgtaggcgtgaggatatatgctttactgaagaaatagtaagagagttgacgcatagagactaaggttagggtgtgttagaaacaaagcagctttcccttttagaagaaagatcgtatgagtttactaaggaaatataatagaagttttgggtctctgaaaccttgaacgagttgcatttaaatttaacaaaacgacactaattttcttatttattttttcttaaatgaaatttggctgttgttgcccattcccctgaagctcacaggcttatacaaattttgcgtaaaatgcacagtctgttgttttctcacaattctaaactgattttcaacatggctttctatccattagctccaaagtcaggttagatttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgcaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgtcaggttagattttaatcggtagttttttctccttcttggtagaggagcttttctaaagctagatgaggatcagaccaaaattggcaattacaattttaaagagcaacatccagaaaataggtactgaatgaagaatttgattaaaaaaagaagttttgaaattggcaacatttaaaaataaaaccgcaaggtaaaaaatgaagacatagaaggacagaaaaaaagaagtctggctgaacttttctgctcagggtcaaaatgactttggagtgcagcaaaaaacaggaatataaaataaaatgttaaaatcacaaggaaaaaataagcctttccaaatttgccctgtctcttatctatcagactcagcccaaaagcaaattgttggcagatgttttgtgatatgattttttttgtgacatataaaaacgaaaaggaatagatatgaatgcattgaagagagatcaaaatgatacaatttgagcaagacataaattagtcatattaagctcaatgccttatgaaaaattttcagtggtattatatgttatcagacaaaagggcccatatgaatgtaacaatttttaaatatacatcttttaatatctgaagaaaatgataatgcaaacaatacaatcaaatattatgtaagatttttggtagtatttttaaataaatatttgatgtttttaaaaagatgttaaacagattggttgcccattatattacactactcgtttaatgaaaaggcatggtacacttactatatgaaatttatggccgaagattacatttactctaaaaatgatttatggagagtagcaattgatacagaattttaaaatgatgttacaaattttctgtgtgtctgattgtaattcatatacattagtgagtggaaacagccattattaaatcttctacagttgaaatcattcatttaagttattgtggtttaaaaattcaccagtattaggcctgatttgtggataaataaagaggaggccctattcctgaatagctcaaagtactgtgaaagagaagaataagtagaagatgaaaatgctctctgaactcgtacgcatgtacaaagtaacagcccagcacaggaagaaatgctcaatttcaatcctccgtgctcgtggctatcaaggttataagtgatcaggcttataagtgatcaggttataagtgatcaagagatatagcttttgtttatccttccagcttcattatgttacacacactcacagaattctagcctttgttattctatgaattactagaattactaggattgttccctctactcaaaacttttgtacttgttattcctttatacttaaagaaattatttctggttgtttttataagtaactccttatatatataagcaactcactgttgctgtcaatcctttaggactgttttctccacctctgtttttgttattgtttatctagtaatttttaattcatttgtttcttcacatgattggtgtttgtctttcttgctagaatagatgctccatgaaggcaaataatgcttttgcatttttcctatgctattgtaaattcctagcatagtacctagctaccctggtttcctcatatgtaaaatggggatagattataatatgacttggtgaggtaagtttataaattaaataagaatatgcatctaatatttttaagaaaataataaaatcattattaattattttagtgcagtttatgtagtggcagccaaaaaaatgttgcttatgtatatattttacacctaaatgtttatgctgattattttctacatgctacaagtgttttactacagaagaaataaatattgtgtttaaaatacattaatataagagtataaagtttaactttttatatgtaatggttaccaataatataattcatggtaaacatatacaataataattatgcattatgttggtgctattgataaattatatactcattcaagtattagatgtgtctctttatgatttaaatgaattttatattaaatatggccacatcagcaatacaatgggtaaaataagcacataatctctctgattctgtgtgagtcagttgtgtgtgaatctgtttcaaattaatacgataatcatatgtaagaataaaattgcatcttaaaagtaacttaaaatgttaagtaaagatatgctatttttaagtgtatataaatttataaagttattttttcttttactaaattttatatcaaatttataggacgttcaactatatgtatatctgaacatacactgtcaaaatcaaatacaatatagagataaatatctaaatttaaaatgttttattttggaagtaagaattgcagtttgaggcatacacaaaggatgtgtggtcttcggtatgtccaaagcacaaagggaagtttgggaggtttattagtagagaaatagtaagtttttttattttattttatttttatttattattattatactttaagttttagggtacatgtgcacaatgtgcaggttagttacttatgtatacatgtgccatgctggtgtgctgcacccattaactagtcatttagcattaggtatatctcctaatgctatccctcccccctccccctaccccacaacagtccccagagtgtgatgttccccttccggtgtccatgtgttctcattgttcaattcccacctatgagtgagaatatgcggtgtttggttttttgtccttgcgatagtttactgagaatgatgatttccaatttcatccatgtccctacaaaggacatgagctcatcatttttatggctgcatagtattccatggtgtatatgtgccacattttcttaatccagtctatcattgttggacatttgggttggttccaagtctttcctattgtgaatagtgctgcaataaacatatgtgtgcatgtgtctttatagcagcatgatttatagtcctttgggtatatacccagtaatgggatggctgggtcaaatggtaagagaaatactaagttttgttgtggaagtaagtttcttggcaccagagaagattttgggagcttgcaggctttgattggtgagtgatactggcaggtaaaactggtcttaggattacagcagatgattttagcagctgaacttgtagagtatttaactcttggagcagatgctatgtgctctgaatgattttctcccggctccttgaccctgattctctgatttagttggataggacaagaatgattcaattcatataatcaattttccatatatatatatatatatataataccaacccacccacccacacacacacacatctatgtgttatgagttaatattttcacaaaaatgtaaaagaaattgagtttgtagtataatttttttatctgcttttatcacttcatcatcatcagtaaggagtcatgcctttggaaaaaaactctaataattgctttataatttctttaaacaaaaaaacagtgacaggtggattttatggctactacatataaagaaacttatgtactcacattgcactcaaataagatggggggctcactgccaattgtttctaaaactattatattaaattacagcattgaccaagaaaaaaagatgaaatagtcaatttagccaacagatctgttaaactgccttccccaaaccaaaaagtaaaaccgaatcccaaagtacttctacatgtacttatttctttttattactcagagaaagtgattttatttcctgtagcttaacactaatcccttcacttctgatttctattccagctgcttcaatttcttcaggactaggaattttttcctctttctcacatacattcaatctctgtctactaattaatttcccataatctcacagcattttaatctctcctatcttaatagtctttgtgttaaactctgagcctctacacactaagtctcttttttcactgctacacaactgtgcaaaaaaaaaaaaaaatgcagctcacgtatgtcaccataaggcaccatcaatttactctgccaaaccaaactcgcttctgactacatttaaaaatatctttccaagattgtaaattaattgtaaaatatagttctctcttgcaacttcatttgataacagttgaatgctactttctttatgattatttctatttcagaggtaatacacgacagtgattaaaagcataggtactagttttgtgaaattggataagtggtttaaaatgtccgtgtcttaatttccttttatgtttagtgtgttagatttgttaatacatgtaaaatacaaagacagttaataaatgctcaacaaggccgggcgcagtggctcacgcctgtaatcccagcactttgggaggccgaggcgggcggatcacaaggtcaggagatcgaaaccatcctggccaacacggtgaaaccccatctacactaaaaatacaaaaaattagccaggtgtggcggcgggcgcctgtagtcccagctgctcccggaggctgaggcaggagaatggcgtgaactggggaggcggaggttgcaatgagccgagatcgtgcactccagcctgcgcgacagagcgagactccatttaaaaaataaataaataaaaaataaatgctcaacaaatactaagcatttttatactgggtatgattattcactcttctggtcattgtttctcacaccactatctgtatgctaattttacttaaatttatgcagcaaatcaattttatgcatataataatctcaaattcaaccccaacaatattttgcttatacaattgcctttcaatttaatcatcatactttgttttctatctctatgaggaagttcatccttgactgatctaactttgccaggagttcagaatgcacttattttcttttatttttactttgcttttcttttagttcacatacatttagtaatgtttcatctctactataattcctaaaagtttgtcatactctatctcatgtctatcatgatgttaccacaaagaatcccatttgtaaaatatcatctttcaacttttacctatattattttaatagtttccaaatggagacttttatttaataaaagggaaatcaaatcaggtcactaaaattacagcagaacaaaccctctgtagcacagtgagcaaggttcttcataagttacttgtttagctccttgcaatttgggctgcagccataataatcaacataaagcacgtcaaacacatcatgctattttattctttggtgctttttcttactgtagcaggaatgtccttctcatcgttcaaaaatcctcctgttaagaagttttatggcttttccatctaccaatggaaatgaaaacttattccttgagtgtcccaagtcccctttgaatacatcgagcacagtccttcaatctttgtgtggcattatatgtttatgcagattttacaaacttagtgaaaaggactatgactcattagtcttgtctgtttgaatagctaatcatgtctggctcatcttcctcctctgtatcaaattcacattgataatgccataaataacattgattaagtgtgaggtaatataactaggtttgttaaataataatggtattaatttgctgaattcaattctgtaaagtaattgaacttctttatttacaacgtgctgtactgattctttctgatatacaaagtccacaaataagagagccaaagcattttcctgccttcaaggaagtagtattgtacacacacctggaagacaaagtaagtaataccatgtagatgtaaataaactataagactaatttcaccgtagagcattttgttggttttgataaataaaacatatttggtctgaggtttaaagtgcacacagaaatattaaagaatgacaaattcttctgcattgcaacttgaaaggtcaaataaataaaagcaaatacaaataaaaagttccaagggtttttgtcattggttctgtttatgtgatggattacgtctattgatttgcgtatgttgaaccagccttgcatcccagggatgaagccaacttgattgtggtcaataagcttttattgtgctgctggatttggtttgcaagtattttattgaggactttcacatggatgttcatcagggatattggcctgaaattttctttttttgttgtgtctctgccaggttttggtatcaggatgatgctggcctcataaaatgagttagggaggagtccctctttttctactgtttggaatagtttcagaaggaatggtaccagctcctctttgtacctctgttagaattcggctgtgaatctgtctggttctgggcttttttggttggtaggctgttaattaatgcctcaatttcataacttgttattggtctatttgaagaaagggccttgaataaaattcaacaccccttcatgctaaaaactctcaataaactaggtatcgatgaaatgtatctcagaataataagtgctattcatgacaaacccacaaccaatatcatactgaatgggcaagagctggaagcattccctttgaaaatcagcacaagacaaggatgccctctctcaccactcctagtcaacatagtattggaagttctggccagggcaatcaggcaagagagagaaataaagtgtattcaaataggaagagaggaattcaaattgtttatgtttgcagtttacatgattgtatatttagaaaaccccatcgtctcagcccaaaatctccttatgctaataagcaacttcagccaagtctcaggatacaaactagatgtgcaaaaatcacaagcattcctatacaacaataatagacaaacagagagccaaatcatgagtggactcccattcacaattgctacatagagaatcaaatacctaggaaatacaacttacaagagatgtgaaggacctcttcaaggagaactacaaaccactgctcaaggaaataagagaggacacaaacaaatggaaaaaaacattccatgctcatgggtaggaagaatcaatatgatgaaaatggccatactgcccaaaataatttatagattcaaagctggatagctaccatcaagctaccattgactttcttcacagaattagaaaacaaaactactttaaattttatatggaaccaaaaaagagcccctatagcaaagacaatcctaagcaaaaaggacaaagctggaggcatcacgggacctgacttcaaactatactgcaaggctacagtaaccaaaacagcatggtactggtaccaaaacagcatggtagtggtaccaaaaccgatatatagaccaatggaacagaacagaggtctcagaaaaaatgccacacgtctacaaccatctgatctttgacaaacctgacaaaaacaagcaatagggaaaggattccctatttaataaatggtgttcaaaaactggctagccacatgcagaaaactgaaactggaccccttcattacacaaaaatttactaaaggtagattaaagacttcaatgtaagacctaaaaccataaaaaccttagaagaaaacctgggcaataccattcaagacataggcatgggcaaagacttcatgactaaaacaccaaaagcaatggcaacaaaagtcaaaattgacaaatgggatctaattaaactaaagagcttctgcacagcaaatgaaactatcatcagagtgaacaggcaacctagagaatggaagaaaatttttgcaatctatccatctgacaaggggctaatatccagaatctacaagtaacttaaatttacaagaaaaaacaaccgatcaaaaagtggatgagggatatgaacagacacttctcaaaagaagacatttatatggccaacaaacatatgaaaaaaagctcatcattactggtcattagagaaatgcaaatcaaaatcacgagatatgatctcatgtcagttagaatggcgatcattaagaagtcaggaaacaacagatgctggagaggacgtggagaaataggaacgcttttacactgttggtgggagtataaattagttcaactattgtggaagacagtgtggcgattcctcaaggatcgagaaccagaaataccatttgacctagcgatctcattgctgagtacatacccaaaggattataaatcattctactataaagacatacacacacatatgttttctgttgcagtgttcacaatagcaaagacatggaaccaacccaaatgcccatcaatgatagactgtataacgaaaatgtgtcacatatacaccatggaatactatgcagctataaaaaataatgagttcatgtccttttcagtgacatggatgaaggtggaaaccatcattctcagcaaactaacgcaggaacagagaaccaaatgccacatgttctcactcataaatgggagtcgaacaatgagaaaacatggacacaggcaggggaacatcacacaccgggtcttgtcagggggtgggaggcaatggaaaggatagcattaggagaaatacctaatgtagatgacgggttgatgggtgcagcaaaccaccatggcctgtgtatacatatgttacaaacctgcatgttctgcacatgtattccagaacttaaagtgtaatttacaaacaaagtgacaagaaatgcagtaccctgggtgtaggaaatttgtggaagaataaaagaatagttgtttgtagaaaacagatttttactggaatccacaaggagtcaagagtactagaaatggcatatacatgttggcagataggagactataaaactatatatatgttgagatacacatgtatttatataaatatctgaactttttataaaatacataatgtaaattataaaatactcctataaatatgtaatatctgaactatataaatatttatataaactataaaagtatgtcatttatatgaaagtagctttgcaatattaactcgtgtagtgtgtcaagctttatatactatatatacacatataatagagcaagagagagaaaataggaatgggagatagagacaggatataatataatatttgtttaacttaaaaggatccagtgcttctttgtgctggcagcatgtgtatatatatgcatatacatatgtgagagatatatagatatacatgtatacatatatatatatatcacatccatatatcagacataaattcaactatattagtagttacattaaacagaaattacaaacacatgatgttcaaaggcaaagattgtaagattggaataaaataaaaacaagattcaatgatatactgtctgccctctacctgtgatatatttcaaattaaaatacccgaatagttttaaagtaaagaaattggaaaccatataccaagtaatcagtaaccaatagagagctggaatgactaaacttataccaaacaatgtatacttaatgtatagaatgtcttcaaagtaaaagcaggacttttttaaggattaaaaagtcaatacattagaaagatggagaaattttgaatgtatatccagataacatggtctacgtaagttaattttcatttacttctgttaataaaccgacaaactttatttcaccatttacttatgactgagattaaagaaaaagtttaacccatcatacattacctagtcatacaatacaattttatatagtaccccaaatcacacatttttttcatgaactacatgttttagcagcttcattttgatataatattttatattattgagatacaaaaccataatattcactcaaattgtacaattcaatgcttccttggaatactcatagttgtaccattatcacaaaacctaattttagaacatattcatcacgtctaatctacccattagcaatcactctctatctctctcctcctcacatataggcaaccactaatctactttgttttactatagatttggctattctagacattttgtacaaatggagtcatacaatatgtcatcatttgagactggctatttgcatttagaatgatgtttcatagttcatgcatattatagaaggtacaacacttcattcctttttattgctgagtaaccttccattgcatggctaaactacattttattgatttattcaccaatttatggacattttgaaatttttcacttttatgtggttatgagtaatgctgatataaacatgtacaagatattttctggatttttgtggttttcatttcttttgggtatgtaattagaagttgaattactggatcatattataaatctatgtttaaattgtttgaaaactgtcaaactattttccaaattggttgtaatagttcacattccactagcaatggatgattgttccaatgtagtcacattatcaccaccacttgttatattctgtcttctgatttttactatctaattttatatgtagtagcattgtattgtggttttaatttttattccatgaatgactaatgataatgtgcatcttctcatgtgcttgctggcctttggcatattttctttggagaaatattggaataaaattatttgtccatttttaaaatcagcctgtgtttttatcattgagtcattagtttcctttatatagtctagatctaagccccttataagacatatgacttgaaaatatcccaaatattggtggtcattttacttttttgatattacttacagcacaaaaattttaattttgatgtaatctaatttatctattttttaattttactcttatcattttgatatgacgtagtagcactgggacttctaaaagtatccacattcaaatcaagtgatagaatcaccaaggtagacacagggcccagcatcaatggtaattgtgtcttcatcagactcgttccttggtaaaatgactgtaattctgtcaaatcacatctgagggatttttttttttaacaagttgactggtatttttgttaactcaacaataatatatgaagttattttctgctgaatttcggaggctatttctgctgcatatattattatgtaaactgcctgctacagctaccaagataataaataattagtcaaatttatccgacataatcttttgaaagactatttggaagtaaaagagtttcaatgttggtgaattgttttacaagctctaaatattttttgataataatttttaaatttcttttcatttaaggaaatacttttcaccctattgtgtatatcctggtagaagttaagttctatttacttttatttctgaacataggaaagaagtataattaaaaactaggccaattcaatggtgttttttggaaagtaaactttgaaaatgattggtgtttatttattataatgaatttttcctaaaatttctggttcttagttctagtcaatatttcaactttaccacagacttaatgagctatttgttattttcaacaaaagatattttcctcacaaagcacaatatttgtaaagtcactttcaaagactttaaaaaataatttgaaaaaaagtataaagtagttctacaaaaattaatagaacaaatagttttattctaaactatatagttaagttcatatcagattaacaaattaagactctgagaaagaatataaataagctcatcactccagttctgtaactgctgacatttgttaaaaagtaaatctcagattgactttttaagttatcaactgcttcttgtttcctcaaaggcattttgtacttgaaaatatttgtcatattaacataattcaatctgctagaaatctgaaggaagatacaaagaagaaaagtttacagtaaatctgtctctctctttcatttttaccatgcaaataccatctaaacagttatttcacatttaaagaaaatcataatctataacctttgaaccctcttcatgatggcatattgctcgtagctataactactaattgagaaaatggagcataaaattactaaagaagcatagagaactaatatttaaaatcacaggaaaagttaattaattgagagagcaatcaacagaaatagagagtgctatttagaaaatgattatgtgaactatgatagaggtgaagatgggagaagataaaacacagaatgtcattaatttcattactttttataaagttaggaaaattaaatgccatgactttaatagtattcaaatgaaagaatgacagcttgaatacatttgaaggcattatatttcagaaacattgtttagggccagttgtagcctaatagcgtgtctaggtttctttggtgtaaaaagcgtgtttaaggtaattcctcaaatcttcttcccaacttttacccatcactagcattctctcccttaacaagaattcctagttttgctttgcatctaggtttaatctaggactgttttcttatttgaaatttctcattcatttagaaatgaatgatttctaaataattgccaatttctaaggtaattataaggcacagtaatggaaaatacgcccttcttaataaaagcactgtaaaaattgggatttttttattttttattattttatttttttatattcttaaaattccctattttatttgcagtactttatttatttacttccccgagaaatgagggataaaatatctgtaacagcatatatacgtgtgtgcatgtgtgtgtgtattttatatgtgtatgtgtatatgtgtgtgtatacatatgtgtgtatatatatattttttatccaatacatacatcctggtgtcatcttgtgcctgtgagtagcaaaacataagtgttacaaatgtttatttcctagtactaatctcagtttaatttttgtgtttcatttccccttctttattttgctttatcaatgatacttatttttagttatccgtgtgtgtgtatatatatacacacacacacacacacacatatgtatatcttttgatttgttttgttttgcatgggaggatatttgagtcaaaacacatgtaactcccaatctcttttctaagaaactcactttacttacaatatagcatgaggaagttcaagcttaaggtaattctcaagaacagtgaaagttgtaataaaaggaaaatgggaggaaatatgtgaatttaatgaagataaagcatagactctaggtcagctagtttacaggaggaaccaccaggaaatcattctcttgaactcggaacaaatatcaaacatggatttccaaaactatcccttcaaaagaattacagtttgatacagtaatactgtagaacagtttatgccctagggaactgtggagaacacacatcaatcagccagcaattagtggaatttaacagctggatttggtcagggaaagaagaacctgtgcctcctggggaagaatagaggcttaccaatgtctggggtgaaagaatttagtaaaataagccaggcactcctataaaataaacaagccaacaacaagagcacattgcggaagggacagtggaagtgcccagagtgtcaacaatatattaaatgttcaatttttttgctgtgaattatgaggcatgcaaagaaacaagaaagtgtgaaccatattcttggaataaaatttgttaattatgtccagaagtaatttttaaagtactttctgttttgctggcacaaattcaccattcctatgacaattctgattcactgtattaggtttatattgattgatattacattaacctttgaagctaactgctaacaactaccttcaccaggtctaaacaagaataataattgacttcaggtataagtctcattttctgaaattaattgctttcatttatggtcttcggaacttataaagttacttaattcatgctaacaatatcaaatttatctagaaaaaaatttaggaaatcttatcacaagattttttaaaaattatgtacatgtataccttacaaaagaaaataatatgtattatatgatggcttacatctttgagaaacgacttctgaggcagagatttacataaacattagggagtacactcaagaacagcctctgtctgtgagtgagtgaaataggattgtgtagaggctggtgtttaactttaatgcagttgccttatctgacctatataatacacagcatatgctgtaatcaaaacaaaaaattaaatatatataatatttaaatactataaaacagaaagccaatagttaataataagatgctatgaatacatctttctctttatttactcattactgataattaaaagtatttaccttctcaaaaatgaaaaagaaaacaaaaaaaatcaacttagggaaagaaaatatgtgtatagcgttcaattgatcattcaacatatatattttgtctactgaatgtgagtcaaatattatacatgagactgagaataagtcagaattattcatgaataacctggagccatcatagaagcagacataaagccaatattaatacaaaaataactatttttaatgttacccattattctgaaggaaagctagagggtattataaaagtatgtgttaggttatcaaagctccttggtgtggggattagggagtgtttccatcaagaaaggccctgaagtatgagtttgagttgatatcagatatcaaaggctaatcaaaatctcaagactaaaagtaatatggggaaggtagttcaaagaaaatagctaaacttatttaggttattggatatatatacctaaagactttattatatagtaataaaaccatattatatagttttgttttattagcctacatatgtagacacaggctgaaccaataagtttacatttaaatgaattataatcaaagaatatatcaattgccaatatgtactcaaaagatgttgaatgtctaaaagatttattattcagaaaaaacacagttaaagtccaacatgtttgctaatatgagaaataaaacagaatttctaacattatcactcttatgtaagtttattataaaaattataaccaatgaaataatgaagattataatttaatgacaacaataactttcctaacagaagcaataaaatttccttcataatcagattttatatttaaccacttaaaacaaaaagaagaaacaactcaacattattaagcttataaagtattcaataatggtaagtaagtatgcaaaaatccattactttttaaatacaatatattgttagaagaatgccatacatacccgctatgaggatttgctacaaatgagaattaatttgaaatacatttttaggggttatttagaatgttgaaaacgtctaaataatcccttaaagcagtaaagaaaaagataatattacagattaggaagtctagaaatagtcatttataaattttctctaaataaatatgagtgccctagccatatagtttttttttttttctggcaatgcagagtagtctgatctacacattaggactgttaactagtactcctatcataaataactaggatactagaaaaattagacaaaatgacaatttcaaatagtgacaacaggtgataagaactgagagaacaggcacaaatgaggtgaggggcataattgtaccacctttataattcatgaatttcctgaataccagcttaggaagagggacccaagaaggtagttgtactctcacttagttggaaagacagagatctacatttagagatgcttagtttccttgtgtatggggggcggaaatgccggatgggaagagatgaaacagatacatagttctagaaatctgcatagagatctccttgggtcttttgttgaatagcaagttgtgtatgctgaaactgagtgtgatggttactgttgagtgtcatcttgattgggttgaaagatgcaaagtattgttcctgggtgtgtctgtgagggtgttgccaaaggaggttaacatttgagttagtggactgggagaggcagacccacccttcatctgggtgggcacaatctaatcagctgccaattttgctagaaaaaagcagacttgctgagtcttccagccttcagatctttttcccttgctggatgccttctgccttcgaacatcagactccaagttcttcagcttttggacttttggacttacaccagtgatttgccaggggctctcgggctttcagccacagactgaagtctgcattgtcggcttacctacttttaaggttttgggactcgaactggcttccttgatcctcagtttgcagaggcctattgtgggacttcaccctgtggtcctgtgaatgatactccttaaaaaactcccctttatttatacatatatgctattagttctgtctctctgaagaaccctgagtaatacactgggtctctgttaaaagggcaataaacaacttctattaaaagaaaatgtactatagagctatatgctaagcaatgagcagcacaggacatgttcaagtcccaaacaaccagagtggacacatgtcattaaaaacacagggcattctagagaggaaggccagaaaggcctcacattacaagttggagtccactatctctagagaacgctactaacaaaacttaaatgaagtttaaaaataaactacaacagtacagacgaatgtacacataaattaactacatgcttataaaatgtccacattatttgaaagaaatagtgcaaaagttggacaaagttaatgtttgcaatgcactatatccaggagagatttctagatgagtgaagaaccaggaaaatgggatctataaccaataggacatttagtcattagaaatagacccagaaatgacataaatgatggaattagcaagtaacaactttaagatatcaatttgatagaggggatgacagatgaataatcagacaggctgatggatggaagttctgggatttaaaataaaatataaacagaagaagagaaatagaaattacacagcagaacccagtaaaaattccaagacagaagaataaaatgtctggaaaaaattaactggatggacttaacaaaatatgtgacagtgcagagaaaagttaagtgaacttaaagaaaaatcatagaaaccatccaattgaaggacagagagaaaaaaaattgaaaataaattgaacatagcgtcagagaacaaatgagataatattaagcattgtaatctatctgtagttgcactcccagaaataaatggaaaatttggatttagaaaaatatttaaagatacattgccactttttggaaaatttaatggaaattataaacacagcaatcaataaagcaaaagaaaaatctgcaaattcattcacatacacacacacatccctcaaagtggcaaatttctgtaaacaagtgatgcagaaaaaattaataaaagctgccagaagaaaaaaacttcagaccaggcgcagtggctcacgcctgtaaccccagctctttgggatgccaaggctggtggatcaggaagtcaggagactgagaccaccctggtcaacatggtgaaacctgtctctactaaaaatacaaaaattagctgggtgtggtggcacgtgcctgtaatccagctgctggggaggctgaggcaggagaattgctttaacccaggaggcagagatgacagtgagccaagatcacagcactgcactcctgcctggcacagagcgagactcagtctcaaaaaaaaaaaaaaaaaagaaaaaagaaaaaaaaaaaacttcaaatgcattcaatggaactaagataaacacaattacagatgtctccttcgaaataatataagatataacaaagtgaaaggatatttgaaaatctataattaaaaacctcgaatctaaaattctatacccaacgaatatgacaaagtagtgtcacacatgtaggagcttaaagaaattgttaacaacagacctaaataataagaaattttaaaggaaacattgagagtaaaggaaaactagtctcaatagaaagtcagatttgtaaaatgaaattaagaatatcagaaacactcaatgtgtactaaagataaaaaacagttcttttcccctaaattttgtctgctttaaaatataacacagtttaaagttaaataatagcacagacgtgtaagtttagaatatatgtagaatttaattgtataaccataatgacaaagatgaggtgttacaaaatggaatgtactgtttgtttatgttttatttaaggtggtatatttttaaaataatttccaggattaaaataattaaaaccattattaagcaatcatgacaaaaattttctaatactagatataaaaattcaacatgaggctattacaaggcttttttcccaaacaaatataaatatacgtatcaatgaaagagaatgtgacataaaatattcagaaatacgttaaaagatggaatcttaaattagtgaaacagtcactaattcactgtacaataaaatatatatgagaggatttttacagaaatatgatatcgtaggcaaacatccaaggagcacaaacataaaagctagcattggtttacttgaatgtagattattcctcctgcttgagtatgaactgctttcattacataaataaaaagcacacaatgtctcattttctatcttctgttaaaagaaaacatttttccttctccatccagcatcaataataataatccatcaaaatccttttgttgctttactctgtatcgatatattataaaatattgctcaagaattattaatctttgaacaactttaaaaggcttatgtattttgttaaattaaactctttactatctagattaatttatccctatcaatatatattcttgaaattttttttgctttctcaaagatctaatgctattaaactgctaactattggggaaagctttagaaaaacatcttaattaagttaatgcaaaattatattaactataacatcttaaatgtaataaatataaaattaaatgcaaaataaattgaagacaaagtttaaaacagatgctaaatattgtagtaatgtacatcatatattttgcatgtaaagagaaataaaatttaaataatccaaataaaaatactatttttaaaaattatgtattagaagcaaacagaaaacaaaagccaaaaaagtgccaaaggtgtacatatattactttggtcatgtattctgtgtatatgaaaatgcaaatattattttattttattaacagtgttttatatttttatactgttctttagttcaccttattgaacattaaaaggatataataaaattaaaatcatattaaaaactagtgaaatgtttgtaacatatcttattaaaaaatacactcaatagaaaaatgccaaatgataaacttggttatatttacatgaaaaatatattcaacttcactagaaattaaatgaatgcaatattaaacagaaatttggtgcactttaatggttcaatagagattatttagttaaaatgctgatgtttaagaattcagtcataagatttataattcacacacagattttacagattttaattggccctctggtaacaggtatcaagagccttatatgtgtttatacctcttacgtgggagtaagggtgaagaactgaattatagtgatattacatatcagtttgtttaatgacactgaaaaatgatgatgctatgtatatgtaaaatggtaaagcaaaattacataaaattcaaactttttgcttaagccacaaaatgctattattcctattttttttcaatttactctctacccagactcagccaattttcatcaaagaactatggatcttcagctgactgtgttgcaccttcacccaataatctcatcccacgtctcaggaaatagtggcgttaaagtttcgtgagggttgattacctagacagttcacaaaacaattttcatcagctgaatagatctatggaggttttttctgggcacagagtttgttgtgcataatgctcttctgctggaatataaagtaaaatgtttccttgttcattggcaaagacaaagtaacaaaattctgtcagtatttggaattgtgttatataataatagcataggcatgtttaaactagacaacatataatattaaaaacaacaagcaatattttttgaattcttaatttgtttcaaacttggtgtttagcactgtttaaattattagtacatcacatttattccttataaacctaaagacataaataaaaactaatttgaaatgtacagtgatagtttacagattatttatgctctttctaagtttccctgtaaatgctaaaaattaacgaaaggcctttctgacaatacagtaccatttaaaaacttaatttcataatgtttgcacaattaataagatgtttattattaatgtgtttacttgtcactatctggtatgttttgtgggtcaatccagagtaaatctgattagaaaaatgttcacttaaactagcatacattccaaatgtgtgttttagatgttattcttaaaatagtctataaatagaatatatgttgtcataatttattgcatgctattaaacacatattgtatttaaatgaaaaaatgcatttcaatgccatattacctgctgactccttttatgtagtgtgctattttattgcatcacttacataagataattgaaatgatcagtgatgtaggtgagtggttaataatgctggctcttgagtcagaaattgttagtagactcctggattcatcaacaattaaatgtgaggcactgaaaaagctactttaccttccttgccttagttttctcaatgataaaataggatattattttcttaatcatagaatggtttccaatatgtaagagtacttgcacgacacctcctaggcatataaaaatatatcaagaaataatcaaacattgcatctgagaaaatatttatttttcattttttgacacttaagaacatgattatatatgtattactttaagtaaacaaaagctattttccctagttttaatgctctttaatttccttttctattcctaaaatgctaccatattttatttctccagataacctctcctctaaacaaaagtcctgaataatcaaattgagccagtataagcatttggattatgtatgtataacaaagcagaaaaaatctgaaattgaaattattatatcatacatcacatgatattgtggaaagacattctaggtttatataatacaaatttagagtctccatgaagcattctttaatttacctaaaattattacagaagtatttcatccaaaaaatgttctggggataaaaataaaaagtctgacattgagcttatgccttaatatgttattcttttattgaattagaaatcaagaagataacatgtcatacttcaatatagtggtaaaaattaaacaatagaatatttaaaatactcactttccactttaatccttctaaaacattctgtatggtgggtttctattcagtatactttgagacataaccctacttatcttcacaaattgttttacatgtattgattgttggaatgttcattctttagaagttagttttgtaataacatgtttccaatattaatttatgtggaaagtgcaaattactaatttgttggtgtttattaccagggggaagacaatttttccatggatggaagtgcgtgggggaaatgaatctgttccacttaagatcattgggcattagattcttgtaaggagcatgcaacctaggtccctcacatgcacagttcacaataggtttcacactcctatagaatttattgcagctgctgatctgtccggctcaggtggtaatattcaattgacagtggctcgcctcctgctgtgtggcccagttcttaacaggccagtggcttgggggttggggacccctgatacagggtgcatttgacttctgcttaagagggcagagaataagcagaataactactgatcaagtttacagctagaatactcatgcacatcatatgattttaattaaccatatgcataattatctgttttatcatatttaactttttcgttttcaggttttacttcctcctactctcttgttctgtctgaaacagagtaattacatgataaaagattcaaaataatgaatgaatcatagaaactataacaggtaatgaatgttgagacaagaagttaccaggttcgtctttgttgtggggaaagatgcagttcatttatgctgtagtacatttgtgtctgaactcagaatcagagttcctagaagactgttctactttacaacctgcaagaactttgtgttttcagaattttaagccttagggcagacttactctttctggtagtggtttgagatcaattgcctgttgcaatgttcttcatcttaggtttgccttccctgaagttttgtggaagggtagaaacctgagagagtgcttgctgggatttgaagtgtttacttttatacctggcatttattttgaagtttgggcattctctgtcttcagtttatgccaaaggcatgatttccatccaggtattttttttttcttacagctttcattgttttgtgagataagattgaaaaatttgaaccttgtaatctgccattgtctttagttaaccagtgtccccacatgtcaccctgaaatgaaaaccttgaaattataagaaaaacaaggatttaacaaatggaaatcctggattttcttgaatattacaacaaaactagattttaaaaagtagtctgagaagctgagaatgttcatgagcttacgtctgcctcatgttatgcagtgaatgaatatgagaatgtttattatagtcttagaagagtattcttaaaactgcataaatgtaagatgtaggacttgaaataattttgaaagccgctcacaattttttttgtgttaatgaagtcaaacatgttttctcattccccagaattccacctgtcatagctaacataagtacaagttaattaataaaatcacgctgttttttttttttggaatagaagcactattcctaatattgacttatgcatgataattttatgatttaaatttcaagtaaaatattatagtatatttttatgaaataatcattatgttaacataaaatatttataccttttgtatatacttattttttgacaaataataattgtgtatatttatggagtacaatgtaaaattagttggtgaggtgaaggatattttaattagcttgattgaatctttctacaaatgtatacataaaacaaaatgtcatactgaagctcaatataaaatatttttaatgtgctttgtgaattaataccttcttttggatgttatctctcactgatggtggtggcagcctgtctggagcagccactacggggatgccagcagcagcaggagaggcacagctgggactgcatgctctgcggaccaaatgggggccagaaacaaggtggagccccacccctaatgacctggtagggtgggagccccgcactcccagtcacagctgcagccacccagcagcagctctggaccagggcatcctggcactcttgggggcccaggaagctccctgcccccacaggcttagaagtgcctgctccctctccctggcctctccccactccttgtgcccactccagtgtggagcaaagttgtggccaagtcccggtgctctcgtgtgctggccagatgtgcacacactcagggtggtgctgacatgccagtctgctgccatctcagccccctccagaatttgagcatcaacaaacacaggagggaggccagggggctgaaggcagctcagcaaagatgccccttggcatgaacagcctgggttccatggacggcttctggctagatgcagacaggttcctaggcaggaagggggaggtccccagtgaaagcccacattcaggccagggacagcctgaagcctgagggccgggctgcctgttacaggtgaagtatgtggcctgcagtgagatcttcattgataatcatttggctgatctgatggtgctttctccagggctgcctgtgaccacccaaggactaacagcatgcactttctccattctgagaatgtaaaaaccccagactcagccagactccccaacactccttgggatgacctgcctgtggaaaggagctacccactaggggtctcctctgctctaagagctgaacactcattgatgtgacctgcctacaggtttaaaaatattaaactatggtttaaaaatattaagctataattccctaacagagattcacagagaaatcgataatcttcactattaaattacacacttctatgtaattcatgaatcaaagaaaatgttttaataaaaactaaaaaaaattttaaacaaaatagaaagaaaatacaacgtatcaaaatacaatggattcagctaatacagtgcatgcaggaaaacttatagcattaaatgcttatattagaaaaacagagaggtttcaaatcaacaatggaaacttccacttttgaaaattagaaaaagcatggaaaaatcaagttaaagcaagcagaaagcaggaaacaataaatatataaataaaaatcaaaaaaataaaaattaagaacatatagaaaaacactgtctattttcacagacgataggattctccatacagaaatgcaaggaatctataaaaacaaacaaataaacaaaaaacacttaaaaatagaaaatgatttttgcaaggtcctaggatacaaagtcaatcacatttttatgtagtggaaaagagtaagtggagagtaaaaataaaagtttataataactcagaaattattgggtataagtctgataaaatatgtgcagttgtgtgtaaaactacaaaactcgaatgatagaaaaaaatgtcttacataaatggggagatataaaatgaccagaattagcagactgaacataaagatgcgaattctatccaaattgacctatgagtttactgatttcaataaaactttaacaaatttgtaaaatttatgttagactgattctaagtttctaacttttatatatgtgtaaagcatataaggagagaaaaaaaaactagactacataaagcaattttgattaaaaaggcttaaagtgggaagatttactttaatgttaagacttgacttaaagttacagaaattgaaacaatgcagtattagtgaattgggtagaaacatagatcaacagagtagcatgtgaaacccaaagatagattaatgcagtcatggccaaatgatgatcaaaacagttctcaaacaatttaatgaagaaagaatagtcttttcaagaggttttctggaacaattatacacccatgtatccaaaactaacaaaacaaaaaaaattaaatacctcaaattcaaactttatataaaagaagcaaatcctgattacaacatatataaatgcaaagcctaacatatgaaacgtgcaggagaaaatcttagcgacctaggtttagacaaagaattcttagaagaagtgtgatttgtaaaataaaaaaatcaaattattaaaatttttgtttccacaaaagatggttaagagaatgtaaaagataactaacaattgaatatattaataactacaacttataaagaatgtaaatacacattcatacatacacagatatatgtaaagaaccctaagcagtaagaaaagaactgatcttattaaaaatgggaaaactatttgaactagcattccattgaggaggcaacaaagatgacaaatatgcatgtggaaagatgtttgaactgattatcctttagggaaatgtaaattaaaaccatagtgaagtattatgatatatattttagtgtttaaaataaaaatgctgacaatatcaactacaaacaagtttgtggagctgctggaacctgcgtgtattcctggtaaaaatgcaatataatataaccactctggaaaacagtttggaataaaactgatgacacactcactcaccatatgaccaagcggtcttactcatatgtttctgggaaaaaaatattctgttcagacaaaaacctgtgaatgtttgtggcagttctattcagacaatgtgccataattcagcaatcaaaacaagccaacttttgatacatccaaccacttggatgtatttttaaagcattatattgagggaagcgctgggtttcagttacatgaggtatgattccatttacagtaagatctgtaacaggtaaaattacagtgtcagagaacagaccagtggttgacatgagtcatgagtcaagtgtgtgagtgggtttgtatgttgtgagtgtgtgattataaaaagataaaacgaaggagttttgttgttgttgttgttgttgttgttgttgttgtttttgacggactctcactctgtcgcccaggctggagtgcagtggtgccatctcggttcaaggcaagctctgcctcccaggttcatgccattcccctgccttagcctccggagtagctgggactacagacgcccgccaccacaaccggctaattttttgtatttttagtagagacggggtttcaccatgttagccaggatggtctccaaaagtgctgggattacaggcgtaaaacgagggagattttttagattttttattcaattgatgaattgaatactactattaatactactactgtaaatgattggcatgacaaaaaggagcatgcaccccaggtgcaaagaagaaaacatgaaaccaaaaaagtaatttctaatacataaaaaaaaatctatgttttcatttgcctcacttcagtcaccgtatttattttgctgtcatttttactaggaaaaaatcttgtctcagtattctttgacttgacagatgattttaactaagacttagttgagattcattagtatttccaacatgtgtgttctacaaagcaatgtgttaattcaatgtcaatagacatatctttagtacatcttcaaatacatttttcaaagaattagctatcaataaaacaaagaaatggtatgcaatattactttagtgattttcaagtttgcttttttggtttattttatgttcatgtagtgattattaatccacctaattttattgagaaaatttaaaataatcggtattttaaattattattattattaatagtagtattcaattcatcatcatggtatgtattttaacaaagataaaagtgcatagagtggagagtgtgtgtccctttcccacatgtcttaagtctatccaacccacaagtttaccacttctgcagttttaattatttatgaatcctaggtattgggtcatgtatatgtcatacattacataaatgtttcctcagtcaaaataagattataatttctgccttttgtttttagtgattttattattttacatatattttaattcatcccaaatttagtctggcatataattcaaatggtagttctaatttttaaaaaatctctatattgaaatatatcattaatgcaaaaataagacaaaatttttgagtgcagttttcttaattttttacatagttttttcacgcatgtcaaaatatgacatgtcaagaaagggaatatcactgatagccctgaacctctctttgcaacttactccttgaccttcctcctcctcaaacataaccattgtcctgacttatatcattgtaaactaactttggtttattttgaactttatataaattaatatatgtcatatacattaatttatttctatttcattcagaattagatttgtaaaaaatctttagtatatactatttctttacatttctacactaaattatatttagccattttactgctggtgggcatttgagttattttcaacttgtttataactataaataatgaatgaattttttgtttgacatttttatttacttttgtatttttggccattgtgatgtgtttgcatttctccttggtatattcctcagagtagaactgctttggtgtaagttatggtatatattaatttaacctttagtacatgctacgaaatactctctcaaagtgtttatatctctacgtatatcactttatgtccctaaaggcagtatataataattcatgttgatctatattctcaacacttgatattgtcagtttttaagtttagctatttggatgtatggattgggcaacatttgacaaatactttaaggactgattagattaattaacttttatatgtttgttggtcacttggctattctccattaatgaagacctgttcaagtatttgcccttttttttttaatagatttttctccttttttatcttcttgatttgtgggatgttttacatagtttaaatgtgagttttttgtttttttttttttttttttttttttggttaaaggtatacaaatatctcccagcctgtgacatgcttcatcattttttaaagaaatatttgtgagaatttatggtcacgaatttaatatcaacactgtcctataaggtcagtagtagtagtttccaattaagagagagttgttctcattaaatgtatatcatggcatgtttatatctcctgtctcctagaaatgtattgtttttcctttaacatttaaaactatattccacatggaatatttttgtatgatttaatggggtccaattttttgcttttcttttctcacttctttttcctcacattctatcatttctcacactctcttcttcttctttatctctcaccctaaccctctctcttacctatgtgcatttaattgacttggcagcatttattttattttaatttttaatttttacaggtacatagtaggtgtatatatttatcgattgcatgagatattttgatacagaaatatgtgaaataatcacattggagtaaatggtatatccatcacctcaagcattcataatttctttgagttataaacattcttttaattccaaagttattccaaaatgtgcgacaaattattgatgatgatagtcaccctgttgtgatatcaaatattagatcttattctttaatttaaaatagttgtctttccttcacagccctagagtatcaactttgatgttcattaaaagtttaatacagttaaatctttacctggactctttattctctaattaatttgctacatttattgatttggttatttttatgccaatatgtgtttttaatttctggtgcattctgataagtattgatatttggtaatgtgatttcttaattaaatttgcattctaccaatgcaatcaatgtagtcttttattttcatttaatttttttgaaatttttttcaataatatgatatttagcagatttgtacttctttatttagcttcattcccatgtatataatattttttggagctagtatgaataacacctgttgaaaaattttgttttctaaatattttttgctgatatagagaattaaaattaatttatatatattaaacttatacaagcagaagttttaatggtaaatttcactcattaattgctaacctcacttattaaatgaatttatttttgtatctattattttacattttctaagtgcataatcttatgagcataatgctgttttatttctttctctctaatcttaatactttaattagctttaaatgccttattacattgttgaatagaaattctttgaaggggcatgatcacttcaatttcagtttcagagaagtcagtcaatatttgaacattaagtagggtattagtctttttaaaaagctattatttatttcattaagacaatttctagtttactaagcgttgatagatccaactttatcttccttttactgataagagctgttatttttatgacctaataaatcctcttttatatttgatccttgcccatttggtttttaatttctttactttaaaattttataaatttataatagtttacatacttatgagatacgtatgatattttgatacaagtatgcttgcttttccattttctagtcttaatgtttgtcttttcaaaatcattatgtcactgtgtttgttactgtatctcataaatgctaaaataggtagccacccctctatgttattttcagaatgtttctgtgttttcccatttatttaattttttaaataaattttaactcttgtttgatttcaaacaaattattgttatttgatatactcataagtaatttttaaagtatgattaatatttaatttttatttcagggcttttttttccagtttcattatcagtgttgactaatttacaaaaattatggtagatttctttttttcatgctctcaaaataatattctatactttaacttttttctctaatttttaattataatttatctattaaatgttttttaaataagagttttctgtaggtatatgaattcttttaaaaaccaatttattattaataataattagttttctcatattttctatgttttgtaaaaaaactttggtagtttttttttcatagaatactaacttcatccaattccacagaattaaaaaaaaaattgttacattctgctttgaactttatttataatttcatcagcttatgtgttgcctttggttattacatttttctattttataaaataacagaagtttttatatttaaattttatatttcatttttgactatgttagctaatggtctaattgtgtagttttaaaaatgtgtttattaaagaaccagcaaatacatgtatttataacgtatttcttagttctatggattaacttgctttctatttcatcaatttttaatttaatatttactaacttttcatctttctttttttcaggcttcctttgatatattttatatatactttctttctgaaactcttacaatgtatgcttaatcatttacttaattaccccacatcttaaaatacatcttcaagagtacaaattttttgctgattaatgtttcctagttatctcattagttttgatgatgtttttcaattcactctgttctttttcaaaactaataatttaatatcagttggtacttttctctttgacccaagagttaaggttttgcttttctcttttcctaattgatagagtatatttgtttattgattttgttttcttgttttttgcatttattttaaatggttagtactctttctataattcagaaatttttaattagtttcttagggcctttcataactctgctatcagattatctttatatgccacttggttgaatggacaatgataatttcaccttgtatggaagtcaagcacgctcaagactgtgaataatgcactttcagcaatcctgcacttgggtagactgttatgtgatgattttcaccatggtcatactagtgaatataaatcaaactgaatttactgaatgttgagatacttaggagattcagctttagacttggatattaagcataagggaaataaaagcatctcaattttgggatttggaattatataatagatgatgatgccttctattgctatgaggctggatatgacccccgttcttataataggggaagctttgagaaaattaaacaagaattttagtttttaacatgctaacttgaaaaagcttttcaaaatataggaaagaaacttgatttggaggtgtaacttagaagagttcaatgtctgaatggcatttaaaggcgtggactagaatagattaccagattatcattataggtagatgagagaagttagccttgtacacaaccctattctctcaaaataaagtctccagttggagcaatggctttcaaagaacatgtgtatgaatggctggtgggctgaatgagaaatgattagaatataatgtaaagaaagtcaataaaatgaaatatctagagaaggcaagcctttacatgtttgttcagagggtgaataagatgaaactaggtaaatggtttctcaacacagcaattagtggctttagtaagtcatttttgagacacttcacctgatttaagtgggatgaaaaagatatgatgtacacaagtataaacagaaaacaattgtaagaaactcaggagaaaatatactaatcagctgctacagtgaagtatatgccaaaggaggatatttaataggtagatgagttaatatattatcagagaaattgagtatgtttgtatgctgatgtgaattacctatatatacactaaaatacaattcatcttgtaaaagacaaaggagatggctattagaaaaagcttctttgaagagacaggatatgaaatttacagtagggcaggggttgactttgagaggagccaattcagctcatgtagtacaatcagaagaagaaaagagtagcagcatgtccctgcaaatgtttgttcaattggaggcataaatatgttgttctgcttctcttttctcgatgaagaataagccaaaatagtatgttgaaaggaagggagaggaatagcacatggacagtttcactaacgaagtgatagttgtgaaattgacatttcatgaaatggcaaagcagaaatataactaaatgcggtaatataggtggcaatattgggtgttcattgagatttgtggtaacaaatttaaagtaatacaagtcagcagatttgtgttacttttttttcaacaatattttgttgctcaattatcccagggaacaattgttttcaagtagggctgaatttgtcccaaggaagataatcaaatgagagagaggctaaaccattaagagtgttccgaggagtgactttaatagttaggataactaaacttttcttctttcttgagttctgagcaagtgaatagaacaacagaattaataaactgaagataaaactgttagctttatttctggggaaagtggcatggaggatatggtttccataggtgaggcacagcatgctttctaataattcctgccttactgctcagtttagattataaaacagtgcaacaggatgaaaccttaagtatgcacagtacactcgcttactgagattattactttgcacaaacctaaagtttatggcaagtgtgtcaagaaagtagggaagcattagaaagaaatctacccttccatgctcaggaattttgatagaaaatataaaaacccatccagaaatcagtaagtggctgccacctacttctcacgtaaaacactctatctctgtggagtgataaatgggatgattcaaaagaccaggactatttaaggggaggaaaatcatctacattaaaataagaaaaatagaaaaaaaatgttccccacgttcccaaataattatataacggaatttaatcaagttgtgttacaagtcagatttagtatccagaaatattttttttttcttttgcaaggtgctgcaatcaagagaaagagacagagccacactgacaagaccacgttctagagagaaggaaatatgagaggctcaagggcagggctgtgaggacaagcaggggagatgagatgaggtagcatgaatctcttcttttttgtactttatgtaaaaatttatttgaccaaaatgtttaaaaagtgatactattacatatgatactacccaggaggtagcatgaatcttaacagcaacaggaggtcacctctgctcacaggtagcaatgtgactcgaaccacagacatggagagagctgcctccatcctctaatgaaatgaagagaaaaattcagtctgttattgtacttcaaattagacaggaatgggaattttagatgaatgccattcattttcaagtgttagaaatcatattatcataaggaggaatcaggataaatcaagtatatttatcttcacataatttcctgattgctcctcattacatggagaagatctggacttcgttaaattcattatttcaaatttcctgggaaatcaagagttgttgaggtgaaaaaagaattgtatgctaaattttaaaattcatattgaaatgatataaatattaataaataattagaatatctagaatgctactttatttttaacttttatattttattaactaacattgttttacattataaattcttttctatgttaatgatttaagaattaataaataatttgtatttgacatttaattaaatttgatatcaaaaatcaatttaccataccttggaagagccaagagttactgacagaaacacattctctgtcagacttttctccattaaaaataatgaggtataatcaatattttttacatctgtgatttgaagttgaaactcggaaagaacatttggacatatatcctgattatacaaggttatagataaagtctcacagagagagttttcatttccttttatccatgcccttgagttcagtaaattaaatagacaaatataggaaacatttttcaacaaatgagaatctatttaatatgactgagaaacaatgcaacttaaagaaatttttaaaacaaatgcttagacaatgtaatgttcttctacagatttcattctgacagagttgtgtttctatattttaaaaaatatgcaatgatattagctattgatatttcaaagcattgtatcctatactattgacttgtaaataatatgcctagttgcaatgtatggtgaatgagtattcattggaattattaattcacaaaaaagctgtaacattttcatgtagttgaggaaaacatacagttggtcaaaggataaaagccaggcatagacaataatttaatactcacattataaatttacttttcaaatggtaataataaattttaaaaattggaatgtaaaaggtttctctacacaatatagtagctatagaattctgagattacttatatatatgaacaagaagggataaaaactttgtactagctctaataatggataaattattgatttgcaggttaaaaacagcaaatatttgaaataaaataatgcattcaattttcagaaacttaatgctaaaaagaaattgtttttatgattcttatatttatttaattttaacattgttttaaaaaatctttcaatatccctaataacagatgcttacagtgaatgtgataagaaactttttataacagattaattggctgattttacttcttcaagtctgtaagatgatggtaactttaaaaatcaatggcatcttaagtttatgagggaaacatattttacaataaaattagaataaaaagtaaaatttacccccatcgcctaagccaacactgaatcttcctaaaatattgttttgaatatttttgaaaagtcttttatatgcttaattttctagtctttttgttcaatttgttgctccaaataattgatttagaatcaactgagagtcattttgttaatttgactcctatttaggcatcttaccaacacatacaaatttagttaacttcattcttcaaaacacaaattgatagacatgagattatcctttccccttcctccctttctcctttcttttctgtcagatggcctttgttgccctaaccgaaggctgctgtgtgggaagcttccaaagcactctgtgtggaatccatctgtctttttgtacttggaggctttgtttacatttataccttgtttgtacaccactttaataacgtggctaatcatttacacaagtgctctgagactttattctttgatctggataggatttcccttcagcgtgggataagtacgtacccataatgtcattacagatagcagtgggctgtctgtggctttgtgttgaatatctgggatgttttaaagaatgcctcttccaagcttattccttcaaattgccctaagctcagagtgcttcttggataaattctattataatttgaataaatatataacttagtggctatttaaatgctccccagcatagacagtgaagaaatctacagtagtatgaatccaaaacaagactaaattcaacatgttaagaaaaacatttaccataaataaatctactttaacctaaacaatacaactaacaaaatatatcttaagtttctgaaataagcattatgcttctgaagtttttgtgaaaaaataaacataagagaatagctggaaaataatagttttgaaaataaatggtaatacgaagacctaactttactggaaattgaaataccttctactgacaggatgcttaagctaatgcttctaaagccataaatacttataacaataaggcagagcttaaaatacagaatacccatgggaacctaaactacactaaatgtttcatttcaaaataacatgggagaattgatgattcagaaaagtgttttacaagtcatcctttagaaaaataaataagactagatatctattcattatttcaataacttcttcatgaatcaatgacataaaattaatgatacatttaaaatataaaaatatacaggaactcatattaataatattgtaatggaagaagatattttaataataatgaaatccgaggagctgcaatggaaggactatgatattggacagataaaatttattaacatatctgtagggcaaaaaaaaagaagaaaacccctaaacaaagtaaattaaccatataaatataaaacaataagtatgttttaaaaacacactataaaacaataaatatatagtgtatatataatatacactaccatgtatatgtatatatatgtatatataatttaggtaaaaacttgctaatagcacacatggctattacagttacaaatttcagaatacttaacagtaaatttactttaatataattttttattttgaatacacagagtaatatttatagaaatgtatacaagtattgtgtatccacatattcacatataaatatgcatatatgctcaaacacggtgagtgagttggaaatacacctcactccttttctgaggcaagtgcaatttgcattgcattctctgccactgtggaggtgggatggctatgtgatttgctttggccaatgaagtttgagtagttgtggggatatctttggaacagatttctagaagagcagttttggcatcaaaaataatatgtgctttaaatttccaggtatagtttcaaattgtactataaaaaggttgtgtagacttacgctctgatcatccttgcttcttaggagttctttaaagcagaaacatttaagatttattatttaactcgagaaattttctttcttttgtaaaagtggttgaccttattccagataataaatgtttcgtcttgggttccaaggagctggctgcatccaaactgcaatgaacctataccataggtaagaaataactttatatatatatatatacattatatatatacatatatatacacattatatacatatatataatgtgtgtgtgtatatatatatatatatatatataaacatatagcaatgagatactgagcatgtttgcactgcagcataacctgatatggtttgactgatactctggctaaatgataagtcctatgttaaaccatgctttcctttttttatttatgaagttttgggaaagtacctaaatctccctaaccctcagctttcttatattgaaagtgttaaatccaagtacttatatcacacagttaataaatcataaagaaaagttatgttttcctattaacttttaataagagaaaattaaaagttgaatgtatttctgattcatcacaaaattaaaaatacttcctccatgttttctcaacattttggaaaactttcttttttttttttttttttcttttcagtaatgattcacagttcccatagatgtgaataggaaatctaactaagattatctattatgtcttgggattcttgaataatttattttaacctttgtagtagagggtaataatattgcttaatactttatttgtgaatctaaatattaataatatgaagacagtgcaaaaagattgtcattcatattgagaaatattttcacaggtatttcttaaggtttatcaatggaactgaagaaacatctaactcctacataggtttagactacaaaactgatgttttggtttaaaatgtagaaacaactagaggtgatttagaattagtcaattgaaactagccaaaatatttttatttttgttattgaaaaattgtgtttgcttaagttagatacattcaaatcaaaggctgctcctctgcttcattttaatgtggtacccttaactgcatgtattcagtagagacttggctctgatgcaatccaaggtctatgaagggatgtagtggatgggactaggtgaaacaaaatcacttcaaattttgagcattatctagttgtgacaaatctatgtagcttgcttcatgagatgatgcagcaggaattatttggtcaaagaaagtatattaatatcatatctacatttaacatcagtctactgaagaaggactgatgtgttgccttagaataacaatcactgtcttgctagtagaagtcaatacagctcaggcattaaaactattcaaaatagagcatggaatagtgtgaaaagtactacataattcaattataaaattttttaaaaatgaaacagaatgttgggtctgtagatatttaacctgatatacattttgagttagtaatattattattcgtatcattagtaatatagagtaaatatatacttaaaaatttactgctttctaagatataggccttcctacacacattttgaaattatttcccaatacagttacttaaagaatgctgttcatatacactaaagttgaaatctatgctaatatatattttaggacatagaggttcatacaaaaatttttggttttctggtccatattttcccaaagcttaactttaggttatatgctctttaatggtaaaatgatttataagtatataccttaaaaatagatgtcaaagatgctaactgaataagtgtgtttaaaagtcctaaaaacatatttaatccaggttaatctttaccaaagctagattaactgtcttatatataaattcattcatgaatttgacttcatgtttaatgaaaaatattgcttgaaacatttgacagacttcctgtagaatgactaaaagaatagacaatatgcgatatatcatatagtttattcgtcaaggagcattttattgcatttcttgactaataacaacattcacgagaaagactagcccccagcatcatactacatcattggtgacaactaaagaataaaacaaactcatgaatatttaatgtttaataacaacatacaaaattagaaaccataataacaagagaagattaggtatttgaattatcttgttactaatcatgtagcatacataataatactaaaaatgtattaaagcaagattttgtaggtgacaataatttaataaaaaatttaaaaataagacaattcaataaacaatgtatagcagcagtattatcttcaaatgacagaaagtaattattatattatttacttcttggagcaggattagtgctataaatgaatgcaaacattaaaattggtctcagatgacctaactactaatacaaaatacaaaggctaattaagtccatttcattaagcgtgaaatgaaggttaaactcctctctcaaaatgaaaagtgtcactattttaaaatcaaaatcctacattgtagagccaacctttgactaaaaagtaattacactatatgtgagcacttgtaggcacagacttttttattttttaattacaaaattttactgagctttattgataaacttttttatttgtatttttattttttttgagacagactcttgctcagtcacctaggctagagtgcagtggcacaatcttggctcactgcaacctccacctcccaggttcaagggattctcttgcctcagactcccaagtagctgagattacaagcgtgcaccaccacacctggctatttttttgtatttttagtagagacagtgttttcccatgttggtcaagttggtcttgaactcctgacctcaaattatccacccgcctcggcctctcaaattgctgggataataggcataagccactgcaccttgcttattgataaatttttaactaaaagttatatgtacttgatagaataaaatcactttcaccaacagtataaggaattgagcttttgcaaatggcataattttttatgcaattgaaatcttgtttattaagtgtaaatgcttgctagattaatcacgatatcaggtttttaataaaatgtcctgaatattttcctgtctcttaaaacacatcttttttaagtaacctaataacgaatcataaacatcctttattgtattagacagtgatgtatgcaaataattattattaaaattagaaaaaatagatcttccacttttgattaggatgtagaagtataaaaagcaagcttgttctcatgtatatatttttaacagatagaataacaccatatatttctcactatgtcataaaaaaagggccaacatcacaaattcttatagagctgatttacacgaagaataagcccctcacagggaagtagaaagctgtttattcaataacaaagacaagtggataatgtatctgttacacagtatttcatgtatttacaattttcaactaggcgaatatttcctagatagggcaaaactattaattataaaggaaattgaatgacaaatttaatcaaaataaaagcaaacatttatctaagacactattaaaaatgaaatgtcaagatacagaccaaaataatatttagaatgtttcagacatatttatccaataaaagacttgtgtcagaatgcataattactcctaaaaatgaaacaaacaattaaaaatgagtaagcatttacgaagacacttttctctctctttctctctcacacacacacacaatatacaatttactgataaatacaaaaaaattaataactttatttttattcaagaaactttacattaaattatcacaaaatatcacttgcctgtaaatatgaaaagataaaagtgtgctaatccaaaatgttgataaaaattcgaacaattggaatggtaacacatttctggtcttattgtaaaatagtaaagccactgttaaaaaatgcctttgatcatttcaatagctgcagaaaaaacaatcattaaaattcagcatttcttctttacaaaaattctcaacaaactggagcacagaaggaaggtatttcaaaatatataaagccatatactacaaacccatagttaacataacactaaatgggaaaaagttaaaatcattttccctaagaactggaccaagacaagaatgcccactttcaccattcctatttaacatattactggaagtcctagccagaggtgtcatgcaagagaaaaaaataaaaggcatccaaatagtaaaagaggaagtcaaatttctcttttgctgatgtaatcttacacttagaaaactctaaagacttctctcaaagaattctagatttgataaatgaatttagtaaagtttcagaataaaacatcaaagtaattatattagtggcacttttatgcacaaataatgatcaagctgagaaccaaatcaagaattcaatcccacttacaacagctacaaaataaataaaattactaggaatacatttaaccaaggaggtaaaagatctcaataaagagaactgcaaaacactgatgaagtaaaccatagatgacacaaagaagtagaaagatttcccattcttatggattggaagaatcaataatgctaaaataagcatactgcctaaagcaatctacaggttccatgaaattcctatcaaattaccagtgacatttttcacagaataagaaaaaataatcctaaaattcatatggaaccaaaatagagccaatagccagagcaatcttaagtcaaaaaaaaaaaaaagaaaaaaaatcgaaatcaatcaaaacacacaaatttaaaaaaagaggcatcacattactgggcttcaaataatactaaaagattgtaatatccaaaatagcattgtactggtataaaaataaacctgtagattaatgaaatagaataaagaacccagaaataaagtcacatgcctacaaccatctcatcttcaacaaagttgacaaaaaactgcactgaggaaaggacattctattaaataagtgttgctgggaaaattgtatatccatatgcagaagaataaagttggacccatatctctcacgatatatgaaaattaactcaaaatatattaaatacttaaatgtaacacttgagactatttcaagactatctgctctggctatttgcactaagatataatgagaaaacctaggaaaatctcttctgaacattggcctaggcaataacttatgactaagacctcaagagcaaatgcaacgaaaccgaaaatagacaaatggggcttaattaaactaaaaaaaaaccttctgtacaacaaaataaataatcaacagaataaacaataacttaaagaatacaaaaaatatgtacaaactatgcagccaacaaaaagctaatattcagaatctacagggacctcaaacaactctataagaaaaatagaagtggagaggggccaagatggccaattagaagcagctgtggtctgctgctctcatggagagcaatgaaaagtgccaatgaattctgcaccttcaactgaggtatccaggttctcacactgggactgactaggcagatgcctcaacccatggagagtgaggaaaagcaaggtggggcaacagcccacacaggagtggcatgaagccagggtagcccccatccctagccaagagaggttgtcaatgactgtgtgaccctgcctgggaaactatgcttttcctatgaatctttccaacccatggatcaggagatcctctcatgagcagacaccgccaggtcctgggtccaaagcacagagctgtggagtcttgttagagtggctgctcactcactttctagggcatgcagggagacccaggagttttacatactccagacctgggaattctggcaaggcaagagatcccatgcattcccctaggaagtatgctgaatccagggagccaagtggcgttgctccacaggcctcactcccctggtacctcacaagttaaaacccacttgtttggaattccagccagccagtggcaggaggcaggagatggcctgagacaaattgagttcccggggggaagggtggccaccatacctgacgttccagttggctgtctagccttccaacaccagggaccgggaggaattccccacaatgcagcacagatgttgtgcttgatcgtggacaatctacttctttaaatgggcccccaatatacccctcaacattgggcagggcctccctgtgtgaatttcagcaactccagccagggttttatggacagaactctggtatctccctgggatggagaccctggtggatggggtagccactgtctcttcagttcagcgacatagcctttccaggctgctggctctggagaggcagagcagtcagcacagcacacctgctctgccaaagcgcagccagactgcttctttaagtgggtctctgatcccattcctcctgactgggtgagaccttccaataggggtctccagacacctcacacaggaatgggtgcccacctgagacagagctcccagaggaaggggaaggctgctgtctttgctgtttcatagccttcactggtgacatcacaaggtgcaggagggaccaaggtgactagggtctggagtgaatccccagaaaaatgcatcagccctatggaagaggggccttactgtcaaatgaaatcaatcagaaaatgacaacaaaaaagaccccacaaaaaccccattgaaaggtcagcaacttcaaagatcaaaggcagataaacccacaaagatgagaaagaatcaatgcaaaaatgctgaaaactaaaaaagccagagtgctgcttctcttccaaatgactgcagcatttctccagcaaaggcacagaactgagttgaggctgagatggctgaattgtcagaacaaggctttggaaagtgggtaataacaaacttcactgagctaaaggagcatgttctaacacaatgcaaagaagctaagaattatgataaaacaatacaagctgacaaccacaatagccagtttagagaggaacataactgctctgatgaaactgagaaatgcaacactagaaatccacaatgcaatcacatgtatcaatagctgaatagaccacaaaaatgaaagaatatcaaagcttgaagactatcttcctgaaataagacaggtagacaagaatagaggaaaacaaaataaaaaggaacaaacaaaacctccatgaaatatgggattatgttaaaagacagaacctgaaagagacagagaattaagccaagttgaaaaacatacttcagggtatcatccaggagaactaccctaacctagcaagacaggacaacattcaaattcagaaaatccatagaaccccagtaaggtattccatgagaagattaaccccaagactcataatcttcagattctctaaagttgaaaataaaataaaaaaaatgttaagagcagccagagagaaaggccagatcacctacaaagataaacctattagactaacagccaacctctcagtggaaacccttcaagccagaagagattgggggccaatattcaacaatcttaaagaatttccaacctaaatttcatatctggccaaactaaacttcaaaagagagggagaaataatatttttttcaaacgagcaaatattgagggaatacatcaccactatgcctgccttgcaagagctcctgaaggaagcactaaatatgggaacgaaaaactgttaccagctgctacaaaagcacaatgaagtacacagactagtgacactatgaagcaaccacataaacaactctgcaaaataaccagctagcatcatgatgatgggatcaaattcacacataaaaatattaacattaaatgtaaatgggctaaatgcctccaaaaaagacacataatggcaagtggataaagagtcccatggttatgctctctacaacagacccatctcacatgcaaagacacacaggctcaaaataaagggatggaggaatatttaccaagccaatggaaaacagaaaaaagcaggggttgctatcctagtttctgacaaaacagactttaaaccaacaaagatcaaacaagacaaaggagggcattacataatggtaaagggttcaatttaacaagaagagctaactatactgaatatatatacacacaatacaagagcattcagcttcataaagcaagttcttagagaccttcaaagagtctacaataatagtgggatattttaacactccactgatgatattagacagatcattgagacagaaaattaacagatattcaggacctgaacttaggtctggatcaagtagacctgacaggtatccacagaactctccatcgaaaaacagcagaattacattcttctcatcaccacatggtacaaaagaatttaaatcataacaaacagtctctcggacctcagcacaatcaaattagagctcaagattaaaaagctaactcaaaaccacaagactacatggaaattgaacaacctgcccctcaatgactcatgggtaaatactgaaattaaggcataaatcaagaagttctttgaaactaatgagaacaaagagacaacataccagaatctctaagacacagctaaggcagtgttaagaggaaaatttatagcaccaaatgcccacatcaaaaagctagaaagatctcaaattgacaatctaatatcacacccaaaagaactacagaaccaagagcaaacacaccccaaagctagcagaagacaagaaatagccaagatgagagcacagatgaaggagatagaaaaatgaaaaatccttcaaaacatcaatgaatgcaggagctggtttttttttcaaaaaaaaaaaaaaaaaatagaccactagctagactaataaagaaaaaaagagaagggaaccaaactgacacaatcggaaatgataaggggaatatcacaagtgacaccataggaataaaaacaaccatcagataatactgtgaatacctctatgcatataaactagaaaatataaaagaaattgataaatttctggacacatatactctcccgagactcaagcaggaagaaattgattccctgagtaaacaaataacaagttctgaaattgaggcagtagtgaatggcctgccaaccaaagaaatcccaggatcagatggatttattgcagaattctaccagaggtagtacaaagaacagctggtaccattttacccaaactatttcaaacaattgaaaagaagggactcctccctaagacatcttatgaggccagcatcttcctgataccaaaatctggcagagatataacaaaaacagagaacttcagctcaatatccctcatgaacatgcatgcaaaaattcttaataaaatactggcaaaccaaatccagcagcacatcaaaaagcttatccaccataatgaagtcagtttcatccctgggatgcaagattgattcaacaaacacaaatcaataaatgtaattactcacataaagagaaataaagacaaaaaccacgattatctcaatagatgcaaataaggcctttgataaaatttaacatcgctttattttaaaaactttcaataaactaggtattgaaggaacatatctcaaaagaataagggtcacatgtaacaaacccacaaccaatgtcatattgaatgggcaaaatcgggaagtgttccccttgaaacacagcacaagatcaaggataccctctctcaccactcctattcaaaatagtattggaagttctggtcagagaaatcaagcaagacaaagaaataaatggtatttgcataggaagagagggagtcaaattgtctctgcagatgacatgatactgtatctagaaaaccccagcgactcagcacaaagcttcttaagctgattagcaacttcagcaaagtctcagcatacaaaaacaatgtgcaaaaatcgctaccattcctataaaccaacagcaggcaagcagagagccaaattattgataaactctcatttacaattgctacaaagagaataaaataaataggaatacagctaacaagggaagggaaggagctcttcaagggaaactacaacccgctactcaaataaatcagagaggacacaaaagaatgggaaaaaaaattctatgctcatggataggaagaatcaatgttgtgaaaatagtaatttgtagattcaatgcttttccccttcaactgctattgacattcttaacagaattagaagaaactattttaaagttcccacggaaccagaaaaagcccaaatagccaagacaatcctaagcaaaaagaataaagctggaggcatcaggcaacccgacttctaactacactaccaggctacagtaaccaaaacagcatagcactggtacaaaaacagatgtatagaccagtggaatagaatagagaactcagaaataagactgcacagctacaaccatatgatcttctacaaacttgacaaaaacaagcaaaggggaaatgattctgtatttgataaatagtaccgggagaacttgctagccatctgcagaaaactgaaactggaccccttccttacaccttacacgaaaattaactcaagagggattaaaggtttaaatgtaaagaccctaaaataaaatacacaaaaaaatagaagaaaatctaggtaataccattcaggacatagacacaggcaaagatttcatgacaaaaacaccaaaagcaatagcagcaaatgcaaaaatcgacaaatgggatctaattaaactaaagaccttctgcacagcaaaagaaactatcatgatccaagcagacaagaaatatgaaaaaaagctcaatatcactgatcattacagaaaagcaaatcaaaaccacaatgagataccatcttatgccagttagaatgatgattattgaaaacccaagcaacaacagatgctggtgaggctgtggagaaaaaggaacacttttacactgttggtgggaatgtaaataagttcaaccactgtggaagacagtatggcaaatcctcaaagatctaatggcagaaatatcattagaaccatcaatcccattactgtgtatatacccaaaggaatataagttattctattataaagatacatgcacgtgtatgatcattgcagcactattcacaatagcaaagatatggaatcaacccaaacacccatcaatgatagactagataaagaaaatgtggtaccttgacaccatggaatactatgcagtgagaaaaaatgacataatgtcctttgcagggacatgaatggagctgaaagatgttatcttcagtaaactaatgtagaaacagaaaaccaactaccacatgttctcacttataagtgggagctgaacaatgagaacacatgaacctatggtggggaacaacatacactggggcctgtcggggtggggggagagagagaatcatgaagaacagctaatggacactgggcttaatacctgggtaatgagttgatctgtgcagcaaaccaccatcgcacatatttacctatgtaacaaactgcacatgtatgccggaagttgaaatacaagttaaaggaaaagaacaacaacaaagaaaaatagaagcaaataacctcattaaaaattaggcacaagacatgaacagagatttttcaaaagaagacatacaagggccaacaaacatatgaaaaaatgttcaacattactaagcaccagagaaattcaagttaacaccccaatgggaaactgtcttacaccaatcagaatggctatcattaaaatgtcaaaaaacaacagatgttggtaaggatgtagagaaaagggaatgcttatacacattagctggaatgtaaattagtacaatctctatagaaaatattacgggactgtgcgcggtggctcacacctgtaatcccagcactttgggaggccgaggcaggtggattacctgaggtcagaaattcgagaccagcctggccaacatgacaaaactccatctctacccaaaatacaaaaattaggcgggcatggtgtcgggtgcctgtaatcccagctacttgggaggctgaggcaggagaatcgcttgaaccctgggaggtaggggttgagggggtaagaggggaagattgcagtgagccgagatcgtgccactgcactccagcctggcgacagagcgaaactccatctcaaataataataataataataatatagtaaaataaagaaaatactatgaagatttctcaaagaactaaaaattgaactactctttgatccagcagtcaccctactgggtatctatgaaaagggaaagaaatacatattaaaaagacacctttgggaggccgaggctggcggatcacgaggtcaggagatcaagaccatcctggctaatacggtgaaaccccgtctctattaaaaatacaaaaaattagccagatgtggtggcgggtgcctgtggtcccagctacttgggaggctgaggcaggagaatggcgtgaacccgggaggcggagcttgcagtgagccctgatcgcaccactgcactccagcctgggcgacagagtgagactccgtctcaaaaaaaaaaaaaaaaaaaaaaaagacacctgcacttgcatgtttactgcagcattttcagaatagcaaaattatggaatcaatgtaaatatccattaatagatgactgaataaagaatgaagaatatgtggtgtatatatcccatggaactactcagacaaaaaagaatgaaatcatgtcttttgcagcaacatggatggaactgaagacaattatcttaagtgaaacttagaaacttagaaaatcaagtaccatatattctgtcttataagagagctaaacaatgtgtacacatagacatagagagttgaataatagacattgggactcggatgggtgggagaggggtgagagatgaaaaattacccattgggtacaatatacactatatgggtgatggtggcactaaaagcctggacttcactgctacacaatgtattcatgtaagaaacatgcacttctgccctgtaaatctacaaaaagctttaaaaacaaattgccagcaaccaattttatgcaaacaatatatccttatcaataataattaataaactaacaaatgagtgaaactgtgctctagagaataaaacagactttagaatttttttaattagacttatttttggaaccccacactcattctcaattctgatgaagaaaattagattttttacacttgtgacacaaaacactgaacactttaaaaataatattcatgctaaaattatttttctttgtactttattatgtctgaactagtttttttaagaacaaatgtaatatctatactttaaatgcaagaaaatacatatctatcaatgatccagcaattccacttcacagatattttgctggcataggcaaacatttgaccacaaggtaatcatacaagaacattcataatagatattcataatagcccaaatctggatgcaaatgttcaccaacaggaaaatgataatcacagtgtggtctatttcttcaatgaaatatttctcaggaatacaactacagtaggtatacagaaaatgccatgaatacatctcagaaccactatgttgtataaaagatgacaagcaggaaagatagtattgtggtttcacacttacatgaatttttaaaaggagctaaactaaaccatgatcatataaatcagacaggttattgtggagagttaaaggtggttgtatagtaaacaaataaactaacaaatgtcactgagagaattttctaaatgagagaaatgtatttatcttggtgtggtggtaatatgaacatatacatttgtcaaactcatcaaagtatatttaaaacagacttatttttttctatggaaattacaccagaataataattgtagaaattatgttgcaggatgttgggaacagaaaataatgttatatcaatcatttcacatagctatttaaaatttactcctgggagaaatacgtttattaatacttgagtcaaaataatgagattttgaagctacatttttgtctcatatttatttttgttatgatgactgagtggtgggtaggctcaagggaatgcagaggtatgaaggagaagagattgattagtgtttcctccagggacctgagatgtttggcatggagattttccggggatatttaatgctacagagcaatgctgttaggtggaaggggaaagtgagtctgagactatgaggctacttcttactatttgacaagcttttattatcagataaacatgaagaattatgatggatcatgtaatctcatttaatcatgtataggcaactaaccaactaacccattccccaacgcttacttaggtataatttgtatagtcaggtgtccataacaacattttatcaacaacagattgcatataccaggacagtcgtgtaagtgtataatggagatgaaaaattcatatcacctaatgacatcatggccattttaaaggtacagtgcagcacattactcctatgtttgtggtgatcctggtatgaccaaacctgctatgctgccagttgtataaaagcataggacatgtaattatgcacagtacataatacttaataatgattataaatgactgtgttactggttttatgtatttcctatgctacacttttatttttattttagagtgtactccttctacttaaaaaaatgtaaaacagcctcaggcaagtccttcaggaggtattttagaaaaggcattgttatcataggcaatgacagctccatgtgtgttattgcccctgaagacctgccagtgggaaaatatgtacaggtggaagacagtgatattgatgacccttaccctgcatagagctgggctaaaatgtgtttgtgtctcacttttaaaccaggaattatagaatgtgaaaataaacacaaaaatagataaagtttgtagaaggatataaagaaaaatattaatatttgtacagttgtacaaggtttgtctttaagctgtgttatcacaaaaaagtcaaaaagttaaaaaatttgtttataagaaggaaagttacaataagttaaatttaagttgcaaccaaagaaagactttttaaaataaatttactataacttaagtgtacagtgtttataaaatctgcagctgtgtgcagtaatgtcctaggccttcacatgcactcactattcattcactgactcatccagggcaacttctagtcctgtaagctccattcatggtaagtgccctacacaggtatacaattttttgtctgtatttttacttgacctcttctatgtttagttatgttgaaatacacaaatacttaccattgtgttggaattgttaacagtattcagaataatggcatacaatacaggtttgtagcctacaagcagtaaggtaagtcacatagcctgagtgtgtaataggctatagcatttaggtttggtaggtgcactccatgatgtttgcccaatgacaaaattgcctaatgatgcatttcttctcagaacatattcccattgttaaatgatgcatgactgtacttaatccttccacagcctgttttcatagctcagctgccttatgtaagtataatgctatattttgaattgctgtgggggccagaaatgtttatatctcctaagtagagtgttaatagacagcctcaaagtttgtgaaaacagaataataaattttaaaaagaatagactggatttcaaaaattataaacattgcttattgattttattggaaggatgtggtttgatacatggtttccaggtgctgaaaatttattgattagtaaatagatatttggcagtacccactatgtgctagaacagtctctgtgtaagatgagtgatgtttagcagaggacttcacttttctgctgatctcactcagtccaagagttgatagcagcagcgatgtccacctttataagcacatcttcatattttccagtttccaaatccgaggggtctgaggagttcatgatgacctttcagctctgtctattgctgccagtttcaagactcttttcaacagtcttcctaaaagatttcctcttttattagtataaagttaaactggggaaagatttaagagaatttaagacaagatggacttacgtaagttgaatattgttcaacttacaacttcaagcacctgagacactttctcagctcacaggagcccactcatttcaacccaagtgcttgtaccaggcaagtatcagacagccaaccaattccttgcaggagtttttaaccagtgtctgatggaatttgtcccttgcttgtgataaatttgaggcattaacaacacggcctcttaaagctaccaagaaatactactatgttactcaccttgaaacctgctcagaaggaaacacccttctctttccctgattcaattatttactccttatcagtaggcttgaacggctggaggtaggtagggtggtttgactggggtcatatgtctggggccctggtttagatagtgatctggcttcctaggtttttcttcacattacatcctctgtgaacagaatgtttcagctgaggtgcacaaaattatgaaagaattattttatgacactaactcctaggttattttgttatgcagcaatagattactagaacacactaggagtgcatcaaacttctgtcaccaatatagtggatcaatgcaatattctccagaagactaagatgttcagggtcttttgtactatatgactaaaagcagaaaaattaaaatatatgcatgaggcaactcagtgggtatgtactactttccatgttaatgtgaacaatgtttgagtctttttattgaagggtatctaaggaattgattcaacagaactatatatcaggtgccagaggccattaatttattaatctataaaattaaatatagcacatcttgcacagaaagtgatattcaattaagtcagaagttatgaaatacaattacttttcaccatctgtttcttttttgtttttatttatttagtttttagaacctaaacccataaattgaataggaatattatatggctgatcacctctagttacttacattttatatggtggcacctaattatgtaattttacctgaaatgtcgtagttattctgacttactttttgcctgaagaagtaattttcaggggcttcctttggtttattccatcataatggctcttaatccatagattggcaagtcatgtgagtaatttgtcagctaccaatataggatttcaattatgcacctaggaactgaagaaatgaacacagaatgagtcttcctggagcttaattggtatgtaggagtcattaattcaaagcctgtttccaacagaagtttaagaagctgggtgtttcccttccctcagtgtacactcataccgggaaactggtaagagctgtagtgtacttctaatcttcaaactttctactcccttgaggggtttaggcagagagaaaaaaaaaccctaatttatagcatttttaaaaaattccatggtgtaaatacacccaccatggctgattttaacataccaacatgataatattaaacatggagttgagcaaagatgcgaacaataagctcttgaaaactgatataaactggttccattacacaactggttagacgaatgtttattgtatagtttttatttggtattacaggttccatcctcaagacaatccaaatcccccttcatttgacattatctggctctagaaactggttcaaatacaaaaactgagtaaatatatatttttttaaattagcggttgacatctgccatcatcttgcatgattttggtctttcttgaccatacattcttgtttgctatacatctattttccctcaagaattatcaatgtccttttacttacttttcatttattgttatatataatcccgttgcaccattcactttctgttccttattgtgctaactggatctttcagggaacatggttttgtgattctttcctttttaatttctgtcaatattcccactttaaaatcaccacctctattaaaccctcagaatgcttgctacaactctttcgagaaatattaatgctcttaccctatttgactggagttatgtcatgtctaattttcaaatatctatcctattagtatatcaagaccaattccaggtgatttagtcaagatgttgactcttgattcagaggagggttttccatatcttcaaactttaccttttgtcacttaattctctgaaactattaaatgcttgattttcagcatagcttcaccctgccaagtcaagtgttaaggccttcttatatgttgtcttggacattctacttcctcaagtcttctgggcagttgacaaaaacaatccaactcaacaatgtaaaaattgccattgtacccatatcttttgaaagccagaactttcaaataatccatttcttactcttctacttgcacctaatctgaatccaccatgggcaagggttttacagacttttattttatagtgccccatgactattacatctttatttacactaaacaggttctagtttttaattgcatcaagtgatccagtttgagatttctaacacgaggttatgctttctaagaccactgtcagataattgcctaagtaattgttctctcaaaagtggaatgtggggcaatactggagtatgggaagtaggtagttgatttgaagaaggtcctaggaaacagtgtgtgaaagcagagaggtgagaccagaaagactaaggaccgtaaagagtgacttggcaaatgaatcactgccaaagacaactggagctcgtgcttgttaatgagccttagaataattttatgcaggctttattgcttgaagcttgtcagcaaacatctcagaatttcaggctgccttatactttgacaaaggagagtttctggctctagagaaatattttagcaagaaaaaaagggtgctttagatggaaagctgacaattaaaataggagatgcccactgttctgtcagaagaactcagggtggaccagtgtgaaaagaacaatgtaacaatagcatctgctaccagtgaggttctcaaaatgttgtctgtggaccagcagcatcaatatcacctgtgaagttcttagtttcatgttctcagaccttgtttaatgatcagactttccagaagcagagcccagctaattgttttaataagcttcccaggtgcttacagtgctcactaaagtttgagaataactatgatatagcattagatcattctagaatacttgaatttttagcaaagtagttggcaatttttatacatcttagattttatattaaataagcgtaataaaatacaaagatgacttttaaaagaacataagtagcattaataaatttcaagccagcaaatgaagaaatggtttgaaaaaataaaattaaccaaaactaacttaaacagaaatttttgacaaccatttactttatagagcaagtgctgaaaatcaatctaaaaatgaaacactggaccataccgctatgcctacatagccaatttatgccaaacatttcatgaatagttatttctaatattacaaaccttttgtattctggagaatacacaatatattaatttcctaatgcattgtgtgagtcttcagatgaaaacaagacaagaaaagataataattgcaggtcattgtcattcataaaagcagatttaaagaactgaaacaaatttttaatgaaaagtgaaatacaaagacacataagaatgcaaaggcataaaggtggacattccctagcagatatcagttttaattttgaaactgtagtaattaagagcatgtggtaatgacacagaattagacaaatcaaccactataaaagagcaagtactcagaagcagactttgttccatagcagaatgctaataaatgaccatgtaacatgataaagcaatgggaaagaaaggagctattgattaaagaaatattaaaaatatgtaaaaagaaaaacaaaagcattttcagtctcaactatatacaaaaattaaactagttcaataatttaaatatcaaaatcaagacattaacatttcagaggaaatatagatgaatatacatctgtctttgaaggagaaagacaacgcaaaaacatagcacagattatttatttaaaaaataaactaaaacacatgttaaatttaagtattcacttgttaaccaaaagatatctataaaaccatgaaaatgtcaattaccaattgaaagaagatatttgcaacatataaaattgacaaataagtaatattaatgatatgcaaacacattttaataatatatgagaaatattaaaactaataatcagagaactgcaaataaatgtaaaattgaaacacttttgtaacaatattattagttttaaaatggaataagaaacactatatgtttgagatacaatgtgtttattttttaaaaggactaatctgtttactcatttaagcaacaattagtgtggaccaactatgtgctggggcctactcttgacacctaaaatatacaatcgatttcacaatgagagatccatactttcattgagcttacattcttgtgtggagctaatcaattaaaagaagtatttcaaacagaattatctaataaaataaatacaaagaaaaaagttacagctaataagaagaattgggagggccaaataggggctacaggagtaagttttcagtattgaacgtaatggccatggaagtttcttaagaaagtgcattttaacagaaattaaaatgttaaatttggacttgagcagagtagtgacatgatctgacttgtttctaggagaccattgtgtttttcatgttggtaaaaaaacttccaggaagcaaaagtaaaagtaggaagatcagtcaggaaattatgctggtgatgcaggggagaggaaatatgttttgaatgacatttgaagaggtggaggtagttaggatagaataaattgggacataagttttgttagaaaagtatttagccaaagtaactggaaggaaaaaaatcactttaatgaaatgaggtgtcatcagatatagtttttttttttttaatctctgagactaaatgaaatcacctcagagtgaatggaattagagaagcaaagaagaccaagaactgagctgtggggatactaaaaaataaaagaagagtagaaattcatatagtagagtaagacagctgtcagaaaatagtaaatcaaggaaaatatgtgtcacatactttacaaatggaattgaaacctgcccagttgtcccatagaactgatgtttatggtttcttttgaataaacatagaaatggattgtcccagtcataaaacttgagaaagtttcatttgtcttatctgagttcctttactcaggaaaccaaccatcaggcctcccagataatatcaagaaaccgaaacataccagattgttgcatctggacaacaagatgccaaactcctcacccatcatgattactgtccatatgcttcctgttggccaactcctcttcttcactcttccctaattcctgtttttccacacaaaattacatttttccccagctatataaacccctaattttagtcagttgaggagatggattttgactgatttcccatctttttgccttcagtacacaaatagagccctctttcttggcaatactcattgtctcagtaattggctttctttgcagtgaacagcaagacctagaccgaacccctagtgctttggtaagatttgggtccctgaccaggaacgctttgctcatggcttggctgctataggtagggagagtttcagaagtcctcctaagcaactgtctgactttttctttggccattggtggggttcggtctcttgccggccccattgccgttggccccaactgcttttctcattcctaaaaagaacagcctttgaaatttatcatttgcatccagatgagtaagtgacttttatgggtatcagacaataggatttgctcctgtcgatctgggtaattcagaaggaatttcaatagaacaaagcaatcactacaacaataacaacaaaaaatgatttaattacatgggaaattatttggtcaataagcagctgaaaatgtaatcaacatcattattaaatagacttacaaatttaaaacaagaagataaatatgtctctactcatttggcagaaattttgaagtctaaaaagttcatgcattcatgaggatatcacataattgacatagtaataaaatattagttcaaattaaagttagtaaatgatttttgagaaaaaaatttaggtcataataacatttaaataaatggattataaattatgacctagcaattgtacttctagttaaaaatatatataagagaggaagaatattcatgtcagcacttatttctaatttcattagagacaagattttcaaaagacaaaaaaataggtggtggaatattcatataacactatacagaaatgaaaatgagcaatttatctctctgcataatatggatggatctcacaaaatagcactgtgccaaattgtttcaaattaatacatagagcataatatatttatgtaaaataaggataagcaacaagataatgaaagacaaaatttggaatgatgtctacccttgggagagagaagaactattgggtactatgcccactaccagtgtgatgggattgactataatcaaatctcagtgtcactcaatatatccttgaaacaaaattgcaaatgtacttcctaaatctaaaatacaagtaaaaatttaaaaaataacaaaaaaggaggcatagcaatatgatgtgtgcttgtggttgtatgtgtctttctgtgtgtatttgtttcctcaagcaatattcatcagctcaatccaggcacagaatcagagaggaaaaaaaaaagaaaaactaactaggtttggagttttgacagagtatgagagaggaagaaggaagaagagagtattattcaaatggaatgcaaaaggtaactgtagtgagccatgaaatataaggttaataagaaagaagagagtaagcaaatgaatactcaaagaacaatgcactgaaatacacaatttctaagaaatgtgttggaattggagtgcaagagaaactgagatgaaactgtgtggttcccagatagtggaatgcaaaactactagaactgataaaggatacggacaataacatcatagtagggtaatcaagtattgcaccaggggttgaaaggagtgtattgtacagtacaatatggcttctatctataaagaggagtgagttataagatcaaacaaagaaggagttctgatttgggaatgagaatttgttacaggtatttttattttcctttattttgtatgcagaaaaagaaggagacatataaaattatgataggtcaacaagactacatatgctctagcattctgtctgtccacatattttcctataaatccaaccattaatcagaagaaatatatggctaattaacacctcaagcataatccattgcataaaaaatcagcccatgttataaataccattttttcccaaaaaagagtatttgatctgtgtatgcgacaacctaaaagtttaatgttatctacatctggtcttatttagatcaagaattttaaaaactgttattaactctctcaataattaattgtattgctacaatcatataaattttgaaagataatctttgtggatgcaagcaagtaaaaataaaaaatttcatatttctttgaatgattaattatacaaatgtattgtaatacaaagataatttattttagtcaaacataccagaaaacaagcatatggtgactataaaatgtatttcagtttactgataaatatacttattgttttattattaacaatattttattgaggctaatgcactattttaatcattgccatgacaatcaccaaacaatctctttatttttttaatctgtagcctgcaacaaaattttatttactgaaagacacctattgaatagcaaatatagaaaaaacgctttagcaaagatttagatcgttattctaaaacacttgtaacctagtttttagggcaacatggtgacattctttattattatattactcttattagattaagctttgataaataagtttttgagaagatgtaatgattaataatgagtatggtacatttcatatgtaaaataaaaatttgcaagtataaatatacacaaacaagtttcaaattacaagttaaaactgactatcaaatgatatatgtgtcacaattctattcctgttttaggaacaaagatatccaaactggtagagtttaaagttatactcataaaattcaacagttctgtaagtggttattgggtgtaataatgaaggaagtcacatctacttccacactttgatgcatttttgcaatggtaacaacagcaacgtacttggttgtattctgtaagaaagaaccccaccgtttcggcatgtaatctcccaacttttatcatcatcgagtcttcagtaggccaattcagttatgttagccagatacttctggttaacagggaatgtgcatagaattccctatcatgatgacatgatgataacaacttaggaatcctttaatttcatggattgtactgaaaacaaagcactaaaagtagagaaggcatacatatatccagaatacatgtctattctagtgagaaaaagtcaatgcccattccatgatggaactgttccaacataatcaagcttacttacacatggtagctgcctagatcatctgagcaatgtcaacaaattggagggtcagctgctggcaggataggcatttagcaggtcagcctttgtgcaaggaagttcatgttgttgatcccatagacaacctctgtctatcctgccatcacagttatttgtacatgttcccactgaggaagcactgaggtgattgggaaaagaagctaaccgatatcagtaggaaatttcttctcattcacctcattattagagcattttctacattggaagccatttggtgaacattcacctgaaacacaaatatcttcacagtctttgcccagttagagagatgcctaaacatatcgttttaccagagcttttgtgttaccagtttttcagtcctattcattccatttagccaaaaccttagtagctcacctgaattgatgttgctctgtgctgtaggccatatgtaggaccagagaaattggacaaccacatttactgcttcaagaatttgcattcaccgctaacctttggtgataaccatccattcctgcttgatcctagcctatcctgtagaattgtttataaaccaatgtgttttttcctcctaataaactgtttacaagaaaccagttttcttgaagtcataggtgtagatagagggagcgaaggcaatgcagcaggactaagtgttgaggaagcttgaagcacttactacaagtgtgcctaaaccctttcatatcatttctagttgatgataggtcattgctgtacattcctattctcgtgacattttgtgtcagataatatccagtcattttatgtcccacagttccgtattcagactttacctgattctaggagcaagactggcttcattaaagccagtttctcaaaaataaaataattactggcaaatgagcacacagatagacatcagaaacctaaaagtcaatgctgtgattttgccactgaaaagcatctgatgctttatacagtatccttactgaccacagattctttaagtaccatgaggtctgctggtttataacaacaaaatggaacaacacagtacggtttagcctggtttggttgtagagatttctctcatcctcctccccattcaaaactggaatccttatgattacacaatacatgcttttctcaaatgtggaccacattacccatatattcaaaaagccctactgggtgctgggcctggtgactcacgcctagcacttttggaggccgaggtgggtggatcacgaggtcaggagttcaagaccagcctggcaaagatggtgaaaccccacatctctactaaaaatacacaaattacacaaattagcctggcatggtggcgggcgcctgtaatcccagctacttgggaggctgaggcagagaattgcttgaacctgggaagcggaggttgcagtgagctgagactgcgccactgcgctccagcctgggcgatagagtgagactccatctccaaaaaaaaaaaaaaaaaaagccctgctggttatgtcattttgttagtgctagatgacacgaggcaaattaacttggttttaccttggaggaagatatagtaacattttaaaaaatactgaccttaacagtctttcaccaaggtctattctcagtttttgaatttgggtgtgatttatgtgtaattattaggtatatatgtgtttgtgcattttttgtctcattctggaatgcttcatttgacaagctcttttattcttgactatcaaagactacagtagaatttctggttgagtatatcccattttattttaatattcttgtaaggcattcagtggaacttttgaaactagagcttgtttacaaatttagggaaatcataattgtatacatatatttagaaaaattatatatagggaaatgatatataggtatacatatatgtacacctatatgcatctctcaggtctacctcaattttattctctcatacatttgctatctttatatttttgtcatatatcctagataatacttaaattatatctttaagaacactgcttcacttttcaactgtggtagtgtatgatttaacaattttgctgaaattaatattttgatttttcttatttctaaaacttttatcatgtttgctcttctttattatagcaatattctctttctttgtaattctaccaactctgtgctttgatggtctttacggccttctccctaatccttttctcttatcctacaatctctttatcaatgtattaacccacataacttcaaacacagttgcaccccctaaaattagtcatcaacctgtatctgtgtgtctaacttcagatgcatagatcctgtgccttggaatcagaaacatctaagagatacatgaacgttagtgtgtcccaacctgaacttctggtttttataccaactatatctaatggtctagtatcatctatcaccatgaatgatctttcatgcaatgtttcctccagaaacctcagaggaaataaaacgtcatcattctatttcacctcttcatttcaaacaatttcaggccttggtgattttcttttcatttatttatttatttatttagagatggagtcttgctctgtcgcccaagctggagtgcagtagcgtgatctcagctaactacaatctccatctcctgggttcaagcgattgtcctgcctcagcctccttcctgagtagctgggattataggcgcccgccaccacccccagctaatttttgtatttttagtagaaacagggtttcacgatactggccaggctggtcttgaactcttaacctcaggtgatccgccagccttggcctcccaaaatgctgggattacaggcatgagtcaccgtgcccagcccttggaattttaattagatatgttttcccgatcttcattgccactatgctagactacggtggcattatatctcaccagcgtgcttgtcttttttatattcttccaatagattttctaaagagcaagttaggtaatttttttttgatatgtaagtttaatgtgtcattatcctgaatgaaacaattcagtttctactcactacttttaagttagaggtcaaatatctttatataagtcaaatggctctcatgataggcatctttactccctctgttgattcatcactgttttgttttttaatttattattattattttttaggtttgtggttacatgtgaaagtttgatacatgggtaaactcctgtcatggggtttgttatacagattatttcatcacccaggtattaaggtccacagcaaatagttacggtgacactaattatcagaagtttttaaagtttgtataatcaagagaggaaagtacaaaagagagtagctaacaactgaacttacccctatttacatgcatattctttgtttggctgagtagtcacaattgattttaatgtataaaatagtaatttaacatgtatgctatatatatgtgtgtatgtaataacaagagacagctacataaatatacgtacacatattctgacaaatgtcatagcacacatgaatgttaacccttattgctacgactactgaaaatttagaagagccattgatttggacatttgttctacttctactcatttattctaatgaaaaaaatctagaaaatgtgtaacttccaagaatatatgtgtacctgctggcaaagactaatgatctgatccaatgggcattgcatcagctgtataatgaattcagtattatttaaaccaccatcatttactatgaaaaattatatgaatcatatattaatatgataataaaaggttttatataaaagataaaaccaaaaattactaaatgcatactgaattaatttatcaatcagcaggctggtaaatatacagatcaacagaacatttgaatagttaatatctaatgctgctaagtaaaaacaagtccaaatatgggatccagtgttttaatgtcataataaaaaatgtaatttaaaatagtacatatatttatacttatatctaaatctgcatctacatatgtgcatgtgcacacatatgtatatctttatgtacatatacactgtaaaacattagaatatgtaatatatataataatattacaattcctatttgaaataaaatgaaaacaaaatggaggtataacacttgtttatggttggtttctgcagaatattgggacgaggttaaagctcagttgtaaattcctgtattccacctgaatacctcagatagggatctatgtatttgaaaatattccatgatgcagtattcacggggaagttctatcttgggcaacacattttttaaaaaggctttttctcactatattttttaaattattttttttctttttaattgattaagttttactaccttcatgtgaaatctcttcagctttcattaacatttttttctcaagtattaatgaaatatgacccactaattcacatttaatttcctaggtgctacactaaagttgttgtttgtggtcagtatagtttattataattaattagaaacttttttaacttttatattaggtttgtgggtacatggaaaggtttgtaacataggtaaacacgtgtcatgggtgtttgttgtacagattatttcatcacccaggtattaagcccagtaccctatagttatcttttctcctcctctccctctcccaccctccaccctcaagtagacccccgtgtctgttgtttccttctttgtgttaataagttcttatcatttagctcccacgtataagtgagaacatgtggtattttttttaattttggtattttctataaatttattcagtagaatgtttgagggtttgataagtaatgcaaaccaaatgtgtctagacagaatttatttgcatagggaataatacgtttctgataagtgaaaaggtcagtgttaagtgctggtggttgctgggcacctcaaggtcagaagtcagatgtagttcttagaaagagaatatagagacatattttaggattatgttaattctctcattcttcattaaagctgttgttaaattggtggctttctttttcatttttttaataaaaaaccatgctgtacactcattatctgtgtaattttccattaactggaaatttatacaataatttccagtgtacataatatgtttgtttaattttctaatattgtacctcctttagaaatatcattgaagcatatgaatcttaaatccaaaactaaaaactgactcaatgttactcagtcgattgtatccactttcctgaccggattgtttaatgagatgtaatttcttcttgctatgttgacctggataaagtggatgggcaggcattgcatgtgatattacaaagaacaggacagatggaagaataactttaagggattccaatactagaaggtatgtataacaaataattagaaggcatacatgacaaatatacaattattagctggtgacactatctaaataacattaaagttatttccaaatataatcataaatataatatattttacagacttataaaagtcttgattaaattacagaaatcactagtttcattcaagcaactaaaataccttttgaggcaggtgggtagaagaaaaaaataagaaaaaaataaattataaacaaatcaaacaacacacctgcctctttcacaagaatgttctaagttttagatgagaagatatgcaagaaacttatttcatcttttcactcaacaacattctgtcattcaacaatagtttactaatgtgctctagtgccaagtatataatttcaaagaagacaagaaatatcttggttttcaagtaaattatacacaggcagggggaaattaatataaacaagcaaataaaaataaaatacaatgattatacaaaatcataaataatctgaaggaataaacacaatggtgtgattgcccacagctatgtgaagtagggtaatttaatttagactagacagtcaataaagatctaattgaacatatgatatttgagctgacacctgaagaatgagaaggagccaaccactcatccaaaagaataacttttaatacagagaaatagcactagcaggccagaactacgagcatttcatcaagaaaaaaataaaatttcaggaaagtggaagcgagtaaggagatcattagaaagaaataattctgcagagctagttagaaaccatcacagggtagaaaattggctgtgatttgctttgtggtatgctatacaaatacaaagtcattaaaatgttaagctgagtttgttgctacctaattcaaaagactctgagtattgcataaaatatttagaatattaattattaccagataaaagtcaagaagagtctactaattaggtgggtactgaatttgaattagaaaaatgcatcatcaatacagacaaaaataggtgcccagcaatggtggattggataaaatatggtacatatacatgattaaatactatgcagccataaaacagaatgaaatcatgtcttttgtggcaggagggatgcatctggaggccattcattgtcaaatgaaaatgcagggacaggaaaccaaataccacatgttctcacttatacctgggaactgaacatggggtactcatggacataaagatggcaataatggcaagacactgggaacttgcttgaaataaacaggggaaatggtggaaaaactaacttttgggtattatgcctactatatgggtgatggaatcatttgtatccaaaatctcagcatcacacaatatacccatgtaacaaacctgaacatgtatccccaaaatctaaaataaaagttgaatttaaaaaaaaattaaaatatttagctgagtgcagcggctcacacctatattcccagcactttgggtggctgacaagggcagatcatgaggtcaggagttcaagaccagcctgactagcatggcaaaaaacgatgtctctactaaaaatacaaaaattagccgggtgtggtggcgtgcacctgtaatcccagctactcaggaggctgaggcaagagaatcgcttgaacccaggtgacggaggttgcagtgtgccgagaccaccccagctgggagacaagagcgagattctgtctcaaaaataaaaataaaaataaaataaaataaaatattttggatttagaactttgatggtttattgatggtttggatatttgacataaggaacataagacagtttccactttttgactgatgcagttgttggatgctatttacattattgaaatttatatggaaaggaactggtttggtatagtaaaaatctagtgacatatcaattcagagatagatatctcttagaaatcaaagtgaaaattgcaaccttcacattttatatctctttttgcactttggttttcaccttagcagtaatcatcaactgatttttaacacattgatctaactatgttccagcttctttagcagaatgaaagcttcatggggctagttaatttgtctattctgtttaatgctttaatgttatatcctgatgatatagaacagaataagtgttacaatatatgtattaaatgaatgaatatatatatataatgaatctaaatatatatgtaaatatatataatgaatctaaaaatatataaatatatataataaatctaaatatatatataatgaatctaaatatatatataatgaatctaaatatatatatatataaattttgttttcttgagacagagttttgctcttatcacccaggctggagtgcaatggcgtgatcttggctcactgcaaacttcacctctcaggctcacgtgattctcctgcctcagcctcctaagtagctgggattacaggtgccccccaccatgcctggctaatattttgtatttttagtagagacggggtttcatcatgttggccaggctggcctcaaactcctgacctcaggtgagccacctgccttggcctcccaaagtgatggaattacaggcatgagccaccgcacccggcctaaatgaatgtaattttatgtagatattttattgtacgagtccatagcacagggaagagtttgaggctctggaaacaattttgaagcttatcagcatagatcctacatgctatgggtttggatacagtgacctctgcagagaaattcggacacagatttaaagtgttatcaaaccaaatccattcctgaagtttcccagactttaataggtggaaggattagcaaggagaccaagagaaaaaatacagaggaagaaaaaacaaacaaacgaaaaaacaaacgaaaaaacaaacaaacaaaaaaacagaaaaacaaagataagtgaagagagaaaccaaaccctgaagatgcatgaaaacaaagacaaattattcaagtgagacagaatggtagaatatattcaaatgtgccgctaagccagtaaaatgatatcacaaagtgcccactggatttggacaagttgtgatcattgatgaactggataagtgtaaggtcaataaaggggaatgaagtagatggacaagtgaatggaaagaggcataatttctgatattatggctgaaaatgaatctagatttatgaaactcctaaaatatttgattattgatatctatatatctatcatctatctatcgattttaattcattcatgagctaataaggttgtaaggatatatcatgccaaatgcagtaaagtaaagcagttatcagcactgcttttcccctgagaaatttgttatataagaaaaatgtaaacactggttttcatagattcaaattttgtggaagtggagacaacactttatgccagtacacatggcaagtttagtaagattcttgctcatattattacaattcctaagggatacagccttgtcttaaagaaccgcaaaaattaaaaaaaaagtcaatttggcattttgtaaagtggagcagtttattcttagataaattttaaagccaagctgacattcataggtctttatatacataatttgccttacttggatgttcgaaaacatcagcagatgaaaatattgaaagtgatctggcacagtacacactattccagtgacatgttctcttaaagcccagacctcatcactatacaattcaactatgtaaccacaaacaatttgtacctataaagctattgaaattagaaaatgaataaataaacaaataataaataaaatgaaaatatttaaagtgataatagccaagtaagaaatagtttttagaggaatattgctttacactattcctcagagtaaacacacaaatattttcaaaatagcataaacagcttaaagaaaaataagtaaataagcacaaaaagaaacaaggcatgatttgtgaaaatcagcagaaaatgtagggaaaaactgttctgcttgatttgacattgggtatagtataaaataactattcctacaaagtttaaatttaaaaatacaatatagaatatctagaggaatgaggaaattattgaaataagcagattttaaaaagagcatataattttttttagaaattaagaatataattatagaaaaataaaccctaataaagtacactcacttctgactgaggtaaaaatggcagctggctattcttttcttgcaccaatcaaaggaaggaaaaaaactgagatacataaaaatatatagtttttaaagaagtaagaatactttgtaagaaaatcagatttaataaactgaaattacagagggacagcctttacaaggtaagcagtttatcactggtatttcttcagaggctgtatttgctgattctgggcatgggctgattgaacttcgcctataaataggtagcctgctgaggaaagaaaatctagcaaagatttgcatgtttgcagagctctgcaacaataattttgaaagttctggagtcaaaaatgcctgattgattttattccatggttcattagctaattttttttttctaaataggaggtgaagagtttctggaaggaaaatatcatttcttatagtcttggaatatttggaagaaatagtctgatctaaagagaggagcctctctcaaacccaaatgctgttttctatctaagacatttgctgtgactggatattgcatggggaaggaagacaaactgcaaaacttgaaacttccaaataacaaactcccacagttctccatttgagaagacagaaaacagtcagatcctcaaatacaaatctgttaggactgttaggagtatgcacatagaacagaaacaaccaaaggagaagtgattctttcaaaaattgcaaaagtttccagacccgactagatccctgactgaattgaggtgatcaaccactctctgtctcccggtggaaaataaaaatgatcctctaaaaggtatcacttagaactccttcttttcctttctgtatcttgcctagaatactattaaaaaattaaatgtggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaattacatgtgacaagacataggataataatactggtaatgaatagaaattaataaacattggaatcaaacctacagataacatagacattggggttagtaaataaaaaatttaaaataatcatcataataatataaatacaaaggtattagtaaaaatgctagaaaaatagataaaatgatgaagaaaagtgacatcaataaaatcaatcacttctacatgatacaaatgcttaagaaaatatttttaagtaagaaccctttgtataggattaacagtagaatgaggacttcaaaatattactagtttacttgaaagcaggtgattacaaaatatttaaactggaaaaatagaaaaagaaaatatctgtgacacattcagaacacagtacgagtctaaaacatgagtcaacggagttccagaaagagaggagaaagaacaaataaagcagaaaagaaaatatattaaaaaattatcaaaggtagcaacacataaattcaagaagctaagtgaactcaaagtgggagaaatacaaggaaaaacatgattggaatcatactgaaaccactgaaaatgaaaaaggaaaagcaatttttcaaagtatcttgaggggaaaaagacatgtcatcttaaaggatcatcagtaagatctgtatctaaaacaaaagcaatgatttggaaaacatgaaatcggtcaaataatttcaaatacatgctaatccaaatatttaaaaactattctcaatatacatattcatggcaaattaatgtgaaataatataattgcagacaaaagaaaacatagtctgtcatcaatagttctgcattaccagatgtgcttagattgaaacctaccttcacttaactagctaagtaaatttttataagttaattcatctctctgtctcagttttattacctataaatatgagatgtaaatattgtctaatttataggggtatttagaggattaactgacttaaaacattaagattcttaaatctattttaggatataaaatctttctaacatgctatttttctcagtattaaatgttacaagcaaaattacgatttatgggtgcagagtatcccattattaaattaatatgcttttgtcacttagacaatattataagaatactaagagctaggtattggaatcaatttaaatcatttttcttgatataaatcttcacttttctgcttttagcctttattatgctgggcaagttatgttacctctttgtgcctctatttcagcacctgttaaatgcaaatgccatttgtagctaaagtatacggttgttgtgagttttaagccagttaatgtatgtttagacatcatcaatttatagtagtagtttttagtatatgtcatttatactcaacactataaacagtcttgcaatagcaactaccacatgtattgctatgatcaatttcctcagataaaatcctatatttggaactctgaagtaaaaagctattaacatcttaaagtaatatgcttcctcaaattgcccttcaatcaactctagaaatttaaacactcaccagaaatgtagcaagtagcgcatttatacacatccttgataacaatgaatcctctgattaattattatattcataccatttgttctgtattttacagctgaataaaatagttcctcacatttttctttacatttttctgttattataacatgataaatcactatcataatacaatgtaataaattaacatattaggtggtattctaacagaattcaatttctaaaagccatttggactactaattaaacaccacaaaacagacaattttttatctgcttatgattgtccacataatatttattataattatgtctatttgattggtaagcaacaatgatatgaatggataattttcacaggaaaatgatgacattcactccctttaaacttttgactttttaaaattactaaacctaattaaaactatttttcttctgatataaaaggatgacatacagttgtgattttatttccattatcttctttgaactaaaaacaaaatgaagtaaatgtgctgaggctaattaaaagtagaatggacactttgaactcatagattgttagtttcagatgtcctcagagatgactttaatatgatttctcttctaatgctgaaacccctttacaatgtccctgattgttatgtattgcacatcagaagggaaatgactagtcgttagaaaatactttctaatattgacccaagatttctcttttagccactttcacttgcctgctttcaattcttccctaagatgtcttaaggcatctttagtatatcagttttataatattagaagagagtttaaaaaccaataatttcctactttttaataaaccaactttatttttggtattttaatgctttccgatttctacttatcctggctactctcactgaggagctcaatttctcaacatctttttgtacctagaagaaaaacttttacataattttattcaaattttcttaaaagccttactgagtatttaaaatttttaaatgacatttaattatctgggcatttattcaatccaccatggaatagtagtttaaatacatggatctctccccataaattccagcaactaaaagaaacacagaggataactgagaagcatatatatatatataaatatataaaatatatattatatattatatataacaaatcaaaattatttaatatgcagctgtgtattattttatcctctacaaaatgttatttgaaaaagttaaatatgtatgacaatatcctagtcttgaccctaaccaaactgaaaatcctattagaaaaaaattccactagctcagtgtactaaagatttaaaaaatgaaagtctctggaaatataaattgaaagtgattgcattgttttattcacaataactaaacttaacttggaaacaaataaaaattaagaagaaatataaaatcttttataattatggtttaattaagtagaatacaaaaatcggaaagagtagcaatattcaacctttaggtactttatagtcagtgtctaactcatatatacatactttttaaaaacgaggtatctatcatgaagtataataaaaactcatcccagagaaacaaaggataggctttaaaaaggcaattctttctgctgctgcagctaaagctaaaattgccctgcaggaaattttgattctctggcacatttaagtatttctcatttacaaaagtgaagtaaggcaaaagaacctgaggaaaagcctctttgttgcatttttgttcacagcagttcccacaaaagatcaaattttaatggaagaagatttaatagatgtttagatgatgaggcaaaaaaatacaactgctcctgcaactagttcttttgaaaatggagaatctaaataattactcttgagaaatcagcttacatgtctatatcatagctttccaattatatatgaatgaataaaattgctggaggacatattttttcccctccttctcaaaattgggtgataatctgttaaagtcattgctaaatgtaccttcagatttgtggtgttctgcttctcaacaacctactttagctcttataaatgcaagaacataccccacattaatcctttctgcttagcctctcagcaggataaatttaaagccatctcaatggccccaagcaatatttttaaaaagaagtaaagaaaaatcctaataggtcatcccgatcattctgatgtcagaaaagtaacaatgctaaatacaaccttcactgttttatttcagactcattttcaaattccaaagtaatagagttttaataacaggaagatacattaatgaggaaaaatgtatacagttacgcaaaagtagctcagtgtgaatttgcttgttatgatactaaatttgagttactcatcataccatctatactaaaagcatgggtttgttcttaaaattgatgcatttgataagatgaaatattcagatttattgtaaataacaacagttatttaaaattatgtaaaagaaattaactataccacaaataatataagaaaataattagttgaaattatgttaattttgtcaaaataaaatggaaatgtactttcaaatataattttgttagcagacccataaaatctatttttattacaatggacacatacattaatgtataaattatagggaaacttgtataacctatatatatattctttacaaatacatggcatagataaacttagctctttctagataaaacctaaagatataatagaggactttactgtaaatgtatgcttatagagcttcaaaattactagaaaatttgaagtaccaggttttacatattctgttagaaatttattttttaaaccattagttctggttctttgtgtggtgtttgcatggatatgaggctgagataatgtatatattacgaaaaagaaacaatgcctgttctttcatacatatagtcatgggaaatacgtgatatgatgattggagtttttttgggggagatgccaacatttttttccgttcaaaagacataaagtttacagctgtaaaagacagaagtacactgttgtattttttttaacttaacattctatttaaatcaagggttattttaaactgatgacagattttcttaataactcatagaagagacctataggtgtttccatgaatgagatagcatttttaaatgttaagaattttaaaaaatcaatgatgaagaaaaagtcttgatagtagaatgtggatggaatagtagaatgtgcatggaatagtagaatgtggatgggatagtagaatgtggaaggtatccaagttcaagtgttagatatgttattatgaccacgcctttgaaattaattaatcataatcatttactagctctgtgaaattgcacagtccgtatgataagaagcaaaaaattatcaaactaaataatctatattatcaattggagatggtgaaagggtgagcattagcaatgttttatcaaaatgattttatcatctaattttttcttcaatgcaacatataaaatgcatacatattctgatcacaatacaagaatgtttgtgtcctggttcccagtaagatgaagtaagcatattttacctaatttctcccacagaacacagaacacaaacattgaacctgctgagcctgtatgaagctactatcccaggactgtgaaaagtagactagttgaggaagaattcaagtcgacactgaactagtggtaagttaccaacaatttgtccctgttttcagggccaggacactacgcagacatatttgtggtttacacaaaagtgagaattcatgttcaaaggaagagaacaccacgaaaagcttttgtctgattcaaggagctgaaaagtgaactcaggatcacagagtggagggattcacggagattacaacaacgtattacaagagttggaactcttataggtgaatattcctttcttagtggtaaggcagtggtcccaagaggctggaacaaaccactattgctcttagacctctctctctctttctctatctctctctctctctctctttctctctctctctctttctctctctctccccttctaaaacttaaagattgagataggtatagtcatcgaagtgtgccagagattctggtaagtaaagccaaactttctagataaagaagcagaaagaagagccccagagaaccagaaagctctaggaagattacaaggcatcagtgggtgggaaagtgaccctctaaagttttccatgaactcctaggctcactcttgagcagaagcaaaacaaaatgaaacagaaaacctcaaaaaataaatgaaacatataaaggagaattaagtggaaatgttaacggacacaacataaaacagacttactgaaaaatgcactagatgagcttaacagcaggatgaaaatgacagaagagacattgaacgtcaagttaaatcgacagacattatccaatctgaacaacagagatggagaaggtgcaaaaaagaagaagcaatcctcagggacctgtaagaaattaacaccatgataaatatttatgtaataggagttccagaaggaaaggagaaagaaggtggtgctgaaaatatttacaagattaatggctgaaagtttcctagatttggcaaaaaacttaaatctataaattcaagaaagtcagagaatcttaaataacattaattcaaataatgccatgattaactacataataacaaaactgtgccagactaagaaaaagaaaaaattctgaatgtagccagagcaaaatgacacataacctgcaagggagcaaaaatttgtaggacatcagagtcctaataaaaatattaataataaagaaaaagggacatactatttttaaagtggtgaaagaaaattctagttctattggatatataatttagaaatgaatatgaaataaagacattttcagacgaagaaaatgtgagaaaacttattatctgcaaatctgctataaaaggattgctattaaaataaattattcagactgaatggaaataatgccagtgagagacttggagcctttgcagtgaagtaagaacaactaacatgggcagatatactaatttaccttttgagtttttataacacacttgatgattgaaagcaaaaattatagcactgcctaacttgattttcactggatgtagatgaaatatattataaaactaattagatatacagggactgatatggtaaatgttggttgcacacagagtgtgaaatttgagtacatatgttgcaatctccaaagcaactactaaaagaaactggtattgagataaaatcaaaattatatatcttaaaatgcattactaaaaaatgttcaaatgacccaaaggaaacacaatgtaaatcagagggaacaaaggaaaacaaataaggaaattatagaagtaattccaaatgtttcaatgattggaataatgtaaatgatataaatgtaaatgacctaaatacaccaataaaaagatagaaattgccaaaagggataaacaattattcaactatatgctgtcttaataattgatttcaaacaattatatatttttaaagtaaaaaagataattagtgtttgtatgttaagcaaacactgtatattaatacagtatctctcattgcctaaaaaaggcagagaatgagccagtccttacctgacttcaaaatcactttaccttcattgcagatagcatgtgcttatcaaattcattttatcaaattacttaagaatatcaacaaaggtattgttcactatgtcctcctcagcagagaagaattgctgtaagtcagggaaagtctgatgtttctatgtgaaaacttcaaccaattctatctttaatatgaccagtaaaataggcagctctaccttttagaaaatgttcatttgctattagatccagaagcttcttaaaagaatcataagaggacattaataaagtcaatgttaatgctatgcattattattattattattagacagaatttcgctcttgttgcccaggctggagtgcaatggcgcaagctcgactcgactcaacctctgtctcctgggtttaactgattctcctgcctcagcctcccgagtagttggaattacacgcatgtgccaccacacccagctaattttgtatttttagtggagatgggatttctccatgttggtcaggctggtctcgaactcccgacctcaggtaatccgccacctcagcctcccaaagtgccggattacaggtgtgagccactgtgcccagctgcattatttttattatatatatatttttagatggagtctcactctgttgcccaggttggagtgcaaagccgtgatctcagttcactgcaacctccgcctcccaggttcaagtgattctcgtgcctcagcctcccaagaagctaggattacaggcacccgtcaccatgcccaactaatttttgtatttttagtagaggcgggatttcaccgtgttgaccaggcttgtctcgacctcctgacctcaggtgttccgcccgcctcagcctcccaaagttctgggattatggggtgagccaactcgcctagccgctatgcactattttaagctgagcttttctcctattcctagatcaactgcattatccgtcgtaactcttagtcattttagtaaaatgcatagtacatttaagaattcaaaaaatatgtattgagttatttttgagttagatattgaagataagtagaaaacaaaacagataaacccccttcccttatgaggtgtttatctactgaaataactgttggtatatctcaaagaaaatgatgtcaacactagcaaaatcactgaagtattaattttgccatttcctacccaatatcaagtaatacctatttttaaattataagttactgtcgaaaaaattattaaaaatttttatgaaagtcaacatttctaaatgtaatcatcttctgttttttttttctttaatagaagctctgtaggaaatcccaagtcaaagtatcattggccaaatattacttattggaaaactcacataactctagcaaaagcaagaggatagattatcctcagcatcaaattctaggtgcttcaccgtgaaatctctttcacttcatcttttgtcagtatttcccattccttattggcttctttctcccaagcaagtttccaacacatgccaggaaacaatgccagtggtaaaaactgagcatgcttctacccagagaaacatggagccccactattagttttggaaaattgtttagtgtaactttggtgaaatcaaaatccctagatcaatcaatagatcagtcaaggtgataagaatttaaaaagtggtaattattacataattcgtaattgcacatgcaaaatcaatgtgtctttgaaggaaagctgctgggcaaggaaagcaatacgtgtctccagtatttgtctgaaccccaggttagttacgctttccatccatatagcttcattttggactttattctttgtaatagctgaccctttataagaatacctaaagtcagtttataaaatttatctaaactgtacttctcaagcacctcacatttgcctaattccaaaggacagagggatatcaaacctctagctctgcactcttatatttcaagtcgatgaagaaaatgattgcttcaaagaatatcattctctaatatttattattctattttagaaaacaaaatcatcttagtttcatactaaatctaatctgtccatgcaagctgactagagcttatgaaaaaaattgaaaatcagataacagaaatcatccaccaggaaattaattatgatcctttcctatgcctgtattttctgcaatgacttctttaatggcaacttctccccgttaattgaccttctgaatatttgaaatcatttaatttccatttccttctctaacaatttcatgcaggaattacaatgcagagatgagctcttccagggacagaataaattttctattttgaccagggcactccaaatttaggacaggtcaccgttaacatcccagcttttatctgattcccatttcatgctattctgtctgcattgcttgagtctctggagaagcttaagaaatttttggaatgcattctaccgggtgtctttcttcattctccttctttctttttcctcctgaattatttagtccataaattgaggcttttgaaaaggctcccctcttgttcgaacatttctaccagctggagaatcatcatcaacagatttctgaactgaagctgcttccttgatgtgtccaatttttgtaaccttatgcacccagtaagaaactacatgtacttagccaggtggtcctccccaaagcatcgccttccttcagcatttcagcttccaaggacttaaataacttgcactacatcagtgactgcaaaaacattccaaatttgctacctccttcactatagcaagaacatatccttttaatctttctttaatgtttaattttcctctgttgttcctctaatcctttgaagtagacacagctgttaaagatatttttaacttaattctcaatttatccttagtctacctctgccacgttttgctggatcagagtatcttcctctctatttgctacaggccaatacattgatttttctaacaaagtattgctttgtggagttgagagatgggagttggcaatttcagagattttgactgcatattcccattaagttagctctcactgcacatgcagggatgcaatgtagaaattattccaattatcatgtctataaatcctacttatagacgataggtagggggaatattatcagtggatctgtaacccactgtaaagcatggtgtcatttattacttgttcctcataaacccccactctcacaggaagctcatggtgatacatgggtgtctgggtattcatgtcatatcagaactttgtgttcaacagttttcaaaatttctactcattctcctttcctcatcgtacagtcaactgactaaatggccataggttcttttggagaagaactgggggaataagtgtggataagcttaccatgcagttgcagaatacttcctactaagcattcagactcctcttcagtcaatggatttcacaagtgaaaactaattaaggtctgggaactgagaatgtggcattttggttgaggtaaccactctcacacctacatgtgcatcattgttgaagatcccaagggataccattatctattaaccatcgacacaattcccagctggcagtctccttgcctgcccttccaaatttgttatgtattacagtaattgcagccttctggctcctggtaattaagtactgtcaactggcctctattagtgtggggtcacatggatgttgatgaactcagcactgtaatcactactcctaatgttttacctagccggcaatgaagagacattgcttggcttcctgtagcaatgctggcattgctacaccaacacattcctaaaatgcaattctctggcagcgaggtgaggaaaatagccagaagattgtgttccactgggaagacaaaaagaacacaccacttcccaaggatatgaggaatgccagcatgcacatttccatcagcctctgtcttctttggtctactgggagacaggacataattacacacttcatgtaaatataaaaataattacctatttctgtcagctcacatccttaatcaagcagcctcgatattcagtatctgtgatactcccatggttgactgtaatatgtcagtcatgagtatttaaatactcactaattctgtacctctaaatacttgatactttattttctgctcagctatgtttatcttacaactacaggagataaagtactactcataagctgcaacataggcactttgactctcaaaatttatctgatattaatcaccttaagtctctcatccctctgcagaatgtcagaaataaccagccatcaatgctatggtccataattttctagtacctggagcattgcccctgcaagcgtaactctcgcatgtgtaacatttcccagggcacctcagtgaagtatttagtaaacctccactgccacactatatatgccatacatacaactctggatatcatcatgtcggctaaccatgtgatgagtaagcgatttcagaatgcagcctctttgcttcagatcactgctggaaccacatgctttagtttgagtcctccaagaagcaaagaaaatagcattaaacgtgcaagagatttattaggcaagagagaatgggtgggagcctaaaaagttcaggaaagtcatcacaccatgaggcagggctgactcagtgagaaacgtcggatagaaaaaaaagaaatcttatcgacagtggtacagtaccaacaaagatatagcaagaacagtgataagttttcaagcctaagtcatctgttgtaaactaaactgaaaactaaataaaatcctaagtcccccaaccaactgaatggatccactcttggccaaggggaccctaaagaaaccttaaaacttgagttccgggccgggcgcggtgcctcacgcctgtaatcccagcatgttgggaggctgaggctggcagatcatgaggtcaggagattgagaccatcctggctaacacggtgaagccttgtctctacaaaaataaaaaataaaaaaattagcctggcgtggtggcgggcgcctgtagtcccagctactcgggaggctgaggcaggagaatggcatgaacccgggaggcagagcttgcagtgagccgagatcgcgccacagcctgggtgacagagcgagactacgtctcaaaaaaaaaaaaaaaaaaaaaaaaaaaattgagttcccagccaggatgggatgggaagcctgacacatcttgttacagcccctaccttttttgtttagatgcaacaactgaccagcattaatgttacaatagaggtcataagactaacggaacaaaccatctgcggcaataagatatcaaattataaacaggacctgaggtcatgccaagcaagggttaagccatacaccccgtacgcttaaagaacaaactatgctctaattaccacaaggcttttctttttctctggcagctaaacaagcactagccttgagataaaacaaaattcaaacaactgaagctcattaccagtcactgactatctgaccctttgttccacaaaccataactacagcttggattggacaagagactgatttctataactctccttagaagaggccactaaccatgaactgtttctggccagtttcacagggctgcacattaccgtgccttcctgtccctgcttcaccttttgacatgtaggatctaattgcgatgccttcaaatgttttcatggccgggcgccgtggctcacgcctgtaatcccagcacttttgggaggccgagctgggcgggattgcttgagctcaggaattcgagatcagcctgggcaacactgtgaatccccgtctctactaaaaatacagaaattacccgggagtggtggcacgcgcctgtggtctcagctagctactcgggagggtgaggcaggagaatggcttgaacctgggaggcggagcttgcagtgggccgagatcaagccactaccctccagcctgggtgacagtgagactccgtcttaaaaaaaaaaaattttcatatgttacatacgactcagtgaacatgagttatatgtaacatgcatggttatttggtatgcatgtgttagaaccacttttataaataatcagaaatcccccttaacctactgaatatgtatacgtggccaacccattcagcataaatccctgtttcactctcctctcccttgaagtgcctgctaatctcctctgctggaggctaatattcccagcctgtcggaagggcaatcttgaagattgtgatgctttacaagaaataaatagaaaagaaataattctcctttccaactttatgaagacctctggatttttcagctgataacgtgtgttatatctcccaggaatgagatatcttcactaaccctaacagggacactcagtccttgctgagaggatcctattgaaagtatgaccgtgctgagtgtgctgtaatggacttcggggcacagcaactgtgtccaatgctcaattatgtttcctgcagtcagatatctgataggcacattttcacgacaatgattcctatttcctgacgaggtttcattagcatgcaacctctgcagtttcataaggtcccaagctgaagagactttacacttcatttaatgcttcttaaatttcttaatgattttaaaagaaggagccccaccttaggctctagaaattatataattagtcttatgtgttattgtaactataattaacattctaagaaaacttggtcattttcacctagagtagtgtatttttgaataagaagtaattttcacttatcagtctaacatgtatctcaactgatatttggtctattatgacttgcaattactctgttattgtttctcatacgctccaactctaaaatcctcctagatttgttttctcatataaaatatagtttttgttatcacccatgcaaatgttacttacattccaacagtctcatgattctatagtgaattttaccttcattcaaacatcaaatttgtgtaaagcacataattagtccagctttttagaatattatactcaatagaatttacttttgactcccttttgtgtattttagggaatacctttccaaaatttgccattaccttcgattatctgggcatttcattcaagtttgatttctgagtttattccttttgtattttgatatatgtttggcacagacctcaagatataacaaaatataatttataatcacctagattatggcttaaaagtaactaactgtattagttttttcttttgtataaagttctaacattgcctggtcatcataaaatagtgcctttttcagaacaatgattattttttttcttcaagttggtttcgcattgcttttcttcagaccatttctaatataattttattacaatgtaagttttccttttcatgtttaatgtttagtattccctttgaaaagcttgattaatgtttttctatttcaaattcttgttcttaagtcttttcatcttgtcattgtgttttttattcagttcataaagccaaaatttttaaaattctttctccttgtattttacaagaatattattaaagctggtccctcattctaacttccaaatataataatttatcttgataataaaggcctcctttttatacacattggctaaaaggctgccttgtaagcttttaccgaatccagagtttgagtcatttaaatttatagtcatatgcaagacttactctatgaactaactagaggtgatttgaaaacaagtagcgaaagttaactgtgaggttgctgtcaaacccctgtgaaaagttgggtactacggtctgaagtccacaggctctgtcatctggagaacagctggagtgacctcttgccaggagaaacctgagtgtgagaatctacatgaacatgttcccccagtcaaccctgtgtttgtggaaaccattgcctatagaaaatgctgcatcagtggtgtagctttggtcaatgttgcaaagcttctatccactgtgttgaggacagttcccatcattttgcagtgttttgacaaaaacatcaacaaaaaatgcttttacatggtaggctgcatgatacacattgatgaaaaatcaggacaaatacagtcccagctgtctgtatattttgaaatagggtgagagaaaaaccttatatgtttagaggcctttggtcttgctcatgttaacgcctgtttattggccattgtgcacacatcgcctaaagtggatgtagtctcaataactattaagctttgccaacagcccatatttatttggtgtgatatttactctcttcccaaagcttattttaacattttcaggaagcttgtgccatgttttcaaaaggaagtgattaaactggtctatttgtacttgctttaatctagtctcatttgcaatggatacagttaaaattgcatattgaattttgtcatggggattttataatttcaaaaattcaaaggacctaaatatcttctatacttaatttctttggtcatttttgttagctaactgatggtgggaagagtaaaatatagctcataaacaagcatatgttttggaagtgtggggttcaaatggtcattagagaaacatttttgaatgtggtcaaaatgagcactagtataaaatcaatgagttcttaataaataatattttattttatctattcatgattataaatgcataattagccactgcaaatgctaataggcatgtataaagagcttttaattcccttttcaagttaacaattgaaactgctagtgaaatcaaagatcagaagatatatggatgtattggcagatctattctactctattaatgccaaatgtctggattgattataaattcttatgtcctcaaaaggtctgttaatacttacttctaaagatgaaacatacatgtaactgtgttttattttctttattattttgaattttgttttttatctttgaatttctactttatgaattttatgattaatatgcataggtatagaagttaaattatattgtataatttaaaagttctcatgaaagtgaaataattccagtaagatacactaaaatgttcaaatttataattcaggatgaaataagaaatcattataatgggtaatttggaagaacatgaaataggtaatgcactgataatgaaaaagatttaaaaaaagtttgagtaatcaagagctaagctatattgaagataaaataagtttttttttctattgacagaggataatttgcatattggaatcaaaagaaaaagttccctgaaaaatcatgattcttatagtaatgactataattcttataatactttcgatttacatgacatttctaattaagatgaccttcatgatacatataaaacagcatctagaatatatcagcaattatcgtataataagcacttaataaatgttaggaatagaaggctttaccaattcattttttagcaggaagtgaaattcaactcaatcctttttttaagaaaaaatagcaataattttgtctgcatctggggaatcacaggatatagttgctttatgcactactagatctattgcccttttgaataagtcattagtaaatctgatttttctccacttttcaactaggttcctttcacatccactaaagtatattatagtcatattgttaggggtaggtctccaagttactgacggtgaatctgtaggggtctgcagaaacctcaattcatgcctcctcagaaaaaataattcaattgaagggaataagacagaaaaagagaccaaggcaagtttcagagcaggagtagaagtttattaaaaaactttagaacagaaaaaaaaaaaagaaactacacttggaagagacccaagtgggcaacttgatggacaagtgtggcgtttaaccttgattctagaactatacatgcttgctcacctccagtggcttgctcccctttcccttcatttttccctaagggcaagccacccacatgcacagtgctctccttacacttgggaggtgagcacgcacagtgcgtttaggaagttgtacacatggccatgtgaggttttcttcccttttctggtggaatgcctccagaagaccatactccgtcattttgtctcttaatctgcatgcctgggctcactcgcccaattcctgaaattttattggaagcagattcattactaatctcaagtatttttatctgtttggaaagttgcccctacctggtgcctataatcaattaacactttagtgtgacatgtgtggaccattagaaaatggcctctccctggcactggctgccaaattatttttagtgaagcagtgtgataaccgcagaaccatcacctgatggtcacctgacattcgtggtgggtggaggaagggagaggcctctcctgcctcgctcatgcctgtctaactacctgtaactacaatattgcattaggacattctcgcatggctataaaggcatacttgagactgagtaacatataaagaaaagaggtttaattggctcacagttctgcaggctgtacagaaagcatggtgctggcatgtgcttggcttctgaggagccctgggggagtttttattgatggctgaaggtgaattaggagcaggcacatcacagggcttgagtgagagcaagtgggttgggggcaggtgcaacacacttttaaacaactagatctcatgcaaactcacttgctatcctggggatagcaccaaggcgatagtgctaaatcattcatgagaaatccatccccatgatccaatcacctcctacccagccccacctctaacattggggattacatttcaacatgagatttggagggacaaataccaaaatacatgaaatatgaatttaaaaagtggaggatttgattcaatgaacaaccacccacagctttgtttaaaagtatttacagaaagagttgtttttgtaaaacaacatattaaaatagcataaatttaggatatctttaaataaaagttgattaattactttaaataggtaatattgagagaatgaaaagtcagtatgcagtgaactagaagcaacaactatattacactgaggtattccctagaataaaatacgaagaattaaaatagaaatcacattttgcaaaagtatatggcctaattttcttttaagatgggctgaaatcttcctggggagggaatagatctgtgatttttattgtttttgatttgatgagttagagtttataggaaaataagagcagtgtgaagttttttaaaggaggatcagaaactgaacataaaagagaagtaccagggaagcatagaattgttaagacatggcatatccgttagcataataaggggaataaagagtaaagaatgttgtagttactttatttgaatataaatatgttgttttttgtgcctgctaaagtgacagaaaaataatgaacaaaaatacatcaagtactgtggcttgtaaaacctttgttaaataagatagccttccaaaatcctctacaatgctactttatttcccatgcctacaaaaggatctttgctgtctgttactgggttcaaaatgttccttcttcttagcatgatattcttaaattaatatgtgataatttatgtaaaacaattttagtttttgcataggcatcaagagtgttcattttcataatatgagatgatacataatttttaaatcttaagcttacttatacagtggtcctacaatgaaattctccagcttcaaattcattcatagccgcactttttccttggatctgaaatgttctgaaagtaatttaattgtctctctccactacttagtgaatcatattagtgactaaagatctctgaataaaggtgaaaaaggcactcataagtactgagtcaacatgaggaaagtattatgtcattatgataataacacaatatatttgtacagagctttatagtttatgaggtgcttttatgtgctttaaatcatttgatctgtaaaataactctgaataagtaagggtattttttattgcacattacagacatatcagcctaaagtagtgtaagaatttagagaaatttggtggctggcaagatggccaaataggaagagttccggtctgcggatccagcgagatcaacgcagaaggatggcgatttctgcatttccaaccaaagtatctggctcatctcattgcgactggttagatagtgggagtgaaaaaaagaaaagacccatcaatgtgctgtattcaagagacacaaatcacgtggaaagacacacataggctcaaaataaagggatggaggaatatttaccaagcaaatggaaagcaaaaaaaagcaagggtggaaatcttagtctctgataaaacaaactttaaacaaagatcataaaagacaaagaagggcattacatactggtaaagggattaatgcaaaaaaaagagctaactcctaaatatatatgcacccaatacaggatcactcagattcaaataaacaatggggaaatattccctatttaataaatggtgttgggaaaactggctagccataaatcaagttcttagagaccaacaaagagacttagactcccgcacaatatttgtgggagactttaacatcccactgtcaatattagacagatcaatggaacagaaaattaacaaggatattcaggacatgaacttagctctggaccaagcagacctaatagacatctaaagaactctccaccccaaatcaacagaatataccttcttctcaacaccacatcgcatttattctaaaattgaccagacaactggaagtaaaatgctccttagcaaatgcaaaagaacggaaatcataagaaacagtctcagaccacagtgcaatcaaactagaactcagaattaagaaactcactcaaaacctcacaactacatagaaaatgaacaacctgctcctgaatgacaactgggtaaataatgaaattaaggcagaaataaataagttctttgaaaccaatgagaacaaagacaaaacataccataatctctgggacacagcaaaaacagtgtttagagggaaatttatagcaccaaatacccacagaagaaagtgggaaagatctaaaattgacaccctaacatcacaattaaaagaactacagaagcatcagcaaacaaattcaaaagctagcagaagacaagaaataactaacatcagagcagaactgaaggagatagagacaacacacaaaaacgctttaaaaattagtgaatccaggagctgttttttttgaaaagattgacaaaatagatagaccgctagccagactaataaagaagaaaagagagaagaatcatatagacacaataaaaaatgataaaagggatgtcaccattgatcccacagaaatacaaactaccatcagagaatactataaacacctccatgtaaataagctagataatctagaagaaatggataaattcctggacacatacaccctcccaagactaaaccaggaagaagtcaaatccctgaatagaccaataacaagttctgaaattgaggtagtatttaacagcctaccaaccaaaaaaatcccaggaccagattgattcacaggcgaattttaccagaggtacaaagaggagctagtaccattccttctgaaactattacaaacaatagaaaaagagagactcctccctaactaattttaaggccagcgtcatcctgataccaaaatctggcagagacacaacaaaaaaagaaaatttcaggacaatacccctaatgaacatcaatgcaaaaatcctcaataaaatactggcaaaccaaatccagcagcacatcaaaaagctgagtccaccacgatcaagtcggcttcatccctgggatgcaagcctggttcaacatatgcaaatcaataaatgtaatctatcacataaacagagctaatgacagaaaccacatgattatctcaatagatgaagaaaagaccttagaaaaaattcaacactccttcatgctaaaaactgtcaataaactaggtattgatggagtgtatctcaaaataatatgagctatttatgataaaccccaccaccaatatcatactgaataggctaaagctggaagcattccctttaaaaactggcacaagacaaggatgccctctctcaccactcctattcaacatagtactggaagttctggccagggcaatcaggcaagagaaagaaataaatggtattcaaataggaagaaaagaagtcaaattgtctctgtttgcagatgacattattgtatatttagaaaaccccatcatctcagcccaaattctccttaagctgataagcaacttcagcaaagtctcaggatacaaaatcaatgtgcaaaaatcacaaccattcatatacaccaataacagacaaacagagagccaaatcatgagtgaactcccattcacaattgctacaaagagaataaaatacctaggaatacaacttacaagggatatgaaggaccttttcaaggagaactacaaaccactgctcaaggaaataagagaggacacaaacaaatggaaaaacattccatgctcatggataggaagaatcaatattgtgaaaatggccatactgcccaaagtaatttatagattcaatgctatcttcatcaagctaccattgattttcttcacagaattagaaaaaactactttaaatttcacatggaaccaaaaaaagcccatattgcctagtcaattctaagccaaaagaacaaagctggaggcatcacgctacctgacttcaaactatactacaggctactgtaaccaaaacagcatggcaatggtactgaaacagatatgtagaccaatggaacagaacagaggccccagaaataacatcacatatctacaaccctctgatctttgacaaatatgacataaacaagcaatggggaaaggattcgctacttaataaatggtattgggaaaactgaacctggaccccttccttacaccttgtacaaaaattaactaacgatagattaaagacttaaacataagacctaaaaccataaaaacccgagacgaaaacctaggcaataccattcaggacatagacatgggcaaagacttcatgactaaaacacaaaaacaatggcaacaaaagccaaaattgacaaatgggatctaattaaatgaaagagtttctgcacagcaaaagaaactatcatcagagtgaacaggcaacctacaggatgggagaaaatttttgcaatctatccgtctgacaaagggttaatatctacaaggaacttaaacaaatttacaagaaaaaaataaacaactccatcaaaaagtgggaaaaggatatgaacagagagttctcaaaagaagacatttatgtggccaaaaaacataaaaaaaaagctcatcatccttggtcattagagaaatgcaaacaaaaccacaatgagatgccatctcacaccagttagaatggcaatcattaaaaagtcaggaaacaacagatcctggagaggatgtggagaaataggaacactttacactgttggtgggagtgaaaattagttcaaccattgtgaaagacagtgtggcgattcctcaaggatctagaaccagaaatatcatttgacccagcaatcccattactgggtgtatacccaaagattataaatcgttctactataaagacacatgtacacgtatgtttattgcagcatttttcataatagcagagacttggaaccaacccaaatgcccattggtgatagactggataaagaaaatgtggcacatatacaccatggaatactatgtagccataaacaaggatgagttcatgtcctttgcagggacatagatgaggctggaaaccatcattttcagcaaactaatacaggaacagaaaaccaaacactgcttttctcactcataagtgggagctgaacaatgagaacacatggacccagcgaggggaacatcccacactggggcctgttgcagggtgaggggctaggagagggataacatcaggagaaatacctaatgtagatgacgggttgatgggtgcagcaaaccaccctggcacatgtatacctgtgtaacaaacctgcacattctgcacatgtatccgagaacttaaagtatattaaaaaaaagaatttagaagaatttatataaaggtcttcatctgatactttgaatgctgtggtcagaaatgactgaagaacatacagacagcagctaaaaagtactctctctatctctctctctttctctctatctgtaccctgctttttcctattcctgtatttgctctcatcctcctgccctcctctatttctacttattttattcattctagttttacacatttatcaggtatgcagtatagaaaatgtctccactggtagactcaaagctttatgttttgggaacagacaaagaaagacttctctttctcaataccctttcgaaaatattttgtgaagcatcccctagaccagcaggaagcttctgcaaaaaccattcagatgagtggaaaatagggacaagtccatttcacagagggataaatgagtcttattctctaagaatatcacaaggtacataagaatatcaaaccaaatttataaataaggagccaggtaaggcccagagatcttaatttattttcaacacattgtataaaattttatccaaaatatttatataagactatgtgattaaattaatttggaatattacatatcacatataaacagttattaagtgattgcaaagtagatgtatgttataatttttacaactaacttaaaggacttacctagtcttagtttttaacttatagataattgaatgaatagacaaatatatacatgtatataacactagacatacacatatgtatgtatgtaaatatatgtgtatatatacatatatataatttatagtcatgcgtatatttctgtttgttatttgcaactctaatggaaactaatatgtattgattaaaagatctagactgatatatgttgaatatgaaaacaactggttgtggtggcacaatgctttagtcctcactacttggaagactgaggtaggagtattgcttgagtcctggagtttgagactacagtgcactatgatcaggcttgtgaatagccgttctgctccagcttgggcaacacagtgagactctgtcactaaaaagaaaatagggaatggaaatttataactttaaagttaacagtatactatttggttgtctaagttgatctgtatccaaaagaaaaaaacaccaaaataagccaaattagccatcatggtggtagtgttacctaaacaccagggggttagtctgggtcctgctgctctccacacagaaagccaatcactgacacaatgagtattgccaaacaagaaggctttatttggtgctgcagctgaggagatgggagatcagtcttaaatccatctctttaactgattaaattaggggcttagagcagaaaagaaaatgtaacaatatataggagaacaggaattcaggaggggtaaggaattaatcataatgaatacggggcctgtcatctcattgtgtgtacactatgatctggtgaatttcagttctttgatgctttttgagagacctggggatcctttgctgaggaaggaactcagataaaacaaatttaagttccaagcttaagaacagattctcaatttctatatttatcaaaaaaaaatggtctatgagactattgggtcagtttcattaagagacttacatactctaataaaagatgtaatcaggtgttctttgttctgaagtaactctaatttgctacatagtcaatatatttttgaatatttcctgtatgccagtcgcttatctacctgccttccaattattcactcaaataacatcacatggtagtctttttagtgctcaaacttctctaaatttttgtaagacagtatgtttctaaatttatttcccatttagttagtcttagagcctgttgttttggctatcgaaaatattacaggtagtagaatatcaaatagtcaagtctcctgtcttccaaaaatatttctggtatttctcagatacaatatttaatactcatagttattccataacaattaaccatatctatagttggaatacctataggtaacatcatcttgcaaataacaatcattcatgcaaaactaatttgttgatttgctttaaaagtgctacacttcaagtaaagacctacttagataatacaataatattcattttatttttaatgtcatgtgtcatgtggagggaaaaaacttttcacattttttcaaataatgcctaggcactctgctgtatgaagacacttatttgataattttatctgttgtcatactccaggtagggacacagatgaacatacatgtacacccacatatgcatttttttttgcttttctcaagtataattttatgttgtgacctttatttatttttttatttttgagttggactatcactttgtcagcaggttggagtgcagtggtgcgatcttggctcactgcaacctccgcctcccaggttcaagtgattcttatgcctcagctttccaagtagctgggattacaggcatgcaccaacatgcctggtttatttttgtatttttagtagagacagggtttcgccgtgtttgcctggttggtctcgaactcctgacctcaagtgatcgcccgccttagtctcccaaagtgctgggattacaggggtaagccacctcacccagccttttacgacttttaattaactcattttcttgtcaagttgtttaaataaatctcatattcgtaaaagatttttcagcttgtagagagaagacaactatcagtgtattttacagaaacaaccattctctgtatgactttatatacaaatatgcaaatatttgatgaaataaaagttgcagaattaaaatgtttaataatgaattagaagtaatcatatcataatggttgaggattcctaatccaaatatctgaaatcaaacataatccaaaattcaaaactttataagtgttgacatgactccacaggaggaaagttccatatttgacctaatgtgatgagttgtagtcaaaattttgttttataaacaaagttattaaaaatattatctatcacgcctgtaattccagcactttgggaggccaaggtgggcggatgacctgagatcaagagtttgagaccagcctgaccaacatggagaaaccctgtctctactaaaaatacaaaattagctggacatggtggcacatgcctgtaatcccactactcgggaggctgaggcaagagaatcgcttcaacccgggaagctgaggttgcaatgagccgagatcgtgccactgcactccagcctgggcaacaggagcaaaactttgtctcaaaaaaaaaaaaaaagtatctaatattacctgcagactatatgtacaaagtgtatatgaaacataaatgaattttgtgtttaaacttgagtagtattctataagatgtatcattatgtatacacaaaaattccaaaatcccaaaaatccaaaactctaaaacacttcttgtcccaagcatgtcagataagggatactcaacctgtactaccacattttagacttctttcaaacaaagcacttaataacaattgttttaaaatagaacactgagattatggcaagtagaattaaagatgtatattgataagtgactgtttgagaaatgtatttatttttataattttgcttaatgtcaactgtattctatttatgtaggtagagctctcatcatacagatcgttggaaagtagcatcccgacagttctgagagaaaaaaagtgagtatgcataaacacaaacacatacacacacacacacgcacagtttcttttttgccattattacgggctagctatttactttgcattgtcattttctgacttctcttggacttctgagcttcagatacctgatcaacattgtgtaaaggagacaagaagaaaagaaattgatttgtgctggccgggtacggtggctcacgcctataatcccagcactttgggaggccaaggcaggcggatcacgaggtcaggagattgagaccatcctggctaacatggtgaaaccccgtctctactaaaaatacaaaaaattagccgggcgtggtggcacacgcctgtagtcccagctacttgggaggctgaggcaggagaaccgcttgaacccgggaggcagaggttgtagtgagccgagatcgtgccactgcactccagcctgggcaacagagcgagactccatctcaaaaaaaaaaaaattgatttgtgccttaatgcccacaactgtgacacatgacatcttctatattcaatgtaggctgaaaaattatatttttaacttttaaagaatcaatagtttaacaaatatctcttcatgaggttggaaatgatagatcaaaaagctttggcttttgatacaaaccatgatatacaacacctcttgaaaattacttttgtaatcaagacatgtaaacacctgtctctctctctttcactccttctcgctcactctctctctctctcacacacacacaaacacacaaaggtaaatgcaaatatagtaacacataaattactggaatttcacttatttgttccatactcttttagttactccataatatggctttaaatacaattaagtgtatttccctactttttattaagttcttctcatgtccttgtgttaatgtgtgtcctacctcaagatacttgctctgccaaaaaataagatatttcaagatagaaagttttgaccaacttttataatggaacccaatacatgaagaattctctctttaaaaatgtttttttttctacaaagaatagatttatgttttattgttagcaaaattagcaatctattattagcaaaattaatgaaactccagaaaacatacagatcaggtattatttgctggaccaataatgactggagtactaaagtgatcggagtggaagttaggtagtaaattaattaataccagagactaaaacaaggtataaaaaacacaatgacagaaaggaaacagagttatcttttgctgaacttagatgaagataataaaagtaaaagtttgtcctaagtgaaaacgtaagtcaagtcacaagaagaaaccaagaataaaactgcgtcatacataagattaaatgcacaattatacacagagtaagagagcataaatattccatgagtagtcccaatagcaataccagttataatagtcaacagagtctggaaaatattgtagtaaaaacaatgaaaatgtatcagtacttcaaaaaagaaagtgagatgtttcttctccattgcaggtatgcatgaaactttgtttttatcctctgcctattttctaatctgacagaggttccaccttctgaaatcacactcgttaaagcagcaggaggagaggacatcaattactaggaaatgttgcttaaatacttcatataattttccctcatatccctttggtcatagtgactcatatggccactgccaacattagtgatgatatggtttggctctggttctgtgtctccacccaaatctcacctcgaattgtaatccccacatgttgagggagggacctgtaatccccacgtgtggagctgcaatccccacgtgtggagggagggagttgactggatcatggtggtggtttcccccatgctgttctcatgataatgagtgagttttcataaggtatgatagtttttaaaatgtctggcatttcccttgctttcatttctctctcctgttggcatgtgaagaagatccttgcttcccctttgtcttccaccgtgattgaaagtttcctgagctctcccaagccatgctgaactgtgagtcaattaaaactctttcctttataaattactcagtctcgggtatttctttatagcagtgtgaaaatggactaatacaaatggatattgtgattatcttttatgtcgatagtttgaggaaaatgttagtaatgtatactatagcagtgattgtggtaggtgttctgtaaccatttgttataggcatcacaacacactcagattcatatgctgaagtccaaactgccagtactgcagaatgtgattgtatttaagagatagggacactgaagaggtaattaagttaaaatgagactaatagtgttggccctaatacaatctgattggcatctttataagaataaattatgatgtatggggaaacaggaggggtgtgtgtgcgcagagataccactatgtgaaaagacagcaagaggaacatcatctgcaagccaaaaagagaggtttcagaggaaagaaccctgatcgcaccctgattttggacttcgacactttagaactatgagaaaataattttctgtgttttaagccactcagtctatgagattttgttatggcagccacagccaacgaatataccagttgtactgaaattattggccatttcatagataatagacaatgtttgagattcttattatgagaaccacatgagaaatttttaaatgaagcaaacaactttataaaaacctggcaaattatttaattattttctcaagttaaactacctttctatgaacatggcatggtcattcctacctctgggtttatatgttatatttatgctgctgtgtcagtttcccattgctgttgtaacaaattaacatggaatagtggcttaaggcaacacatatttattcattaactgaaagttcaggaggttaaaattcaaattgggtcttattgggcaaagttgagaagttagaagaactgtatttcttctggagtctctgtaggctactcttattttctttactgtttcagcttctagaggccatctgaatttggaattttgaacctgtcgttcatcttcaaagggaatagggtagctccttccaaaatatttcagactctaaagtctgttaccacatctcttactctgatgtttctgtctctgttttaatttcatttacaaacacccttgtgattatgttgggtctgctctgatactccaggatactcttcccatctcaatatccttagattaatcatatctgcaatgattcaccatgtaacataatgtattcggggtttccagaaattcaaccattattctatctaccatatatacctagaacattctttttcccctttgcaccttcttataatatagatctcagattatttcctactcaggaaaccatctcttgccttagcgaacccatcagatctctgtgttataaatggttatggtattttatgtatttccgttaaactgcttaaacgtaatcacttgatataaataattctatatttattattttttcttgtttttcttcatagaacatatgatgggagggacaaattctgccttgctcactgcagtgtcctgaatgccttgcacagtattttagtgataatatttagcagatgagtgttgattagataaaaaactcacactgtaatgaatatctattaatactttaattagaatgaatttattttaagcattttaaatatatttgcaaacgatcggtgttacttcagaaaataagaaaatatttggagtcatacaaacctatggccaaacctcacttatttaggtcagtttctggccatacaatcttatacaagatatggaatgatatatgtaaaaaagggatggttacatactctaagattctttggcaattaaatatcaaaagtagctcctgtagttcctgggcacattttgagtactaaacgaatcacattcttcaaaaccgttttaacttgaataaactttatattttctatcatacatttttgttcttcagtattttattgttcagttgttaaaatcttcataaattcacgttgtaatcatataattctgtgtaaatctagccaaataacaagaggttcctatagtaaattttagggctttctagggccagatccattgtaaaactatactccaaaacagaataaattcacacatattttaactaggaaatatagcaagtaatgaaagtcaaaattgcatattaatgtatttaaatttataagcttatatactgattatgttctttatgaattctatgtatgttattgaaatatttagtctaacacttggatcaattattatttgctatgtgtttttcttttgttagtagacataggtgtttggcagatcaaaaatatgcctaattaaactgtgaatcaaaacatctaaaacttggtagatgctcaatagatgctggtgaatgaaatatatgacttaatattatatcatatcatagttaatataatttggtatctatcaagcatcaggggaaaaattttatgtctctcaaaagacagaaaaagttcactcataccccattataattattgcagacaattctgatgccaaaagaaaatggtttacatttctgtgatcttaggtaaactaatataagctatgcaaaactaaacacagagaaaagaaattcattttttaaaatgctgaatatattcattgcatttgtaaaactggtgcataatttgttgtgaagccatagatgcatgcataccttaaatatttataaaactgactttatgtcttaaaatgtttttctatatataacagtgggattttatttcttctattttaatcaattactatttttaggcaaggtctttttattgatgctaaaatgtcagggttcctgatgatgtctattaatcatgaactttatgagatgtgctactaagtgtacactttttaaataactaggtccgtaccacttgattcaaagttggagcatgtattcatctgatatgatgttgtattttggacaaaaatattttgaattcagcaagtatagtaaaaattaaaccaagaaaagtaattgaaaaatttaaatcttcaggtaattaacctcagggtcttcttctactagaagaaaatcaaatacatttatttatattgtactataatgtaaatataaatcacactaaaataaaatataattatattagcaacttatgtatttaatacattttctatattctttgtttcctatgcaataaagatgataatttaaatgttttgcagataaaataaaataatgctatttttagttattttgaatttttagttgctttctttattaaataatgatgaagtgaaaccagctccctattttctgctatatagacacacagctcctcctacagctatatgttatacttaaaaatttagctatttttattctcatagtcttccaataaatggtctctgaaatagtattaaaataatagttttctgtagttgatactttggaatattgctgatgtgagtattcatttttactcatttattttgtaattttagataaatgctatacatattcaatgtgcatttctcaaagtaagcatgtagatttaagttaatagttaatatagcttgaggcaaaattattatcaaaatactttataaatgcttcagctgagcattttaatacacatctgaaacaagttaaacattatcccaagagttcactctcaattaaagctttaaaaaagagataacataaattataaatcagtattgcacaaagcatagtattataatgtcatggttgtaagaacaataaagctttaaatttccctacaggctactcttgcctatttggaaatgttgttcaagttatgcattgcctaaagggatatattcgctatgaacaatactttataaacaaattgatgttctgtatcacaagttaggatttgattactgaaaatgtatataatgtaaagctaattataaaaccccaagatttaaatgtagttttttcagggatttacattttttctaattaggaagaggacttttcaatatgcagagagctagcattgtgcttctacgaaatagtaaaatagctcaagccaagtaacgctttccaaaatttttctctaacatttctatgtggctttagagaaattccaaaatagtgcttaggatcatattctacataatgcttatgcctaaatgaaaatatgcatcacttttctttctgaaaatgtcttttatgtatagagatgctgtatttctaattagtgattctataattagcaatctaattttggctactcttgagaaataataaaatgaaattttcatttgccatttagtttccccgggaatttcccagccatgctaaatgactgccatggagccacagattgaattgaaaacaaatgtcacacacatttttgtgacttgtagaatgtcattaacattttgtaaaaaaaaaataacatattctctagtcttcaaggtgtttattattttatgcctcatgattctttcttattactttactactcttcttcactaacaaattcaaagctttttaggacaatctttatatcttaataaacaagaatattagaagctaatgtaaatatttacctacatctctgaaatgttcatatcccttttagaaatcttttcacacaccactttgtggtgctgtgactatctaataaaataaagaataaaaccctgtcatataaactctacaatgtagagcaacgttcatagaatggcatgctgtgaaaaaaaacaaagtacttttgaaatcaggccaattggagtttgactacagtcccaatatgctgtgtaactttatgacctttgctctctgtacttccattttctcccctaataaaacatcaacaccctttcttaggattatttatttcatgaaaaataggcaactccatgcctagcacatagtgctgttccatacttgtatttcttggttactttagaataaagtaaaagtggaaagatttcttagatgcaatataatcttagacttgatagttgaatggaaaattacagcagaaagatgagtggaagcaaagataaaatacacaaagctgtgttgaaacaaacaattacatctattaccacatacaaaatgactacaagtcaaaatgaataggctagaaacgttcatagtagtcaggttacgaagagccagaggaaaagatgtggctcttacactttaacatgtatctaatgcacaactatgggaaaaatttaattacaaaatggctaacattttggtagaattctctcacagtcctattatttgattacttcatcatcatttacttacttgataaatacatttattaatttattcaactcaaggattgatttatcaaaacaaagcaagtaatgaaggcagggagaatgtcattgtgatagcaaatctgagacatgctgagggattgagtttggtctgtgtaatagggaaggtgggaacagtatttcaaagaaagatttaaggtgtagtggtgtttgtaggatttcaataagtaataatcctgtctccttcctcaaatattccttcctttatttaataacacacattaaacatctgctatgtgacagaactccgttaagaaaatgtatctgttatgtgacgtaattcctgctttcaaagacctgatactttagaagggtggttcgaaggccaaaaaaaaaaaaaaaaaaaaaaaaaaagacttatatttataaatactatgaaaaagagataaataaagattacatattttttggagagcagttgcaaaaattatctcagtgaagatggcatttaaccataaacaaaatattaaaggagtaagtcacacagttatcaatgacaatagtgttctagaaagatgaatcaacaagaaaaatgcatgtaaaccatgaccaaatatgtattttgtttaaatcagtagttaaactattaggattagaactgaataaatgtggtcaaatagatggaacagaaagtaacagaaaaagcaaggaaccaaaacaatgtaaaaattcgtacagcatggtgaggaatttcatttttatacacagtgagattgaaaacttttgaacgttgttaatcttatagattactttggtttccatatggactagtttgtcagtagagaatagacgtggttatatcgaccagtggtttattaaaatggtccagggaagaaatgttggcggcttggactggagtacagcatagatgccattacaagtgttattttacatatatttaaaaggaacctgccataggacttattgatagattgcttagactagtgataaaaagagagaggaaaaatagagtcaagatgaattttgtgctaagaatatagcaattcatttaattgacatagggaattttgaaagaaaagttttttttctttcgtttattttcttgaaaggattttttaaaaattgcttgtggatacatcatgactatattatctattctatatatcctgttacagatagataataagtctagggctctgagcataaaacggggctataaataagcatgaaggagtcatcagtaaataggtgatatttaaagacatgtaactaaatgagttcctctaaggtttgaatgatcagatgcagaagaaggagagtgatcaaaatgtctgctttatcaataaaattatattcaataggagatgtgaactttatgcagagctaaattgtatcttcttttataatacgcttctgaatttaaattgtccttttgccagtgtctgaagctaccttgcaaaacttaatgcatgtctgaaaataaacaaacaaacaaacgaaacgaccagaatgcacctctctgcaggaatgagcttcaggagagagttgaagagaaaggtttataactaggcatttttcaattaacaattagttagggtattcctgacagtaaagtaatgaggagtaaggagagagagagatgtttttctcgtgtgttcttgtcatgattagtgaaagaataatattctaatagtgatgtccactggcattaaaatataatttcagaaaggagataaggctgagggaggaatttctgttaaatctctgattttctttgagggtctataaagaatagctatttcactacataacaagggtgctcaagagcgacatttattgtagtgaaaaaatccctaaaattatctattaatggtctcatgggggattagaacaatattttcctaatgtgttcatgaaataacacacttagaaataacatcagtttatttatttatctgaaactcaagattggtctcagatgtaattgatcagctgaggagtcagtgttgcaacttaggccaccccaagggataagagtagcagtatattagacatatattagacatacttgttttttttttttttttttttttctgagacagagtctcactctgtcacccggctggagtgcagtcgcaccatctcggctcactgcaacctccacctccctggttcaagcgattctcctgcctcagcttcctgagtagctgggactacaggcgcacgctaccactctcagctaatttttgtattttttagtagagacgggtttcaccatgttggccaggatggtctcgattttttgacctcgtgatcagcccacctcccaaaatgctgggattacaggcgcgagccaccaagcccggcctatacgtactctatttctaattaaggcttatcagtataccccaatgactcaacatattattagaaattttagaatttaaaaaattgtagaagaaataactatttcaaatattgccctgaacaaaataggacccttgccctataaataaaacatatcttattttacatttaccatatgaagaaatcgtccatgaagtgtattcatctacagatacctatttaaacatgtctagtgcctcaaaagcagaggtgtttaatagtaagcaaaaattacactcatcatttggccattcaaataacactcattatataactaagagaaatcaatacaattactatgtatccacacttgactgaccttgaattgaatgtattgatacagaaactaagcatgttgcaatgtcttcttaatgcttgatgaactccatcaggtgtaatcacttcttggcagattagaaacgtcttactcttttctcggctcaacacatcttccaggcattctttaaaacatgtaattgtgctgtatgcatatctattgaactctgtctaatattctgaggtgcctgtgcctatggaacaatagtacaatactctttggagctgcatgcctgaccaaccttttaagagaaaattctttatagaagctcagttggtacacgggcttaggttggggattctatcagaaacttctattagacttttaaatgtttgccactttgggactactacactcaggcctgcctttggcaatagagagcaagagtactggcatcactttcccgtaaaacacctacaagcccatattttgaaacatttttaaacttataataataactgaatacatttgtagtttgtaacttataataattggatacatttgtagtttgtaacttataataataattggatacatttgtagtttgttattattatattaataattaaaatatatggagagtatatacatatattctttttgaatgaagaaaatgagtttaaaaatttctctgggtaaagtcataaacatgcttaaaatctagacagatatatcaataacagctcttatagaatgctattttcaataatccttatttctgtatattttttacatgttatatatgccaagatcatttactgcatataatctctgaaatgagagctttaaaattagttgtgctcctactgtttcactttttaactctgtttccaagttactaaagcataaggattttagttggtaatccagtctgaatgatgtttcattacaactttgaagattgcctaatttgagtaggggattatttatatttagagcaatagatgaggatcaagcttagaaacataaagtgtgttaagataacagaagtacactgaggctaacttgtacctactaacaagttagttagtgttcaccctttctcaactccatgttcagtgatgtcacgtgggtagcattacatcagccatggtggaagaatttacagtacagaaatgggcaatacggtggacctttgaataacaggttgtgaagtactcacgtccatttataggtggatttttctcaacctaatgcaacaaaaatatatttgtggtatagaaaatctcacaaggatgaccgcagggcttgagtatggacatttcgtatatgtaggggtcctctgaaaccaatctcccatgtattcccagagatagctgtaattacaagtcagttcccttctcccttccacctcagggttagattttaacatttgctacccagccatcaatcacagatgtcctgtgttttattcttgacagtttaggtcaattttgtccaacccatggcccataggctgcaagcggcacaggacggctttgaatgtgacccaacacaaacttgtaaactttcttaaaacattatgagatttttttttggtgattttttttagctcatctattattgttagtgttattgtatttaatttgtggcccaagacagtttttcttctttcaatgtagcccagggaagtcaaagaccggaaattcctggtttaggctatatttgatacacagtaaatgaaattagaaaattttatacagcaaaaatttatttatgattgcttcagaaagagtaatgtggaagcttttctaagtgtaaatgagagtttttaaggaactagaggcagagggcagggcagtggttgctgcagtatcctaaagaaggatttgtaaatctccagttatggcaggagggcaaatgaaatgaagagagcttcacaaatgtgtgttcagaaaggttcatggacacataccaggttttaagcctaagcagctcttgtcaacaaatatagtaaaattgagaggaaagtgatttaatttataatgaaatagacataggtatatagatacaaaatcacatggagcagagagactatgttgtactttttttattattatactttaagttctagggtacatgtgcacaacgtgcaggtttgttacatatgtataaatgcgccatgttggtgtgctgcacccattaactcatcatttacattagatgtatctcctaatgctatccctcccccctcctcccaccccaagacatgccccagtgtgtgatgttccccttcctgtgtccaagtgttctcattgttcaattcccacctatgttgtactttttaaaaaaatatttcattctggaaatcctgaattggcctcaaattatactcatgaaggtagtctactctgcaaccattctctgagcatagcacctggagggaccaaaacaaaacaaaacaaagaaagaaaaatgaaaagaaaaagaaattcaatttttcccccagaagaaaattagagaacttctttaacaaatttttaacatatttcttttgattaaatttgctttttagtttctgctaaaaatataaaacatttttgaagattatgtgtgcattatgtcttttaaattctttccctggagtttatcgatttttaaaaattaatatttatatttatttactcatttatttgttttgtgacaggaggtggttttgtcacccaggctggagtacagtgccaccatcatagctcattggagcctctaactcctgggctcaagctgtcctcccgcctctgagtagctggaatttcgtagtgcaccaatacacccaggtaatttttttgtttttttgaaaagacaatgtctcactgtgctgccccagcctggtcttgaagtcccgggctcaagtgattctcccacctcagcttctcaaagcagtgggattatagccatgggccaccacactccgtcttttacagacttaaaaaaaaaatgaattatgtgattgaacacacagatttgggggccttaaatccaggactacttatgccactacagttgtcacttgagatctgtaatgaattagttacaggactttctgcggatacaaaaatatactgatgctcaagcccaatataaaaaatggtgtcatatttgcatataagctgcacacatcctcccaaaatactaaataatctctagattatgtataatacctaatacaatgtaaatactgtgtgaatagttgttatactgttatgtttagggaataatggcaaagaaaacaaagtctgcagacactttttattccccaaatatttttaattggtttttggttgaattcaggaatgcagaacccagcgacagtgagggccaactgtactgtgttgaacagactcatcacgtcccaggacataagcacatctctgtgggtttatttttatttttatttttttaaccaaaggtgcataaccagaatgtaaccaaaaaggactaattgaagtatattctacacagtaaatgacatgtactctgcaaaaatgtcaaggtcatgaaggctgaagaatggttccaaattgaaggagactgaagaaagacattactaaatccgatgaatgattctgaattgtatctgggtcagctagttgcttggctgctctaataaggaaggctccactggtcttggttccaagttgtaggttgagtctggtaccacatgttcacattctcagcagctaactgaagcacatttttccacagtcaaaattcaagacaagttcaactgcacaaggatatttcaagtttctgctcacttcacatctaaagtatctcattggctaaagcaagtcacaagaacaacgccaatgtcaaggggttcatatggatgcataatactgtcaccacagggcagtgaagaattgagatcaataattcaagctaccacactagccaagtgccttacacgttccttggctcactacatggtataacacacagtggcaaattcccatctcaagtgacaattagtgccaaccacattgctgaacccagggacaatgctgatactgaatgatctactactgtaaaatctttttactctgttgatgaagaggttgccatgccaatgttccataactatgttggttctagggaaacatagctttttggaaatttacatttacctattagaaagtctgcaaacatcttatagcagaagttccaattatatggtctggaaaagtaattacagatacgaccaaaaaagaaacaccaacaacattgtgaacaagggggtttagtaagcatgaaatatgagggtgacaaagtgaaaaattcccaaatttcctcaaaagtgtaagaaataaataattctgtcatttccatgacagttaaaaagaataaaaaatgaagtattgtttttaaaaataaagaaaaataaaacagtgaaaaaaaataagctagctttagagtcacaatgcccggatttaggtactggctccaacatgtagaaggcctgttaactgatataaattatctcacctattcaattcttaacatcctattctctaaatccagacaataggaagaatatagttcatggaactgtttgagaattaaaagaagtaatacatataattcccatagagtggtggctggttggccctatttaaaaagcgtttggaacttgtcactacattgaaattattatttaataattatttattatcaattttgagtacagtaatgaaatgtcatttattagttttaaaataaacaaatatattactgatcttaaagttcctaagacttagttatatattattatatacacatattacaacatatatttgatgataactatatacatatatactttactatacatcttatctatgacaatatacacataaaatattgctgccattagaaaaattattgtgtattttttgttaataaaataaatgtgataatctggttaagcatttggaagaaaaataaagattattcttcccagaaacattttagattattcttataaatactaatcactcatatgttaataaaaactgacatattttaacatgtaaaataaaatatttaaaggcagtcaaaattagttaaaactttcatcatgtgaggatgataacaaaaactataaaaattttgcaagttaacattctagaagaaaatcacatctttttgtaataaaacacataataaacttgaatgcagaggaatattgaaagattacattataataacttgttaatgaatttgaattatatacatttaaattttaattagcaaaaacagttaaaagtaacaatttaaatcctaaaatgtattattttttctcaagtataagtaacatatctagccaagcaaaaaaatgcatatagatgaacttctttgacctcgcagattagatcaaggatctaagtgctttccaataaaatatttttattaatttattttgctctacccttgattcgtgaacactacagatgaatcctgtaataattctttcccagttgaaatttgtttttggaaaaaaggtacttcacttacttgttgtattagctacctaaacctctgttcaacacatttcttaatgcaggcaggtataaattaatgtgttgtcttatcatgtattcaacacttactaacaccatacttagttaatgaatatcttctagatgaaggacaatgtgctagcaacatgaatggacactaaattcaaggatgtataatgtgagacattaatttggtatttcatcatttaacttcatagaatgtaagaattgtagtgcattatgaattactaatagcctgtaaattcttagggaaatgctctctagaacagtctgatacatcgcaatagttcattttcctttgcaatatcacaacattggcttttactattcattaaagaggagatttctaatatacgaaaggtgtttcaatgtttggaggaccaaacagtattcatgagaccactttaagtaatttcctaatatcctggaccttacttaggccttaggcctctctactgcctacattttcgccacagacagacttaattacctgctcaatcatgaacatacgtttcatcctttctaatctctatcgtctccatttagtgattttttttaactctaaaatttgaaaagtcatccccattatttataagtgacagggcaacttgcactcctccctctcagcctcctcaaatcatgtatacacacagaaatgcacaaatcgtcaatatactacaaactattggtaaaatcagaatgtactttctgtagaaacataccttccattcaattcctttgacttctttcgtaacagttagtcgttcttaagttcctgcagtgatcacattcatttttagttcacgtaaacatgaaaggctttactgactcacctgggaactgtgatctcaccaccactaagttatcctcatgcatttttattggttgtaataatgataacaatgatgttcaaaccaagaatatcaatatggcaatgtctgtgattactttgcatgtattgtttattcatgcaacaaaactaatctggctattgcaatctacttttaacaaataggtgagagagaatttaaataatttgcccaaggtaacatagtctaggctatttgttttattcaaatctatctaactatctatatctatctatctatctatctatctatctatctatctatctatcatctaattgtgtaaaacatgcattttttaactataattggatatatataaaatagtctgtgtatagttctagagatttattttatagcacagtaactgtagttaataataattatatactt

SEQ ID NO: 463 - DNA, 90292 bp, Homo sapiens
tgcatcctgcttttcagtaaaaaaaaaataacattgttaagtcatagggggatgacatcagtcatcctgaaaggggagatatgagcaaatgggtgtggggtgaaggcaggtgaggggaaccaagcttaagggcaaaccaagttttgtccagattatagttctttctcctggcaaaccaagtcctgaacctgtcgccaggctgttgtttaggctcagggcttggatggccaggagaaagaactgtaacctgggcaagacttcacattcattaatatcatcatatgtattaagaggaaatctgaattgatttacatttcaatttcattcagaaggccagtgggaagtagtgtagtctaggagatgagcagttcttggtgaagttgattctgtttataaactgaattacaggagaaagaagcagagggcagggcagctaggaggatacgcaggataggccacaccaccccaatgtgaacatgaaaaaggaagaagtaccttgtgtaagggagttaaaatccagtcactttctttttttaaaaaaataaaactagttaccctctgctgctgctttttctttttgtaaatctaattggtgtgtccttctgaattcagctaagatgactcctcacccagagaaagggttcatctcctctggctttttttgtttcttctattttcacaccagttttagaaaaggcagggccctcatttggaagtagcagacaaaatggcagtgcaggtttgtgcattctttcaaaagaattcttgatttttggctgggcgctgtggctcacgcctgtaatcctagcactttgggagtccaaggcgggtggatcacctgaggtcaggagttcgagactgcccaacgtggtgaaaccgcgtctctactaacaacacaaaaatcagtcaggtgtggtggtgtgtgcctgtaatcttagctacttgggagattggggcaggagaactgcttgaacctggagggtggaggttgcagtgagctgaaatcacaccacttcactccagcctgggcaaaagagtgaaactccatctcaaaaaaaaaaaaaaaaaaaattcttgattttcctttgaatgtgtcctgctggctttgtggtgtggaaacggcgtgagaaaacggctccatcatgctgttcgtgggactgactgttcccagcagtgtagaaaccttcctgttttatgcttagagcccgattccagagtccgtctctctatttgtcctgattgcagcaaaaacatgcagtctacatataatcagaggatcctgctaaacagttgtcagaaaaacaacggaaatcctagctgcttgtgatttcattacaccggccttgtagttgagttagtgaaagatgaatttattgagtgcatctagaacaggggcggcacttggcctaaggacgggtgatgtagagtacactttgtagcagttattggtgcgacatgcgattgagtattcgctgttgcaggtattctgtttattgtatttcacacaaggttaattcacggttttttttatgctttcaaagcaaaagctatacaatacaaaatgtacatgttagatttccatgtcataagtaaacaaacttttttttaacaattataattttcagaaacctaatgaacctataataaaatattgagaacaataatcttcagtcctattaggcatcgtgggagaacctgggggaaattttacttttccttctgtcagatttgtttgattatactgtaactcattaatggaacggttcctgtgtgtcagctgctgagcgaagtggtcactgtacatcatttttcgtcttcacatcaaaccctttgggacgggtcctattatgatccccattttacggtctgtgttacgtgaaccaatggactccactaaagaaaaatagaacatgaagaattgaaaagttttgcagtcagttcagtttttcatggagcctctgttttctccctgaacaactctgtcccttgaccacagtttctttgaaaattggctgggtgtggtggctcacgcctgtaatcccagcactttgggaggccaaggtgggcagatcacctgaggtcaggagttcgagaccagcctggtcaacatggtgaaaccctgtctctactaaaaatacaaaaattagctgggtgtggtggtgcatgcctgtaatcccagctacctggcaggctgaggcaggagaatcactggaaccctggaggcagaggctgcggtggactgagatcgcaccactgcactccagcctgggtgacagggtgagatctgtctcaaaaaaacccaaaagaacaaaaaaacaggggttttgtgctgtgacctctgctagtttcaccctagctcacttcccaagcatgtggtttcagttatggcctaggtagattattttgctcattcacagctagctcatacctttcttctgagctccaaacacacatagccatttgcccctcagtttctccatagatgtctaatggcactgccaactaactgaacattctttaaactgaattgatggtagcccctctgcactcccagcaacaacaaacacactgcattccaccaaattccacaagcagaaacctagttagtcgtaactccttcatctttgtaactttccattttcaatcaattaccaatttctatcaattttgcctctaaagatagttaagaatcttacagcttctctctatgcccactgctatcacccctgaccaggcctccatcatcttgtctgtgattcctgccataatcttatctcaaaatctttgaggttatgagttatacatatttcagtcttctgtttgctccattaactgtgtttctttagaattatactcttcagtaagtttagctccactttctcacaggtttggttttccccgcatgtctgctgcttcttggatttccactacttttttttttgacattctctgttctgctgcctgcttggttcacttcagctgaccccaggtggtgatggtgcattatttggagggtctgtcatttgcctttgggggctccctcttccttctgggagtcctgcctgcctctctgctctcatgcacatattcattcctactcagcaagcaacaactctttgccagacactcttctaggctgggggatccagcaaggtatcgaacgactgtgatagccacccaaggttgagtgtagaggtgagagtggccacagatctgtcagtatttccctgaagctggcccagacccttgcactgtttggatccttggctccagctttgaagtttcttcagtttcttttggactctgattttccctataaaatttatcctacttacatccatctttcaggaatttagtgtcagtattattttaacatttcttctttaggcttggctaatgggtacaaaaatacagttagaaggaataaaatctagtgttcagtagcacaatggggtgactacagttaacaatttatcatatatttcacaatagctagaagatttgtaatgtccccaacacaaaggaatgacaaatgtttggggtgatggatttcccaattacccagatttgatcattgcacgttgtatgcatatattaaaatatcacatgtaccctataaatatgtacagctattatatatccattagcatatgaaaaacaaaaataaattcctttatttaaaaaataaaatttcttcttaaagtaggtgctcagtcatcctttttgagctaatcctctgaaagagccttcaagaatccattccggtccaactaccaggtatcgttctatcaagatcactcgtcatcctcaagttgattctatcatttgcctgctttaaacccttcagaaatatgctagttcccttagaactaggtccaaagttcttaacatgggtctacaaaaacccagatgactatggcctccgcatacctcatctcctactattttccaccacttctagcattcacctatcctgagttttcttaatttctgaaatatgctacggtttcagccactacatgttgacaatgtttcaactccctggaaaagtcttccttccttcctttatatatttttttaacctaactaaagtctgggcttaaatatctcttactccaggaaacttattccagatcttccatactaagttaggtctcctttaattgcaataacttgtttattgtgtttatttattattttaataaggtctgtcttccttgctttactgtagactttaagactgtagggaacaaagtcaatataacatttttttcccctggcatatggaagaattaaataaacatggttggataaccaaattgtacctatatttccatttttgtggctgactgactgaattatatttagggctatccagaataactttttgtgatggtagaaatgttccatatctgtgctgtccaatgtggtatcccataaccacatgtggctactgggtacttgaaatatggctaatgcaatggaaaaatcttacatgtttctaattttacttaatttacatttaattggctagaggctaccatattaaagtgcacaggaaagatatttccaccttctaagtcatatttctttttttcttttttccttttttttgagacagagttttgctctgtcacccaggctggagtgcagtggtgtgatctcagctcactgcaacctctgcctcccgggttcaagtgattctcctgcctcagcctctcaagtagctgggattacaggtgcctgccaccatgcccagctaatttttgtatttttagtagagatggggtttcaccacgttggccaggctggtcttgaactcctgacctcaggtgatctgcccacctcagcctcccaaagtgctgggattacaggcgtgagccaccgcacccggcctactctttgtttctgattgtctttttcaaggatgtttttatggtgaacagtctcggaaaagagaggtggtgtctccctgtggaacagagcgcaggcatgcttattgccaatttggattccctaaactcagcattcttaagaaacaacccactacacttgcaagtggtatctggccctcttcacatcaccctgtgggatttggagcttggggagctgacttaaaatgccaatattccaattcctgctactgctttgagtaaaaactctcctttgtagctgacccagaaattttgtgtcttctaccagcctccatgaaatggtggcggactaacttgttagcttccaaatagggtcaaatctacacccttcacagttcttgacacacagacaaaacttaagctcttaagtattttgcttaggatggttttcaagtttgtttcctcgatgttcttcttctcctctttcttaaactaccaaggaacattttgctcctgttaatgttgtaaactcaacctttttgatttataaatagcaaatgacaagagaattccattctaaagtaacagaataactttaaaatgtgtctaatgagtgggagatgtgatttttcacactatctccaattctcacagagttaggcatctgaatagagaaccactggaacgcctattgagaagtcatgttttgcctttttatctttaccaacacaaataaagttcttgggatctatttgtttttatgatatgtataacgttacctggtaaatcacagtggttatgacattttcccagacaacaaagggagattttcctttttaatatttcataatgcctgaaagacatgttttctccaaacacaagattttcaattcaaatgaattcagcaaatatttatcaaggcccttattctactgatcattgctttgtaatagaacatctaaggaaatgatgactttttaaaaacaatatagtcagtaaaaaaaaatttttttttttttgtgacagagtctcgctctgttgcccaggctggagtgcggtggtgcgatctcggctcactgcaagctccgcctcccgggttcccaccgttctcttgccacagcctcccgagtagctgggactacaggcgcctgccaccgcgcctggctaattttttatatttttagtagagatggggtttcgccgtgttagccatgatggtctcaatctcctgaccttgtgatccgcccaccttggcctcccaaagtgctgggattataggcttgagccaccgtacctgtcctatagtcagtaaaaattttactaagacaaggctgtggaaaattctaagaatttgtggatatttgtcttgacatgttgctcttctggatcctggaatcaatttagctattgtacttgccaaacaagtcagattccttagagttgcttgttgcaaggtgtggcagattgtattctccaaaagtagccacagtaatatttctggggcccattgacagctgcagcctttttcccttccccttgaagctgggcaggattttgtgaccgccacaaatagaatgtgggagaaaagacaccagacaggacaggactagggtaagatgagtgaaacattctcactccttggatgccatacataggggatactaaaaaactcagtcatagaaattgtgaacccagaacatctgagacaggtctcagttaatttagaaagtttattttgccaaagttgaggacgcgctgtgacacagcctcaggaagacatgcgcctaagctggttggggcacagtttttttttaatacattttagggaggacacgagacatcaatcaatatatgtaagaagcacattagttcggtctggaaaggcggaacatcttgaagcaagggcaggaagctgggagggagcctgtaagtcacagacaggtgagacacaaaaggttgcattcttttgagtttctgatgaggctttccaaaggaggcaatcagatatgcatctatctcagtgagcggagaaataactttgaatagcatgggaggcaggtttgccctaagcagtttcaagcttgagttttccttagtgattttgggggcccaagaggttttcctttcacaatggccatgtgcttggagtggcatctacaagccaaagaatggcagagattgtgggcaaacagcagaagctgcagcaggtatggcaagctccctcctagcaccatcagagagagcgtagccctgctgacgcctgattcccgaatggtgagacaatacatttctgttgttttaattcccccagtgtgtcgtactttgttatagcagctgagcaaatgaatctaacacttacgagaggagtctgccccaagctacctcagaggcagctggtccctcgtgtacatcttatagacaagatggtttttgctgtatttgtggtaacaagtttgacttagcttgacatgctagctgtgtagatgatgaacatttgagacttcataggttcggtctgcagcctgaccattttggaaaagcaaaactgctcttctcttctgctttctttttccttcttcacttgaagttctctaataacagtgtctgacatagagtaagccctcaataaatgatgattcctttatccagccatctacccctaatttccttctttcttccttcatcagtggggtgggacctccatcttcttggtttccagatatatttggtttttatttttagaaacaaactttgcttgagcctttggcttaatttcctctcctcagtcattactacttcctgtatttcatttcctttctctcttctgctttcttcactttctttcttttttttctttgagatggagagtcactctgtcgcccaggctggagtgcagtgcacgatctcggctcactgcaacctctgtctcccggttcaagtgattctcgtgcctcagcctcccaattagctgggattacaggcacacaccaccacacctccctaatctttgtatttttagtagagatggtgtttcactatgttgggtagactggtctcaaactcctgacctcaggtgatccacccgcctcggactcccaaagtgctgagattccaggcgtgagccaccgtgcctggcctctttcttcactttctaatgttggctcttgacttcgttctccaagtcacactgtttcctggtggccttgcctctgtccttatctctgtcttcacctttgtttgtcccccactcacttcctgtttataatgtgtgtctacttatgccatagctatttgcttttttttttttttttttttgacggagtctcactctgttgcccaggcttgagtgcagtgacacaatctcggcttactgcaagctccgactcccgggttcacgccattctcctgcctcagcctcccaagtagctgggactacaggtgcccgccaccatgcctgggtaattttttgtgttttttagtagagatggagtttctccatgttggtcaggctggtctcgaactcctgacctcaggtgatccgcccgcctcggcatctcaaattgctgggattacaggcatgagccactgcacccagccttctttttgtttttaataaaccttctcctgaagaataacatagctaccaaaaagtgctcaaattattagtgtatagcttggagaagtgtcacaaatggaaaatttcacctgtttcaggaaaaaactctcacaacatgtttttcctctgtttctcacaccatcaaaatcaacacacaagacttctgtgaccaaatgtgtgggggttgccccatcaccacgcagtgaacaggaggtgggtgtcctccgattcaattccaacactgtttacctggaggtcgcatcagatcccacaggttgatcccacaggcccccaagactccctctgaccaccccttcagacaccaggtgcaaatctaggcctctggaacttctgactgacaggcttcaagttggggttcccatgaccccttctttggatttgccgaatttgcaagaatggctcataggacactgagaaacacttacttaggtttaccagtttattataaaggatgtcacaaaggatacagatgaagagatgtgcagggtgaggtatgggcaaaggggcatggagcttccatgccctccctggatgcaccgccctccagatgaaaccacctttgcaaaattatgactgagacagtgaaagagatctaacctaaccaactccattttgcttctaacctttaagttgtctttgttcattcctgggcataggctgaactaacttggggaggaactttatagttgatagtttaaaataaagatgataatagccctttcctaaaacagacctccttgcctggggactagattgcctttgtatgactaacaaattagccacgagattagaaattatggcttaggagtcatgccgctggagaccacaagattctgaccctccctaactgctcctaagatcagtgcttgagatactttgcagaccctgcacttgatggatcagctggcaccacccagattgatgaactggctcatctgccccccatccaggaactgactcagcacaagaagacagcttcaattccctatgatttcatctcctacttaacccatcagcactcctggctcactggtttccccccacccaccaagttgtccttaaaaactctgatccccaaatgcctggggaggctgatttgagtaataaaactccggtctcccacacagcccgctctgtgtgtattactctttctctattgcaattctcctgtcttgataaatcagttctgtctaggcagcaggcaaggtgaatccagtaggcagttacacaggaacctgcaagtattcagctacccagaagctgtctgaacccagtcctcttgggtttttaaggaagcttcaaggggtcagctttccttttcccatggtattgggtgggaccctctctaggctgggtctcatgactcacaatcagacagtcaaggaagattagagtcctgattgggccaggtgaaagaagagcaggagaaggttggagagattgtttcctgaagcctgacacacctaacattataacaaaagactgttaacaagggctatatgagttatgagccaggaactgtggatgaaaaccaatatatttatgtgtgtaaatcacaacaccaccttacccaaatcaagaaacagaaccttcctagtaccctagaagccctctcctagtctaccttcatcttcttctctaaaagtaaccaaaatcctggtttcaatgccacaaatttttttttctgccttgtttgcataaataaaatgatataactattaaattatattattgttttttgtttaagattgtttatgagcttgttatgttgtatgtagttcattcattttcatagctgtataatagtccattgaacgaatataccaaaatttacttccaaattctactattggcagacacttgggtggtttccagttttggctctgagtattcaaatctgagtgttttcagtatatgtacctaacattcttgtatatgtcttttgtagttcttatgtatttctatgggacatatcttagaagtggaattgttgtgtcatatgcaaaggttcaccattgctggacattaacatttttctttatatatatatatttttattatactttaagttctagggtacatgtgcacaatgtgcaggtttgttacatatgtatacatatgccatgttggtgtgctgcacccattaactcgtcatttacattaggtatatctcctaatgctatccctccccccttccccaccccacaaaaggccctagtgtgtgatgttccccttcctgtgtccaagtgttctcattgttcaattcccacctgtaagtgagaacatgcgaagtttggttttctgtccttgtgatagtttgctgagaatgatggtttccagcttcatccatgtccctacaaaggacatgaagtcatcattttttatggctgcatagtattccatggtgtatatgtgccacattttcttaatccagtctatcactgttggacatttgggttggttccaagtctttgctatagtgagtagtgccacagtaaacatacgtgtgcatgtgtctttatagcagcatgatttatattcctttgggtatatacccagtaatgggatggccgggtcaaatggtatttctagttctagatccctgaggaatcgccacgctgtcttccacaatggttgaactagtttacagtcccaccaacagtgtaaaagtgttcctattctccacatctctccagcacctgttgtttcctgactttttaatgatcaccattctaactggtgtgagatgatatctcattgtggttttgatttctgtttctctgatggccagtgatgatgagcgttttctcatgtgtctgttggctgcataaatgtcttcttttgagaaatgtctgttcatatccttcacccacttgttgatggggttgtttttttcttgtaaatttgtttgagttctttgtagattctggatattagtcctttgtcagatgagtagattgcaaaagttttctcccattctgtaggttgccttttcactctgttggtagtttcttttgctgtgcagaagctctttagcttaattagatcccatttgtcaattttggcttttgttgccattgcttttggtgttttagacatgaagtctttgcccgtgcctatgtcctgaatggtattgcctaggtttactcatagggtttttatggttttaggactaacatgtaagtctttaatccatcttgaattaatttttgtataaggtgtaaggaagggatccagtttcagctttctgcatatggctagccagttttcccagcaccatttattaaatagggaatcctttccccatttcttgtttttgtcaggtttgtcaaagatcagatatttgtagatgtgaggtattatttctgagggctctgttctgttccatttgtctatatctctgttttggtaccagtaccatgctgttttggttactatagccttgtagtgtagtttgaagtcaggtagtgtgatgcctccagctttgttcttttggcttaggattgacttggcaatgtgggctctttttggttccatatgaactttaaagtagttttttccaattctgtgaagaaagtcattggtagcttgatggggatggcattgaatctataaattaccttgggcagtatggccattttcacgatattgattcttcctatccatgagcatggaatgttcttccatttgtttgtatcctcttttatttcgttgagcagtggtttgtagttctccttgaagaggtccttcacatcccttgtaagttggattcctaggtattttattctctttgaagcaattgtgaacgggagtccactcgtaatttcgttctctgtctgttattggtgtataagaatgcttgtgatttttgcacattgattttgtatcctgagactttgatgaagttgcttatcagcttaaggagattttgggctgagacaatggggttttctagatatgcaatcatgtcatctgcaaacagggacaatttgatgtcctcttgtcctaattgaataccctttatttctttctcctgcctgattgccctggccagaacttccaacattatgttgaataggagtggtgagggagggcatccctgtcttgtgccagttttcaaagggaatgcttccagtttttgcccattcagtatgatattggctgtgggtttgtcataaatagctcttattattttgagatacgtcccatcaatacctaatttattgagagttttttagcatgaagggctgttgaattttgtcaaaggccttttctgcatctattgagataatcatgtggtttttgtctttggttctgtttatatgctggattacatttattgatttttgtatgttgaaccagccttgcatcccagggatgaagcccacttgatcatggtggataagctttttgatgtgctgctggatttggtttgccagtattttatttatttatgctacgattaagaaatttaaacttcgtttggtatgtttattggcctcttaaatatcctgttgtgaaaagcctattcaactcatttaagaatttgtgttttgcaatgtcttattaattcttattaattgattaataaaaatggatcagaattaattgagatttattaattctattaatcaaatacaattcttttattttagttagaacattttgtgtcctgtttaaaaaaaagttttcctacctcaaagcaataaatatacttttctatgttatcttttacaaatgtaatgttttgcttttcacatatagatccacctgtgaaggttttttctatatggggcgaggtagaggaacagattcacttttctccatctggctgtgcaactgacttaccagcatttattgccccactattgttgctgctcagtgttgctttgtcataaagtaagtttcattctatattagatcccccaagttttgaatggctgtattatattatagatgcatcaccaattaaatatcctaaaaattaaatatcctaaacaatcaaacataaacaagaagccaataagcctcacctgatttggctaggtggtattctaaccataaaacttccaaacaaaagggatatggaggaaaaagtatggatttaggccacttatcccaatcttagctcatgctcttactcatcaataatagttatttatccccagttttctcctctataaaataagaatgataataactatctcagccagttgttaggaggattagaaatatcatagcttagaaggcttggcacagagccggcaccccaaaagtcatagcggttattaatacagccaaaggttcaggaagacctcatctcagtttcagaaagatcctcgttatctttggaataaagaaaatgctttcgtgtgtctactttgaagagttggaggtggctgagcacaggctgggactatgagttttggctcccaatggcctttggcttaaagaacctaataggacccaaagatagcatcagtttgagaaaacacatgagaatcttcattgctgccctcatggcctttcatatcaataccaaaaacctactgttttgtgttttgtagtccttttcttttttttttttttctggagagacgcaaagaatatttagataatatttctgtaattatttacttagtcttggtttctaattttcctcagagaaaggaaagcattatttgaaaataaaactaaagtagcatttaaaaatccctaggtgaggacatttttccagtggaagtttagcctccagattcccgtgtcactatttttatagttttcaatagctttggcccttcccagcagactgggaaggcctggaacataccataatgctcatatttaagcaacaaataaaaaaaaaccctattgctgtcaagattgttggtattgtattaatctttatgttagaaatctccttggaaacctagaggggaataaaggttctttacaatgggatagagaactttagatttatgatgtttcaccaaaccatctttgctttgggctttttcactgagtaaatatcaaagttagtagtaagggcagaaacttggtcctttttggactcattatattggaaattgaataaaatgactgaaacagagacagttaaaaggtgtcagttgggtttctttttctttttttctttctttctttttttttttttttgtagacagagtctcactgtcacgcaggctggagtgtaatggcacgatctcggctcactgcagcctccacctcctgggttcaagcgatttcctgcctcagcctcctgagtagctggaattacaggcgtgtgccatcatgcccagctgatttttgtattttgagtagagatgaggtttcaccatgttggctgggctggtcttgaactcctgacctcaggtgatccacctgcctcggcatcagttgagtttctaatcttcatttttattaattttatcctgaatacaacatgaggcattatggatcagagacaagatttcttattacagctcagtaaataataaacatgtcacccccttgccccattgcttacccctgggtgacacataagagacagtgggaattttccccgtgttagtagtggacattccctaagtgagggggtaggaaaaactatttgctctgcttacaaagggaaggaggcagccactcctcttgccttctgaaaggctctctttggaaacataaagggcagaaatcctaactccagcctttgccatgtaaataaaatctcctcaggtacctggtagccccaactgactaggcttttacaccttacatctaagaagataaatctccagtatcccaggcacctttggagttaacctaggtgtctataccaggatttagtcttttggcctttggggagacaagagatgttttattttcctttcagatcagagcacttaagtagacaaatggctgtggagctaactgtcatggtgtttggagaatcccaaaaggccagggattttactaaagcattgagagtgttccttccatctgagacatctgcttgcagaaaaggaaacagtcaggtgacaaggggctattttctccagtggccacaggattgctacagctaggatgagggaggaatatgatgtctcttggtggggtgtggtgggggagattcccctcccctctataacatctttttatgtgcaatttaccaactgtcaatatgacacagagtgtcaatagctaatgactattatatatacctatctcctgggagtccttttatcccatctgtttaggtgagttgattccatttttcactttggaaatgtgagtggcatcaactttatctgtagcagagggaatttgggttacacctttattctgtgacactctagttcaggggttgacagtcttcctctgtaaagagccagatagcagatattgtaggcttggctgtccctagacagtctctgtggtatattacttgttcatttatgatggttaaacatgtcaaaacctgtatagaagcaggctgcgggcaggctttggctgtccaagttgtgctttgttgatctctgctctagttaccttctcctattctgtccatatttcccatgttccaaacctccaacttggggaaggtgaaacaatctttatactcatgatattccctggttttcagatcagaaaagacaggcaaactatgatgtctgatacttggactttgtcatggttctatatcaatgtcaagttacctagtctttgcagcttgattcaaagctgaattgtttgtatttcatggcagtcaggtggaatttggaaagatataaatattcataaagatgccatcacattggtgatccaaagacaaaggagtaatatagtatctgctttctatcttctgagaattaaatcattgtaagctgggatggagtgacataaaatatgcattaaaattatatgctccaaaaacatttcattgtaacatttcctttcaatatgaccatttagccatagtgagaagatatattaggccaacttattaaccagcatacaattaagggttcccaaaagattacatttccaaagcacttatttttcgatctgtatttgctttgaggctggccagcaactttgagagactctccgaaagtccagggctaacgtccatggtgaagcctcctgggtggctgagattacaggcatgcaccaccatgccaccatgcctggctaatttttgtatttttagtagagatgaagtttcaccatgttggccaggatggtctcgaactcccgacctcaagcaatctgcacgttcggcctcccaaagtgctgggattacaggtgtgagccacctcacctgggcttatatggtattttgtgtctttgattttgagattcacccatgttgtagcccgtatcagtacttcattcttttcatggctgggtaatattccattgtacagatctaccccatttgatttatccattcatcaggtaatggacatttggcttgtttctgcttactgagtgtgatgctgctctggacatttgcacactgcttttgtgtggacgtacattctccattctcttgggtacatacctacatacgtaggagtggcattcctgggccatatggtaactctatgcttacctatctgaagaactgctaattttccaagcagccatatcaattcttcaatttccccacatcctttctaacactttggtattgtccatcttttttattatagccttcctagtgactgtgaagtggtttctcaatgtgttttgttttgagatggggtcttgctctgtcacccatgttggagtacagcggtgtgatctcggctcactgcaacctgtgcttctgggggctcaagtggtcctcccacctcagcctccaaagtagctgggaccacaggtgcacgccaccatgtctggctaaatttttgtatttttggtagagatgaggtttcaccatgatgcccaggctggtctcaaactcctgggctcaggcaatctgtctacctcaacctctcaaagtgctgggattacaggcgtgagccactgtgcctggcctctcagggtggttttgattttcatttttatgatggcgaatgatgttgagcatctcttcatgtacttactggccatttactatcttttttggaaaaatgtctaatcaaattatatgttgttttaaaattaggttatttttctttttattgatgagttatttataagagtgctttatgtttttggaatacaaatcccttatctgatacatgattttcaaatattttcttttcttttattttctttaagacaggttctcactctgtcacccaggctggagtgcagtggtgtgatcatggttcactgtagcctcagcctccctgggcttaggtgatcctcccacctcagcctcctgagtagctgggactacaggcctgcaccaccatacctggctaatttttgcattaattttgtttgctcaagcaatctgcctaccttgacctcccaaagtgctgggattacagctgtaagccaccatgcccagcctgccaatattttctcctactctgtgggttgaattttcactttcttggtggtattttttgaagcacaaaagttttacattttgatcaactccaatgtactctttttttcttctgtcacttgtgctttttggtgtcatatctaagaaaccattgtctaatctaagttcatgaagatttcttctaagggttttatagttttagcttacatttagatctatgatacataggactcctcttataaccactgtaagtttatcaatttgaggaaatttaacattgacaagatacttgtatgtaatcccccattcatattttgattttctcagttgacctaataaattctatagaattttcttatttctttcagtacctgtcagtccagaattatatatacatttagttatcttgtcattaatctcctttaatgtgaaactgttatctttcatgatattgatatttttaaagatatcccccccccccgcttcttttcattagaatgttcctcattttgtgtctgtctgatgtttcctcatgattagattcacgttatgcctccccggtcagcctgaaagtgatgttgtattattttgtacttgtgtttaaaacaaataattcttttacagagtgaataactagatccctacattgtttatgtttaaatacatgttcagatacctggtttgggaccaggtgcagtggctcatgtctgtaatcccagcactttgagaggctgaggcaggtgaatcgcttgagtctaggagttcgagaccaacctgggcaatgtagtgagaccctgtctctattaaaaaaatttaaatttaaaaacaaaaacaaaatccacacacctggtttggttacagccagggataattctaatttgattctgagcacctacagttattgagcatataaataaatgggaagttgtgggtcttatgatggctgttctggtctcttggctgaatcctcatgcctgggcctagcgcagaagtctcttttctgtgctttgtgctagtctctgtggactagctgtgtttttttcttcctaggtagtagtattctctcgtctgcatctgatttgatgttttggtgatcgaacaatatgaaattaagtgactctataacatgacttggactattcagatttccttaaaactttttccatccactgggaagagtatataaatatatatccagtatatatattcaatgtgtgtgtgtgtgtatatatatatatatatatacacacacacgtatatacatatacacatatatatatattcagtatgtatgtgtattttttcagtacatatattcaaatgaaatactcagcagactccaataatccaggcagataaaaacataactgcttagttgaatcagacctgaccctaccttctaaacaggaacctgcacttatctcctgctttaaactgtgaatatttcctgcttgtctctgggattttctgagtctcttttggcctttccatctttagaggaagttttattcttgtggttcagccttcagagacagaaatctggtagaaatgaggggaacattcaaagacagttgttaagagagaaaatttcttgttgcatgttggctgaaatacatcgagaaatatgtcaataatgttaaaggaaaaagttgaaactgtatctaattttgggtttgcacttatctttccaggaaggagatgagtcttaaaaaacaacaatctctacattaacaaaaacaacaacaacaacaagtcgcattaagcaacagctgtttagggtgaggtatgaatgtaggacttaaaccgtgtgatgtctaaactccgttccatggccatgagcctgtgatgcctgtgttgtctataacctgtcaatatttttctctcaacaatttccagctcaataagtgggcgagacaaggttatcaataacaagttggttattaaaggttaccgtctattcacgtgatagctttccatttccatcattgaattaaggtctcagtttttatttagttagttttttagttttggttgaaaggggtttgtgtttatgtgacttatttggttagtgggttattttgggggaaaagaggatctccttcttttgctgacttagataaaaaattcttgccttatgaaggctctggctgtgctgttggacttgctaacgtgtggagaacatggctatttaattgtaaaaagttgtcctgaggaaaagcctgtattctcctcacccagtgactagaaaggatggtgtaccatcagtaggctgcagagagaaaaccactcttttgtgttttcctttctttctaccaggtgtaaatgtgtcaggaagtccaggatggggctcctaggttcagcattgttatgggttgaagtgtgtctcttccaaattcatgtgctaaagtctgctatagtttgagtgtatccttcagaattcatgtgttgtaaatttggcccctggtgtggtgttgggagatggggcctttttgaggtgattaggttgaaagatggattaataccactcttgtgggactgggttaatgcttgtgggactgggttaatgcttgtgggagtgagtgtgttcttgcttttgaaggacaggattagttactgtgagagtgggttgttataaagtgaagctgcccctcatgttttgccctttcaggcatgtgcctgattcctgttctgcttctgtgccacatttctggtgaacacaaggccctcaccagaagccaaccagaggcagctgcctgatctcggacttaccagcctccagagccattagccaaaataaacctcttttctttttaaatgacccagtttcaggtattctgttacagcaacagagaatgggctaagacaaagtcttaaccctctttcagaatgtgactgtctctggagatagagcctttacagagataattaagttaaaatgaggtcattagagtggaccctaacctaatatgactggtgtctttataaaaagaggaaatttggatgcagacatgtacagagggaagatgatgtcaaaacacagggagaagatggcatctacaagccaagacctggaacagattcttttctcatggttttcagaaggaaccacccctgatgatatcttgatctcagatttccagtctccaaaactatgagacaaacatttcaattttcaagccacccagtctgtggtacttttttatgggagccctaacaaactaataagcatcatgggcagatacacacctggcaggggaagggaatatctaggggagcccaaagctgttcacttcatggctattctggtgaaagcttacttagtaggtagactagaaaaggacttgctagacctaggggagattaaatgtggtagaatcagaaacctgcacttggtaaactgggcaggtcccataccacctgtgttctctttgaatgatctagcttatctcagcttgtagaaggtaaccatggcaagctaacccagccagtagtggggaaacatccctctagggagcaacctgctcctgccggtggctaaggtcatggaggaagaggactcagaaattaggatcaatcccataggtcagttaaccctctctattgtgagttttaatttttttcctaaatgctaactttgaaggtttggattttgttttaataaggcttcttcccttaggagaatagagaggaaaagatgctgtttctctaggaatccctgtaagacagaaagaaggacttaaaacttttctgtcttcaaggatttgcacatatacaggtgccatctcttctgtcctgccttgcttcaagttctgctaataccactgcaggaatctgggcaacccattgttgagtggttgctcattcttctagtgacaggaagtcctttgtctctgaagacagagtcctttctctgttggacacctctgaagttaaaaggtgcttctgtctcatttcaaataacttactcccaaagtttgagaactcaatccatgtaagttcgggattgcctacaacttgaaaatgcctactgctgtggtttaaagaatatatgccagaaattagaaattgttgtaattaaaggaaaatgcgtcttaaataattgtctagcagagagaaatctacatttgctgtgaatagaggctgtcctcagcctgagatctcagcaaggctgggctgccaagggaggaggcagaatagagtgtttgtcagagctctggcaagtggttagaagtggggagaacacacaacaacctccccctcctgagcacacaataaccaacccctttgatctgggaacaattccagatcttagtcctagaccagctggggcaggatgaatgtggagaggagacattctccttccggaaagtaaaggaaagaggcatgaattgctcttgagtgtctggctgtatgtcaacaagtggcctctctgttccttggtttccaggcgctggccatgtggtctgtccaggaaggagagtgtaaatgtgataatattgcctgctacacaagaagcatcagccctaggaaaaaacccttcattacaggaaggaagaaagatctagggaactctcccagtgtcaaggaacctggggagggaaattagccacaagagagtcacttgctgagcatggaatcagtgcatgttttggtggaggattctgttggctgcttgaggtttttttttctctactttatggtagcaccacctacctaatgaccatctggcacaaagttttcctttctgaaactgtgcagcttaatgctgacaaattctaagccgcaactctcctttttgtgatatcatttcttacaacttagagaaacctgcggtttcagggtcctttacttcctatgtgtcatagttatgatgacagctaaatttactttagttacatttcacattggctacttctggacaccccaagtcatcagtcaattttctctgcatcacactgtagaatggcttgtttctggggaggttcgtggacatggctaattcccctccttttttttttttttttcccaaaaacccgtttgcactcctaaaagatggctaattgtagccattatttgctgcttctagtaatctctctctccattctgaaagaacaatttagcttcccagctcgtagcatataacaatggcttgcagaatttcttattttgactggtgtgtggggtgtgtttatgtatgtgtttgtttaggagagaagaattatggccagttttttattcatgacatttatcatctttatttctccatactgattctaaagattgaaaatgcttttaattttaatgttaatttttttgtacatagtatttatgtctttaatataacatgtgcttatttattactgtatgcaagtgacttaaatattgaacctttcaaaataagaaatttcttcaatttttatcatttgagaaaaatatactctttctggggaatgatttctgtaatagatacggtttattttaattgtggtgataaaccatgccttcagtagagacctctgagagtaacaatagcagctaatttatttttagctgttatttgcagagaagtgtagtttataagttatacatgatcttatttgatattcacagaagcctaatgaggcaggatgcattcattccttcattattttatttatttaacaaattcctactaattgctagtggtgtgctgggcacatccagaggtgctgttgacacagtagtgagcaaggtagatctggtcttatcctcagggactttatagtttagttagagctggtataattaacattcctgggctaggtgcggtggctcacgcctgtaatcccagcactttgggaggctaaggcgggtggatcgctgaaggtcaggagttcgaggccagcctggtaaacatggtgaaaccccatctctattaaaaatacaaaaaaaaatttagctgggcgtggtagtgggtgcctgtaatctcagctactcaggaggcgaatcaggagaatcgcttgaatccggaaggtggaggttgcagtgagctgagatggcaccactgcactccaccctgggcaacagagtgagactccatctcaaaataaattaaaaaatatataattaacattcctatttatcagtccaaccagagttcagattgatttgtatctgtctgtgatccagggtctctgagacctcatttatatttagctgcctgatcttgctgaggaaaggcaccctgtgaagaggtctaactccaggaagcttccatggggcatttgtgcagacagaaacttggaaggtgctagacattgtgtaaaggcagctggtgaacaatgcccttccaaatgtgagattatttttgggagggcctaagggataagactttatcattctgatttacttgcttgaggatattgtccttctctgggatggagactttcaagaaccagagttggggttttgtgtctgtatcatccctggatctaatttcattctaactggcacctgcacagaggtttttacttactgcaccttgacgaggagaggtgtgctcagtttcactgtcataaaccaagtggttattgaaagaattgagagactgctagggtcttgatattgtttggctgtgtccccacctggattagtttgttttcacactgctgatatagacatacctgacactgggaagaaaaagaggtttaattggaattacagttacacatggctggggaggcctcagaatcatggtaggaggtgaaaggcacttcttacatggcagaggcaagagaaaatgaagatgcaaaagtagaaacccctgataaaaccatcagatctcgtgagacttattcagtgccatgagaacagtatggggaaaccacccctacgattaaattctctcccactgggtccctcccacaacatgtgggaattatgggagtacaattcaagatgagatttgggtggtgacacggcttggctatgtccccacccaaatctcatcttgacttgttgctcccacaattcccatgtgttgtgggagggaccccgtgagaggtaattgaatcatagggggcaggtctttcctgtgctattctcatgatagtgaataaatctcatgtgatctgatggttttataaaggagagtttccctgcacaagctctcttctcttttctgccaccacaggagatgtgtctttcaccttccaccatgattgtgaggcctccccagcaacatggaactgtgagtccattaaacctttttcttttgtaaattgctcagtctcgggtatgtctttatcagcagcataaaaacagactaatacaggtctactgggatagaggtcagcctacccccaggacaaggaaggatgcagatgcctctctgaggagctcccagtggtgttggcagtgaaacaggtggctggccatgaagataagcacatctagattttaaagtgcccatcaagagtatagaagtcagcagctgacaccacacggttgggacattcactggctgggtacacagtcctttacagggtggacttggcagggaagtgttcttttttttttcttttttctttttttattttattattattatactttaagttttagggtacacgtgcacaatgtgcaggttagttacatatgtatacatgtgccatgctggtgtgctgcacccattaactcgtcatttagcattaggtatatctcctaatgctatccctcccccttccccccaccccacaacagtccccagagtgtgatgttccccttcctgtgtccatgtgttctcattgttcaattcccacctatgagtgagaacattcggtgtttggttttttgttcttgcgatagtttattgagaatgatgatttccaatttcatccatgtccgtacaagggacatgaactcatcatttttttatggctgcatagtattccatggtgtatatatgccacattttcttaatccagtctatcatcgttggacacttctgcacagcaaaagaaactactatcagagtgaacagacaacctacaaaatgggagaaaattttcgcaacctactcttctgacaaagggctaatatccagaatctacaatgaactcaaacaaatttacaagaaaaaaccaaacaaccccatcaaaaatgggcgaagaacatgaacagacacttctcaaaagaagacatttatgcagccaaaaaacacatgaaaaaatgctcaccatcactggccatcagagaaatgccaatcaaaaccacaatgagataccacctcacaccagttagaatggcagtcattaaaaagtcaagaaataacaggtgctggagaggatgtggagaaataggaacacttttacactgttggtgggactgtaaactagttcaaccattgtggaagtcagtgtggcaattcctcagggatctagaactagaaataccatttgacccagccatcccattactgggtatatacccaaaggactataaatcatgctgctataaagacacatgcacatgtatgtttattgcagcactcttcacaatagcaaagacttggaaccaacacaaatgtccaacaatgatagactgggaagggttctttacccccctcctacctccctggagaagctcacaagaaaggcatatagatttaaaatgacatatagatttaaaaggacagcaaaaatattaattgcatgacaccagttatcaaaggactcagtgagattaagtggggtgggagatggatttatagattataaccctcccaacacctattcacaaatttaccccccaaacatgtgttgaacattacacagagaatggggttaaagaaaaggtccagctcccacacattacattaaaatatatttctgattatgtctcttttgggtaataagagtctacatgaattttaccacctgtgtgactctgaaaaaattgcttgtgtcaatcttaaataatcagattcagaaaataggattaagtagagagcttatttgagagcaaagcatgagcatagctacccatgtaacatagactgccaaagaatggaatcagtgcaggaaagttaacttcccaaagcaaagaagttaagttttaacttatacagccagaagcagagaaacttaagagttgaaacatatttccgctcaaggccaatacatatgttacagtaatttgattggttacagtttgctgcatcccaagaaagattgctttaacattccctacggaggaggaatggactccagggggtcttatctctggtgtctttcagtctttcctaatcatctacagcaggggtccccaacccccacccccaggccacagacctttaccagtttttggcctgttgggaactgggctgcacagtagaaggtgagccagagaagcttcatctgtatttatagccactccccatcacttgcattaccacctgagctccacctcctgtcagatcagcgacggcattagattctcataggagcacaaaccctattgtgaactgtacatgccagggatctaggttgcatgctccttctgagaatctaatgcccaatgatctgtcactgtctcctaaaaaccccagatgggactgtatagttgcaagaaaataagcccagggcttgcactgattctgcattatggtgagttgtattagtgtcatttttcattatatattacaatgtaataatagaaataaagtacgcactaaatgtaatgtggttgaatcatcctgaaaccaccctcccacactggccccatccatggaaaaattgtcttctgtgaaaccggtccctggtcccaaaaatgttggggaccactgatctacaagaataagaaagagagttaatctataactggggaagcagaggttgcggctgcatgctgcatgacccaggctatatagccacatttctctcaaggctcaaaataattcaaagcagttttaagtttgaattatttaatgtcacacttaaccattcagagtctgtttttcctctgcaaagatggggaaaataatagcaccttcttcatgggaattttaacctatgcttgccacttagtaaaccctggcaaggcactcacagttgctcatttcttgccctctgctttgtcttgaccctgtcgtgttcccagtcagtttctcctgggagtcaactgagtacagtgagcccaacttttccagtccaactccatggatcatttcccctggcttgtccagttttccctaaagattctgctaatctctacttaccacctccttcatcctattaaacaaaactttttcagcttgattttgagacacttccaaaccttatgatgaaggcattctttctactgcaatagtcccgttccctcccttgcaagaatccttttgaataagtctctccttactaagtcctgatctgtttctttgatagcacttaataaatattagctggtaactaccaatactcagttttaaccaatatccagattcagcaggaaagccaggaagcctggggctgaccaacttctacttgagagtatccactgcactcagaaattgctaaaggttacatctgtaggtctgtgtatctttccaaaatgccttgcctttggttgctagcttttgttttccaaacaacagaagatggtgtattgatatggtttgggtgtgtccccacccaaatcttatcttgaattctcatgtgttgtgggagggacccagtgggaggtgattgaatcctgggggcaggtctttcctatgctgttcttgtgatagtgaataagtctcatgatatttaattgttttaaaaaggggagtgtccctgcacaagctctcttctcttgtctgccaccatgtaagatgtgcctttcaccttccaccatgattgtgaggcctccccagccatgtagaactgtaagtccattaaacctctttcttttgtaaattgcctagtctcaggtatgtctttataagcagtgtgaaaattggctaattcatctatattgcttcactctttcatatctgaacattcaggtccccacttggttcaagaagaaaattatttctcttaagagttgtcattttggagtgtgtgtggcacctgctgtccaggctggattcattgggtttctgaagagcagagagggtcagttgcctcagggcagaggtggggacaagctacaccaaaagtttaccccttgagggctgtcaaaactcagaggagtggctaggcaggatgttagtctgtgttttcagcctcctgggatgttcctccccctggaattgttttgctgagttaggaggagaggggaattctgctttgaaacctgctctgcagaagccagtttttcaggtttgagggtccccagggatcagttttcataacagagaaggtgactgagttgttgacacccaacaggctcctgttgttcctgctgacagcttagcgttctccttgcgggtcctcccagctctccctcctggttccttttctttctatcctgttcttggttctccctgactggaaaatgtcacctcttgactgagtctacctgtctacactgcagaaccacagggagatgggaacaatcatacatctctatatgacctttcccatttcagatggcagaaattcctaagtgtgggagattttgttgttggattaactggtattggctgtccatgccttgagggcaatcaccaactctgctgggtgcctactgacagagaccctgattggccaaactctagacgtggtcctctgagcccctcattgatgaagccccatcctcaggccttgtcctcaagaatctggttgtaacaagaaaactaggcccagcacagtggctcatacctgtattcccagcacttcgggaggccaaggtgggaggatggcttcagtccaggagtttgagaccagcctgggcaacatagtgagacctcatctctacaaaaactaaaatgtacctgagtgtggtggttcatgcctgtggtccctgctacccaagagctgaggtgggaggactgcttgagcctgggaggttgaggctgcagtgaaccatgatcatgccaccgcagtccaggctgggtgacagagcaagattttttttttttttaaatagtcctgctaagttaggagatggatatctaatcactcttgatatctgattgtgttccttatcccacaccattgcccaggggatgtcttgtcaccctggcctgccttcagcaagaatcctgttaggtctgtttaaccagaagctccccaacccccaacacccccatgtttcctcttattaattttccatccactgaccccaactctaccctttggctgtaaatctccgcctgcccatgctgaatctggaatggagcccagttctgcaccgatatcattgccccctcttgtagtagttcctgaataaaatctgtctttactgctttaacgccagtgcagctctggttttctttacactataataaaagctctattagtttttattagttgttgatgatgatggctgggcagttccctttcttttaattgtttttactcctcctaactcaatttttattgtttctttttaaaagaaatctatcctcctctccccagtaaaaatcccactcagacaatttgtgatctagttgaagtttgcttgcctaaagcaagctttcagaacaactgggctcccagaataatgagagaaggttgtatttatagttcaagttattatatagcagttgacagtttcattttgatttaaagtcctgtctctgataataggaaaaaggatcacagcttatctctggctgtaaggctttagaatggcctgtaattcaaggcttatctctgggaatgcacggcttttaaaaatgtaaatctttcctgggctctggtagttgccgtcttgtatcagatggggctaagctaaggatgagaatgtcagttttattttttcaggttgtcttataagcaaattctacctcaaaggcatgaatttgaccaaatatgtctgttctagattttctgatctagtataattaacttgatgttcttttttatttggttggttttgcttacataggcacagaaagaagtagtggttattacataaagacctccttgtatgcttgatcataagatattaaggttaaggagtgaatttgtgtctgcgactccatcacaaagcccctggattcatatttttgatcacttttattatgccagaaatattctctgttgcctttagtagttcatctatttccatttcaggaaccaaaaacatgtattcagtttccccttggagtgcctttaactgtaaggtttatcttctttctctgaaatcttcatatttacttttcctggctgaccaagaagtacaagtcttgacatcctgtaaggctgggactctgtaagccccagggaaggctgtagagcagtcttccaggaggattctgtaggcatcatttccacatgaagtatatagtccttgttccttaatgtcacagtctcaccaatgccccacaatgcagcagtgtcttgttgtgaggtatgacctggagttctttgtctcatgaacaagagaattaaggagcatggacacaaagggagcggttggaacaaaagtttaataagtaagagaataaagctctctgctgtggagagaggccaatttttacagttgaatgcaaaggctttggtaggaaaccaatgaggtctgggtatctcaattgcataaggtgcgaatttctggtagttccactctgtcctcctagtagtcatgtgatcccttagcttcagttactccatattgctttgctttgttccccttactgtgcatgtgtcagggcatggaattttccattgtgggcatgtctggtcaagtcacctgtgtagccttttttttttgttttttgagacagagtcttgctgtgtcacccaggctggagtgcagtggtgctatctctgcttactgcaacctccacctcccaggttcaagtgagtctcctgcctcagcctcccgagtagctggaattacaggcacatgccaccatgcccagctaatttgtgtattcttagtagagacggggtttcaccatgttggccaggctagtttcgaactcctgagctcaggtgatccatccacctaggcctcccaaagtgctgggattacaggcatgagccaccactcctggcccctgtgtagtcttttttatctgtgcagctgtgggcatgtcttaggtaagcccctctgtgtaaattcccttatctgtgcctggaggctgttcttttgtttgaaagaaatcaactgaggacccaccctaactgcctgtctgactgtgttctttcccttctcctctgtcattaataatgggctggtcaaactcaattaaatgagatttaaatgagacgcttctggaacggttacaagtttggtttatccaattatatcattaaaaagacagatttttttttttcttttaaatttaacttaaaaagtttttttttttttttttttttttttttttttatagtgatggagtctcattatgttgcccagggtggtcttgaactcctggcctcaagtgatcctcccacctcagcttcccaaagtgcagggattacaggcatgagccaccgtgcctggcccaaagacagaatcttattgaatccatgcaaataactacattgctgtgaaaagtaaaagggtttaatgaaggcactttgattgtttgggtcagttttgcagacaaaggcagtcaataccagtgttttctatacacccatcatccttaagttcttgctgattcattagcttataatttatatccagatattctacagggtatctcccctgagttctgaagtaagatttggagcaacataccatccaatgagtatgttcttgcaatttgcataggattagtctgctaaattatagaaagaagagatagatcaatatgtaagaaaaattgtttcctctgcctcctgtaaggaaaaggacactaaccacagttaaattacccctttcagttcactttagtcctacacatttaattcctgttctgcaggagcttgggtcagcaggtggctgtaaagagtcacctgcttctgggccacagggtccctgggagtcctgccgcagtcctctggcacaggctgacggggcgtgatgttacttcacagtattcacgagtcgtgaatactgtgggagccaagggaaaacttccctgtgccctctgaaggtttgctgaaaaatcaatgtacaaaggacagattaactggagaaaaagcatgcaaacttattaatgtgtacacaggggagaatcacagagtaatcactccaatgccccaaggcagtgcagaagcttatataccatcttgaggttacagaaagaatggagtttcaaagccttaaaagacaaacgtcagctgaattaaaatgtaaaggagttcagctgagcaatgagtgattcgcaaatcgggcagcccccagaatcacagcagattctgagagtcttcaggtatgtgttgtgatcagaacaaatttatagacaaaaaaagggaagagatgtacagacattggaagtgaggtacagaaacagctcgattggttacagctcagcgtttgccttatctgaacgcagtttgaacgcttagcagtctatgagtggttgaagtatggccactgggattgaccaagactcagctattgttacaggtgcatactcttaacttaggttttaaatcttgtctgcctattaagctatgttacctaataggcatagctcctatgcctattaaaagtacggagtccccttcaggccatatttagcttctcaggccatgtttagtttgctttaacaagagcaagtcccaaatcatgccgtggttttgttatggtggtaaccgtattatggtggtaaatcaggttatactggcaagacaggtcatgggagggggaggcgaagaggcctggccggcaaaggtggtcttgttgtatagatgaaacctcacaggtagcagccctcagagagaatagatggtaaatgtttctttcagttgtctcaaggtatcagactctgagttaatcttgcctagatgtggacaagggaagacctggctgcattaatgcagattctctgcagatgcaaatctctcctgcaaaacacagctctgcaagatgacttctgcctgctggctctctgaacagccatctcacaatatgtcaaagaaatattttttggggtaaaacattttgatttccttccgtatctaaaactgtactctactgaggctaacattcttttgatatttcttccagaaggctaaattcctgatctgtagcttgtagcaagggtctttaggcaagaacaagggaaaaaggggaggtgccttttggtgttaagactgaatggttttggttaatttagtatagtaatgtcaaagaaaaatagcacgggacacttgtgacagggggcaaggcagactttactcagactactgcagtaggggagacagactccaggagcagctgagctgagctgcagctaaaacaaaggtgactgagatttttaaagagagaacagaaagggaacgaaagggggctctagagaaattaaagacagaacaaaaaagagacctgggggcgctatgaggaaatggaaaatttcagaaagggtaagtggagaattattgaaagtggtttggcaaagtggattgggattacgggcattttatggtttggcagcattttgtttgcttgagcaaaaaattcagcatagaaggctggggtcagctttagggacacaacttggtacaggtggaggccaggctcaaatgtagtcaggtctcttggcacggtgttctggtaagttcttcgggccacatgggaggtcacagtaaccagtggtaagggagtggaggggagagtggagctccctgtaggagtacaggaacagtgtttcaggattttgaaatgaccgattatcctgagggtaaaaacattcgtctcctgtccatgtcaaggatatggacaattatccagggctttctaatccaaccaatacaaatattttaaatataaaggtatttgaaattgaggaacaagctgggcgctgtggctcctgcctataaccccagaactttgagaggccagggcaggcggatcgcttgaggtcaggagttcgagaccagcctgaccaacatggtgaaaccccgtctctacagaaaaatataaaaattagctgggcatggtggcatgcatctgtaatcccagctactcgggaggctgaggcacgagaattgcttgaaccctggaggtggaggcttcagttagccaagatcgtgccactgcactctagcttagacaacagagtgagactctgtctcaataaataaataataaaaaataaaattgaggaaccagcagggtgtggtggctcacacctgtaaccccagcactttgggaggcagaggcaggaggatcatttgagcccaggagtttgagaccagtctatgtaacatagtgagaccctgcttctacaaggaaatttaaaaattagttgggcatggtggcacaggcctgtgatcccagccactcaggaggctaaggtggaaggatcatttgtgcccaggtggttgaggctggagtgagcccagatcatgccactgcactccagcctgagtgacggagactttgtctcacaaaagaaaaataaataaaattgaggaagcaaagtctttaaaaaaccaacttcttaatcattaatgaaccaatctttatatttcattatgtgattgctctgatccgtcccggagggcctacgatggtgaaaatgttcatattaataccattttacctgtactgagtgatatgggggatgcagcttctcttttgacttgagagttctcagatggttgccttggtaatcaggtcacctctcaccacggtgctgagtcatttaacaaattggagggtgtcaaccctgattgtttcccagacttccctattcccaagggcactgggatgggttctgtcacccagacccagattcccacaagatttcctgccctgccctgcacacctttgctcctacacaggctctgcttttccccgtccccggagtgttctcaggatgaggttgagggatccaacatccaaagactcagggccttctacctttcctgactcacttctcactgctccccttggggccccccactttgttttcgggttggccaagtggttgatacctgagagcccatcaggaagtctagatggttatattaaccgtgcctttttcttttatgtatttttgaagttttgacatcttgggggccttgctaaccttagagatgtcagaggcttgtaaaccagagcaactccatcttgagtaggggctgggtaaaatgaggctgagacctactgggctgcattctgaaatggttaaggcattctaagtcataggatgagataggaggtcgtcacaagatacaggtcataaagaccttgctgataaaacagcttgcagtgaagaagccggccaaaaccaaaatcaagatggcgacaagagtgacctctggttgcacgacccgtattgttaccctcccaccagtggcatgacaatttacaaaagctggcaatgtcaggaagttaccctgtatggtctataaaatgagaggcatgaataagccaccccttgtttagcttatcagcaagaaataaccataaaaatgggcaaccagtagccctcggggctgctctatctaaggagcagccattcttctattcctttactttctttcttctcccccctccctcagacggagtcttgttctgtcgcccaggctggagtgcaatggcgtgatctctgcttactgcaacctgggttcaagcaattctcctgcctcagcctcctgagtagctgggattacaggcctatgccaccagcctggctgctttttgtatttttaatagagacgggtttaaccatgttggccaggctggtcttgaactgacctggtgatccctctgcctcggcctcccacagcgctgggattacaggcatgagccaccgcatctggccctattcctttactttctcaataaacttgctttcacttcactctacagactggctgtgaattctttcttgcgtgagattcaagaaccctctcttggggtctgtatcgggacacctttcctataacagacactgacactgcctctcctagggtgagccagttcctagagatggtaaatgactcacctgtgaatgcaccttccataggccaaccaaccaatccagagcccacaccccacacctgagctctcacactgcaggtcactgtgccctcatcacccagggccaggtagtggactaacccctgggacccacagcctgctgaaaacaattcaaactagccaaccctatggcagtttactctgccttgcatggtccttccctcaggaaacacaataaaggctcttgctcacgttttcctctcgctccttccatctcctaacctgggagctttctcgtgggatcccacatggcatgatgggcccccagctcttgggaactgggagaataacaatcttttcaatgataatctcctagtctgttgattttaccatatctgaataataaagattaaactaaaatatacgcacacacattagaaacacaaggtgttactacttcccctgaaaatatggtgagactcactcccctatcccaaaggaaacaaaatacttctcacttcttcctcctgagttgtttcacctccatccctccagggatccagggagagtgaggagggacttcttgttagagggacttcttgttagagcaaggaaattctataagttttgtcccaccctgagataaagcctaatggtctaccctcatgcatttctattttcaaatcctctttttatttattaagaatagcattgaacttggagttggaggctgacctgccctgtgtccatctggcttggtgagcttttttgagacccaactcctcagggtcttattttatgtcactattatatataagacttttagatagaatttcctaattcctgtgattctatttcttttggttttaaaattttatcagaatctcacgcgttaagggacatgattatgtttccttcgggaacagaagctaagcaaatgcagtatttatttatctttgcagatagagagcggttgacagaggctctccagtctgaattccagggaattcttaactcaagtgcttgctcttgttagtttctatttgttactattaaagaggagattttccttaatgatttaatgggaagaaatcctcttagtcaacaggtcatctgctttcactgcccacaaccaccctggcccagagctgggggcctcttagcctggaactaccaaagacaaaagcctgtaaaccaatttatctgcctccaacctctctgggtcaccctgtgtgttggtttccagcagttgctggagcacagtaccacaaacctgatggcttaaaaccacaaacatttctttgtcacagttctaggggatggaagtgtgaagtcagtgctggcggggtcttgctccctttgaaacctgcaggggaaggtccttccttgcctcttccagctcctggtggctccaggtgttcctcagctggcggctgcataacttcagcctctgcctttctcttccctcggtcatcctctccccttgtgtctctgaggtctttccacgacattctcctcttcttataaggacacagtcattttggattgtggacccaccctgttccagtatgacctcagcttaacgaattatatctgcaatgaccctgtttccaagtaagctcacattcacacttgtggggggtgaggacttcagcatatctttttgagggacacagttcaatctgtaatagcttgcttatagtaatcttcctgcttactgttgtttttctctgtgtcattactatagagaacacaaggaaaggacctcgaggtatttataacaagaacttacaaatagaggggagggaagtgtcctctgaccactaaactatacctaatggcttagtgcagagcggtgtgaagtccaccagagagttgaggcagatcctaatctaagactcacccgatgcaacctgctgcacacggtgtctgtgtaagtgctgtggtgggttagtcagccgaggaagctgagaaaagggagagcagagaggacagcaaaggggcacatcttttaggcatctgcaggtccccagaccgggtcctgggaagctgggtagccaaatagtgaagggctggatgatcctgggtttatatccttactctcttcataagttgtataactttgaacaacttacttaacctctttaagcctcaaattcctcatgggaatggttagacctccctccctctctccctctctccctctctccctctctccctctctccctctctccctctctctatctctttctctctctctctctttctctctttctctctttctttttttgagacaggatctccctctattgcccaggctggagtgtagtggtgcaatcttggctcactgcaacctctgcctcctgggctcaagtgatcctcccacctcagcttctggagtagctggatctacaggcacatgccaccacacccaactaatttttatatttttctgtagagagggggttttgccatgatgcccaagctgggctcaaactcctgtgctcaagcagtctgcctgccttggctttccaaaatgctgggatgacaggtgtgagccactgcccttggcctagacctccctttgattggtcgtgtatataaagcacttaggagagtgcctggtacctactaagtgctggtagatggtggtcattgtaataatgattttgcagcaagtatgcattaggactcttgggcatacataagtggtagaatgagtttatccaaaaggcggaatgtaatggaggagaaatacacatacatctagtgtatatgttgattactaaacccagcaatagcgtttatgtgaccataatctggacaggggaccagctagaatcagggtctccaatgtcaccaggactttgcacttctgtggattatttggcatcttatttataaaattttgttgcctgattgggtaaaactaggtactttccaaatcttgagaaagatcaaagagttttatccttttctctgcaagtaactacctattccttcagcaaaaggagagaggagaaaatgaatattactgtcatcactaaaatggctacagtaacaagaagtttaatgattgagaagaagttaaagtaaaacagtctcatgaagtgcctcttttctcagcatcacacaacaaaagtttctttacttagatatttgattcttatttactatttgccttgttttgctctctgtggccaatttgtcactagattctgaagctctcagtcatgtctcttttgctattctcatgggtcctgaaaatggaacccagtgtttttttccctttgtttctttgaccacaccgggttttgttttggattatttaactgggatatgtggtagaacgtttccactggaaagatgagaaaagataaactacaccaagacttctctgttttcaattttgctgtgacttatttcatctttgctcaatatcatttcttgctcttggtgagaagtggagctcataataaatatagtcttgtgggaaaatgatataacattatgaagcccaaaccaggggacacagtcatcgtgcaagtcactgtatgaaaagcattcttagctttggttttcattccctttaggcagtttctggaggagataggctattctattctaaaattatgtgcctaatactgtcattttatttcttgagaagatttttgtgtatattagtataatatgtaaaaatacaatataataaacacaaacataatgtataaatgtaatatgcatgaatgcagacatgaatgcaagtttagtaactcacactttaataggaagacctaggaccctaaagaaatgatagcttttgtcaacatcattgttcccccagctgctttggggctttgtcatatttttatacaaagccctattgtgcctactgcccttctgaccgttcaaggttcattgttaccctgacaggagctgtggaggggatggggcgcattcattcctttctttgtttggaccagactctgtccaattgtgagtggagactgaatggcttaggtgcaattagttggcttctgtgtttgcagaccaagaaaacgctaagcttttagctctgatggtacccaaagaaaatcctgttgttggtaccagtttctagtagcctcacttccttctggggttgagttatcttaattcatgtgggatataataagatgtctttgcatagattttgatagtgcttggagctgcagcacttagacaccaccggctgtcgatggtgtcaaataaaaaaacaaatccatatttcaaaaggattactgcaaagtgggaagaagaaaggataattgcaatcgggagaaagctatgaccataaggttggcaggcagctcaagagagaggcagaatgggatttcttttacagagaggaataaacaaggctggaaggaactgggtatgggaagtggtaggctagtggatgagagaacgtcctactctgaggtcagcctgttcttaggggtggctctgtgctgctcaggctgagggtgggtcaaagttcctgtggaaggcgagcagcttgacccaagcttggttaaaaagcattttgttccgcttgattcatgaggacaagcagttcagctgatcttttgtgaggccaagaatgggacctggtgtgtctgtgtcatctcatcctaggtaaaacaaagggaacactcatgagtcttctttaagtcctgtggggatagggagttctttgcaggcagctgttttctggaacacaagaaagtaaggggatttcttaaccgtccctgttttgcaggatcagtgggctcaggtaaaattcaacgttgtcaatggttatgcttagaagttgtcaaactaaataacagagcgtgattctccaaaagaaaagatgtttatttgggaagagagcattgcaacgggaatatgaatgccgtaatatactatgtatgtattcagggaggtagaagaagaaaaaggctttgaaaggaaaaaatgaagaggattacatcattgttttgaaataattattcttggctacaaggatcaacaggggtgatgccagtgtggggttagacaggcagctactgggcagatgtctttccagtagtatttttgtgagtatggttgtgatggtctttgtgcaaggttgtggcttttgtagtcttttttttaaatttcaactttaaaattttagattcagggggtaaacacaccggtgtgtttcatgggtatattgtgtgatgctgaggtttggagtgtgactgatcctgtcatccaggtagtaagcataatacccaggtctttttcattatcaggactgctagcaggagaaccctttcttcatggccttgcctggctctatttgtcaggatttattttagcattagtggctccattttgattcagacacctttcacaaagtgaacgggtgtctttatacatggcagggtgccaagtcatgctccagcttccctgggagaaggtgggttcccatcagcagtggcagactgatgacacatagcacagagacaccgagagagaatctctttccaaaggaggaaccagtttatttagggagaaaaattgctttggaaagagaaaaactctctcgcctgaaacccaagaaaggaacataccaaaaccttctgttgtttgctaaataagagcaaagttgtgtataataaggcaattttaacagggaattatcagcaggacataaatggacggtgggtggggtttctaatgggtatcatggaagacagattttctttgcattaaaatttggtcttgttttgtattgtttaattatgatcatttcagatccacagtcacttgagttcttgtaaataaatccaggctcttttgtgtatactctaacagtggtggttcgttgctctatcctgccctgccgtggctttgttatatcacaaaatccagcaagaatttatcttgctgctaataaaatcagaagatggcccagaagaagaagacaaggattttgtcttctttgaggttgccccatctctaaccagtgacagaaatggcagacccaatttaggtcaccttctaccatgtctcttaggatttgtgcctgcagcatcataaacaaaagtggcacatggaaatgacaaagacagcctgacacagtccttttgatatacgtgtattgtttgtgctctatgttcatgcaattacgtaagatatttatttcataaggaggacttttgagactctagtgtagatgttgattactaagccttgactatctgtacttgaaaataaacttaatataaattttaatctatcttttatgtttacatgcatcatagagtgatttttacatgcaagattttggtaaaattggatgggatctttattctggagtctctgtgtggctataaaagacattttctcttttcctttttttttttttttgcctggtatgttgaatctttcatatcccttagcttcagtatacatgaattgatgattgaataaattaaggataagcacactgttctgttcttctaaaacctttatttattgctgtgatttatctgacaatttacataaagtgctagttagtacagctgaaattattaattcttcagagaatgagatgttcaactgtttccacagctccaggcaaattttccacattgatatgcaggaattacacagaccacaactcgttttttgaattaaaatgcatcattgatgctaattttaaggaagtctgtatattgtactcctatttaaccaaacatcacatttcctcattaaaatatcagcatccataatgaagcactttgcattataatttaaaatgtcccactatgttgaatgcacatttgaacatttaaatgtaattctgctaatgtactgattaatttatgttattctcttccactcacgtggcagattttaattgcaattagttagctgctgtcgggtctcggcatgctgaaggctgggggaagtcctgatcggggtagaacaattaccaggacttttgagcagggctggtattagagggagcgagcgagagcacccatcaaagttgtgaatcttaattctcctggtaatagctatgcttggggggccagcatttgctctgaggaaaaagccaaataaatgggaattatccgagcactataatacaattaagctgtcacaacaactttggggactgatcttttgtactctttccacgttcatcccggcggcttgggggctgatgtagccgggaacgtgctctctccggcatcctgggcttttgatgtgtgtgatgtacagctgtaacaaggcatggggtacaacacccgcctttcactcaatgttgttgagctacagattcatgtaattaattttaaaaagccattactttgatcttcataaatatgcccaggattcaaatggaaaacctcaaggggaattttctcaggaggatgatatggccaaaatgcaatttcattagggtctactacttgtccctaaatgaggctgcccccaccggccccagcttttatttcagtggctgctattaccagctgcactgctatattatgcagaaaatctgcttgcttactctgcaaacaaactgccttggttcaatgagctattcgtaatgttatgctaagctttgtgatatattgctataatttggtgtaaagcacttttagttcttacactggttttattatgttaagtatagggcactggtgtttagaaatgagatgaaaacataatccttgaggtattcactattagtgaggcacagaggagggggctctgggccccttgaacttgggttctagtcctacttctatcacttcatggtctctgtgaaccgctgtgctcttagctctcagatgaggatagaatgaacaattcctagctcaggtttattttgtgggtcacattacaaacatggggaaaagaggtctgtaaaattagagcagaatgtgcacctaaggcttgatgttatagtagcaccttacttttgttttttattggcatgacttaaaattctgacaaaaatactgttgagagagatggagctccaaactgccagcctccttcttaagtaagtaatttctaaaaatcctggtaagtagtagaattgagcagtgacagtattaactgtggttaaattgtagaatttttggaagagattatgaaagctgactctaccctcattcaataaaatgcatcaacattgcagatgatccccaaatttcagtggcttaacacagcagaagtatacttctagctcatgctgcatgttccagggtccacagggacccaggtgaatggagacctaattttttttttttaaattgtagtaacacatgtgtgtttctgaggcctccaagatgggggaaaaaagggattccagggggctgggagatgtccccaaacaccagtggggcctcaaccccagtcggtgtccaggctcttgacagcatcttgagaaggaattcaaggatgaattgtaaagtagtgaaagtatggagatttattgcaatgtgaaaggtatacactcaagaaaggggagtgcaggagtattcaagagaaagccatgctcaagggggtttggggctgctgcctttatgtgtttgtttaaacaaaggaatattcaggacaattcctggaaaaaggtggagacttcttggaactgtggtgccacccatttttacaccaaatactggttttcccggaatggtcacagcactggctgtgtttaatatattaatatatttagcatattaatgagtgtatcacaaactcctaggagaaacctaggtcaaatccagtgccatgttgggtctagttggtcttagtcttagcttggcccacaccctggttgtgcagagtcttacagcctcaagcttctgcagctacttcaacagttttccttttgctaatcaggttaaactgctgctggcaattttctattctcctgcaaccaccctgaatgacccctgtctcagggggacacaggcacaggcccttacatgcttactcctggaaaggatgcaagaaacctatgctcacttctcatagcccaagggacatgcaaggtatgtaacatgttggcagacccatcatcctctcatgtgccacctgctctgagttgctgacagagcctgaggttagttgctggaatcccagtctcctgtatttggatggtggggtgacagaggaggggtcttgaggggacagcctcttcccttagaggcatttcctagtggtctgatgcattggccgaatttcctaggaagtcccacagacagaatcaagtgatgctcctagagctttgcagatatcatccatagtccctgccctgagatggcttatagtgtatcctagtagacttctgaagaagcctgactctgacgtgcaggacaactaacagcatagcatccttagctcctccagactgtgttaatttcttatggctgctgggaaaattaccaaaaatgtggtggcttaaacaatacaaatgtattatcttgtagttctgcaggtcggcagtcagacatggcttagaattagtgatggcagcctccttgctgtggaggctctagggaatctgctgtctttccttttccagagtccagagactccctgccttcctttgctcgtggctgcctcttccatcttcaaagccagcagcgtggtctccatcatctctcacttacatttttttttcttttttcattttttatatctttctctctaattctcttctttttcctccttctacttttttgtttgttttgttttgagacagggcctcactgttgcccagactggagttcggtggtgcagtcctaactcactgcagcctcgacccccctgggctcaagggatcctcctgcctcagcctcctgagtagctgggcctttttttttttttttttttttttttttttttttttttttgaggcagagtcatgctctgttgcccaggtttcagtgcagtggcatgatcttggcacactgcaacctccgcctcccgggttcaagcaattcttctgccttagcctcctgagtagctgggactacatgtatgcaccaccacacctgctaatttttgtatttttagtagatgtggtttcaccatgttggctgggctagtcttgaactcctgggcccaagtgatctgacagccttggcctcccaaaatgctaggattacaggcatgagccatggtgcctggcctcctccttctacttttaagaactcctgtgatcctcttgggcctacccagataatccaggctcctccagatctgtcacaaggtccacaatgtggaccacatctgccaagttatttttgccatacaaccgaacatatccgcaggttctggggattaggatgtggggtccttggaggccatcactctgcccaccatgcagacagacagtagtgaggacacctgctctgtgccagaggctgcaccccactctctgcatgcatcccctcacttagcttgcacagcagccctgttagtgaggccttgtggtgtccttgttgagtagaggaggaaatcgaggctgagaaaatgaccactaagaagctaaggcaggctttgaatccgcctttcatggtggaaagaacacagttttggagcaggacaggcggtgtggtgaattcagctccacatcctgattagctgtgtaatgcctggcacttctgtggttcaatctccttgtacacataccacgtccgtcatatggcatggggcatgtggccctcatgaagagagctgtgctgttggaacaaaggtgagacacattctcagtgaaaaaaaccaaatggaaaaaaaaaaaaacatcccaaattcccctagcaccttggatgtcatggtggaaggaacataggatttggaacaagactaatttgggtttgaatcctgactcttactatgtagcaggctcactttgccagactgatacgttttcatttgctaatatatgtgtatatgtttaaaggtttcatttcttctgttcattcattaaacacgtattcagctgcaagctgggacctgtcagatgagaagacagggcatggtttttgtcttcattgtgtagaagagtggaatcctttatttcctgccaagtctctgctcccttacttttaaagcttgcctctctgaactagaaaaggctgcatcccagttaacttaatttttttctctgctacactcctcaggaagtttccctgctgcttctcacgcatactccctttattctcatttgcaagatcattactctccccctgctcctggcatctggcctattttactataccctggccagtctacctcctaaatgtctctcctcccctcctttccatcctcactgtcttaggtcattgtcatttcctaactaggcatggatcctcttaacagagtttcctgcttccagtctcctcccctgtggtccctggcccacactatatttgaggacccctgggctctcttaataacatgacatcccagtctacctaaaagatggtggagaagatgctttggggctgggagggtcagctggaccacatgttccctgctcccgtccttgagatcgaacctgtctttggggatgccattactcatggctgctacctctgccgacgtttatagctctattttcctatggcacttcaggacatagacccttttctttaatttccttcctcacagctgacaccagatctggcacgtaagcacttaaaaaagcctctttctctccgtggaaaaacagcgaatgacaatacaaggagctgttttgtacttgttaccagagatgctcagagatgctgggggaagtggggggtcttgctacctgtttatgctccctgctcagcttcttctctgctgtaccatggcagagaccatgtgtcctcttcatgcagggagctcctttaggcatttgtagagatctccctgccctttggtatcacaaaaaacctctaagccctctatttctgtcctagaatctccaattttcccaagggggctgatagtcgtactctattttcttcaggggcatccacactccttacctagaagggtgtggcctagccctgtggtctccatgcacatccaaaagccacacttgaaaatgatagtccagcctctttatgacagcaacgtgaacagtagttggggtgtagtttcctcacctgtcactaaaatgcaaatctaaccaagtaattagtgtttatgatccatcaatacctctccattgccttctgaaaaaagtctgagctcctggctcaggcctttcctatctttctaagaggcttctgacactgcctgttctctagctgtattgaaatgcctgaggcattccgctctcttgtgcctgtgtgccttgcttctgctgttctgtctgcccagaattattcccacctggcaaattctaattttttattttaagaattatttttagagacagggtatcaccctgtcacccaggctggagtatgccttggcctcctgtgtagctgggactacaggtgtatgccatcatgcttggctaattatttatttatttatatacatatatacatatatatacatatatacatatatacatatacatatataatatatacatgtatattatatatataaaatatacacacacacacacacacacacacacatatatatatatatatatatatatatatagagagagagagagagagagagagagagagagagagagagagagagagagagagagtagaggcagggtctggctatgttgcccacatgggtctcaaacttctggcctcaagtgatcctcccaccttagcctctcaaagttttgggattataggcatgagccactgcatttaacccaaacttctatttaatcttcaacacagcacaggcatcccctcccttttctgtgaatctgtccctgaaattccgcccccgacctgcccccaactcttcatagcgataaggatgtgatggtgaattcaccacaccacgtgtcctgctccaaaactgtgttctctctgctcttaatacatatacacatatctaggggtgggtggtagggcgggcagaaaagtgtttcctctactcagactcagtaactggggactgtgaattaactgacaaaagacacgttaacgggagaaaaggtatgtttctttatgatgttaatattttttgtgcacaggagcttcacaagacagagaaaaccccaagaagtagttagattggaagcttatataccattttaacaaagggtaatacattgtggagaagtgactagacaaagaaaagggaggtttaggcttctggggtggtggtaaattgtgggaaggtgaatgtgtgtgtggaaactcatggaagataagggttattttagcaaggtttctctctgcagactcatcttggtgacctttcatcttcttcatggctataaaactgctggagagaagatttatggcagtcttcatttctcagaagtttctgcttttagtcagataagaaaatctctgaaaagtcttctttctgtatctgttgattctcagttgccttcagctcataataatacatatgccaaagtggcatatcttggggttgtatattctgatccacttcagctctttattatggcctatgtcacattgttttgatagtctgcttatctgtttcctcctgtgtctgtgagcttatccaggacagagatatgaattatttgtctttgcatccatatactgatgcttgggttccacacccacagattccgatataattgatcttggatgctgcctggacactgggatatttaaaagctcctcaagtgattctaatctgcaggcagggatgagaacaaactgcctatgaccaacgttttagatcctagcattctcccagcattctccaaagctcttggggaacttcctctcaaagcatgtcagtgatggaggggagaatactgaaactaacctctggcttgagcagtaagctagcaggaggaaagggttatcttgggagcagatgccaacaacagcatcttgatctggaagttggtactaaactgagatgtggcaccaactcatggagatgagatagtgtttattgggaaaaatccactgagttagggtggtacagaggcagacatcagagtccacaggaggaccctaaccttgggctgtggggcttttagatcgcattggttgggaagagatacaacagcaatatgatatggcagaactttggctccagcgctggtctgccaactcagtgttcatggatgaggaagtgcagcgtatccccaggcatggccagagggctgtaggccaacctttgaggttgaataggattgattgtcttaagcactgagctgtggctggtttccatggagctttgcaagaggccaagttcttttctgggaggccaaacttcagggtgtctatcttagaaagttaacccttaccccactcacagaggatgaactcacagacatgagccagcaacaggagacaggatgatccaaaacaattcagaaaagaacaaaagagaacttctgaaaataaaaactataattgttgaaaaaaatccttagtgggataatgagacagtgaattagacacatctaaaaagagaattacaagaagatatatttgaagaaactatctagagcagatgcagagaagagagatggagaatgtaaaataaaatttaggagggagcacagaatgaaaaggtataccaaaaatctaagagtttctagaaagagagaatagggtgaatcaagccagacaacatttgaagagatcactgctgggaaattgcaagactgttgaaaaagatgaatatattgatcccataccaagacaaggcatagtgaaattttacagtactgaagccaaagagaagacttttaagttgtcagagaaaatgattacctatgaagaatgtcagttagtgagtggacttctcaatagtcacatggaagacagaaaatagtggaataatatattcatgagagaaaagaaatgttatcttagaattctatatctagaaaaattatcttttaaaactgagagagaaatagagaccttttgttcttagataaaggtgtgcaggatttacctcttccaaatagcataaaacaaccctttgaagggtgtatttcagaaagaaaaaaaaatgatcacagaaggaaagtctcagaggcaaaaaggaatgcagagccaataaaatagcaaatacatacattgaagcaaagagtttgtaaattagagaataatgattcattttcgtcttttaaaaaagtcccagaatggaagcacttgtcaagtgtgtttgtcagttgtatcagggaaagaatagtggttatataaaaatttctctgaagtccttgtctccttggaaaagaggttaagatataatctattactaaactttaagttaaagatgcatagcacaatttcaaaggcagtaaaatatcagatttagggtgctttaatttccaagccagtaaagggaataaatggaaaatatgataaaacaaataaaaattttcagtccatcccaaaagaccaagaaaaaagaaaaaagaggcattaaaatttaagaaggggaaataaaaggggcatagaaaaggagagacaaatacaaatttaagaataagataatagaaacaaatttcagtatattatttatctcaaaaatagtaaataagctgaatttacataccttaaaagagattgtcagaaaaacagattttggggaaaaacacaaagagatctagtgaaatgacatttctaagaaatatttcttataagaacagaaatgttgaaagaggatggaaaaatatatacctgtcaaatacaattaaaaagaaagttgtgacagtcatattactatcaaacaaaagtagacattaaggcaagaagcattattgaggaatgagaggatcgctttttaataataaagattcaatttactgggaagatttaatatttcaaatgtgtatgcacctaataaaatatcttcaaaatatataaagcaaaaattgttagatctaaattgaagaactatctgacaaacccaccaccagtgtgggagattccaacacatctctgtcagttattgatatgtcaaacagactgaaaaatggtaaagaaaatttgcataacacaattaccatgcttgatttattgaacatatgtaaaattctgccccaatatgcattcttcacaggcacacatggaatgtttactgaaattgaccatatagtaggccataggcagctatcaattactttcaaagaactggtaatattcagaccacattctcttgccacaatgcaattaggttagaaatcaatagcaagaagattaaattgaaaaattccctatatatttagaaattaaaccacatgtctaaatagcccaatggatcaaagatgaaatcataatgcaaatgaaaaagatgatccatagttggaaatcatccaatccagtgttgtatgcccttgacccagagggccaggtgggaggggccatggtgagggcctgacaagggctctgggaagattcttagaaagattgatcctcaagcaattaaggcaaaagcatccaaatccctgacctgtggagatttcatttttctttattgatctgtcaaatggtctaaattctctcactcaggttgcttcttctataattaaggataaaaatattcctgtgttgcattgcagagtgtcaggaaaatagtcacttgagcagaccttgcaaatgttggctggacgccctcacctgcctttagggatgcctccgggggtatataattcctaagtagacacccatggtttcgtatatggctactaacatgtaggcagggcctctggataccccaggggaagacctttgatgcctgaaggcagctggctgcagtttaatcgccaggtagttcatctcagccatacactgaactgtgggcttacacccgggatgcctttgaattggagagctacaggaagtgactgtgccctgggcttctcttattccctttccaagcttccattcatccactttcaacccacattcatattcctgccttaacggcaagttgcaaggaatgagaggcatatctgtgccaagcactgtgcaaacctgcaagtccagtgtgcacctgtcatttttcaccctcactttttagcatatcaacctggagaaactcgatgcggctttctgcattctaaggcccatagtgccaaggtaggacccatcactccaaattattttttaacttattaaaattagaacctaagtctagatgataatctaattccttcctcctaattaatatcattaattgaactgattaatcctaaatgattaatcctgacatgataatggaaacaaagtcaaacctcctatttcctaaatacaaatgactaaatgtagcacaatgctgtgtgagccaaaattcggattatttcagtctcttctggaggatgtctcaatacaaactccttaaacttagagttggaccagctcatgttgtcacaaataaaaagcactgcctggctttctcatttgaagtttgaagtacaacttaatttccaagaaacttagatagcatcacgtgcctctgacaagcagttactagccggtatttactcctcaatacggaataaatttaacagcaaacgaattacatctaaaaccaaatcttgtaactgaattaaggtaaatatgctctttctatacaactaacataaagtttaaataggcagagaaaagaggcatctttacttcttaaaaggcaattttcaaaaatgaattgaagagtaatacatctgaataataatgtcaacaaaaagaacaactatcccagcactttgggaggccaaggctggtggatcaaatgagccaggagtttgagaccagcctggccacaaaggtaaaaccccgtctctactaaaaatacaaaaattagctgaatgtggtggctcatgcctgtaatctcagctacatggaaggctgaggcatgataataacttgaacctgggaggaggaggttgtagtgagccaagatcacgccactgcactccagcctgagcgacagagcaagactctgtctcaaaaaaaaaaaaaacacaaaaaacacaaaaaacagctatagcaccctccatgagcaaatggaaacataacgttgctgtgtctcatccaagcaatatctaggttctagaatagggaggaggaagaacagagatacattacttgaggcaagaaaattatccaaatggtgtctcttccttcctacccagacaaaactggtattatttccctatctatttttccacttgctcccggccaatactataattaaaagacctccctccaaggatttcaaagtactttagagacatggtctaattaatcctcagtacatcctggtaatgtccgcaagctccaggccctgcctctgcccatcagaacccattgaggtgcatgcggccacacttcttgagtggcttatgggaagtgacagcagctgtcttacccagcctctctttccagaagccgtgaaaatagcctctctttccagaagctgtgaaaatggcctctcttgggtgccagggtcagtgtttgccagctgaagggccaaaaagccatcaatcagctctgatatgcataatctgcatattcattcttctgaatattcattcttccgcataatgctctgttgccttaattagggctgcagcctgcggataggtagaggcatgttttggagtctttcagccaatttatctttttaaatgaatcttttttggccttagatgttggtctgttcctatgatcacttagttgcccttcttggcctcttctctgggtttattttttgtgaggtggtacacagcctttctgcactggctgtattgttgattacactcccttttccagagttccattttctatgcaaccctcatccagaaagcgtaaaatgtctcttttagtcatttcaaccccaacaacacgtcgagttaatggctttcagcagcactgtttactacaactctagatttgctttctatatagaaaagctggagctcaccctagaacccccagagtgctgtctgcttgtaatttctcctaaatactctttattttcccatctgccactttttcctcccccatatgattgtgtgaggtttgtgaaggtgataaaacactgggacattcctgaagcattgcagagccagggcttctcaaaaccctaaagaatgttttaaaatgtattatttattataccatctgagagtcacatagcactttgatatactcaatatgatcttaaaataatgttgtgaagaaggaagctcagaatgcttcaatattgtttcaagatcacagaggacaaatgcagattttctttgtacgttatcaattttcttttcactcttttttgtcaatatccattctctttccatcaccacttgtgattcatttgacgattatttactgtatgtctttttttttggtgtcagacactgtgccagggcctagtatttgcacaaaaatatatatttttggcccccgccacagaaaatatttttgtatgggaaagggtcatcatgcaaagggttaatgcaatactgtgtgatggagacctgaattagatgttatgtacaggttgagggaattcttggattggaaatagaatgataaggagagaaagaaagagtgtatgcaaacacgtagaaatatgaatgcagatgcagagtctgaggaattctaagttgttcagttttccagggctggattggaaagcagcagagacaaaggtggggagaccactggggctgacatcctagaaagccttgtgcatcatcccagggagtttggactttggtcctcaaggcagcaggatgtcattgaaatcctgtatacagcaaagtcacatgatcagatccgttgattttatcaagctccctctgggtcttctttgaacctctcaaattggcacagatgaaggaagacgaatatgcttcatgttgggaaagagtgcaccgatgtggaaattctcacagaatggtagcagaaaaataaagtgaaaaatgcttgctggaaagaaatttggcaatgtgtgttaagagacttgaaagggtttattcttttaactcaatagttctgttgctgcagatatattttaggaaaacgatcttaaataaaaagaatattccagggcaaagttattgtttgggcaactactttttattaataagccactagaaacaatctaaaatgtccaacaatgaagtaatagttaagaatacaatgcactcataagtttataatgaagctggtgaaaagttttaaatacagtaatgtccagcaattgcacaatgtttttgctacccaagatccatttacacttatcctggtgaaagagctgtgctttctgtctggatccaggattggaacatgatgtcctggttaagccatctaccctgctctcagggactggttcaggggggatcgtgcaacctgagccaatttaatcataatgaatctcaataattattctggaaaggctgggacaaggatgcacccattttcctgctggatgtggacaagttcgtggtaatttgtgatattgacaacagaaacctcatataaatagaaatgttaaagtggtatttaaccagaccctgggaagagcaacacttgattattgccaaagaacattttgggaaatgtgaagagacagctgcccccttcacattatttatctttggaaggaatgtcaactcagcacctgatttatgaattgaatgagtaagtagaaaaaagattatttattttggaaaatcctcttcctatcccgaataatacctgtgctatgtaatgtacaacaatgagatgctggagcaaaatattaagaaagtccccaaagattcagagttaatcctcctgccacactccagagtaatctttgttaactgaaatggaaaaagtcattttccctctagacttgctgaacttctgtgatcaaagctccaggattgtagaatatgaaatttaggcagcaaaaagcgactcagagtatgaatttgctgatttgactcatgtgacttcaagccaagtctcttaaagttacttctaaaagtgcaggctgatttccaaacctgagtcactttaggcttccagtaagatgaagatcagacagatctgacacaatatggaaatgaatgtggtagaacaatttttatcctgggtgtgcattttagcctgtatttgtctcgggaatatttcaagatgcctttggctttttgggggtattagggttgtaagtgaccagcattcctcgaggtcaatgctattctctgcaaaacacaataaaagcttgcaggaggccgagggctgtatgagaaaattaagtattgattgaggagtagatatgatgttgtgaaatgtagttattagactcaattcagtgctgttaatttgaggtcttgcactttctcagaagattacaccagttaacaatacattattgaagtctgaggagtactcttaccccgcctcatgctctctgcatcctttctctcagctttggaagactgctttgcccaatcgatatgcttttattgaacacaggtttatacaaccagtcagctcaaatatgatcactttcaggagtttgcgacgcgtggcaaagtcaaatttccttccaaataatcttctatcaagaaatcagaaatcctgaatttaatcatcccccttttcacgtcccatgaattataataggacctcggaaatgaagaagaaaataaattcattctttcgctttcagtggtcctctctgccctgctgcttccagtggagttgaaataaacaagatccctgaacatgggaagggatcagaggtatctgtaactaagaacaacagatggaaaaaaaaaaagtcctttataaaatcttagaactggaaagggcattagaaacacctagtccagttctttcactttctagatgactcaattcatatctaaagtggctgtgatgcgctcagacttcatagctagtcagtggcagagctgggaaagtaattcaggtgtcctgacttcggttattttcactatgtattctgcctgcacaactgcctcgactgtgtacagggcaagaatctgagtgaacagtctctttaagaacaattgcatttataaaaaattaaatttacattagataattttcttccaacccttaaatgtcaaacaaagctaatatgcagacttctaagaaccttgcgcatggttttacagcatttttttctaactttgttttgtagagaggaaagtttttaattatcttcactttactgatgacaaaattaagacccagaaaatccaaatggcttattttaagtggtatagccattttggatagacaggtagatactcaaacctaggtccttgtactcttagttccgtgttccctttaatgttctctgcagcttccgttgcttactctaaaatttgtcttctggctggtgtgttggccacaactgtaactccagtgctcaatctggagatcgaggcaggagaattgcttgagggcatgagcttaagaccagcctatgcaacatagtgagaccccgtctctacaaaatacaggtttttaaaaatttgctgtttggtggtatgtgtttgtagtcccaactactctggagactgtggagggaggatcacttgagcccaggaggccaaggctgcagtgagctatgatggcaccactgcactgcagcctgggcgacaggttgtttctaaaatttttttttaaaaattgtcttcctgtaagactgaagcacttaacacttctctagttttgctactcctttccctaagccgtatgccctggaatggggcaaatgtttgcttaatattttagcctgtattcttaacacccaagcttaaaatcaaagagggaactctaatagtatttctggcttctctgggcatggcaaatattgtgttaatcactttacttggtgtttgcaatctgtttcattgtcgctaatatgaacatgacatacaatatatgagtcatttattaatcttgctaaattcacatttggcaatattctttccagcctgtgcaagtgagcacgtacagcctcacttgtgatcagaaccatgataccctagaaactgtttcttcctctgctgtcttctgtgaccagctctttattctccaactaaaatcactcggttgacaagagcttcccgtgttaagcttccttccgaagtgattgcagtttatcttttccaatcaaaatgggaacaatttgtgctttcttatgattccagagctgctataaatcggggtaatagatttttcagtgcctagtaagataattgtgctggggagaagattaaagtgcatgctgggagccgtgaatgctgtgtgcctccatcctcctgttcttgttgcttccaggacgacctagaaaacaaggctggagaaagacagctttaaattcctcatgctaaattagttctgagatgcttctgggcaaagactgccaactgaactctgttttgacagtagaaatatttataatgaaacataatgaagtaaaatttaagtcccaaattaccccaacacagaagcactaaaattgcaattctggttatagtgacacctccaattaccaaaatgcgaaataattctctttagaaaatgacttcattttgaggaaatgaatcctagctaaggatcatgacacacacaccaggggcttcaaatcctgtgttactgctgaccctagagaagcagatgagattctccacgtctgtttccccctctagaggcaacagtcgataccaacaagccatgtctgaggcttatgtgatgcccgtgaagccttgtcgaacagctctagaaatgaaagcactgagtacagactgggaatttttgcagcagtagtaacaattggtaggatataggatataattaaaaacccacagggttatcacccttatgcagtgatgctcatgttttttagaaagactctcattgccattgattctcaagagcaaagaaaatttctgacccaggctgctggttgttttgattcttaatgagtgaattcctttgtttgttcctctgttcaacaaatatttattgcatacttactgtgtaccaggtgctatgtttgacaccgaagatacaacagtgagtatgattgatggggtcattccccaacaagatattaaagtattatacagtcagttcttggtgttcaaggtagttctgtttgatgaagtcaccaaaaacactgaattagcaaatgctaagccattgctcctaggggaaatacaaggttatgttcctacaagcctctggtcataatagtttcatcaattgatcaatccataactttgccttatgtgtgtttctgtttaaaggcacctttttaatagacatttttggttcattaacattgaactcacggctaacaggactgtaactcatgcctgaatgaagcttatctgaaatgcatcttttctccataagacacatcatggccctcccgtgattaggaacactagctagcacttcagcactatgtttagggaccattttaaacagtgaaatcaccaagaaaaagcacaaaaataaaaaggtggcactagatagactgtgaaaaggacacatttacagtatgagaactgaagcgagaaggcaaagagttgaacttgttcagcttgttgggaacatgcatattgggtgactcaaattttctgtgcacttctgcaaatgaccaaggaaagagccacaggtattgatcctgtggttacaaatacattttagtaagcaggcaaatttgcaaatacagaatctgtgaatcatgtggatcaactatacctccttgacttgcaatttcttaagccttttgaccttgaagttagggccactcagccttcactggatgttaccccaccctaaccccagacacatcttgcacatcataaaaaggtaggaggagttcttggtcagaaggtccctggcactaggttctatggtttttctttttcttttcttttctttttttttttttttttttttttgagacagggtctcattctgtctctcaggctgaagtgcactggtgcaatctcagctcactgcagcctcgacctcctgggctcagttgatctttcctaccacccaccagaggcgcataccaccacacccagctaatttttgtattttttgtagaggcaaggtttcaccatgttgcccaggctggtctcaaactcctgggcttgaaccatctgccctcctcagcctcccaaagtgctaggattacaagtgtgagccaccatgcttggcctaggttctgcagttttaactggggatttgggttgtaagaaacagattcccttgagttacctcatgaaaagggatgtttattataaggacatatttgaaactgaaggcagcttgcaggaccagctgtgctatgactctcacagaccacacagcttctctttctccaggcatttctgctcccttgtctgtccctttcattcttcttttcaccatgtggctttttgctgtttagatataactcttgtttcctcttaattccagctcgagtgttgccgtttgtggttgccctggcccctctcttgttcccgtagctttagctccctctgaactggccccagttctccatgtttcctaagatacactgagggagaatttgagggggtcagctcattgtttcactttagaccatgtcgttggtccttgcccagtttctggactgcctgcctgcctttaggtcaggtgcttacttacctctgagtccatcaacatggctggggcaagtgaaatcatgtgatacaaaacatggtgaccaagatctagccttgcttcagtgtgactgatgcctgctttgtacttcagatctctcataactgtttcttctgccccttttcttaaataagggaattgcttttgtatagaactcagcccccctcagtggttagacatcctggcgtctgaatgccacctaactgggcctccactggttgcttgccatgtgggcctctccaactgcctactatctctgcactggtttagagatttgcatcccatttctttttcttgtcttccttcctttctttttttttttttttttgagacagagtctcgctctgttgcccaggctggagtgcaatgacctgatcttggctcactgcaacctctgcctcctgggttaaagcgattctcctgcctcagcctcccgagtagcctgggattacaggtgtctgccactatgcccagcaaatttttgtatttttagtagagacaaggtttcaccatgttgaccaggctggtcttgaactcctgacctcaggtgatctgcccacctcagcctcccaaagtgctgggattacaggtgtgagccaccgcacctggcaaattttgcattccatttctccttgcctcatggactgatcttcaatgtcagacctgcatttgaatcttattcttgtctacttatccttaaaaggaaccaatgatggtcatgtttcatggtcattatttccatctccttgaccaccaacattctttgtttttttttttttttttttttgagacggagtctcgctctgtctcccaggccggagtgcagtggcacgatctcggctcacggcaagctctgcctcccgggttcacaccattctcctgcctcagcccctgagtagctgggactacaggcacctgccaccacacctggctaatttttttttttttttttgtatttttagtagagacagggtttcaccatgttagccaggatagcttgaccaccaacattctatcaaagtccacagatctatctagactcttgcactgtgtgctgtgttttttgaccttgtctcatgcctcttgagtcccacgttgagtcctaaagcctgtgaggtcactatcactatcaatatcagtgctcccaaggatatttaaaccatagttcccagggggtcatattcctggcaccttatcaggcattccacgcatagcctcttctctggaagctcttctgtgtgtgttgggctaaagccctctaccagaacattctcatgcacaaactgaaacttgatatttttttaccacatgtcatcctcaccctgaaaagtctttcaagctccagtacttctgtctggagtcactagcaagtcaagggcaccatgtatgtgcttccacatccttggctctgctacatcccttcctgagatgccatctctaggtcctcgttggacttgaagtctccggagcagtagttctcgtggcagtggcttaattctaacattcatctacaatcaaacaatcttgtgcttgcagtttcctctgatgcttagagcctcttcccatctcagcagcctcagaacctggctctcttccttggtaatgagctcaggaagacccgtttctgtactgaacctcagcctactgtccctggcttgtcatattccaactacagaagggtagtcaccctgaggaaatggagtgttggactgtgtgcagtcaacaccaatgacctcaaagaaggcataccttctgtattagtccattttcatactgctatgaagaaatacccaagactgggtaatttatacagaaaaagaggtttaatggactctcagttcaacatggctggggaggcctcacaatcatggcagaagagaaggaagagcaaaggcacatcttacatggtggcaggcaagacagtgtgtgcaggggaactgccctttataaaactatcagatctcatgagacttattcactatcatgagaacagcatgggaaaacccacccccatgattgaattatctcctgctgggtccctcccacgacaagtgaggattatggagctacagttcaagatgagatctgggtggggacatagccaaatgatatcacctcctaattggaaaagagatcctttatatttttatataccctacttagactggttaatattccctataaaagataccagaacatccagcattttcagaaatgtctttttctagagtttagggctataagagaacttcatgatgtagattttatcatcttattctattgaggaaacaactgagctaccaagaaataaggtcattctttcaatgctccacagtgttggtgttgggagtaagactaaaataagcttggtataggggagggacttcatgaatcagatgaatgaagaaattaataaatgagggcatgagtaaatgactctgattcccaccataccagggtcctgccacctggtcttaagtttggacatttacctagggcggtgggttcagttcttagatttcaaagtcagatggtcagccctcccatctagcataagccgaaagtactgaagagaaagtatttcagaaagtgaacatcactataacaactcaaggtggtattttgctttgaaagctcagatggatctgtttattgggacagtgtaatgtacattccttcttctttcagctatacagcaattgaatccttttttatgtttaaggaatctcctacaggttgaattttgttggtaggcaaggcccatgtctctctataaaatcaaaaaattgtgtgaggtcatcagggtgggccctgatcccatacaactggggatttggaggcacacatgcacacagggacagccacatgaagatgaaggcagaaattggggtgatgcttctatgccaaggagtgccaaaagattgctggcaaactaccagaagccaggggagaggcgtgggacagattctccttcccaaacctcagaaggaaccagccccactgatacctcgatctcagacttccagcctccagaactgtgaaacaatagatttctgttctttaagccacccagtatgtggtactttgatctggcagccctcaggaaaccaatacgtagtggactcccaagagccgggaggctgaaggacctgctttgtgtctagcaggcagcctctttccgcagcagctccggtgcttggtcaaaacactcatgataaaatgcccttgatggaaaaggtgagtcgtgacttggctacccccattgccaagtgtccactttgctaatagcagtgtccagcccagagtctctgatgtatcctgggggctgagaagtgggctgggggatcagtgtctttgtggatggttgcttacattgtggagatggcagtgatttgtcttcagtggaatggattcttattctgcatttgggtttgctctgcaactaagctgcctgagtgcaaatcatggctctgccacttaccttggcaggttccctcatctttccatgctttagtttccccagtgcaaaattaggatagaaatattatctacctgtattagtttcttggcactgctataataaattaccgtaatttagtggcttaaagcaataggaagtgattctctcagagttgtgaaggactgaaatctgaaattacagtgttggcagggccatgccccctccagaggcctgagggaagagtcctccattgtctctccagcttctggtgctgctggcatgcctgggtgtgcgtccacatcactcgaatctctgccttgtcttcttctgtgtatttcaaatctccctctccctctctcttatgaagacatttgtgattgaatttagtttgatccttgataaccttccccagccaaagtccttaatcacatctgcaaagacgttttttcctcgtaaggtgacatttacagcttccagggattaggagtaatattcttgggtggaatattttgcgtggcctttattcagcctgctctgttgcctcataggattgttgtgagaattatattaattagttcttgtaaaccttttagaacaatatgacacatgataagcctcaacaaatgtcaccagtgaagaagagtatgacaatggtcttagacaaccataagtgtgactgtaattctgcagccttctggtaattttgtgagatgctcaatattctttcagaaatgctgttcttacttaaatgagacagagatcattctgcaacaaatatttgatgcaacaaataatcctgactgatatcaacaatatgggcattatcagcaaatgttactacaacttccctttggggtaggagtcttctttttaagggaatgtggccagtgtactctcagagttgaaatcagagtgggctgcccactcctgagaaagggtcaaattgtttcaagattgatcttgctccagggacctgaatatacatatctgaattgggaaaaaaaatgctctcaataaactcagattaaggtaagctattcattgattagcaaaagactgccgtgtctatgccatttagcattgcagtaaagtgttttgaattaattacttggaaaatctatgatactttgaaaacattttataatcagtttaattaatcactttttatgtccttcttcctgacatttaataaagtcatccctaataggacaatattttaacacatattgcaaataagaaaatgatgttaagcatggtgataaaattaaagctaaaggagagaatatacaacgtgtggattcctgaaaagacagagagcatatgctagtacgtcctgcttttatctttaataatcttaataatcttttttttttttggagaaggagtctcgctctgtcgcccaggctggagtgctggagtgcagtggcgcgatctcggctcactgcaagctccacttcccgggttcacgccgttcttctgcctcagcctcccgagtagctgggactacaggcacccaccactgcacccggctaattttttgtatttttaatagagacggggtttcactgtgttagccaggatggtctcaatctcctgacctcgtgatccgcccgcctcagcctcccaaagtgctgggattaacggcgtgagccaccatgcccggcctaaaaatcttctttttttttttttttttttttaatcactgaggcccagtgatttgtcttatacaactatccaatatctttaggacattaatcttgctttgtaagaaattcagtattgagtagaatttttatttttttaatggtattttaagcatgatttcagttatactttttcttgatagcttgctcgaaaattttttaaaagaatgaattctaattttgtcttaccatttgcaagtatcgttttcacatatattgagaattgagtcctgtgttgtgatgactcacagcatgagcctatataatgtacaaaggaatatagtgttctcttgtacaggaaattcctttatcatggctcaatacactttgaaaatataactcaaactgaaatttaaaagccgtatggaattttacttatatttaacatccagttttcaccaggaagctacacgtgcgtgttcattgttgtacatgttttttgccaataaaatataagatggaacaatttagaaatatgtatatcatcaatacttctctctatataatattgtatatatattacgtgacataatatacattatatacatacattatatacattatatgtaatatctacaaaattgtatataatatagtggtattgttgatatagatatatctaaattgtttcatctggccaggcgcagtggctcatgcctgtaatcccagcactttgggaggcaggggggcgtggatcacctgaggtcaggagttcaagaccagcctgatcaacatggtgaaaccccgtctctactaaaaatacaaaaaattaggtgggtgtggttgtgggcacctgtaatcccacctacttgggaggctgaggcaggagaatcatttgaacccaggaggcggaggttgcagtgagctgagacagcaccattgcactccagcctgggtgacaagagcaaaaaactccatctcaaaaaaaataaaaaataaaataaatggtttcatcttagattttattggcaaagaacatgtacagcaatatgtgtgtgcatataaatatattgtataaatatgtaaaaataaataaataaaaatcttgatgatggcaagagtttggtggggggtgtggtcactgcatatattactgagagctgaattctagcatcttagtgatagtccttgtcgctaagttaggtgtgaagggagtgcatattctaggaagaaacagccaagctacacaccctccagcaagctccaccttccagcaagctccacccttcagcagatttccctggggggcatgactaactccaccagactcccgccacatctcaggaaatctccttccttcaagcaaccccctcacaaaatgattgagcccggattttcatccaactgtagcaggttgcgattgagtcatttctattttgtttgccaagcaaaagaaagatatcatctcctatattttgaaagttgcaaagcaaattcatatggcctcctagtgaattaaatagccatcttggttttatttctttagatgattttttttttgctaattcttgcatgtatagtgtttattgtattttattatattactttttttttatcaaggaaattatcagcttttaatcgtccttagaagattattagttaccttaagaggaaatttcggcttggtgaaaaaaattgtggtaaaaatataacataaaatttaccattttaaccatttataagcgtacaattcagttgcattaaatacactcacgatattgtgcagtcatcaccgctatccatttccagaactttaaaaactcttcctaagtggaaattctgtgtccctgaaataataacctcccattctcctttccccaggccctggtaacttctactttctggctttatgaatttgcttattctaggtaccttatataagtggaatcacgcagtatttgcccttttatgtctggttaatttcccttagcataaagttttaaaggttcattcttgttatatcatgttcctgaatttcattcctttttaaaactgagtaatattccattgtaggtatataccacattttgtttatccattcacattacattgtatttttgttccaattcccttcaacactgagtttccagagcacagagataatgtatagtatgtctctgtattcccagcagctaccacagttgaaggaaagaaacgacaaatggtatctattaatcattcaatggtaggcatggagttatagttcattcatcactcagaggcactttaacttgacagtaggcctggatctatagtcctgaaagatgaagctgtcattttcagctgtgacctaatagtacaaccctcagaagacccagtgcttaaccctatccctgcctcttgaggaaagaccacagcacagtgaccattccttagtctggggcctttacttatgcacagagagaagaggctgagctaggcagaactcaggcagggcagcctctgactctgctttgcagtgttagacaaaatgtaagtgcagaaatatatgctgaaggcaaatttaatttttgccttatcttgcattttccaataccctcttttagttcggataatcaaatgtgagctttggagcagatctagtatcaaatggaattaaatataatttggtcctgtcaatttagtcaaaggtggcttagtaaatgatatgcctcagactttaaaaacaacttaggaaatctctgtaaatacagaaatagctaagctcctgtgccacgtgacagcagaaaatattcccttctgtcctatagattggttgtgcattttatcttttcctgcctggactcacaggtacatttatttcaagtttcaaatatgactttattaatgccagagaaagagaactgtggcaccgataatgcaaatgtgtggatagcgaaaccatggaaactttgtgaaggggcagaggcctggttccctgtgtgagagccctggaccccatgggcatggctgggagtggagtgggggagggggatgactttggcatctgctggcaggcagacctaggtttgcattttcagtctgcatttcagtggctgggtgaccataggcaagttactctctgagactgagtttcttccttgcagggctatttggaggattataatatatataagtggaaataacacatgaaaagtgatggctttacagtggctttaaaaattactggtaacaattattagtgtttgcagatggctatgaagtgttctctgccagactagggaacagtggaccttggaaacatgtctggcctttggatgggagaaatgtagagctgcttgtatagtgtaatttgagtgggttcaggtagataggggtgtcagatttatctaataacaatacacccagtaaatatcaatttcagatgagcaacaaataaatttttagtataagtatatttcattcaatatttgggactaaaaaattatattattattttgagttgcagtcttgcactgtcaaccaggctggagtgcagtggtgtgatcatagctcactgcagcctcaaactaatgggctcaagtaatcctcccacctcagcctcttgagtagctgggactacaggtgcacaccactgcatctggctaacttttgtatagatggggtctcattatgttgcccaggctggtctcaaactcctgggcacaagtgatcctcccaccgcagccccacaaagtgctgggattacaggtgtgggccattctgcctggcctagaaaattatttgtttttttgtccaagattcaaatttgacaggacatcctatatgttatgttgcaaccctaaacacagggaaccttatcctttatctgaaagatctactttaaattcattcctgtggttcttaagggatttttttttagtttttcagatcagttattaacatactgttttaagcttccattgtgtatagggaaatagtagctttgatgggttctagttcagagcaaggcattgtgggaatgaggcctgaacactgtactgggggctgttcagcgtgttctggaaaaggagaagcgcaagaatgggccatctgaaactgtatcacttccagttcccataacgagtcttcttcttaaagcattgtgaacctttcatattctcccatcccagggcgcaggcaaacctcagggacaggtcgtgaggaaggtggcagcttacctgcaatatacaaatatacaagtaattttttagtgtaaatatgtcccaaatattaaatgggacatgcttatactaaaacaattatgtgttgctcatgtgaaattgatatttaactgggtaggactggcctggcagcagccatttccacagctactcttgtgctgtccaaactgcttggtgaaagtggcacagagactatatgaaggatgcaggggactgtgggggcagtcatggccctcccttcatcctctctggaacctgctacatgccaaattcaggttgcaggtggaattaagtttgctaatcagctgaccttaaaatagagaggccaggcatggtggcccacatctgcattcacagcactctggggaggcagggggatcacttgaagcctaggagtttgagaccagcctgggcagcgtagtgagaccccatccctacaaaaaataaatacaaatattagccaggtgtggtgacacgcacctgtagtcccagctacttgggaggctgaggcaggaggatcacttgggcttaggagtttcaggctgcagtgagctataatcatagcactgcattccagcctgagtgatggagtgagaccctgactcttaaaaaaaaaaatagggagatgattctggattattcaggtggtggtcagtgtaatccaaggaggccacacaaggagaagagggaggcagaggagaaccagggtgatggcagtgagaaaaacttgacctgctgttgctggctttgaagacggaggaggaaggccaggaaccatggcatgtgagcaccttctagaagctggaaaagtcaaggacatggattcccttctagagcctgcagagaggaagacagctctgtagacagcttggtgttagtccagtgagaccgtttcaatatttgaccacagtactgtaggatgatgatgcatggtgtttgtaaccctcagggtgtttgtggtaattcgttacagcagcagtgggaaacctaccgaggaaccaaagtgggaaaagatgaaatagccaatgaaatggctcaaagagtaactggagtgagagtgtgcccaggtgtcttaggcggaaagctggtgaagagaattgtccggactgagaggcctagtagattcaaagcacatcttaaccacagaaaaccatcagttagaggccagagaatgtcagacctgggaggaatcctatgaccatatggtccagcctctcatttcttgggtgaggcatccaatgcccaaagatataatggaattgttagaattcacagagctaatcagggagtgaatgatctaggacaagaatcctgttcttctgaccctttggccagccctctgggtaccacaccacgctcacaaaaacaatactttaccgatggctcacaaaaacaatactttaccgatggagggattatctatttaaacttcaaagaaattcttttggaatgtttttgagccctccaatgctaattagtgaattgactcagagtaagacagcggctctgcctcccgactccccagggatgtgtctctgccatggggtcccccaccctgtcttatttggacccacagctgcccatcctcaagactgtgcttgcccagagtcacctgcttgaggaagtagagtatggcaatgaagacagcatgggtgggccctgggtctagacaggcctgagttctagctttggtgttgtccctggtgtggactggtgtgtcctgtggagtgacttaggtaatctcttgaaggctcagggtcctggtctataaaatgaagagaagaatataatttaataggattcaataagataatccatataaagcattcagcacggggtctggaggcagtcagcgttcagtaaaatagcaactattgtacttgtttttagagagaccttctttggccctgcctatggcttccatatctgtctgcattgggcacgttgctgtgcactcccatcagccctgtgcctgcctctgttgttccatttatcacatggggctgctgtatgtaatttacttgaatatctccttgctctagactgtaagcgacttggagtcaggaatcagggcttttttgtgttggtatttcccagcatcatagattgtacctgactcacaatttgactagaggagtgggagtgtgcataggtgtcttagtaggaaacctagagaagagaattgtcctgactcagaggcgtagtggcatggggcatccgagatgtaaaaagtaatagtcccattttataggtgcggaaactgagagctctcatttctccagccttttcattgatttcccccctctacatttcaaccccttggcaagttgtcttttgctcttggacagatcattttcttctgctatggaggttctctggagaaacatggggaggcgactgctgaggctggaagagccaatgacaaatgaccaggggcttatatccaggtggacagaggcttttcttcattgcctggtgattcaaaaaatgtctattgaatgaattaacaaatgaacagcttatatactggataaaagcaaaacaatcaagaagcaaatgaaaacaatgaataaaggaagctactgtagcttcctctaacactctgaaaatagctcaatctttaatggggcctcatttgaaaataaagtaccagtgtgtgaaatctcctggtgtttattgtctaagttctggttggtttttcaagcatggcagacaggtaatgactactaattccttagctattgattttttgggctttgctttcacagggtaggtaaatgagcccctcagtgaggatgggaagaggagatgctctgatttccttaagctctttgacaacatctttcaggagtcaacttttttatattataggtaggtgtaattggaaatttgctttcttgctactacttctgttctagccaagattagatatttagtgtgcaaacattcctgcgaaacgtgacacccgagggctgtaactgacagttctcagtagagtctgggaattgttattgctgctgaattccctatcagacatgcaccatagtcatccaagtaggctagagagtcacatactgtcatttgatgtggaaatttgttttcaaatgaactctgagatttggagaatgcactgatccttcactaggcagagagaataaaatctttatagttttagacgttgcagaagattctggaaagagtcacccttattcccaagggtaaaaattagctgatactaatgagacttctttgagtcttcttgtggctaaaatttctaaggggagtgacacttcatcttcatagtaggagaagtggtttgttgaagttgctggagctggtttcagatgggaaatgcagtgaagtagcctcaccctgctcttgctgcatggttttatgcctctagttccacaaactgagcccaggcagtgtgtccagccatgggcccgcattgagcatgggaggagaggcctgacctgcctgagaaagtccgccatgaggaggaatacttatcacgatggaaatggtttttaaaacatctgtctgtagacctatggatggagaaagagtgctggaaaggattcagagaagaatcacaaagtgattaaaatcttggaaaagagggtttatgagtaagagtctgtaattattcacaaggcaaggtcaaggagatgaaataacgccctaaagtagagagagaggtgttttgcacaccacggaagacaaatgcgccagggatgagtacaggtttttctccaaagaactaatggttgctctacctgattaaaagatggtcaatgtcaggaatcgggaaaaatgacaattaaagggaaaatgtgaaatgctttttcatgtataacactggcaaagactagaaagatctgctcttacccagtaggctaatgggaggaggaagggaataccctcaccccagatactgcagaggctgatgagagcctacattggccaactttgtggagaacgatgaggtagttacgtttccaaatcttaacaaagaggctcctttgctccagcagttccagtaataggactttatcctaagggaaactttggtccagcgataaaagccgtacataggttgttcactgcactggtgtttatcccagataaatcttataaatgccaacgtttccatcaatctgggatgaattaagcaaattatgatatatctataacaggggtcagccctttttcttaaaggacgggatcaaaatatttggggtcaggaggcaaaattgaagatatatgtaggcactaatataataatttaaaagtaaggatttaaacatgtaaaaaccatgtgtagcttgtgggttacacaaaaacaggcagtgggctggatttggcccctgggactagtttgctaagtagtttgccaatctctggtctctaccatgggatactataaagctgttgaaaatgatgacatagatctatatttattggcatgagagatatctacagtaagttactaagggtagaaaagcaggttacgaaacagcatgcagttatgactctatttttgtaaaaatcaatttttgtatatgaaggttatagactaaaatattgactgcagttaatactctaggttgtggattggggagatctttattccttctttaaatatttctgtattttgggaaggtaataaacgtgtgttacttacaaaattttaaaataacatgaagtaattaaaaactgcaatgcctccaaaaaagaaacacaaataaattagaaaacaaagcactattatacagaatattgctaacttctcaatattctacctcaatttggtggtaggaaataaagtgaacttaaattatttttcagataatagattaggataatatctgacactgaaggggttagcaggattccccccacaacttttccatatcttaagaacttgtaagtatagattgggtgtggtggctcatgcatgtaatcccagcactttgggaggctgaggtgggaggattgtttgagcccaggaggtcaagagcagcctgggcaacatggtaagacttcgtctccacaaaaaaatttaaaaaattagctgggcatggtggcatgcacctgtagtcccaacacgcaggaggctgagatgggaggattgcttgggcccaaggtcagtgctgcagtgagccatgttcatgatattgcacaccagcctaggtgacagagaaagaccttgtctaaaaaaaaaaaaaaaaaaaaaaaaaataagaaggaggaaagaaaagtcataagcacaaatttgaaggtagggaacagttgactaaacccttaatactctttccaaacattcaattattgccattacctgtgttaaatacaagttttagattcatcctgttatgaagtcttgttagacaaccttggtgggagtgggaggtatgttgacattgtctgccataaaggaaatggaaaaatttaagtttaatcccagcatttggttttaacataagaacattgcaagccagggagataccgtcatgcagcctgaatcagaccgtgaacagggaaccaacagctcagaaataaaaagacaaagctatctagctaaagtcaataaacaactcattttaaattgcaaatgaattaattatccagtgcttctaaaatgtccctcttggatgcattccataaaattagctttttcattagcaaagttttcattgctaccatcagaagaaattctctctgtgagtgagttgtctgcataattggttatctccagtgatgatagcagcttgttttctgtggacagtgcaggagtgtgagtatgtccaataaaaattctctcaccaataaaaatgtactgaataagtaatgatccctaacatcgaggaggttttagtttggtaggaaaatggacattaaatgtattgagctaagtaattctgtttatgtagcaagccaaataatgatagcagtgataataataaaacctttgatttattaagtgcctactaagccccaagtacaataccagataacatgactgctaggacatgggcattactatgctcttttagatggggaattaaatctcagagaggtgaaataacttttttgaggtcacacagctaataagtgacgggagacctgttttaattttgtatactttccactatgccaaactgcctgccaactataaactataaactactattgtattatctattagtctgttctcttcgatcatcagcacacataattgtgagtttattactgctacaaaaccatttccaggaggattactatggagcttatgaaaccactttgagactattgaactaagagggacttagtcttgatttttttttttttttgagactcggtctcactctgttgccagggatggagtgcagtggcacagtctcagctcactgcaacctccaactcctgggttcaagtgattcttgtgcctcagcctcctgaatagttgggactacaggcatgtgccaccatgcctggcaaatttttgtatttttagtagagacagggttttgccatgttggctaggctggtcttgaactcctaagatcaggtgatccgcctgtctgggcctcccaaagtgttgggattacaggcgtgaggcactgcgcccagccagtcttgatttttaaaagacagcagtcatatgcatggcctcagtgaacattcactgtcatcaattcattcttccttctctcagaaatacgctcttgacatcatgtagcgcctggttgatggagagtgccttagactcctttatgatgtgtgctacagaccaaggtctcagaggggtcaagagcttgcatttcatggacttttgctcctgttgctgcctgataaatggttaattgctccttaggtagtattggactaaagaaaaacagatttggacttgcaatttcatggtaagagaggggaaaacccaaaaaacaaacaacccccccccccattattctttgcacatagacagtaaaacatattccaagttttacccttgaatttccttcaaaaccattcatctgtcatgtttcctccatttttttcaaagctaggagcagcatccatttaattgtgtacacccttagtcctcactcattcattcattccaccatcattcactgagtacctggtctgtgataggcatcattccagacaaaggggcacaaagccaaatgaaagatggttcttgccttccaggaacttttggctttgtgttgtataaacaaaacatttgtattgtaactacaaggaccacaatgtggatgaagagtggaaattcatgtaatggttagctgtcgccacagtgatactgggtaacataccattccaaaactcaatggctgcaacaataatcatctacactttttcattacactgtggttggatggtgtactcgtttggtagggctgtcatgacaaaataccacagactgggtagcttaaataaaaaaattattttctcatcgttctggaagttagaagcccaagatcaaggtgtcggaggcttggtttcttttgaggccttcctccttggcttgcagatggtggccccttgatgtgtcttcagatggtctctgtgcacagacatgtctgtgtcctaatttcctcttcttctgaggataccagtcctattgcaccaaggtccacacatatgacattgttttattttaattgcccctttaaaggttctgtctccaaatagtcacattctgaggtactggggcttaaggcttcaacatataaattttggtgggggaaataattcatcccataacagatggggtttagttgatttaaactgggttctggtgggcttggcaggtctcacatttctcagtctcctggagaagtgggctagctggggcatattcccttcatggcagaagttggaagcttccagaagagttagtggaagcatgcaatgtctctcaaggccttggctcagaacttacacaccatcactgtcacccacattccattggccaacatgaatcctgtggtcaaacttgtgtttcatgggacagggaataaactctccctccagtagaaggaagtgcagagtcacaagacaaagcttgtggccacagggaggcgtgaagaattgggaacagtaacgccgtctatcccaagagtcgggtgcatgaattcaggctggagtttcttcgacatgaagtgaactgaatatttattttgcttctgagtgtttagcattgagtagttttgttcaggtgctgaaatgcgcaacagtatacctgtccaagaggccaaaaagttattttctgaaacaactgcatgagcagtcacattcgttgtgtgcaaatgatcacaacctagtacgacttgtacccagtattgggagacagagcttactgcactgaggctgaggccccaggtacactctacccgttgctgctgctttacggctatagattctctcaggagatattccaggtcatgcagtaggtaaggaaagaccagcagatgttcactgacatgagactgacatgagaacatgtcaaagtagatgtcccctgacaaggagtcagtatatttaggtcaacacaattaggcaataatgtggtgtaaatcattcaaaggccctggaagcaatggaagtagagtggagggagcactgtgaaaaaaggaaatagcatcagtgcatttcctgagcgagaaaatgagaatggcgcctcccggaggcagctcttggcttattaaacgtatccactcatcccggtggcctgggctccactagagaaaaggaggaaaggattcctaggtggcagattagcagctgtgggatttgctgtcagacaagagagagggaagtaaaacagattggaccaccttagggaagaaaaggaaatttatggaaacaaattaattatagcgactgaagtagagaaaagaaagggtagagaaatcagcaaaggctagactaaaatttcccagattggcttttcttgtctctgtgggctatggttaaactctctagggcccatgagttttatgagacttcaccattttcatttgatggcaagctaaagaaaaatttgctgaagaatatgctgggtgacagatgagtatctcttaactgggtgttgctgggcaatttcaggtctgcatttgcacttctatttactttcatatttgtgataactggaagcagaaaaaaaacattctaggacactggatgaaaaagttattcatagcagtttgattgtggagaaagtggaggccgaatgaagtagcatatgggatgtggctgctcaacacaaaagaaccaacacatgaaagtatttattgatattattctgaacctgaatgcatacataagtttttgtaattattagcaattgtagtgttaaatatgaaattatgatttttttctttaaatgaacacgtggaagatgacaatattttgttctgggatatactattacattgcatggcctatcgataaaatggttcagggctcaattttagtttagtgttagaaatgaaaaataacagagataacagtgagagcttcagtgatgatctgtcttgcttaaagtcacaagaagcaagtcaataatcagcaaaatcaaaagggatgtatatatatatctttcttctatgaaccacagtgttagtgatttgctctcagtaaataccatccatcacagcaatgatttttgaaaaattgtattggggttgtagttttatttgcatttattttataaccttattttggtggtagagctgtctaagagctatatgcacaggagtttttacttgttcaatgtttgtacatgctttaaaaattacaacaaaaacttatttaaaaagatgtttgagaattcctttttcctatagaagtaatttgttcatgaggttgatgaaagaaggaggtgagaggagataggtgatgaagaaaaggttttctaggaaaaaggtaatgcatagtcaaagggtttcctattgctgctgtaacaatcactacaaagctagtgttgtaaaacaacacagatttatcctcatacagttttggaggccaggggtctaagcccagatcactggtggtcagtcagctggttccctctggagggtttagaagaacatctgtttccttgctttttcccacttctggaggccacgtacattccttggcttgtggccccttcctcaaatcactctgacctcatgttctgctgtcatatctctgacctctcctttgacctacctcacttttaaaaggcctttgtgattacatttagggctcacttggctaattcaggataaactccccacccaaggtccttaacttaatcatgcctgcaaagtctcttttgtcatataaggtaatattcaaaggtttcagggattggaatgtgagcacctttggggactatttttcagcttacctcaaggggacagagttacattaagacccaggttagaagaaggatcagaaaaagtattgtggcaaggcaggggccctgcatggaattatggatccagtttgagtctgaatcacttgatagatgaagcaatacttgtaagtagactcttcagaaagaaacattgaacacggggaaaaacttggaaaataaagtcttagaataagaaaatataagggtattgtaatttttctgaaatgtagaaagagctataaatgttgataattagccattcttcttataacaactgctggatgttagtaaccacctattgttcacataatcccaacaacattgatttatattttagagaaagctcctctggtttatttattttcctttttatgttttatttttcagttgtttttagagatgaggtctcactatgttgcccagcctggtctcaaagtacctgggctcaagggttccttctgcctcagtctcccaaatagctgggactacaagtgtgtgccacggtactggtcccctctgatttcttgactgaatggaagttattagcaattataggaaaattgctatagactgaatgtttgagtcccattaaaattcatactgaaatcttaatccccacggttatggagtaggaagtggagtacttagatcatgaaggtggagcccccatgaatggcattagtgccctcataagggatgaaagagttgtcccctgccattatgtgaggttacagtgagaagatgggctcccatcagacactgaatctgccagtgctttgatctaagacttttcagccttcagaacagtgagaaataaatttttgttgtttgtaaactacccagtctatgggagtttgttgtagcagcctgaacagactgaaacacatagatttctaaaactattttggaactttctggaaaattttaggactcacaacactgtaccattgaaggtagtaggagactgtcaggagaagcatagttcaggatgactttagaagttttcaaatgccattaagtcagaggtggcctttttttgtagttctcgtctcctcacctccccatgagtttgttcttagcctttctgattgttcagctgacttggaagaactttctgcccaacagtgagtgggtatgtgttctgggaggccaagttacaggattctgccaagagccagttgaggcttggatagtcacgtccacattcacaataacacaatgggcgcagtggctcacgcctgtaatctcagcactttgggaggccaaggcaggtggatcacctgaggtcaggagttcaagaccagtgtggccaacatggtgaaaccccatctctactaaaagtacaaaaattagccaggtgtggtggcacatgcttgtaatcccagctgcttgggaggctgaggcagaagaattgcttgaacccaggagaaggaggttgcagtgagccgaggtcatgtcactgcattccagcctgggtgacagagtgagattctgtctcaattaatagtagtagtagtaataataataataataataataataataataataatagggtagagtcactgagttcctccttcactgtggatagcagcctcccagaggaaggagcccatcagagctgctgcatgccccagagctgactgcatacagcttctacacagggccagcttcatgcatgtgtgacctgtgcaatcccacagggcccctgtacttaggtttcatgctctgctggtgatgtcttgaaaatcttaataactttgaacaagaagacctgcatcttcattctgcactgggccctgcaaattctgtaactggtcctgcctgcacaatctcactcagcatccctgctagtggcctctgtagggccaagcctctccaaattgaaatagaatgaatccacctgcaaatcatataatgctggtagcagaagcagcaatgtcaaccatcagtatgtgctcagtcacaatcatcaccttgtgctaaattattacatcaagagctactaggcaatagtttcctttttcctttacagcaacccagcaaagtccatgttactactattttgcagaacagaaaatagctctgactgcaagaaaacttgcccaatctgttacagagcaggtacaaggcagagccaaaaatcaggcagaaatgtgtggctccaaagttcatgtttcaccaaaattaactgtcttctctgacatttgcctgacaggcaccgtattttaggaagggcaattgccttggcaattttcattgagaactcactttaccttgggacatatccagctgccagaaagttcttactcattctgaaatatagagaaagctttgcacagtgatactcatcacagcagtttaaatatttaaaacatttggaagcagcataaatagtcaacaatacattgtcagctaaaggaaccaagttacatagacaaagtcaactgttacatagttatataaattgcatttataaagattttaatagtatagaaaataattttttataatataaataaattcaccatgtgaaaagtgcatagataaaagacttggaaatatgctaagatattaatgtagatcatttcaggattaagggtaactgtgcttttccgcacttcccaaattttttacaatccatgcaaatttcatttataactaaaaaagatggatggaaaatacgttatgctattgatacaataaatattccttgagcacctaggatgtattaggtactgtgcttggcaccagcagcaaataagacaaaatccttgccttcattttgcttatattatagaattgttattttgatgaaacctgttatcatcatgtcggcatccatgtcaagctaatgggcactattggactcacaggcaactaaaacttacttttaaaagtaaactgttaagttgatcctgtccttggaaagtggattttttttttcatcagataggttcagtgtcttgagatgtctgtatttcaggagttttaattctgacaaaaagtatactagttgtcctttctagctttgagacccttgtgaattattcaagcatattttctctggctttattcaggctaacactagaggtgttgacagaatagcaccaagtttggggctctagagaagacctcagagtcccacattcaagtcctgatgcttgaatacactgcaggtgtgtctgctccaatagtggattcatgtactgtatacatctactagggagttatgaaagatttttccaaaagatttacttacagtaggagacgttgtacttatggcatcctcctatgaaccagtttagcaactctgtcaaagaaggaaatgaggtctgatgagcctatctcattctttcccataccgtttcttagagtccgctgcctgtgtgcaaaatgttttctaaatacccacaaaccatctgttaagtaattcgttatagcatttccctggtgaataatattaagttcatctgtctacaattaggaatttgcttttttgtaaatcagaacaatattttcccataacaaggtccttgatgggctgagtggagaatcacaaataccttgataggtggtccttgagatggaaaatcgtctctaatcctgactagcccgaagaccatggaagtgtcttggcctctctgttgtcctgaaggccctcagagagaggtgaactctgttaattaaacactcttcatctaaaacaaagcatgccagcacagggagattacagaaggaccataaatgtgaattttattttgcatttaaaaagccatgctttatccaattgacatgttggaaaaaagattgatggggggacttcttaagaacacgagaggggctggtaatttgcatattaatttatgtacccaaaatgaatgcagacagccataaaatgcacttgtaataattatactaccattgaactgtgggcttttaattaaatggaatgtttttatcttgtgtttttcacgttaaccatgttgctatggatgtcaagctgttcttgcaaatcaaagcggtggagatgcctgatcctgggctttcatcactcccagccgaagtggcttgcattccagggctgtggcagctgggtctggggctcagggacagctctgggcacctctgttttatgcatactttaaaggagggcagtggagacccagctcggtcgaactggccctgaacaggcatgacaaacctaggctttggaaatgagaaaagaacgatgcttgcaacctgtgagccttttaagtaagtcagaaaatgaaaccctgggtgtgcttcttgagacatgtttgcaccgtttgtcggtgccgttattttgatctccactttcattgtgggcatattagtgtttaagacagcagctacgttatccaaatgatcattttcatgcttttcgatgcagtagcaagaatgctctccctacttccctccatttttttttctccaaatagctgttaagtggagccgcttgtgactgatataaataattgccattgcgttttgatgatctgggctggacacacttaacctcttgttttgtaatctgagttgcatggtaccggtccattattttcatggcaattgcacagactcggcacatccaagcattgtcaaccagctctgtctcccagaaggggttcagggctctagatgaggggttggagaatgcctttgttgatagaaaatgagtagcgtacaggcactattcatatgtccaagggaattaacaagggagagtgatatcagatatatgcaaggcgtttttgttcactgtgacttttgctacaacttgggcacccagcaactttttacagtggctctgcaccgtatccatctcttttggttataagtaacaaaagcaagttaattattagggacacaggtaggtgtgtttcatgcaatttaagggcagggatggcactgggattcagaaatgatcactaaagaaactgggaatttgataaaaacccaaagaatattctgctcctctcttggcttctctttccctctgtggtgagtgcttcattcttttctattggcagaatggctttccccactgctctgccctcagggcaggcagagcagaggtgaccaaggcctcccaagtgctgatccagcctcacagtgtgtcactgtcccagtcactctttcacttcctcaattccaagttccagagaagggaccctggcccagcctcgatctattgcctagcctctggttcagtcttagggggccagggtggttgtgtatgtgcctatgtgtgttgtgtgtgtgcgtgtgcgtgcatgcatgcatgcatctgcatgtggaacagggcgggctggcaaatatgactgtgaataggtgaggacagttaatgacacaccaggtgtccttgtctgcatgtctctactgctttttaatttgacacattcaactgacttcatcaaggaattttcctaatactttagatgatcatgaaaaccaggatcatcatggtgaggtcttggcaattcatatctttttagagctaagaaagcgctaaatacattatatgttcttcaaatgagtcacttggaagagcattaatgtgaccacagtctggtacccagagttgacaagtgaggagggaacacaaaggggtagtgacctctcaggttgagtccaagatgcttccgagagctagatcaacaccaacacaccatttctcccgacgtaaaagagagatttggtcagagagcactctgaaattttacccatcatacactgagcagtccgctaaagagtctgattatacctatagtaaaaacattgaaaggagggccacagattttatctgtcattctgcaatctcctaaattttagtttcttctttgccctactgtttcaacctctcctctccctctttttcagcatcccaagttgttgtgagatgaggaacatattttatggtttttgtaccatatttgcctgaaatcctcaaaagatgcaaactttttttaagctgtgaaaagctgaagaagggaatagctgtaactgtgaagttttaattattgctattatggaatgaattatcagggaataatcaaaacatacatttctatctaacccaagacacaagataaataagaagctacaatggtgccaggattcatcaaggaacttggagttattctgtcaccttcatcattataaatcctgagtgacattatcatggaaggtgcagaggccttgccagggaagctcacacccaatgggtggatgggggaatgggagagggggcagggcagatggttgcctctgtatagactgtgcgtgcgtgcacatgttgggagacaccaacatcctcttctccatgtgtttttgattggctggaaaataagataaaaagaggcaccagtgagaaaatggaaggatcacccttgtcactggtgatcattaaaaaaagctgggaatttgataaaaacccaaggactgttctgcccatctcttggcttctttttccctctgtcgtgagtgcttcattcttttctcttggcagaatggctttccctgctgctgtgccctcagggcaggcagagtggagactaccaagacctcccaagtgctgatccagcctcacagtatgtctctgtcccagtcactctttcacttcccgtgggcagggggactggcaggtattggacatgtgtgagcccacatgggtagggtgcctttttcctcctcagtacactttggaagaggcttctgggagcaagcagagtctgcaggtgcccatacttaggtagacggctgtttccatgagtccagtgaagaagagaaagggggcagattccgccctcctctaatgagaatctttttttgttacccaggctggagtgtaatggcgcaatctcgactcactgtagcctctgcctccccagttgaagtgattctcctgcctcagcctcccaagtaactgggactacaggcatgcaccaccacgcctggctaatttttgtatttttagtagagatggggtttcgccatattggccaggctggtctcgaactcctgacctcaggtgatccacccacctcaggctcccaaagtgctgggattacaggcgtgagctaccgtgcctggcttgaggagaatctttaatagtttagcttcatacaatggagaatttgaaccaaaccaaccaggtaagtcattctacctgcatgaggaggagctagtggtggggtggaggccaggagtgtttgggtattttcctcacaaaaatcagtagcaggaaaacagtacaacagccactgctttgatcctccactttatgcccggcacagatcacagtacctggcactcagaaaggatgaatggagaaacttacaaatgcctgtccctgaaaaat

SEQ ID NO: 464 - DNA, 50813 bp, Homo sapiens
ttgagtttcactctccaaagattcaagattgattccctagataacaggctaaatttagtgtaaactccaatattgaacccatctacttttgaccaactaacttttggccacatacaaggagctacctattactttctttatgattatatctaaatttgtgtcatttctgttgctctacttttaaactatagattaataaaaaaaggggagatgagataaatttagactttttctcttctatatcttatccttgtgatcttttaagtattgtaaacttagagaaaaagtcatttgtttaaacctttaactcagatttatacaaatcataatgtagtcaaggtcaaaaatttaattacacaaatcttatatacaaagttgacattattttttctttcttttctgaaagttatttaatcttcattataagttcccacttcgtttaagtagaagggaagtttagatttatcctttaatttttatcttggttttatcttgttaaaaagcctcgtttggttaaattttcagctcattctatgttcaacttctagataagaagattttacattttctcatattcaaggtgaaacaagaaaaacctgattatatttcctggcaacaaaataaaggtaactagtctcagctctctcctttttggctggtccttgctgtagaatggatgtcaggttgattggtctctgtactgtcatcaactgagattaatgcattcatccatctcttgctgtggcttcgaaaccactgctgctgaaagtcgaccaaatccaatccaatccccaatctctgccaattgaatgatcctttaaaagctgcatgtgcctcatgagagcacacaaaatcttcttgatttcctgaatgctaagaacaagttgtggggtgattccatcaccatttacctagtaaattctctcttttgctatactgttaccacatatcatgctggacatggctgaatatgagacttcagctcgagagctggtaaaacaagaaatgctttcttggattatttcttgcttctttgcgtgtttctgtatttcacccactcagatttcaaccctttcttctaagtctttttttgctttccacactcttccctaacccccaggactggtactggtccatggcctgttaggaactgggctgcacagcaggaggtgagtggtgggcaagtgagcaaagcatcatctgtatttacagctgctcctcattgctcatattaccacctgagctccatcccatgtcagatcagcagtggcattagcttctcacaggagcatgagccctgttgtgaactgtgtatgtgaggggtctaggatgtgcactctttatgagaatcaaatgcctgatgatttgaagtgacactagtgctggggagtggtggcaaatccagattaacattagtagagtggtttgactgcacagagaccataataaatcaatcgcttgcagactcatccaaactctatcaatgagtggagagtgacaattgagctgcatcttgtggcaggctttatagtggcaagtgagctgatgtacttcgattgtacagctgcatctggtggccttaaaagtttgtttgagacaacttcaaatctccatatgttctgggttaaagtcaaggtggaatattctgagactgacacaaaagcactgaaaagcctgcttccattactaacatcctgtctttgtgaaactgggttttctgcagtcacagcaaccaccaaaacaagattatggagtacactgagcatcaacaacacacttaggtgtcactgtctcccatcacccccaggtaggaccgtctagttgcaggaaaacaagcttggggctctcactgattgtacattaaggtaagttgtataattatttcattacatattacagtgtaataatgaagatataaagtgcacaataaatgtattgtgctcgaatcatcctgaaaccgtcacacccccgcccccaggtccaggaaaaattgtcttgcatgaaaccagtccctggtgccaaaaagtttgggaactgctactctaacagaccagaatgggtaggttttctgtttcttccttcatatcctactaggactatatttttactatgatatttttattatgatacttttataattccttgagtcatcaagtatccagatacagctttataatataagaaagattatcgatatccgatgaaagttctgtcagttaagaccaacacatttggttgacaacgcaggaaagtcagaaccactgagatcatggattaccatgaagtaaagtgaatgtatttttgaaatcctcccacacattaaacattttatgaaaacttgaaggcaatatattctggttatttcagactaagtatctgaacttagatcctattaagtcaaaccatgtggaaaacgacaaggttggaccataggaagttgtgatttttgcatgtcaaaagtggaggaatattatcaatgtaggttcagttatttcaattcttcccttatcttgtttctgtgaaaactaattttgggagtcattgccaaatgtgtgaacacagacgcacacacacacacacacacaccattctctttgatagtcaagtctttacatattacacaaaaaatgttgatttatttctacattttaacattccacttgatagaaaagaaattatcaacttaaataattatattgtgctgtctcctcatgttataataaagccataacatacattataaatatgtatatataatatataaatattcacaaaataataattgcattttgtttaatacgtatccaaagagtgtattaggattacacctgatttttcatcgtgtattttgtttgcctgggaggttctatttgccattggctttattctttgcactatcaagatatccagtttcaacatttcttaaacatttcaagcatgctaagaaatatattttttcccaaaaaaaagtgtaattttaatggcctctttctaaaattcagactggctgctttctaagtttgaacctcacaccaatgtcctctgtaaatttctcatcatttgctttctgaatacagcatcttatattccagatatcatgtttttctatttcataactacttgaagcacatcctaaagtaaattgataagaaatgatatgcagggtttaaattaatgaatcattgattacctaaaatttagtttaatttagtgtcagtagaggattctaggtggaaaggtattctacctagttttgaagacattttcacttcgtatcacatcatccagcattgctaagagtccatttccagtttccttagctgtccttttgcagtggtcttgtttctcacccgctgacactatgtgtgtttcctacgactcctgtaacaaagcaccacaaactgggtggttctcgtattttactcagcttacttttttaaaaaatgtgtttgtttctttgttaggttggttggttttgctattctgtcgtttgggatttttatatatttttatattaaccccttatcaaatgtacagtttgtaaatattttctcccattgcataggttgtcttttcagtctattgattttctttgatgtacagaaataatttcttattaaattacacaaacatgcatatataattatttgcatagagcacagtaacttctaattttctgcagatggcttatggttttctggatttgatacataaagaggagatcttgtaataataaatattttgagtcttattatgccttatgtatgttaaatttaatactttcttccgtaggaaaagtgaatgattaaagtgtgacttaaatgtatgtgactgaggcaaaggacatattgctaggtaaatcttgtagatgccaagaattgaagcagaggctttataggtaaactagcagttgaatttctcaagttctcttggaaacatttgtagaaaaaatatttttgaacatttaacgaagcagtatgagcatacctaagtcactcagctgtctgagatgatgttagaatatttctctcgctgtaaaggaaaacgagcaagcagacactttctctagcccatcttcccagccgccagtgtccaagactcttaataacctctgtttgatttgttacttggaggaggaatttgctcatgtgtcatgactgtcagaagccctttttggcaactgtatcagtaattagctatgccttgtttgtgctcaaggcaagtgtatctgtcacattgatttttaaaagttctagtttttattcttgttttcatttcaactcccatggtagcctctcagcattgtaaaaccaacagtcacaatatcgatcaagctttcattgatacttatattctagaaaataagaaccagcatgctacgtcaccctcagttagtatcaaattttgaaaagttaatatttagaatgcaaagttaacagcaaagttaatatttggaatgatttgaaaacatttttgtaaatttttaaatagcttttccgattgagtgaacataaactgccttgtgtagagttttctgagaattttttcattgatcaaatatacccatatattgtctactataaaacagtaagttaattaagagtttctcttccattggtaaaaaaaaaatgtcgtttcagacttttacttgggttttagagcaaattaaaaaatagacataaaatggcatagatcagagattttcaaagttgaatcatcgacataatcaaaagtaacaatagtttaaaatgacattttttaggggaaaacttactgtaacaaaatatttgtgaagaaaacaacatcaaaatcaaagtgaaaatggaaagaagagtctcggataaagtatttgaagaactatgtaaaaggtgatattcattattaacatttcacagatatttaacatataattgagctactatgaattaatgagaaagagaccaaaattaaaaatctgcaatgtatatgaacaggaaatttaaaagaaatgtaaatggtaagtaaaagttaacacgacagtatgttcaaactcattgatcctcaatggaaagtaataaaataacaataatgtttttcttcttgcctttcagatttgcaaactttaaataagtttttaaaagatcatcagcaattctggctatgatgtaaataatttcacaatatcatcaattgttagtgagattttcattttatcaactttgaatagagctgtaaaaatatctccctgaatagatcttacattaaaagaaaaaattatattatgtttactactgtactgttgtactaactagaatagtgactaactggcacattgttgattctcatatttaaccaattcaattaattattaattgtacatatcctctgacctaattatctcacttctaaaaccaatcctataaaaagcataacatgagtgattagaagtgtatgaggatatccattgtaatactacattttggaaagaaaagccatgtaaatgtgagtcaattttaaaaaaagaaggaagtagatttgaaagatatatatgatttggaaagatatataaaatattacattaaaaacaaagcaaattgtaaattatgtgtagtgtggtcaaagattctctaacctgttcaggctcattacctaggaggtttgacaaatctgttggtgcattttaaaatttgaggaagtactaaaaccagacacataaaatattaaacagatgaaaacacgtatgaatgaattattaactttgaaaaaatacctatgaaaggaaacattttaatacttattacacatcacttgacttactagtgaaaatatgcagtcatcaaacataaatgcttgctatttatgtaaaaatctttttttttttttgggttcaagtgattctcctgcctcagcctcctgagtagctggaattacgggcacacaccacaaccgttttgtagagatgggatttcaccatgttggtcaggctggtctcaaactcctaaccttgtgatccgcctgcctcagcctcccaaaaaatcctcatttttaaaaaatgagttgtggcaggcagggtatggtgcatgtggaggagactaaatactcagctacaataacaggcagcaaagagctcttgtgtatatttaatcaagaacttcctacctaagtatattactaagaaaaatacaagtaaataccaaaggaaatctttaaaagaaaagaaaggctccagtggaatgaaattggacagggttgtgccatttctattttaaatattttgaactagcaatcttaagatttttatcagtttgaaacgtaagtaatctttccgtttctgtatttatttgtttagtttgcctttttgatagggcaaggtaagaagtttttaacagttcatcaaaagatccaaattactgacctgtttgcagtgtgttccttttttcttttttataagttttacccatgaaaagagaagttggtaattttttgaagctagggagaaagatataaagaaaaaagattacagaaagggggataaatactattgtatgtggttggaaatatcaaaacactgaaaactacgtctcttgaagtaaaaaaaaaaaactattgattttaatggctagcacatttaaatacaatattttattaccatgacctgagaaaaattaattgctcagttttctatgtggattttagtcttctgttacattaaaatatatgctggcaatagtttgggtactaagtgcgcaacctcttatccaaaaagcaggaagttctcactttagtttatcagcaaaaaataaaaaaagtgatttctgtgccaaaatattttattctaaaggtaagttacactttcaaccagaatacatataatactaatcaggaaaaatcttatttttagcatgtattttaagaataacttcttatgagcgtcataaacttgcaagattttattaatcaatttgaaaatcagttaaatatctgttaaagtggaactatacaagtaaaatttgaactgatcattttatttcagatgatcattccttcataatttagcatgtaattgtatctagacaaataaaatataataatgcctctgatgcattaaaaatacaacaatgacaaaattgtgatttggccttaacaatggacagggatataaaatcaattataacaaattctcaagaatgctctgaaataattatattaatttgtctggtaatattaaacaaaaataatcaaacatttattttattttctagggtatttataccatactaatttttatttttgtttcaaattaaaggaaccaaaaagacagtcccatccaaatcataatcaattcatgctgacttcatggcatcaacattagccagccacaccatatgcctggctgtaaaatggagtaattagtatgtgcccctgaatagtagattgctatttgattagtatattaatacacattaatggagaatcacagaaatctgcagatgtgtctgttttttcggtatgccccaggaacaatgagatctaaatgttccctctgtgggcaccggctgagctctgccctgtgttgctttccactgtgacagggcagcactgacttccaatgccaagtctcacagtcactgttctctctctacaaacccacagattctttctccttaccacatagccactgccagctgagtgaagagcccttcggtcttgagtgatcattggcagtagccaggcagtactctccatgggcctgggcaatggtagccatgaggggaggctccttctccttgaagaaaggagaaggaagagtgtgaaggacttagtcttgtggcttggataccagttcagttgtagtagaatagagcaccaagtagattcctaagttttctgactgtaggcttgactccaggggggcatttctcgacctgccttggggtggtggtgtgctcacagtcatgaagggaaggccacaaggcctggccagattcacaacctgctgattgtagagcacatgggcctggaagaaatactggtggtagccaggcagaggtcactgtaagcctggggcaagactcaacgctgtgctggctttgggtctgagccagtgcagtcatgtggtagtggccccaggggtgcttgtgccacccttccctcatttccaggaggctcagtacagagaaatatattccatttatttgggggaaagtaagggaagagcacaggagtctctgcttggtagtacagggaactcatctggatcttacctaagaccagcaaggcagcatctctatgagtctgtaagagtcaagacagggaattaaaaatagctgcttggaggaaactcaatggcattccagataacacagagaaggaatttacaatcctatcaggttaatttcaccaaaccaagtgatcaaaataattaacaagaatcaagccgatattctggaaataaaaaattcaatttatataccaaagaattcatccgagtctctcaacagcagaattgatcaagcagaagaaaaaataagtgagcttgaagacaagctatttgaaaatacatataggagacaaaagaaaaaaatagacaagaatgaagcacaatacaagatccagaaaatagctgctaaaggacgaatctaagagttattagccttaaagaggaggtagagagagagagatcaggatagaaagtttattcaaagggaaaataacagaggactttacaaacctagagaaaaaatttgatattcaaatacaagaaggttataaagaccaagcagatttaacccaaataagactgcccgaagacttttaataatcaaactcccaaattgaaggataaagaaataatcttaaagaagctagagaaaagaaacaagtaacatacaaaggagctccagtatgtctggcagcagacttctcagtggaagccttacaggctgggatgaagtggcatgacatgtttaaagtgctgaaggaaagaaaaccttttattctaaaatagtatagccagcaaaaatatcctctaaatatgaaggatatatactttctcaggaaaaacaaaagttgagaaactttatcaacaccacacttgtcctacaaaaaatgctgaaataatttcttcaaactgaaagaaaagaatgttaatgagcaataagaaatcacttgaaggtataaaactcactggtaacagtaagtacatgggcaaatacagaatattataatactgtaattgtgatgtgtaaactactcatatcttgagtagaaagactaaaatatgaacctctcaaaattaaaaactataacaccttttcaagacatagtatgatttaaatagaaacagcaaaatgttaaaaagaacgggagaaaaagttagagtgtagagtttttattagttatgtctttgttgtttttgtaatcagtttagaataatgggttataagacactatttgcaagtctcacggtaacctcaaattatgaaacctacaacagatccactaaagtaaaataataagagcccacatgtaaaagttcaaataaacaatgtaactatgtattttaaactatgcattttaagaaactagaaaagcaaggatcaacgcaaaattaccaaacccaaaattagtagaagaaaagaaataataaagatcagagcagaagtacatgaaatcgaaacaaaaaatacaaaggatcaataaaatgaagatatggtttattcaaaagataaagttggcaaacctttagcccgattaagaatgaaagagagaatacccaacaaaatcagagatgaaaagtagacattacactgatactgcagaaattcacaggatcattagagactatgagcaactacatgccagtaaattggaaaacttagaagaaatgaataaattactggatacatacaacctaccaagattgaaccatgaaggaatgcacacccataatagacaagtaacaagtaatgtgactgaagtcataatgaaaattatcctggacaatgacaacaaaaaaccccatagcttcactctaaatatgaacaaacacttacagaagaactaaaaccaattctactcaaactattttgatgagtaaaaaggtgagaatacctccaaactcattctgcaaagccagtattaccttgagactcaaaccaggcaaagacacacacaaaaagaaaattacaggccaatatacctgatgaacattgaagcaaaaattctcaacaacatacaagcaaactcaactcagcagcacgtgaaaaagatcattcatcacgaccgagtgggatttatctcagggatgcaaggatggtataacatatacaaatgaatcaatgtgatgtaccatgtcaacagaagaaaggacaaaaaccacatgatcatttaaattgatgctgaaaaagcatttgctgaaattcaacattttccttcacgataaaaacattcagtaaaactgggtatagaaggaacatacctcaatacaaaaaaaaaaaaaacccatgtatgattgacctatagctagaatcacactgaatggggaaaaatgaaaacctttcctctaagatctggaacaagacaaggatgcataagctcaccgtgtttttcagcatagtactggaagtcctagctagagcaattaggcaagggaaagaaataacaggagtctaaattggaaaggaagaagtcagttgattcttgtttgtagatgatatgatcttatattttgaaaaacctaaagattccaccaaaaaacactattagaacttacaaatagattcagtaaagtctctatcagagaaagttctctttcctacttttagtttagtgagaggctttatcagttttagtgaattctatcaatgtttcttctgtgtccactgggaaaatcttatattattttttcttttcaattcattaatatactactgctgatttgtttttaactgttaaagcaaccttgcaatccttagataaaatctcttcggtcgcaaactctgaattttacatattaaaagtatgtattggtaaaagtcatatattcagaatacatatgactatattcatgaatattagtgtcagaattttttccttacagtaactttagtaccaggtgaatgctggacacacaagttgggtaggagagtatgcctcctttcacattttccagaataatatgtgtggaattgatattatttcttccttaaatgattggtagattcaccagtgaagtaatatggaaaagaatttccttggtgagaataattttaattaaaaattcaattactttagtagacatagagatattctggttatttatttttcgagtgaactttggtagtttttgtcatacaccaatctacccctttaattgaagttgtcaaatttgtttgcataaagttgttctttctacacttagtgttatctcatttattctattttatttgagcttaatatattttttcttttctagtttctgaaagtggaacattgacgtgagaccatttttttctattcttacaaagtcaatagtgataggtttccttttaggcaatacttactgaaacaggaaaattttgatatatttatttttattttgattccattcaaaatactttctaatttcacttctttctttgtagaccaaaggtgtatttagatagaaatgtgcaatttatattccaaatacttataaacttttatctttacatctttgatttctaatttcaatctactgcattctgcatacatgcttaatattatgtgaatgctgttaaatatattgaaacttgttttataaccttgaatatagcttatattggcaaatacattgtattttcttgaaaaaatatgaactggagtgttgctatagcatttttgaataaatacaagttaggtcaaattggttgagagtattttcggtcttttatatttttaatgatgtatgattagtttgttatacaaattatggtgaaggaatgttaaaatctttaggaattatcatggattttctatttttccatgcagttctatcagtttctgctttaatatttgtattgactttattgagataacaattcacgtttcataaagtttacccaattatagagtataatgcaaaatttttcgtatattaaccgagttgtgcaatattattacaatatattagaaggtttccctagctgtaaaaaggaactctatgcttactagcagtcagtccgcaaccccaagcctgatccccagacctacaaccaccagtcttctttctgtctctatagatttgcatatattagacatttcatacaagtggatcatgcaacatgtgttatttgaaactgccttatttcaccttgcacaatgttctcaaagtttatccatgttgttgcatgcatccacatgtcaatattctatagtgtaaatatctcatgctttgtttgttcatttgaccgttaatgtatatttgatttacttccacttttggggttatcatgaataatgatgctatgaacatgcatacatggttttgtgtggatatatttttttgttgatggatatcttcaagtgatattgctaggttatatatatgataactgtatttattattttgagaaattgccagatattttccaaagtaacttcagcacttaacattcctaacagcattgtataaggtttctaatttcttcatgttagtcaatactttttattgtccattttcaaaaaaaacattttatccatccaattgactataaagttatatcacagtgtgattttgatttatatttttgtattagctaatgatgttaaaccaattttcttgtgtttattagtcatttacgtatcttatttggtgaaatatttatttaaatgttattttaattgagttgtttttgatattgagttctaaaactttttacatattctgcatagaagtcccttatcagataaaagatttgccaatattttcttattttaatggttgtcattttactttcttgttgttatcatttgtaatacagaagttttaaattggatgaagcccaatttatctattttatcatttggcatttgtgcttttggaatcaaatctaaggaaacttagcctaattcaggctcataaagatttatttttattttttcttctaaaagttttttttagtttagcttgcatatttatgtttatgatcaatattcagttaagttcgtgtatcttgtaaagtggaggtccaaattcattctttttcatgtggatgtccagttggttggcactaattttgaaaagtctgtgctttcccaattgaattatcttagtaccctgtcaactccaattgaccataaatgctatgttttattacagcactttccattctattctattgatctatacgtcttactttatgcaataccacatggtcttgattactgtatttttattattaaatttaaaattaggaaatgtgggtcctgtaaatttgttctttattttaaaattatttcgctatcacaggtcccttgtaattccacgtgttttagcattaactcttcaatttctacaaaagagcaagctgtgattttgaaaggaattgcatcgaatcatgaatcactttggggattattactatcttgacaatattaaatcttcctattcatgaacattaaatatattttctttccaggtagagagatattattgcatacctttcaagaatatatagtagtttccagtgtacaataattttacatcttttgttaaatttatttctgagtgctttttaaaatgttttattaaatgaaataatttcttaactttgttttcaaatagtttatgtgtagtgcatagtaatacaattggttttatgttaatattacattctacaacctacctcaatttacctattaggaaaatagatttttagtagattttttatgtttatctttgtacaaggccatatcctgagaaatatagtcagttttgcttctctctttaaatccgaataattttgtttctttttcttgcctgatttccctggacagaacctccaatacaatgttgcatgcagtgttgagaacacgctttcctgtcttgttccttgccttaataaagccttcagatttttaccattaagtgcttcatccctaaatatttggactttccgtggatggcctttatcaggttgatgaagttccctctattcctttttctacaaaggtagaagaatctgacatatgaagttttagtcttaaccactcaaaaacacagatatactgcaattagaattggtcatttgaaaacgtaaaagtatacacattataaaaaaaatttaaaaagaaaacacctaatttttgtagctcatagaaataatactgtttagtaacaacataatcaatttaataaaataataagatttaattattaatttaagttgattaaattaacatcaatatgtgaaaataaataattataataagatgattccaaaatgcaaattcagtgagtcaaaaatagccatgaaattcctaaatggaacaacaaatctgtagtatgcttcgagatataaaaagttatttttacatttataataattaaggtagtgtgatattgtaacacgaatacacaaaccgatctagacacagaacagacacaaacaaatagacacagaatagaacccggaaccgcagccattcagatatattgataagattcacctgagttttatttaagatagcccttcaacacagtggagaaagtatggtctttcatgtaaatggtgctgaatcacgcagatatgctacaaatctcacatgacgataatttcaagatggcatacagttacttatgtgaaaggtaaacccatgacaaaaatggggtagattttccagtcctgaagctagcaaatctttcttcaattggacctcaaaatcaataactgcaaagaaagacatgatgaattgaacgatattaaatgtcaaaaaagtatattcattagaaagcaacgacagattggagaatcaacacacagtgaatgaaaatgcatttattcaacaaatgcagatgcccagaatacataggtaaattctacaaataactttttaaaaggcagacaaacctaatagaaaaatatcaaaaggcttaaagagacactttggaaaagatatccatgtaatcaacacacctatgaaagtagattcttatcactgatctataaattaaagttcctatacaataatataacaccaaatcgctaataaaaatggtaacaataacaacaaatttaacaatatttttaaaataagaaaatttaaaaattctcttatcaataatttttattctgagaaactagaaaagacgaaatgtctttaatcaaacatgatctagtgttatccaaaagccaagaacagtcataggctgtctcctttaactgtcttaacaaccctgtgagacaggtatattactccaattctccaattttatatcaaaggaactaggattattttaactttgattttaggttcagaagtacatgtgcaggtttgttaagcaggtatacagattattttgccactcaggtaataagcatagtacctaacagtttgtggaacttcaccctcctcccaccctccaccctcaagtaggcctaggtgtctgttgttacccttcgtgttcatacgttcttgatgtttagatcccacttataagtgggaatacgcagtatttgcttttctgttcctgtgtgagttcacttagaataatggcctccagctccatccgtgtttctgcaaagcttatacatttaagtctttagtctatcttgagttaatttttgtataaggtgtaaggaaggggttcagtttctgttttctgcatatggctagccagttttcccagcaccattgattaaatagggaatcctttccccattgcttgtttttgtctgatttgtcaaagatcagatggttgtagatgtgtggtgttatttctgaggtctctgttctgttccattggtctatatgtctgttttggtaccagtaccatgctgttatggttgctgtagctttgtagtataaacatggctgaaaagaatatggtttcattattttttatggttgtgtagcattctatgctgtatatgcaccatattttctttatcttgtctaccgctgattggcatttaggctgattccatgtatttgctattgtgaatagtgctgtgatgaacatacaactgcctgtgtccttatggtagaatgatttctattcctttgagtgtataaccaataatgggattgcttttgatttgcatttctctaattattagtgagcattttttcctattcttattggctgggtgcatgttttcttttgaaaaagcacaatacaaaatgttaaggctgtggaaaaactgaaagtctctgatactgcagcttgaaatactatttggtaaaaccaacttcgggttactctggaaaacactctggctctgtctaaagcatctgagtttccattgctttcagttttagatataaaactagagaaatccatacatatgtgtaccaaagacacacactagaatgtttacattggtgataatcatgatggcgaaaaatagaaactgcccgaatgtccaccatcagtatgatggctttttttttttttttttttttttttttgagacggagtctcgctctgtcacccaggctagagtgcagtggcgcgatctgggctcactgcaagctccgcctcccgggttcacgccattctcctgcctcagcctcccgagaagctgggactacaggcgcccatcaccacgcccggctaattttttgtatttttagtagagatggggtttcaccgtgttagccaggatgatctcgatctcctgacctcgtgatccgcctgcctcggcctcccgaagtgctgggattacaggcgtgagccaccgcgcccggcctataatggcatatttacattacggggtgtgtgatgacagtgagaataagcaatctataactatcacaccaatatgggtgaagccagatacaaaagagcatatactgcgggattgtattgcataattaacaaacccaagcaaaactactctctgctggtgaacctcagacagaggaatattgattagaagagggcacaaagggccacctgagtactagatatattctatgtcttggttatctggggatggttatatagatgtgttttattcatgagcattcatgaagatgtacaattgtaacttgtgctttttttctgcacataccgtattttagcaaaaataaatttaaaacaggaacgaagtaggaaacaaagttattctgaagaatgtgcaagacagtgacctatccccattatacttaattgctcaaaagaatggttgagaatgcattttgctgactcttttttggaccattctagtaggcagatgttattgcacaccccagaggaaatttggtttgtggttctctgacttacatagttctgtagttttaaagccatgcagtcaagttgtctactgggttgagtttgtttcaagacattcattttgagtgagaaagaaaattcttatgttaaataataatagaattctcagagataatcatggtttttttttggcaaaagatttgaccttcgttgtatgggaaacagattgtatccatcacttctcttctcagtttttaaaagcaaaagatgaaaaagtagataatctcattaacaaaatgaaaaaaaaaagaagtaataaaaaagaggcatgtacaagtgccactggagattgtttatctgatttgtgtctcagtaaaagctgttaccatatgcctgacaggaatatcagccgtgaagatattgttgattaggattaggataaagtcaattaaaaacgaaaacggatttactgacaaaaatgatcaagaactgtgttcccaatcatagactcagataatctcagagtctcatagtcactccagtcactttgtcacgtatatacttgataaacaggttgtgaaagctttctgtataaagcatagtggcatttggaggttaacattcatatacatatttataataatggtctatttattcaaaacccattctggatactagcattttctcacattgcagttttttttatccttggcaaggcattgggttcatttacctttataaataattatggtttaatgtttagaaatagaggtataacttcttgacttatggtattctatgaaataacaagaaagaagaaaccaaatacaatttgtatatgtgtgtgtgtgtgtatgtgtgtgtgtgtgtgtgtgtgtatttagagagagagagagagaaagaagaacaaagtaaattgctcatcatttccattatttatcactttccaaatagagctcattttggaaagataaaggaagtaataggagctattttcagaccatatggaactgcataatgtattggggttgtcgccagattcaagcaaagtggttgcattttacaagctggagagtccctttcacaagtaggattacagaataattatgctcatctttagatgtttctgagagttttcattgggtctatatatgatgatagaaaagtaggatgatgataatcttttcccaagttttaaatacattatgtgtttctgcctttttatttttgtttaaagattgttatgccaggctgtgatatgtttccatttggttaagtcaataaggacattcaattttttcaagatcatgtgcttcacaacttccaaatcttatttttcaagaggagttatttcctggattggtggatatttaagctatgcatgaaacaacaacaaacagaagtttttgttcttctttctttgatacacaaaagctctctgatagtccccgatttatttattttcagtggacttggctaaactgtcatgggctgagttgtacattctccattcatatgttgaaatcctaacacccagcacctcaaaatgttactgaatttaaagatagggccatttgaatggggtcctaatccaatgtgactcatgtccttataaaaagaggagtctaaaacactcagagagacaccagcgattcatgtacacaaaggaaagaccatgtgatgacacaataaaccaaagagagaggcctcagaagaaactaaacctgcagacattttatttccatggtttaagccaccaagtctgcaatcctttcttatgacaatccttgtaaactaatacacaaactaaccagccttcgacaactaagcagcctgcatagattaattgggctagttccatttcttaattagcaagttaggaaacaatatgatttaggtttctgagaaggctaagaaggaattctcctgtgataaggattttataaatgtaaggtccgtaagtaagtatgatgaaatgacgacattttgtctgacccaagacctccttctactctatttagaaggcataggcagggtaaacgttagcatctaaattttctgacattttaacatttattacttctgaatataccacatctgcaaacccaggggcattagaacgactaaatgcaatatctgttcaacacgcagataggagctacatcagcaagtgcagatttgatgataaactttttcgttatttgtttctggtgccaaattgggagtgaagattttagttggggctctgttccaaaggttaggccgtgaattgaactgctgcttttcttcaccaatattagagatatcagttaaattaaaattcaaaacaaacttgctagagaaattaaagaaaatgttaatatttccaaaaagttcaaaatgaacgttcagggtttgagttttatatatatacatagagattaaaatataattataccacttctgcttttggatattgtgctgggaataacctttcctctgtctttcctctccatgtgctcctcatttgcagccacccgaatgagattgatgctctatgcctgaatgctcaggctgtacctagattctccacactctagaagaatgctctgtaactagcagttgtcttctgtgtttctaagctatcaaactgtgcaaagtcaacaaaattccactgttttgaagaattaatacagtttttagcagccctctacctactctaggttaaatacaatgtctagggaaacactataataacatataaattgaccattattactgatttttagggactatccatattctcagtgtaatttctgacctgtaatatcctatatgaaactggactcaactattagataaagaaagaccctatcctccaactggtactcactcagacactgagcaaaaggacatttcaggtcactcggccccttgtactgatatttcatctttgcagataatattaactgtatgactctatcatggaatgctaagaaagaaataattatattttacaaaatattttctattaaagttatttcattttatgctttaccagctccaataagaaagcatgatatgatattttcataggattatggacttggaagattccttattgcatcagcgggtttataatgattgctaataatttcatataccataaatctggcaattattaatcttcaaaggcacttcaggtaaaatctttaaaaaatgtattattcaaattttatgacataactttattaaaactttaccaaaatttgctgttctccaaagaattcatagaaactttgaaagaattaatggaagaatgaatgcaaaaatatagagttctacatgtatttgtcgttgtgggcaatgctttcttgctgttctatagctgttctagttggtgtctaccctggctgtagattcagagaagaaaaaaatttgaggagaagtaaaacggagcatctctctgagagtcttctacaagtttttattcctccgcttttttgtgttttgttttgtttttgttttatcgtatctcctatcagatgaattgaatacaggttggagaataatacatctcttctcttggtaagactatagtagaaaatagaaaattagatatattatttgtccaaacgtctgcttttgtttttgaagaaaaacaacaatagcagaggaatcattcaaaacttttattctttggcaactgcactgattatcttactttgctcaaaggttaacacttgatttaaggagcttttgctcctaagtggaagagtaagaatgtcttttaatttcattactagtatgatatttacattattaacagacttaaacttagacaatattattttcatatgatgaaacaattatacataaaagagcaagcaactcttgttttttctgttagaaaagtcaccatgatccagaaataatagaaatgaatagtataaattttcccttaaacatagatctttattcacttcttgtatttgaaatacttcaccttttcctcaacttcttatccaacaataaagtgtttctgtttgaggagaattgccagtctgaagatattgtgggtaatacctaacttgctttgatttatgtttacaagagtgtctctgttgcagaccttacttttctgctagtgtttaatacattgttgacatttattggagttagaaaaattatttaataatatttatgtttcaactttcaatgcatttttatttttcatgtttcttgtttcaataaataaactcagtgataaggttgagtaaactcagagcaaagatgtcttcacttcgagaatcaagagaagcagtttgctttaaaacacaatgcctttgttttatgaccctattagtttattacttaaatcagttactataaaatgcaagaccactggggaaacttacaggtcatctattcctgtaatttcttgttgaatgtaagaagtgctgatatacctgtgtgtattaagattaaattgttttctgtaaattcaacaattataacaaaattaactaatatttatacatttctgtttcaataaattttcataaagatattttgtttcagtatttcttcatggtagtaaaaacttaaaatatgttttactattttattaaaattgtaaaacacacacatcaatcactttttaatcaactctaatttggctacattctcaagttatttcctaggagcccctccctactgcctctctctgatggattgatatctgtttggaactattcattagctcctagtcattcagtaatgtagaccttctttttattttctggtagaagtaaaaaagaaaacatttactgtattaaaaaaacccatgaagtaaactccacacaattttttgaaggtctttgaccatactacttgcataccttaaaagagagtaatgctttttcttaaaatgcttcacctaaaatatacatatattatttttacctcatatatgtgtcatattgtatgttacatattatatatattatatataaaatatactgtagccaattatatttttgcagttttacaataagtacctccaatgttttaattctctttccctcaatctctttatttttattaatctagaaatgctcataaattttacttgaatgttttctcttccgagcaacttattttaaaatttttattatatttaagtacatgtagtatcctttattaactattctatgtacaaacatgattgttctaagatattcaaaattccattaaactaatttaatttttaaaaaactattcaaaagagcattttctttttgcattttcaaggaatcaaaaaacattttttgatgttgaaattacattgcatatttcaactaaagatatttgcaaaagaaaatataatttgtactataactaggagataatgcatatgagaaatatgtaaacacacacagagtattgaaaaaattaactcacctttaaatgtatggtgcatttttagtattttattaactgtaatattacaactactagattttactaatagaattgattttcaggcttagccacataatgggttccatgataatgagcttaagaaatttatcataaactcatattcatatttctgttaatattgctccatacactttatatattatatgaattggatctcttaatgcctcattgcttccttcagggtacattgtaatgatatgaattccttgggcctccaaagcaaagggtctatagtctgaagttcctgtccatgggaatgaattctaccattataactcctatgggaatcaaaagggccacgattgagtgaatgcatgttgaataaataatctccctaatgtcaagattataatgactgttgaaatccccttgtatgctacttgacactatctatgacattttcttcatccatataatacttattataatcatttttgttccttgagcttctctttggcagcataaaatatgaataaataagcaattgataatccaaagtaaggtttgcaatattttttaaagaatacataaatttgctccttgattgtgtcttctacaaaatgttctcccagaaatttagagaattcctgatgtatgagtaaagataagacatgggatcatgttcatgttttctaggccagctttaaatcttggaagctacatgatttttacaggattttctggaagcacccgattccaggttaagtgttgcaaatgaaagaaaatgttcagatgtaaggaaatacgtctagcagtaacttcactattattcttattctttttatatatttactgattactcaggcccagaaagagccttgccccttgtcttgctgaaagcaatagtctggagactgttgacttggcaaatatatctcagtttttttggagtgattctgacacttgctaccccagcagttactgaaaatatacaagcacacaaaatcatacaaaacataacagaaatagtaaacacatagtttctcatgtgaatggaagtgtctcccagattaaaagatggatcctgtacatttaataacacaatttccagctctgaaatccttctgctgattggcaaaatcattattctggtattatcctagaaggggttgacttttataaacattctcttttacaggcatttatctttccttttctgaaatacccattttagcactttgtccctaaacaaaccaaagacataaaaaatcaatttttgttttaaaaatataacacagccaagcaataaatcaatggtatttccaaagtcctttgcataatttaagacctaagtcaataatggtggcatagcttcagttgttcatgtattattatttgtcttcaaatttttgccacatgtaaggttaaaatttcacataaaatctatgatctttcttatggaaaaaaagtaatacttcttgaaaagtaacaatagtgtaaattatactgaaagccattctacactaacttgagtaaacatttctgacatatgtcaagtgagcatgtattatagctatagtgtctttagcataacagcagatagacttagaaaactatatgtgacacataataggtactcatttaatatttattaaatgaataaataaaatggaacattattcttctgtcagagagggttttatctctgaaaatgcctttgaaatcttgaaatgtaaagattgttaacttgtgactttcaaagcttaataggaaggtagttctggtgtttcccaagtatgaaacagaagtacattcaagaatgttaactgaaattgataacaaatatcaaagcaaaacttgaatcgttactattaactgacagatctatcaatattacatgcttaaaatatgtgaacaatttattaatacattttctaaaggcttatattttcaaatgttcaagaatagtttattatttaattatcttcaatgtaattaaagggttaaaatatctgctcatttacatgtgaatagttgataatgcggaaactattttaatgttccaccaaaaaaaatcaaattacctgggcattgccaaaacacaatttaatttttttttgtaaacagatatttcagtaacaacaaagtttaaagtatattttccttaaaatctaacatgatattcaagcccatcttctaatttgttttggagggcaggtagtagaagccactgtaaataaagcttccattcaaccatatgcattaataatgttatttattccaactgaattccaacaggaggtagcaaggtacaaaaaacaaaaaacttgcaagaatcaggaaatctgggttcaaatatccaatttgatgtctgcaagatgaataagctagaaaagattgtttatttgtcattagttttattaagttgattaatttaaaattaggatggccaatggcagagagagctacgttaatgacttgggttggattcaccatcatcattgactttcagatttgaatgtaagttaatttaaaaataaatagatgaatacatacattaattttgttctgtaaatttgagttggtgaatatgttattctaaagcatattgtgaattgactgtatttatagcaaaacagaaaatatgatgtatctttgctgatgggataatcacatgacttggtaataagaggtgatacctctcatactagtaagatgagaaatcccctaattataaatatttttatcaggtatgttttatataaatatcttatttcatggctgtttaggaaattaaaattaatagggagtgtctatgaaaacatgtattggtgattgtgtgtttacatgtctttttcaggggcttgacttgaaaatcactatgcatttgctgtagaaaatataaagccaggtaaagtgagaattaaagcaactgttagaaaggagagggatgagctataaggaaatacattacaaaaattattcttattgttttttattaataaaatttatatttctagtcacccattattcccttgccaagattattattctagctatttatacaacttatttcatttttaagtctaataaccgcgtataccttttggccagttttctaacagctacattttcaggaaactgttaaattatcatatgatgaacaaatgaattgttaaaatatacaataaaacaatgccatacgtaatattcctacaaaaatatggggttccgaatgctactagtttacattaggcaagaaaaatgacttaaaattgtttgaactaacttagagcacacactgaatttataaataattatatatttttctgtgaaccagactagagagttttggaaatgcaacttagtttacaaaacagaagaatttattgtaaagtgagaatactttgcagaaacccagctatctattaaaggtgatatttgtacttaactaccaggtaaaatttgcctctaaaggagggcagacacacttcaggataattccccaaggcaagaagaaaatactataatttctattgtatttgtttctggcttttttcaacttttagttttgaaacaattttagacatatgaaatagtacaaaaaaacaaaatacagagttgccatacatctttggcaaagttcctcttaatgttaacatcttacatgtaaccgcagtacagttatcaaaactacatgtttgtgagtacagatctcttagctaactactttatttgaattgcctcagcttttcacttatattctgttatagaaacttgctataggtttctccttaacttcttctagtggatgaagacttcctatacgttccttgtctttcatgactttgatacttaggaaaagttggtgttttgagtattatgtaaaaatgccacttaatttgggtttggttgattttgtaatgattcaattgagattgagcatctggaaaaagaataacacagaagtgatatacactcttggtacatctcatcagagggtatattatttcaatgtggtttactatttgcgatgttagcattgatcattggactggaataatgcctaccaggatttttccactgtaaaattattattgttctctttatattactaaacattttgaagagtatactgaaatcatgtaattatcttgtctcccctttgcatccatcagcaaatctatcctgcagcaagtattaccgatattttctattttcctcattctgactacgtgtattgattggaatgcctccataagaaacagttaccccttttctcccacttatttcgtcagtcatttatttatactagtatggacttatgaatatttacataattcttgaaatttcaatccacatatgactttacgatagaaatcagaaatgcatcaacttttgtaaaccctaatgagaatgtacattgggaccctcattagtacaaactctgaacaatctgttgcatagcaaaaagagaattgttgacagcagatagagttcaccatgtgatgaagctggtagtggcactatcattcattcattaacttatttgctcttttcagatatatttattgagaacctactgtgtgccagaccatgttataggattggggggtacccattaaataaaacagatgaattttgccacacagagaagtctagcatagagtaagcaaagaaaagaatattagataaggaggttacagaagtcatcagaaacgagactattcaggacctagattttactataattttgcttgtaaggcccaggcagatatttagtaagggacagttaatattttaaaatacaaatatatatatatattatatatatatgagaaacatatatagtatatagatatagcatatatattatatatactgtatatatagatttatagcagtacatgtatgtgtgtgtttgtgtgtgtatatatatatagagagagagcagtacaaagttggaagcatggagatttgagtaatctaagaaatcacgtgatttgaactaggaagctattagctaagatggtcagattcagaatatcttcggaagtttaaattctcaaattatctgacagattgaatatagggtataaaagaacagtcaagaaggtagacttcaaagtattgaaactgcgcaagggggtgaatgttgcatttactattttgggagggaaaagttggaaaacagagcttattagaaatccagttagaattctaataaacacctgtatacataagtctagattttagccacgatgagcctggggttgcaaactttgaattcatttgtgtataagaagcattcagttcctctaggagagaacgttgggtggagtaaatttaaaggataagcgattggaaagttaaggtattggtgcactgtaaggttgacattggggcattgagaaagggaatccagcagataaattagggtaaaatagaaaatgacatagaagtcgctagatttgtgcatgcttttgtgtcaaaccagaagagattctgaaatctagagaaggctccgtgtgtaattatttcaagacatgaggccgctccatgtatattcatccactctctgtgttttgctttattttaatctttgataaaagtaaggttgctaaagaaggaacaaggcaaatgaaagattaaaatgttgagagtataccattgagattaactgagacgccattagacttactaacgatgctgttgaagaacctttgaaacccattattagaataaagtggttacctggaatgagtctattcagggcctagatgttgttatagctttgtttaaattataatacagtggcctaaaaacaaggagaataacatttcaagaaaaggcagctctctcaggtgttgctaatatgtccaatgagatgaaaaatgtgaatttaccattggatctggtgatgttgaattcaatgctgactttgacaagagcagtttcaatgaagtaatgggaagaaaagcccttctggaatgagtttaataaataatgggaaaaggggagttaagagatagtgagggcaggtgtggtggctcacagctgtaatcccagtgctttgggaggccgaagcaggaggatcacttgaatccagcagttcaaggctgcagtgagctatgatcacaccactgcactctattctggggaacagaatgaggcctcatctctagaaaaacataaaataaattaaaaagtaatagtgagtactgattcatatgagtgtttttgctacaatggaaggtaaacaaatggagttaatgctgaatgattaggtggggtctaaagaaagtacttaatggtaaaatactatttttattaagtgaaagtgtaaatagttgaattaatgagtgaataagcacttaaaagtattttttctttattctaataatgggtgtcaaaggttcaacagcatcagtaggtccaagaccaaaattcaggttctaataaattctcagttaatttcaatactatactctcaatattttaatcttccatttacctttttctttctttggaaaccttacttttattaaagattataataaaacaaaacacagagagtggctgattgggcatggagtggccttatgttttgaaataattacacgtggagccttctctggctttcagaatttcttctggttttgacagtaaagcatgtgccgatctagttaagtatatgtgatgcactcatggtgtgaccggcaaaggtatagctgtacattctggaggagaaaattgttgtaggaatgattatttcatgctgctcttcacctatgttggctcagcaggtatccacacaaatgaagttaggtaccaatgatcaagaggttctacatgagaaacgtggtatataaatgtatctatataccattttgttatgaataattaatctgctgatatcagaattggtaaagtcctcatagcatttcagttgtagctatttttattcatggtttggaagactgcatatagttatatagctttatttcatacatcctcattagtagcatctatgcaaagaactatttttacaacattttaataaagaaaaaaaggagctggatcaggaggagtgagtaaatctgggtttgaatcagaattctgctccttattggacaggatatctttggcaagccacttgaactcagtctcaggtttctcaactaaaaatggctatattataaatatataggcacttaccactaatttcctaagtagttagataatggaagcaatttgcaaccataaatgtaagatatgaaaatactttatacttacttaacaccttactctgctttagcatgttcatgtatgtgttgtcatttgattacacaaatttttagactaagcaggaagaaacttttgctccaaagttacttatttaaaaaaagtaagaaataagagaagttacaaaatagttaaaaaggtccgaagtgaataaaatattaatttgtgtgtttgttgaatgcctaaaacaaatccaaatctatgggggcgttcacatgtacaaattaattttaatgaacactgtgaaatcactattataggtaaaatgttagtgataaatataaatttattaatcatttcaaaattctcctttaaaatgagtgaactgagtcatagagaaatatagcaacttgttttctaatataaaagtgaatgcctgtgaactaatatttactgagtttttgactattttttaagtcctacattcaagcgaattctttattaatctacataattaacctcagaatatcactatattttcctatttttcatgcaagaaactacagatggtccccaacttaagatagttcaatttgggatttttttgatattaaaataggtttactaaggtactaaatgcatttcaacttacaatagtttgaatttatgatgtgtaattataaggaagtaatcccatcttaaggtgataagcatctgtagatgtaaaagatattaaataatgtagccaagataatgcctttataagtgaagttgatttcaaaacctgctttttggctcagatttgtttcataacacatcactgcattagttgtgtcataataaaaatacacatactagtaacaaatcccaaataacaacttcggtctgaataagtcgagtattcatttcctcttaattgattcacttaaactcatttcctgggtagatattaaaatgtatgaaggatttttaggttttgatgggtgtaaaactgatgaaactcataaacacgtatattataaatactctaatatagataaacatagagtgagaaaagagaagcatatactgagtgctagtcaagagacaaaatctcgattcatttataagtgaatagtgaggacttcaaggaaatatgctatatacattgcctttatattcccagcaaatggataaacatagaaagagtgatctgaaagtaatgtgtattcagagacgctatggctaaccaataagtcacagataacggacgcaatgtcaagaaatgagcttggaagacgcagcacactgtgaagggcattgagtgtgatgctgaagtatttaggtttaattctggaatcaatgaggagttatcgaaggcatgggagagacgttcaagcaggaaaatggcatcatttcattattagaaaaaattacaaattgaattaaagctataaggaagttatatcaaatatggaaagtctaatagttttcaatgccaagattcattacaagactatgtaaagaaaattctgtgctttttttttttttttgagacggagtctctctctgttccccaggctggagggcagtggcgccatctgggctcactgcaagctccgcctcctgggttcacgccattctcctgcctcagcctcccgagtagctgggactacaggcgcccgccaccgcgcccgactaaatttttttttgtgtttttagtagagacggggtttcaccatgttaaccaggatggtctcgctctcctgacctagtgatccgccggcctcggcctcccaaagtgctgggattacaggcgtgagccaccacgcctggccagattctgtatttttatgttctgattaatatttacaaagtgaaaactcatttattttgtaaggtattgatgatcttctttctttatccataaattatatctttaggtattgtgagaagcaaatcaatattatccaaagcttattgtgccaacattttttagtgaagaggtacagtacgtttttatttatactgaaacacattaaaatatgaaataacatctttaaacattttttacttatatgtacatatatttatgagttatcaaattttctaagaaaaggaatttatcattttgtagaaaggcttgctcatttttcaattgtgttctaggttaaaaaaaaaagaaagaagagaaagtgtgtatctaaggtctatcttaatatttggtcatttttatactgtagtttctttatctcttctatttctcaaaccaatcagaactactaaaagttctgtaattctgtattaactctgtgaagtaaatggatttcttaaaaaccacatatttaaaataaatggtatagtactgactattctaagcacagtcagtgtatggttatttagttattaaatctactcatttcaaggcagggaaggtactaatagatataatttgactttcagattgatgggtaaaatcttcaaattaaaacatataaagccataaatgactctttacgtcaacatatatgattattatatattcatataggtataaattgtatttttattaacagtaaataaaaatacacttgaaaaattatttaaatacactatttccaaatgtatttttttcttacactgtgacaacattattttttgctggcaattcagagacctttcttcttttttcaatgtccctcttctgctaaagttaaataacaatgagatgggattcaattttactgataaattcttctccacacagataatcgtttttcagtcttgatcgtctttagggtattatgaataatccgtgcacctcttcatttaaaatttattctgagcactatgcgagggtctagggatgtaaagacaagtaaagaagttcatagtctgttggtagagggagaccctgcaaatgatcaagttattaaaatcctgctagataagagctgctatagaggtaaccgagagtgcacaactgacatttagcctaatccttccaccgtaacaaatccccaatttactaccttcacagacctcaaacaattgcacattaaccttagcccaaatgtcttgccctgtaacattctgtctataaattatccaaacagaaaaccagaacatgtcctgagatgcatccatatgcaaaacctttctattcacccatgatatgtaaagataaatatttaatttaaatgtatttttgaatccatctgattgtgggttgtttccatacctgtctagaacatagctgtgttatcctaatgataattttttctgtcctgctctttgccctatcactatatgttgaattctgttcatcgctcccccagttccaatcccttctcttcttcttgatcacatcttaatattaaccattttacataattttcttactacggtgttaatttttctctctaagatactatgtagtaattgttcctccagctattttctctcactagtcatatctcaagtatttctctactcataagatgcattgcaattagaaacatatgcctttcatattttcatattttctttgctcttcaaaatcttttccagttgcttaatataattttctattttcacagcatttttatatttatctgataatacctatataaatggtatttctttaaatatcattaaagaaataccattaaaacacatgaatggaaagtaaacacatttaatcagctaacaaagtgataacaactgccacaatttgttacattttgttcactcctttattattttcaaacacaaatacatgctaatgttaacaattgaacaaattattttttacatatatgtagcctgatttttctgaaaaatatgttgtgaacttttcccaatggccctaaatattttgaaattttctatacctatttgaatagtatttcatctaatggatattcttaaccaatgtttgttccttatattgtggtgctgtgattaatattctagtgtaaaatcctcaaattcatctacaaaaaaatactttagtatatacatcgccagagatgaaggtgaagtaatcaaataactcaaaaaaaaaaaaaactcaaaaagtttaaaattaaagtaatgggacagatgcacaagaaagtagacaattactacaaaatatagcattaatatatgcagttttgatttagtactaattccctgctatgtgcattaattctgcctcatgcaattttatttggtgagtattattttttccattgtatacatgagggaatcccagttttgggaaactattttactctaaaattacctgaaattataatttgaatatgaacaaagcacaaaatgttacagtgttaactacagaaaatgtgttttttttattttgacaaataagtatcttccataaacatatataaaacagaaagttctgtttgctaaataacacaagtatgatgatgaaaaatagaagtaaaaaagaaaatttcacagaaccgtggttacagaatattgaaaggtaactgcagaaaaaatatgatgaatatttttaaaagaactatatgctttaataataatagaagaaatgtgcctagcatatatcattatattgttgcatcgtcaaaaatgacaaagaataacaataatagttttgttgaaataggaaggctgatcaaatggctgtcgtcttaattcttaagaagcttttaaggaaagttgttttttttttttatttttgagatggaattttgctctatcgcccaggctacatagcgcagtggcccaatctcagatcactgcaacctttgcctcctgggttcaagcgattctcctgcctcagcctcccaagtagctgggattacaggctcctgccactgcacccagctaatttttgtatttttagtagagatggtgttttaccacgttggccaggcttgtcttgaactcttgatcttgtgatccaccctccccagcctcccaaagtgctgggattacaggcgtgacacactgagcccagccaggaaagacattttttaaaggaaaagagacaaatgctagagagattgagaggagtccaatagaagacaagaggttatagcaaattttacaaagaaggaagtagagtcaccgtgaggtgagatgttcctgaatacgcaaagacaaacccttgaaagtgtcttgttctgaagccagtaattatggccgagggcagatgtacacagagagggaaatagttaattaaaaatatatctatggcaacacaatactaaattttgatcacacttccatcttcttgcctctttttatttgtacaggttaagtttctatagtcttttattcatcaccaagctaaaagaaaaaagatcagcacctcctgtacagctattgaaaagcgtctgaggagaattaaggtagcagtgaccttgtaaggaacagaaacccccagcattctgacacttcaaaacccagcttatcatccagatctgtcattgttctactttgatttagatttaatgcttccaagaaaacaactcttctcacaaacagaatcactcccaatcattagcccatcttccctcgtgaacaatgtggtgaggaggggtgagagggaagaggagcctggatatgcatctgcagaaacaaaggtggcggcaagatgactccagcagctttctgcaaatgaatatgaatggataattgaggtttataagacatgcgaaaatagctaaagtgtaaaaagaaatgacttaaaaacaacaaaaaatctgagaaactgtcacaggcaaaagaaaactaaatgtaatatgcgatcctgaaggggatctgaaactgaaaagatcattatactttattttaaaataatatatcatcaatattgttttattcacgttgacagatataccatcacagtgaaagatgtttatactagaaacaactgggagtcgtgtagatgggaatcctctgtattattttcatgaatattctataaacttaaagatattctaaaatacaaattgtacttaaaattaaaacaataataataaattataagctggacatggtggcatgcatctttaggcttataggcaagaaaatcacttgaacttgggaatttgaggccagcctgggcaacgaactgagatgctgcttctgaaaaatataaaaataataagttagtattttacagctttattcaggtatgttttacaaataaattgtatatatttaggatgcacaatgtgatgttttgatatatgtattgtgaaatgattaccataatgaagatatatttattattgttattgtaattattattataggattaaaaacaaatgagttaaaatattgtaaatggtgagtctgggcaaaggatgtatagaattttttaaattatttttgcaactttcctgtgcttgaaattatttcaaaataaaaagaaaagtgaaaaatgataagcaaacaagcaaaaaactcatcacagaaatatgctgagataattcagaaagtagatgaagccttaatgacaacaataggaaaaaaacaattccttgtgattcccaagaagatattgccactatggaggattgaggagggttggttgggaggacatgtactatcaaaatgaaataggaagctagagagacttcttaaagtttaaaaatgactacaatgtttgaaagaaaaaccagatgaatattcataaaatgtagaggaaagtcacaaaaaatgccaacggaatgagataataaggcatcaggcatctgatgtactaccattactaggcagtgggacaaagaatgaatagaagaatatcatcaaaaaggcaatagcaaaatatctcctggaggtgaagagaaatttcgatttagtctcaaatggtccatcaagtatcactgaatgaatgaaaggtaagccacccacactaaggcacattattattattattattttaattataatttaagttctgggttacatgtgcagaacgtgcagttttgttacataggtatacacgtgctatggttgtttgctgcacccatcaacccgtcacctacattaggtatttctcctaatgttatccctcccttagtcccccacccccccgacaggccccggtgtgtgatgttcccctccttgtgtccatgtgttttcattgttcaactcccacttatgagtgagaacatgtggtgtttggttttctgatcttgtgatagtttgctgagaatgatagtttccagcttcatccatgtccttgcaaaggacatgaactcatccttttttatggcggcatagtattccatggtgtatatgagggcacattattataaaagataaggaatgacttgaaaagtagatcatcataaaagactctagaatggataaaactaatcacacatagacacccctcacaagtcaccaaaaccagtcaccagtccaaaagaatgaaaacaagactaaactagagacttcatcaggagtatggaaaaaaaggtcaatgacaagcagttttcattttttaagaaacaatgtcaaccaaatagtctaaaaacagtataagaaaaaaacaattttcgttacatatatatttgaaaaatagcacaatgaataataagaaatcacaaaggaggaattgtatacataagtgacagaatatcatggaaatagaaaaactctagtaacatccacaagacaaggtagactccctgcaaaagaactcggcatcagtttcacacaagatttctcctcattaccatgtggcattatgatttcatttgctttcttgatttgaaggctaaatcttgcatgaaagcataataaattcattcaacctatacttcaataattcgaaaaccataataaaagctgtaataaagtattgtttattctaaataagaataaatattcaacataagaacattgctaagagatagatgctgcaaattttgacaaatttccctaataatattatcattaatttatcttatggaacaaagatattcaagtcaattctcataattaaattaaatactggaaaatggtataaaataattataatttactgcaaacatactataacattttcatcagctgttttaagagacattggttataaaaaatagtgatataattttacatctttgaaaaattaattattaaatttatcctatatttaagttcagttcatgaaaccctcttttgacttcccatggtactcttatcataattatgaagtgttacctaattttgccactgtgtatttttatttatctttttgttcggctgctttttcttcaagattatggttttggggagaaagcggccacaattcccaagcttaggcaatttctggggcagtatctagttcctggaaaatccctgaaatatgtgttaaatcaatgcctagcacttaattgccgccatcacgtggggtcagttggacctttctcatgaaattcccctgggtctctagtttaggacttgcctccttcctttgttgactcatgcgtggtttgtactgtatattcctttctcacaattattgggtgaagttgttatgtactttctagtgaaatatcaataattattaaataatacataacaaatcttaaattatgtaatgccaagaaaaaaccagaaattctccaagatgacaaaataacattttggacttatttcatatatgtaatatttattttttatataaatatatatattatatatagagagagtttagagacagggtatagtgtgtgtgtgtatatagatatacacatatatatattttatatatgtgtgtatatatattttatatatgtgtatatatatatacacatatatattttacatatgtgtgtatatatatattttatatgtgtgtgtgtgtgtgtgtgtgtatatatatatatatatatatatatatatatatttatttatttatttagagagagagacaggtctttgttgcccaggctggagtgcaatgacatgatcatagctcactgcagctttgaacccctgagctcaaaaggatcctcctgcctcagctttctgagtagctaggactacaggtgtgcactgccatgcccagctaattttttttaaattatatttttagaaacggtcttgctatgttacccaggctgatctcaaactcctggcctcaagctctccaccttcctttgcttcctgaattgttgggatgacagttgtgagccattgtgcccagccataactcatttttgactgaagaggatatagtctttctgttccactgtctctgctgggcttctcatacacccttggtcatttaattgactgagtttttggctctccttccagtacaaccgtaaaataactagagcagcttgacctgcactactgttttctgctttgtgtaaatatggatttagaagaggagtgaggtggggagggcatatacggcctttgtacctgtgttgcagctccctagctacatacaaataaccacccttattgaaactacccttcaataaccactacttgtatactcacagattttgggttttatacataaaatctaggaacattttatctaccacaaatccatctatatcttaaccatcataaaatcttgagatttgtcactgatatctttcacgtgtagatatcctgtgcaaaataatttgcctttctgagatatcacactttcatgtgtattatccagtaattagaaaacacagtttataaaacaatagtgaatcatgttacttacattctctctatatacaatatgccagcatcgaatcttccaaatttcaaagattcaattaatttttaaataatttcatattgcaatataatgcattttcttctttagtgaattttatatttctttggattttatcagttctaatacatgtgtggtaatatatataattatacatatttatataaacacacacacacctaataagtttcaaaacccacctattgtgttctattttcgcttgtggtatattttaaatagtagaacttcacctggtagagtcatcaagttctctaaaattataatatgacattaggttctaaagagagaatcagatgtcatggattatactttcagatgctcgataccaattttttatgatcttggaaaaacgaatcaacttgtagagtcatacaaacacatttaatggtttgagaataagtaacaatttaattatgttttaaaatgtaagatatattaaataagctgttcataatcttattatttattcttcactgtatggatatattagagtttatttgaatttttatttatgcaagttacctaagaatagtgcttagaagttcttgtgggaattcaaaaattggattcctcagttgtttaggcaagaaaatacaaattagcagaatttctgcaaggcagctgggacatttacccaatttcagtaaatgtggtagaattttctctctatgctattctgcagacaaagaggatttagaactacttttggctgcacaagaaggatatttctgtatattgcaaacaaaatgcagccaccactgaatgaaaaaaatcgtttcaaaataaaacacgcatgttacctttttttctacttgcttttctgttaaagaaataatcatgctcattgctgaaagtcacctccaaatcaacataaacatacaattactactctggggtgagaattttctttttttctataagcagagtatgaaatggctttagatgtcaagaaatagaatagcggaaatgaggtgattactcatttaagccaaatggaaaactgtgtctaattgtctaactgctccattgacttcaaatagtctgcagacagtcacagactcctgatacgtttaatgcactcccaaggagctaaacagaccttctgcagtattgaatttccatgggaattcaaaacatgattcttattgcttctgtgtttcttctcgtcatcctcagtgctaatttctttcaatcacacataaattttttggttcatagtttaccttggtttcttggaaactggcagagaaaacaaaagcttaggagtagtagtatcaaagtaaaattagaatatctcttttttagtttacatctaagcaaaacacactggcatcatttttggtctctcaaatcgaactgtgactattactagtactcggtatttattcaaccattcaaaaagattttctttcatagatgctgttcaacttcctaacagcactgaccttcttaccagtaaagaaaatattttaagaaataacttggatgggcgctgtcgctcacgcgtgtaatcccagcactttgggaggctgaggggggcagatcacgaggtcaggagatacagaccagcctggccaacatggtgacataccgcctctactaaaagtacaaaattagccaggcatgatggtgcacgcctgtagtcccagatacccaggaggctgaggcagaagactagccggaacccggaaggtggaagttgcagtgagccgagatcgtgccattgcattccagcctggcgacagagtgagactgtgtctcaaaaaaaaaaaaaaaaaaaattaaaaaaaaaagaaatacttatcttctttttctttaatgttcaaattagctgaagcaaaaattaaacagctatccagcagttaatacactaaacaaaaccaatttaaataatagttatcctggcagaattgttgaaaattctacattgttttgactggccctagagaaaaatctgattcaaaaataaccaaaaatattcaatgaaaatatataatattctaaattgaaattgcttaagttgtgtaacattttcttatcatgataaaataaaaatctagaacaaggaaatcataattattttcctttgaatatgatgttttatgtacattttatacatatatttagactgtaaaacaattagaataataaaataataaaactaagctcaatttttagattatgtatccactttgtcttttgttaaaacagtatttttttggtttcaaagaaaatcttttatataaaaattgaagaaaaaaatacttaggcaatattataaggcacttcctggatcaggttataccaaaacacacataccacaatgtatgtttctttgaaaataatatatgtttgaaaataatttatggaaattatatctctgttttcagtaaataatgacaaatgagttcataatttaataaaatgaagcaacacacttaaagacactaaaaatatttttgatagataatatcagacacagatatcagtacactggaatgattgactatttgtaacatatattactagtagcagcagtgagaggtagagagtagataaacataacagaaatatcaagattcttatgacttaaaatttaataagtcaaaaagaacaaatggaattttatttgtatagtcttagaggaaagttgatcgaccagaatgaaaactattcgtacagaaattaagaatgtaagaaaataaattgtgccgaatattgtaatttaagagcaagtatttatactaaaattgattaggacattagaatttctggatcaaatgtggactgtcatatattatcagtggacaccagtggaacaataaccatgtgaagattttggagactcctgtctcctccaatccagataacctaaaatataacaacagggagggatgttacttacaagacgtagtaaaactcacctgactaagaagtcctgcagttctgacaatgagtttgactaatggtaagagctgtgtgaataggtagtgacaagcagctctgcaaaaccattagtttttgtttgttatatttatcaaattgacaaacatttttccagcagcaagcatctccattcctttgtatttcttttacctacctagcaaaatcagtttataattccaaaggcagaaactatttcattcatatcctgagctcttagcacgctttggttttgtagtgatgcggtaagggcagataatgcatctgcaaaatgaatgagctgctctaggtagaacataaaacagttctttttacatgatctacactatttaattgggtcataatcattttctcttagttatattttatattaacttgtattaaatcaatttagcataaatgttaaattattatgtgtttaaatatcacccatcatttctgtaaaattgaaacaaagtagaaacaaattaagaaagcagttgcttttcttaggaatctttatactgaaaaattccttaacttgttccttcttcccttgctccctttcttttctccctttctttcatcttccttccttcctagcttcccttcctcctctcttccttccttctggacaaatatgtagtttacttgatcttgtttgtagaggttaggagaacaagacagaaatacaacactagtgctcatttagctttaatcattttggaagagatgtaagatacaaatatgaatattatgtaagataatttgagtgctatgattttccctgggtctataaagactcacacttcctgattttcctttgtttacctaaatctagtagctaatgagtttcacagaagacaaaattcctacatcaaaataaaatttccctttaaattacctcaactagaaaatccttgtagttctcatgcaacccaatattctgagcctgttcccccatttcaccaatcacctttacctccttcagtccccaggctcccaggacccttttaagaaagcctgtggcccttacttaaagaggaatggacaccgatacatatgtccagcagaaactggaagtgatgtattacatctatgtgcctgttaataattaaataaatactttaaaaaggtattgcaactgctaaaaatctaagaacgcagtttgaaattaaatactattaatatttactttgaagtcattgtttttcttcttataattcgtattatgtgggttaagctagcaattgacttttggagtattccagacatgagatcattatacctctggatttctataaaagttgttcaccactacaacctacttgtctgaagcctggaacaaggggataccttcactcaacaaaagaaaataccagtattccagagcctctttagacagaaaattctgaattgataccttgccatgaatttggttgagagaaatgctatggagaggatattatctttattacatagtacacatttactcttctatgtattatgagttctatctctgagttcatctggtggtcagaaatttgaccatttcactgtattaaccaattcttttacagactatcctttacattttggtatttatttcacggctttttaattttaatatatcttttattaaagcacatatacttacagaatactgcccatgagatgcatgtacgattagatgaaatttcatgttactgacatgaagaccaacaagaatattacagggttgcctcaaaataattttcgtcttcattttcttaatacagatctttagaacctatgaatttttgccttcatttttcaatggtatttttcctgggttcaggatttttggttatttccgcttagaaagaagtcaatccatcgtctttttactttcgtgatttctattgagaagttggctgtcaatcttatgcttgcccatttgaagaaattatgtcttccttttttcattaactttttcccttagtttacatattttcttttaacttctgtttttctctgttttctgtgtctaacctaatgttactataatctagagctattaatttcagatgtcttatttttcagccccagaattattatgtttccctttactgttcctaatgagcgcactctatattttcatctactttgtccatccattttaaaaatttttaatagtcattgtaaaatcctcatcagcgaatttcaatttctgtttgatgtgtagttctgtttttattttctattagttctctcctccttggctttcagcctatcatttagtgtagctagtaatttttgattatgtttcaacattgacatagtatataaaaattgtagagtccccataatattatcacgctctaggctaaccattggtaaactatagttcatgggccaaatctggctaacttgttttgtttttgtaaataaagatttattggaaaacagccacactttttcatttacatattgtctatggccactttcacaatacaatggcagacctgagaagctgcaggaagagacaatatggaccactgagccaaaaaccctctggcaataaaacagtttctgctcagctcaatctaatcagagacttgctatatcacagctgtgttgagtcctagcaagtgcattctatctacgttcttccctcgacttttagggtgtaaaataagatcacagtgggttttttagggcccttttccttaatgattttttctttttttttgtctcagaaaactgaaaaaaatgctctgttgtgttttccataggctgtcaacttaggtggttagtcttggaatcccagtattctgcacacgtcattaggaaaaaaattaaaaagcaaaatgaaaagtaaatttcacattcctgttatatatggtaacatttgataaaagttaactgcaggatgttagctgagagacagggagtggttggtggtggattagttctccttccttaccaaatagcaaaaaagaacattttataaaacttaactgcaggatgctagttgagtgatcgggagtgattggtagcagactagttctccttccttaccaactagaaaaaaaagaataaaacagaaaaaaacatctctaagaaagcaatgggagctgctgaagcaaaccctggatgtctgcaatccctgtagtatctgcaaaaaatatttgtcagttttgtttttctctcagttatcctcacttgacatgtaatctggatggtcagcctcttgtaatgaaccagaattaacaaattgcttcatagtaacattggcagttcagctcacttatacaaggttctccactctcagtagtcttaatgcctcaagttctctttgcctccacaacccccattgccttcttagcgacgtttttttaaaaattttattctttttttatagttggcaaggaaggaaagctagtctaccaccaatcactccatatcacatagctaataccctccaattaacgtttattggatgttactatgtataacagtcatgcgaaatttgctttttatattagttttcttttttccccatagacctgctttcaacctcaaaacattcattttcttctatatgttttgctttgtaagctacttcaaatcattcttgggaattggacagcaacaaagacatttaatcattaaaaggaagacattaaaaatgtctattcttgcatttagatggactttataataacaatttaaatagaaaatgaaattcttttcaacagcagtatatttatattcattctttcacaccttctttcaaaagcagtctgacaataaaatggaagtaagtgattctttataaacagagccctttaggaatgtcctttgatccagttaacacctatttattcccttaccattcagtgtacttacagtttttcctaaaatttgtaaatacttctcttttttccaccctaaatacaattgtcactttcttagccttagtcatgtaattttcatctggaacttatttacaaatgacctttccaaaaaaactgctattttgtaaccctgctccggttagggttagttggctcttatcattaaataagtttggttgttagcactatgtaaggttaaatatgaataattaattgtttgtcttaggcgctggctcttggtagagactcggcaatagctaggctttttcttatttgcaaggctcttatatcgcttggaacccgtagagtacgccaacaaacaccacaaggtggtgtggagaagcactgtttttaatgagcgcctggttacagaagggctgaggcctaaaatggcgtcagcaccagtgaggacagggcaggggttttatagtctcctgtaaacgggaagtgatgtaactgctacacagcacctggacagcctctctctcggtcttcagggggtatgtgtcttctggccagctcccgtccttcttctgttatcttgctgatgcacactactgacacaaatggtcttgcgccttgggactgggcctgagaagggaggagttattcattcccttaagctttcaggccccagggagaatctttcactattcttttgtcaaaggtattccaagttctaatgttgcccttcctaattttatttcatacatttttctaatgtttaattttaccaaatattgtttcataaaaatgtttggttaatataatgcagtatgaagagactcaaatttatcaagaaactaatatgacccaggtactgtgctagttttttacatacattttctttctatttaattccctgtgttgttactcatgtttaatacatgagaaaattaagctggaaaaaagttaaataaatctcctttggttagtccccaagtgatcattatcatactttaaaatttactgataattctttaatatacataaatactaatgtttattttccaaattgtcttgtaacagggatcctcatgcattgtatgcattatgattgatgatatctgttatcttttacttttatctattgctgcataaaaaatccttctaaacttcagtggcttaaaacagaaacatactgcttttctctcagacttcagtggattgactggactctgacgggtagttcttatttggaatttcttatgaggatgcagtcagatggtggttggactggagcagcggtgtgctagagtcagtttttgctagtgcaaaagacaactttgtgcatgtatttctagttttgcctccggtgatgtcacattgatagctagaaacagccagggtagtggtagttcaatgaagattgaaattgccatgaatcaaggctctatatccacagcccacctttggaaactggatctatcagcaaatcactggactgaaatcatttgaaggctaagtattgccaaattctctttctagaagtgtgtaattgcatatgccatccacgtacttaccaacaatgtacggaaatgtctgtctcctcatggcctgacagacatattatattaccaatcttttggatttttgtaaatctaagaggtaagaaattgcatttcagcacagtgtccacttgcattttttcttactatgagtcaggtagagcatctcttcatttacagtcttttgcattctttttctatcaattatctattgatacctgttattcatttttctgtaacgtttttattcttctaagtacagcatagaatattatatcttattatttataatacaatgatattattgtatcataaatacttttttttctggttggtaaggaagaagaactagtctaccaccaatcactccatgtcactggagcagtggtgtgctagagtcaacttttgctggtgcaagagacaactctgcatctatttctagttttgccttcaatgacgtcacgttgatagctagaaacaaccagcgtactgtcctttcacctcctttttaaaaattaaatgtttgcattgccacagatggatatgcttgctttgttcctgattggggaaggtattcagtctttcaccattaagtatgatgttaactgttaaacatttgtagatgcctttaatcaactttgaatagtttccctctattgctattttgctgaaactgtacatcgtcaatgtggatgtttgattttgtcaaatgctctttatacattaattgatgttgtgtctggaattggtgggttcttggtcttgctgacttcaagaatgaagccgcggacgctcgctgtgagtgttacagttcttaaagatggtgtattcggagtttgttccttctgatgttcagatgtgtccagagtttcttccttctggtggatttgtggtctgctggctccaggagtgaagctgcaaaacatcctggtgagtgttacagttcataaaggcggtgcatcctgggttgtttgttcctcccggtgggttcgtggtctcgctgatttcaggagcgaaagctgcagacctttgcagtgaatgctacagctcataaaggtggcatgcacccacagagtgagcagcagcaagatttattgcgaagagtgaaagaacaaacattacatatgattgaaagggaccccagtgggttgctgctgctggctagggttgtctgcttttattcccttatttggccccacccacatcctgctgattggtccattttacagagtgctgattggtccattttacagagtgctgattggtccgtgttgacagagtgctgattggtgcgtttataaacctttagctagacataaagtgctggttggtgtgtttacaatccttcagctagacagaaaagttctccaagtccccaccggactcagaagcccagccagcttcacatctcaatgtgatcgtatattttttcttctttagtctattgataatgaatttcattttgatgaacatgtgttaaatcatttcagaaactatgttgggtgtgttttccaaatgtcagtcttcattttctttataaacaagccactccttcaattatgttccttaaagaaagggtatgtgtaggtgaagaagaacctctcatgtttttgtgctgagtttcatgtcctattccacttctgcctgatgtaggctgaaaataatggaagacagtgtccttggaacatggctgctatctttgcaaggatgtgcacaaattgggaaagtgaattgacaggagaatgaatatgtggccttgtcactcacccaaatggaaaatgatttactgcaattgcattcactatataactgtttagaattgtctagctagaggataggagaatgtaaatagaagtacaatatatagtagatcaaatgtaaaattctatgttgaatatgccttcaccagagtccaagcaaaagagcttgaggaaactctgaaggttttatttcagtgtttcattttgttccatcgtcctgtgtttctcttatctctgctggaatatgtccattttccctccaccttaatttaaatctacatgtaaatttctgaaaactcctctctttaggattagttgttgctccatgatctgtcattgctactgattagttcctttccataaatctgaactgctcactcactctcaaatgatgactggggtaagctagcagggaaatataaactaacatttacagacttagtccagatgaggtggtaaaaggagaagaaatctggtttgattcaaggtctgaatactgcctgagttacatagaaacatgcttttactttcaattgtttatggataactttgattactcagacacaaacacaaggacaagtgttgattacatgtgacacgatactctgagaaaaaagaagagaaaagcacaacttccaaagcatgtttcttgtaatggaatagacaattttaatacaaaatattcttttggtcttttttttttgttcatttacagccctagtttctttgcttgagcctctcagtaataaagaaaaagtgatagttttttaaatcccttttttatctaatcaaaaattttataatctctctgtaccacttaaagacatgctttttcacttttatatatatatttatttcgatcaaaatgcatacattaaaagaataaaattaagccaa

SEQ ID NO: 465 - DNA, 50240 bp, Homo sapiens
ctctgcagatttccacagctctttccctcttcagctttctcagggactctgttttgagaacttgagtggccttgccttccctggacccacaagtctctctgttcaacaaaccactaggctttatctgtttccctcccgctgtgccgttgtcgcctggaacatctccccaggcaggaaagcaaagcgctcatcaggcttacacttcctttctcaaaggcatccctgtgcctcgctgcctgattgtgcaatgtcttgaaaacctgtgtttcatagaatttgtgtgtttccttagttgcttcatgtggaagagttaatctggtccctgatactccatcccgagtggcatcaaaagtcccttgtttctcaacaacaccacacctttaagtcctagcccacctgggaccaccagggatttctgaaggctgccctccagaaggcaccaatctgtgatcagaaacttttaggaaccactgtgtcttccaggcaacatttatataaacatataattttagaagctcaatgacattttattttttctaactgcaccctggatggatgtcctcaaatctgcaatgatttggaaaaggaaaattttatacaggctgttcatgttataagctgaacctaagacttattttttagaatatagtcattattgttcattgtcatgtcacatttgttgacaatgcctgtcaggtaaacacgtttccatcttacatagctatatatgaatatatgtggattcactgagtatactcaacttcccattaacttgggataagtaaactatagtgagaatagaaaaagatattttggaaaaaaattagtaggagtaaaaaaaaaatacttacatattggaacgtatctatcgtttggcactgcatagtagtagacagaccacatgctcctctccaagcaactagagatacaacttctccaaaaagaccttgatttctcagccaacagcccatctagaaaacaaaacaggggattacagtctagacattgtgggccaggcacagtggctcatgcctgtaatcccagcactctgggagaccaaggtgggaggatcacttgaggccaagagtttgaggccagcctaggcaacatagtgatccccatctctacaaaaatgataatttaaaaaattagccaggcatggtgatgcacacctgtagccacagctattcaggaggctaaggcaggaggatcacttgagcccaggaagtcaaggttatagtgagctatgattgtgccaccgcactccagcctgggtgacaaagcatgaccctgtcttaagaaacaataagaataaaaataaaaagatatagtcatcagagatcccattccacactcagcaatggggaccatggaggatggaggtagataaggaagaggggttggggagaaggaggattcaggccatggagagtgcttggtcttatcctgaatttcaaaacaatgggctcaactaagaactagcagtttggctgtttttcattttggttttgttctcaaactattttacagtacttatacattcggatgatggttagaagaataaatgtgtttctgaatattgtatgtaattttagctagacaaagaaagccttggggttatatcattcaaggatataacagcctagtctcttacacgtgggcatctgttgctgctcactttcaagattccactgtgtttgtgacttaattctactattttgctgccaccaactgatggattccctccatggatctttaaccaaattccccaagagatgagatctgatcagctggctagtcaacatccattagcaagtgtgcttgttgggccagccagtgagacggctaccttagactcaggtgccaacctgtgacatagggcagcaaggtcatgtgggataaagcaagatcatccatccaggccaccaaaagaggctgtgagtgtggcaggtgctcggtatcccacatccagtacaaaagtggaagattttacttaacattttcaacagtacacacgagtccctgagctaatctttttaggagataaagatatgggaaagacttgatttctgtcatgtcattgaggaatggtgatagatgctgtacagctaggagacaagccagagaatgaacggcagggtggaagaatggcagagcaagcagatgtggaatgttagttcccacctgagttaaacatgcaggtcaattgcttaactcagggcctgttacacagtgagtgcgcagtaagtgatagttgttactatggagacagaagataaacccccatcccagagcctcccaggcatattcttgagtcccacccagttatgctgaatcaagaagcgttggcaaatggcacagccagtctgtagtgattcaaatgcttttgtaaagttagggagagcaaggcaggggaaaggtccagaggggctgctgtcattccaaacagttcttaactattccccgaaggctgccctgagcagccttgggaagcgcaacgtgggactcctcctctcttcctgggaacaagaacttggggaagctttgagtggtttcacatctccagtgccctcagtcctttggtgtgtcagcaaaaccagctggcaccatactttaacagggcccgattcacatggcagtcttgggatttgtggattcagatgaactcttgctggcttctttctggcaccttcaacttcttcaaagccataaaccacagtggttgcttgagctttttcctgaacagcaaatggctttgttttctttgtccccagcccctatagagctggccttgtgattactgtgagcagcaggggggctcatgttgaggcccccgcccactgctttgcaggcagggtgaccctctgttcttagacattgtgattccccccagatacgtgtgagtcaagttgaatgaatagcaaggaatatttcatgcagcacaccagacactgctcctaaagttcatttgggtctcaacgtccaattggccagttaatcttttcactgcaaaaaagatcaccatgacttttgaaaaatcacctttgaaatatatccaggcaggttctcagcctttaaggagcacagaagccagcccaccagcccaccaggcccaccagcaatgctgcttagagccctgatggaggcaggagctagacagaggtggccgtcctcaggaattgcttcctactggccaggagagttcacttcaaaggatgtgaatatgaattgtatccttgtgactaaatttggtttaacttctaacttgcaaaccatggctgattgtttattttgttaatggaggaggggtgctgttttcagccactgcagaggctggtcagggaaggggcttgtggctgagcatcatactccttatctgagggaaggcatctgatcctccttcacggcccctctccttcccaggggccccacattgccactccactttattcctaattcttggcttgagccccttctctgagagagaaaggaacatggccagggaactagcattcccaccaaatcttcaaagccagtggaggccacagaagagctggtggggaggggtggcagggaaacttgatttctaaaacagggttgctaaatactccagacttggctgcttagaaaatgcattgacctcaaaaggacaggacaccctcccctgccaggggaacttgggatttgttgctgctctggctgacttctgtgcccacctgaacacacagagcttagggctccctgtgttagagtcaccacgtaatttgttcatctctctgtcatccaagatgaaagttatttactaatgactcccttttcgtcccttttaattcaccggaggggcccttctaacctctcaattcaggccagtaggtttcctgagcttggtaaggatgagaaaggaggaagcagtctttttcagtgcatgttctgaaggctagagacttgcatggaggcccgtagacacaagagacatgtaaaaccagcctcaggtgcatcattcttttcaagacttagaacataacaggcttagaggaatatgcccagaagaacgtggctactctctcccacagccactttgcatagggctaagcaaaggaaataaaactaatactaccacatggctggcactctgtgtttaccccatgctaggtaccacactaagtgcttcccgtgtagcatctcatttaaatcttcaaaataacaccatgatgtaggcatcatcattgtcatcagcattacttagatgaaaaactgaggctcagagaaggtgcatgacctgcccaagggtgtgccatcactaactggttaaggcaggatttgaacccagaaagtctgccttaaccactccatggtccccagttacaatctgttgaatggatgaattacagtcttttgcttccttaccctaatctctatttggcatataatatataagccccacttatggctactaaacacctaccccatgggctgcttctgcaggaagccccttccctgttctgggcacggcctctgttcccccagagccctgcaaccaattctacactgtaatctagggctgcagagaagtgagctgcagacacttttgttccttaggtaaattccatttccttttctattgtctcaggcttcttagtgatgtaacattacaccaagcatatcctgcttttaaaaagaaacttcgatggaggttggcaaattaccattcacagcttggtgaatgataaagtcacaagagaagagtggaagcaatgcacctggtgtccgtaattataggcttgaatgagggaggaaagaagggatgaaggcaggccaaatacagctgggtgtgggagactggctcagaggggatttgagaggactaggaaacggaaggatgttatagagcaagtacttttaatctccctctatcccaccccagtcttgcactcccaccttctgctccttaccttggttttctttttttgatctgtgtttttcctgatctcaaagatctctttgtccatcttcccataacagcaccagatgaactgtgatgatcaaaataaaagctcttgaggcatcctcaagtcaatctgtgttttgcttcttcagttgggtcctctgatctgtattatgtctgaaaacataccagaacactccaagaatttactccagagacaataactgagggcactagaaaacagaagtcatgatgtccactatcccttaaactagacttcttcagttactccttttaattttgaagtgaaattagtatattttgtacttggaaaataatctgatctctcaggactgcactgtggctatttaaattataattaaaatgaatgaacatcagataaaattagaagtttaggccgggcacggtggctcatgcctgtaatcccagcactttgggaggccaaggcggacagatcacgaggtcaggaaatcgagatcatcctggctaacaaggtgaaaccctgtctctactaaaaatacaaaaattagccagttgtggtggcgggcgcctgtagccccagctacttgggaggctgatgcaggagaatggcgtgaacctgggaggcagagcttgcagtgagccgagattgtgctactgcactccagcctgggcaacagagcgagactctgtctcaaaaaaaataaagtttaattcctcagttgcactacttgtacttcaggtgctcagtagccacatgtggcttgcagctctcatactgaacagtgcagatatagacatggtatggtttggatctgtgtcctagcccaaatctcatgttgatcccttgtaatccccagtgttggaggtgggacctggtgggaggtgattggatctcggagcagatttccctcttggtgctaatttccctcttgcttctcctgacaatgagtaagttctcatgagatctggttgtttaaaactgtgtagcacctccctggcccccctacttgtctggccatgttaagacgtgcctgcttcccctccactttctgccatgattgtaagcttcctgaggcttcccagaagcagaagctgctatgcttcctgtagagcctgcaggagcatgagccaattaaacctcttatctttataaattacccagtctcaggtatttctttatagtgatgcaagaacagactaatgcagaaaattggtactgagagtggggtactgctataaagatacccaaaaatgcagaagggattttggaactggggagtgggcagagattggaagagtgtggagggctcagaagaagacaggaagatgatgaaaagtttggaaattcctagagacttgttgaattgttatgactgaaatgctggtagtgatatggacaatgaagcccaggctgaggaggcttcagatgcagatgaagaacttattgggaactacagtaaagatcacttttgttatgcattagcaaagaacttggaggcattgtgcccctggcctaaggatctgtggaactttggacttgtgagtcgtgatttagggtacctggctaaagaaatgtctaaccagcaaagcattcaagatgtagccttgctgcttttaacagcctatgctgtcatatgtgtgaggaaataaatgacctaaaactggaacttatatttaaagatgaaacagagcctaaaagtttaaaaaaaaaatttgcagcccagccatgtggtagaaaagaaaagcccattttcaggggaagaattcaagcaggctgcagaaatttgtgtaagtaatgaggatccaagtgatgatagccaagactatgggggaaaggccttgaaggcatttcaaataacttctcaacagcctctcccatcacaagccctggccacaaccaggactctgctgctctgcacagcctcagtacactgctccctgcatcccagccacttcagctgtagccatggctaaaaggggcccaggtacagctcaggccactgcttcagagggtgcaagccataagccttggtggcttccacatggtgttaaccctgcaggtgcacagaatgcaagagttgaggcttgagagcctccacctagatttcagaggatgtatgggaaagccttgatgtccagatagaagcctgctgcaggggtggagtcctcatggagaacctcaactagggcagtgtggaggggaaatgtggggttcatgcccccacacagagtctccactgagggcactgcctagtggaactttgagaagagggccaccctcctccagaccccacaatgatagagccactgacaacttgcaccctcagcctaaaaagtctctggcagtcaacaccagcctgtgagagcagccatgggggctgaaccctgcaaagcccaaagctttgggagcccaccccctgtaccagtgtgtcctggatatgggacatggagtcaaaggagattattttgttgctttaaggtttaatgactgccctgctgggttttatacttgcatggggccttgttttggccaatttctccctttttgaatgggagtatttacccaatacctataccccattgtattctggaagtaactaacttgtttttgattttataggctcataggcagaagggctagccttgtcttaggtgagactttggactttggaaattttagttaatgctagaatgagttaagactttggggactgtcgggaagggatgattgtattttgcaatgtgagaatgacatgagatttgggaggggctggggcagaatgatatcatttggatcggtgtccctgcccaaatctcatgttgaattgtaatcctcagtgttggaggtagggcctggtgggaggtgattggattatgggggcagatttcccccttggtgctgttcttctgatagtgagtgaattctcattagatctgatcacttaaaagtgtatagcagctccccttccacttctccagccatgtaagacgtgcccacttcccctttgctttctgccatgattgtaagtttcccaaggtctcccagaagcagaagccactatgtttcctatacagcctgcagaaccatgagccaattaaacctcttttctttataaatcacccagtctcaggtatttctttagagcaatgcgggaacagactaatacaaaacatttccattatagctgaaagttctactggacagtgctgtctcagacaccagtattatagtcttaatgctgatgacacttcattggggcagaacttctaagggatatttaaaacacacagttaacagtaagatagatataaaccctccaagcagctcactcaacactttttggaaaccacttagtgaatgatcctgtcttctatttccttctctctaaggtaatctaagttctgagggtgaaatacgggctccaagaattgccctggcattaagggtttagcttctgggacatgtgacatcctctgttcttgtaggcatttggatgctggttctatctctgctgatgtccttgggccagctgggatctctgacatgtatggtctagcctatttgttgatggcattgacatgtcatataactaagagacttcattcagtctgctggcccttttagtcacctttggcactttgcagggaacaaaaaaagcttctggatactcctgcagactactctgtattgaagtttcagactactctgcattgaggtctcagacccttctgtctggttgcctccaagctaaagttccctcactctctaattcccttcaaattaatctgtggtttctatttcccactccctctctttgacttagctcagtatggtggtctctgcacccattctctagagcccagaaaactctaagctctagtcacccattcttacatttctctctatctgctgcaggtcaaatgcttatttcctttagggagacaaaacatctcccttctcttcttgtgttcttcatccctatgcagaggtcacaaattctgaaaagtgccaaacagcaaatattttaggctttgcaggctatatggtctctgttgcaactactcagcccactgttctaagtgcaaaagtaactatagacaatgggtaaccaaatggatatggctgtgcttcagtaaaacttaattacaaaaaaactttacctccaaagattgtagtttgctgacctctggtttatattaatagtataaagttgggatccaggttctctttgcccttagtatttagaaacaagttttcagaatttaaaaaaaagctcctgtctgtgaaaatcagcttaatctactatagatttttaaagtctactgttgaactcaaacaccaagaattttcttctttcttctaggcatattagtggtgccctaaagagagggcacgtagaaactctccatggatgtttgaatggtagcagaaaggatacaaataaaagaattagaaaatagttaaaatcatagtatttctcaactacattcttatcaaactgtgattgtgaaaattaatgaaaatcagtattttggaaactgtgcctcacacattgtcaggcacacaacgaacgttcaataaatgcccactctttcattcctgtacctctaggatcaacactgatgtcattcaagcaacagctagaagaccaactctgtctccgacttattgagttgaaatgcatttatttttccactgttatgaaaaaatgcagattttccccgaagaagcatttttttaattcatcgctttttcttaaagccacgtgacagaaagccagggcccagatcctaaggagagggaccatcatgggtcagtttttaaaatgggagaaaagtgtcccctgtaaaaaagtactacttgtccactttagaggagagaatactaaatatgaagtgggaggggctaaaataaaattacacccacttcctctgtacgactttcttggttacaagtgatagaaatttaattcaaactaggttaggtaaagggggaatttattagtttggagtatctaaggctgaacaactaaattgtggctggtcaggaatgtggctgggcctcagaaacaactggagccgggcatctgaatgctctccctactctccctgtccttcctttctgcagcactgtccagatcagcttcttccacatgggagggaaaatggctgctgacggctcccaagcctcaatcccttcacccttgccactggtaagacagattccttttttcacttccagtttttaaaattccagggaagggctctgactggctctgctgtagtcatgtgtatacccagccaatgggagccaggctgaggggtggggtcatggctgttactgccgtagccccttggacaggaggcggcaggcacagacatcaatcactgagtgtccttcgcctcagcatttcccctgaggttggttctgcacaccttcatctttgtctcagcacaggccctgggcggcaatgcctttttgtgttttttatgtataaagctatttgttacagtgttgactcaaagctgatacatttctgttctcaggcaaactgcggtttaggttgctgccttggcagtcctggctgtcctcacggaagagcatgtgaaccacggacctggctgtctttttcattgggttggctctgcggtgcaggctggcagatgagcatgtgatgagcccgcccttgctggccgtgcaattcggctcctgtcatgctcttggccattgaatcggcctaatgcagcccctcagcagccagcctggtgttccctggggctgaggatctaatgtcagcagggcatgattcgattcacattaaagatggatattaagtctttttactcggggtcttgtcaagaaaaacaaatctgcctgctatcaaaggcatagaaaatgccccttaccatgacagcagttaactatgttcactgatatcaaagagactgtctgtccccaagccttggaggcagttttgtcaaggtcaattcggctgatctttttcaacgataacccaaagaggattaagttaacatctgacctttaaagagctttattgttggggaaccaagctaattaaaaaattaaaagactgcttttgaaaaatatttagaccaaacactaaggaaaacatgaacacactgcttatagcagcaggaatattgacagaaaatccccaatggcaaactagctttgttatcacactgttgagcttaatgtggggactctggaatcaaacgaatgggttccaatcctggctctgccactttctagtttctagaaagtgtttctagaaacactagtttctagtttagtttcaaagtagggcaagtgtcttgccttctctgagctctgttgtcttatttgtaaaatcgggataataatagtaattatctataagattattgcaaggattaaatgagatagtacatgtaaagccttttcatttaggctaactataaatattactgtggacattttcaagtttaaacatttttaaattttgctttaccgacttgtgccatcatgttgacagctgaatggaatctcttgacaaagtggctggttctcactatctccagaattcagagaaacatctaggttctgagctggctcagctttggaccaaatgttactagcatagatatagcagctcttacaccccagctgccactgcacttgatcatctgccccattacacatatgacaactctgtttactactaaagctatcttgaagaaatggaattgtgagaatagggatggtaatgttgtccagaaaaagttctctcttttaagttctcctataaatactttccaattcaaggagatactgttcattgttaaatgttttcatccaaagcagtgttcctcaccctggcttccggtttgctttttctttttcttttcttttctctcttttcttttcttctgtctcttttcttttctgtcctttctttcttttttcttttcttttcctttctttctttcttttattctttctttccttctttctttcttttttctttcttcctgccttcctgcctgccttctttccttccttcctttccttcttttcttttcttttttgacagcatctaactctgttacccaggctggagcgcagtggtgcatagctcactgcagctgcagtctcaaactgctgggctcaagtgatcctcctggctcagcctcccaagtagctgggactacaggtgcacaccaccacacctggctaatttaaacttttttttttttttttttttaaagacatgaggtcttgctatgattcccaggctggtctcaaatgcctgtcctcaagaatcctcccactttggcctcccaaagtgctgagattataagcatgagccactgcacccgcacttggcttggttttcttttcattggcttatgtggtggttggagttatctcttttgcatgttgacaggtgtcataaagccataggagactttgagatggcctgaaaataagatcatggatttttcctggcagagagtttagtttactttcaaaccccgctagcctttgctactcaaagcctggttcataaaaccagggctttgacttcacttagatgcttcttagaattgcagaatctcttgccccacagtcttgctctctcaggctggagtacagtagcacaatctcagctcactgcaacttccacctcctgaattcaggtgattctggtgtctcagcctcccaagtagctgggattataggcatgcaccatcatacccagctactttttgtatttttagtagagacaggtttttgccatgttgtccaggctgatctcagactcctggcctcaagtgatctgcccatcttggcctcccagaatgcttggattacaggtgtgagccactgcaccggccacaatctgcattttaacaaacttcccaggtggtgccaatgacattaaagttgcagcagcactgctcaggagctgtgcattggaatcacctggagtacttgaaaaactattgatgctcaggtcccaaccacaaagactcccccaacttaactggcattggggttttaaaaaatttctccaggtcattgtaactaatgcacaaggtgagaacttgtgctcaagagacattctttcttcttcctccacttatttctacaattgcttttctcttaaagtaaaaatctcaagctacagtcaaagttcatttcatgtccattttatagataatgccacacaatgtgaagattcattctgaatttaaaaaataacctttacaaatatcttctgaacctttgccaaggtccccacatccctcttttattgtgaggtccagaactagacacagtcctccagtacagccctcaacatcactgaacagcagcacaagggatgtttgtattcttctgaatgaaaggtactgttataaagaaagtcagaacattcgaagggggtgggggcggctttgatggccaagcaaaagatttcctcatgcctacactcagtctgggagtgaatgagccagttacataaggagaaaatcctccttcctagtgttgagctttcctaattggaggactaaatgtgtcattatttaactaaataattaataagctttcttgtaattcatggatgactaaacagataaactcacctgtaccaaactttcagagagagttccactgatttaataaatttggttcatgtcatcagcataaaagtcatctgaaccttgagcctcaaagaccagtgacctccaaacttgacaactcaacttataagaatcaactcggctgcttactaaacatatatagatgtctgagcaaaggtatttgtggtttttaaaaaactacatcaattcttctcaaactttaatgggggtggtgatgtggtgagggcaggtcttgtaaaaaatttagactcccatcaacaggtctgagtagggcctgagattctgcattcctaacgatctcaaaagtgataccgtgccgctacttcatggaccacacttttagtggcaaggccctagacaattttgataatcagccagtttgggaaccagaacttgaggcatcataaatgttacctgaaatatgaaaaagctaatctccgcctcaatgtttatcagcagctcagggtgcatcagtgagtgttacacagacggatacaaaatgtgggtgggcaaatttaatttcaaacggtggaagaaaccttattgagaatgtttaattatgttcatgctccgctaatacgagaatagagtggactcttaagttcctttatttctctagtgatctattctttagagttcaccagcaaacacaaaggcgggaggaaccgttactttaaattcatattattttagctgatgtatctggagcacagtgataaattaatcatgacgtctggtctgattcacaatcatgttctagcctaatttacactttgcatttgcagaactgaaatgcgatgcattaaaatggtcacacaccacggatttttctcctcgctgcacccatggagggaggcgctgtctccgccttttcctgtaagcacctgcccggggcccaagcccacagtggatggctcgtccagctcagagagcgcccaggacgcagtgaggaagcagaattgggcgctcaagactcagacccggactgatgagctaagactgcttgcaagagggagtgggagtcgttaaaaaaatatcctcgtggcttaatgaccaaggcgggtttattctcaaggaagggggagcggcgtggtggtgttactaaacataacagatggcagctgtctgcggctatatagggcgcgctgacaaatccctctggatggccacgcggcgctgggctgcggggcctgggtgcacttcgcgcctggctcggagggcgccgcctgcgggaggacctccgggagccgagctgcctccccgcaaacccggcccgggcccacgcgggctcagggcgccaggcggggtgcgccgaggtgcagctccccggccctaggcttcgctggggtgggggtcgaggcctctccgcgggtggctccctccaccctgccgccccgcctcgcggctgggagttgcccgggagctgtgaattcactagaccagcattcacccagggcctgcgggggctgtgaaaggatgggaggactcggctccccaacccacctttacaaagccgaagtgtggctggtgaggtacccgacacgcacacactgcaccgtgatactgaaccatgcctgagtgtgcattttgtgcgaaatgggtcttagccatgatttccatgtggtgaacatcttttccaaaccccggattgaaacacgattatcaggtcaataacattttttctatgatttggagattgattcagatgggcaaaatcttacaaagttaataatcttataaaaatcttacataataatcttaagtcgcttttagagagacatttaaaaaatatgtctattgaaaataataaaattcagtgaaattggacaggactgtggcagttggggaagcttcctggaagatcgggcagaaagagagcttgccagtttgggcttgggatgggcaaaaacagaggggattgagagttctggggactcaataacgtacatcactgtgattttcaagcggcaaatttctttagaaaggtaaggccagacagactaatgggaactgtccaaggagagggaacagaggaaccctctgcacttttggggctatggtctctgaaatcggctgcaaggaccaccacctaggggtcgtgtggtgcatgtcatgtgcttggctttctgcagcagtgttggagagttccatgggaaaagcctcctctccccacccctcatcatctcctcgacccctttctcaacaaatgtcagggactaaggcttccttattttctcctcaatcaccttgcagtgcttttcactgaaggtgagaaaggttgaggttcattcattcatttaacaaatgtttaagagccttctatgtgctaagcccaggtgcttggaacctgaacaaaacaggtaagaatccctgcctgcgtggagtttgcaagaagcaagctacatggataaaatctgtggacagtgtcagcctgacaatgggctgcctttgtttcctgtaaatagaattattccttttgacttaacaagaattctgacacactgagggtcctccatacatgtgaagctatcattgtgattattcagtaattgccaagaaaaaggcatacctgatggaggaacccttatgtttgaaagaatagaataaagttttaattccttttttatgcatttatctggtggagggtgctttggccacatgcgaacctttccccagtaacgtgggtttgtgtaaagtaggagtttgactgtgaggcattaagaaacatggacttcctgtctccatttctgggaacccttaggtcacatggaaaatgcagggcctctggtactcaacttccctgggaccatgttctgttaaccctaccaccttttaaattctccctcaccctcatcatgtcctcacttccctccttacacagcttcaattctgtggccaggttttggaatgattcccttatctctgccacaggatccaagagctatgtttcaatgatttccaaagcctgaaagtcattgtatatccaccttagataagccagaagaaactaacctacctttcaaatttatttgcttttggctacagcaatagtaatttattatggtacagtgggtaagtattttaccaattgcttattaaggctggagtgcaatgtcgtgattactgcaaactccacctcctgggctcaagcaattctcctgcctcagtctcctgagtagctgggattacaggcctctgctaccacgcctggctaatttttgtatttttagtagagacagcgtttcaccatgttggccaggctggtctggaactcctgacctcaagtgatctgccccctctcaggctcccaaagtgctgggattacaggtgtgagccaccacacccaactacattaaggagtatttggaagttcatacaagaatgccacataaggccacaatgaatagtaggtgtagttgactgttctgtctctcacatagacatacaagctcacaaattgacactcgtgcttaagtcaatgaactctattataaactcatgtgcactcattttacaaacatggatttttgcattctcttttaagccatctgttgcctatgtaggatcctggtttttaaaaatctctcatatcatttttacagtgtacagttatggttgtgtttacacttactcaagatgatttagggtagtaagcatatggatgaactttaaaacttttaaattgttatgcatatattttaaaacatatttgaaaaaatatgtagtttatcagactatcatttcacagaaagtaggatgcaagcaagtttttaaaaatgggttaataaaaacatgaagtcacattgtactgagatacaacaaaaataacacaaggaataacaataataaataataaaattaataataaaaattaaaaatatcctaagtggtaagggatgaccacaatttaagttgcagattcatctatgattcagggggaccaaaaaagtccactgcggttggccctagagaaaggctccttcacgaagtatgctccagtctgcctttgcccaacgttccattagcgctcactagcagacatatcaaaacaggtaccaatgacttaaaaaattatttttctacaactcaggaaaattctaccaaacaattttatcagcgggacaccctctgtccactctctggacatctgtgtctaatgtgatcatggctttagatcttcagagcttacaagcattagaaacatgccagaaatctactcacagcaaaactgtttttttagaaaatcacacagaattgaaaacccggtttaaaaagctccatacaaatcatgagctatttatcactttcctttaatacactaccattttactccaagagccccatttaacagaacttcaaaactgaaagtggatttatttacattttttatgaagaaacaatggtatatactcttaatcacccagtgtttctccacggggttgctaatggcattggcagaatgtttagcatcgctggttcttgggtgctaaatgccagtggcaccctcctccaagtctttgtgacaaccaacgttgctccctgacatgcacgtgcgcgcgctagcgcacacacacacacacacactctctctctctctctctctctctctacctgccctcagtggggcagtactgccctcgcttgagaacccaaactgccttatgctgaaaagaaacctgagacccagggaagagaagggcagtagggatttgcccaagacctacaccaaactggtattgtgttcggctttcaggctgcaaagaagaaagcgttcagaccatctcagatgtggggggattatagaaagtttacacggtgcaggctggcgggtgtgtggtgaggagacccagaaaaccatttcagggatctcccagccaggcctaatggagaagaagaagactttttctcactgttgcaagttcaacagcagatgtgaggtctcaggggctgctctggggacttggccgctttgtcacccgtgccggaagctcacaggccccggagatcccgccttctgactgcatcgccctctgccttattttttctgctttgcttcccctcaaactgtttccttactgcctctgtccctactcctttctttctggttgttttacgttcacagtttcctcaagaaaatacaaacagaatcattaaatatcaccaatacacagaatccctttggaacggagttttttttgccaggctacccgagaagccgctggtaccatccaaggctgctttgggctagagccaacagcttattttctccagcagggggcagcatcgctcgttggcatcttgaggttcactactcaaggtgggctttgaagtcagattgcctgggtttgaaagccagctccataagcccctgtgtaacttcagctgcctgtgcctccgtttctcatttgtaaattgacacattaataataaaatgacttcaaaagatttgtgtttatgtgtgctggcaggggaaggaagtttaaatgagaaggcattaaaaataactcaaaatacaatgacaatcttcatacaagtagaaaaaacaaattattttgtcgttcttaaaatttatgtagaaccactgtactggcataacaacagacacatagatcaatggaacagaatagagaactcagataccacccatgcatttacagacagctcatttcagaattaccatatgattgagcaattccactagtgggtatgtatccaaaagaaaaaaaaaattaaggcctggtgcagtggctcacacctgtaatcccagcaatttgggaggccgaggtgggcagatcacttgagcccaggagttcacgaccaggctgggcaacatagtgaaaccccatctctacaaaaaaaatacaaaaattagtcaggtgtagtggcgtccatctgtagttccagctactcgggaggctgaggtgagagactcgcttgagcccaggaggtgaggctgcagtgagctgagatcatgccactgcactccagcctgggtgacagggtgagactctgtcttaaaaaaataaaaaaagaaaaagaaagaaagaaagagagagagagaaagaaagaaaaagaaagaaagaaagagagacggaaaaagaaagagagagagaaagaaagaaaaaaaaaagatagatcagtatatcaaagaaatatctgcactcccacctttagacaaaggtgccgagaacatacaatgaggaaagaacaatctcttcaataaatggtgctgggaaaactggataaccacatgcagaagaatgaaaccagatccctatctctcaccatatacaaaaatgaaagcaaaatggatcaaagccttaaatctaaaacctgaaactatgaaacgactagtaaaaaacgttggggaaatgctccaggacgtcggtctgggtgaagacttttttgtataagacttcaaaggcagaaaagaaaaaaaaatagacaaatgggattacatcaggctaaaaaacttctgcacagcaaaagaaactatcaacacagagacaaccaacagaatgggagaaaatatttgcaaactatccatctgataaggaattagtaaccagaatatataaagagctcaaacaactcaataggaaaaaaaccccaataattctatttaaaaatgagcaaaagatttgaatagacatttctcaaaagaagatatataaatggccaaaaggtatatgaaaaagtgttcaacctcactaatcaggaaaatgcaaatcaacaccacaatgagatgtctcacacagaatggctatcacgaaaaaaatatcagggaataatagatgctggcaaggatgtagttaaaagggaatactcatacattgttagttcaaatgaaaattagtacagccactatggaaaacagcatggaggttcctgaaaaaactaaaaatagaactaccatatgatttagcaattccaatagtgggtctacatccaaaataaaggaaataaatatatcaaagagatatctgcactaccatgtttactgcagcactactcacaatagccaagatatgaaatcaacctaagtatccatcagtggatgaatggataaagaaaatgtggtttatgcacacagtagaatagtactcagccataaagaagaatgcaatcctgtcatttgcagcaacatggacggaactggagaccattatgttaagcaaaataagccaagcacagaaacacaaatactgcatgcccttactcatatgtgaagctaaaaaagtgggtctcatgaagataaacagattggggtcaggcatgcagtggctcatgcctgtaatcccagcacttgggaggccaaggcaggcagatcacctgaggtcaggagttcgagaccagcctggccaatgtggtgaaaccccgtctctactaaaaatacaaaaattagccaggtgtggtggcgtgcacctgtagtcccaggtacttgggaggctgaggcaggagaattgcttgtacccgggaaggcagaggttacagtgaaccaaaatcatgccactgcattccagcatgggcaacagagagagactccaactcagaaaaaaaaaaaaagagtagattggtggttaccagatgccaggacagtgagagtggaagaggagttgaagagaggttgattaatgggtagaaatatacacttggatagaagaaataagacctagtgtttgatagatcagtaggttgaccacagttaacattaattgattgtacatttcaaaatagctagaagagaataattcaaatgcttctagcataaagaaaagatcaatatttaaaatgatggatatcccaattaccctgacttgattatatgaatcaaattatcacatgtaccctcaaaatacatacatctaatatgtatcaataaaaacaattattttttaaaagtacttagcatttagtatttgatgaacattagctgttgtttttgttgctgctattgttattattaaagagaaagtggttgttgttaatactgttattaagtagaacgtttagagcttctatttcctgactaccctcacccccactctgagtgcttttcagacttttccattcaagttcctctgctggctgaaggcagtaaagatgcagactccagaaggatcaaggggaggggaggttccaggtgtccttgtgcaatcctgaaatttctttgaaaccacttgctttcctctgttttatattatgtcacaaatcatttatacactatagattagatgtgctttttaatatgctattccttaatatagtcatgtctccttccatgtaaaatgctttaaattatatagcaggtcaaatgtttaaattttgtccaaaaaaatctttaaggaaaattggtatccagggagagtcaccatatttctctccaagcgcatacctggaggtcataacccattccaggtcaccacaattctcatgccttcatggttggaggttttcttccaggaacatcaaatagaaagacatagagtcagtcattaaattgtcaaatatttattaaactttattttggggaagacatatagtaaacagtacagaggattcaaccacacaccacctttgtgctccaagagtttatcatatttaagcatactagtgatgtcttctgtatgtaacccacatttctcagctttccccagttggtgaggaggtgatcaattttcttgggcgctcccaccacatttcctgcaatttggttttgattatagctgtatacttccaaacccaagttggacaaggataaaatctttttcacaggaggatccccagcccttatgtaaatcagtgaatacaaacaacttggctacctcttccagttctatgcatgtaccatactgtctcatctctgagccttgccatgttgtctcctctgcctgtcttatctcttccctctcccttcctcaggccatttactgagtaattcttattgttccttcaggtctccctgctgccccccagttatgaactgggtgctcctcgtctgttctcacagaaacctctcaactgtcccttctcactgttatactttgttgcgcttacttgtttgatggtctctctcccctggaagatttcatcccataagcgtggaaactataactgtgaaaagccagcacttgcctaatgtccaacagaaacttcactgccatttgttgaatgaatggtggatgtggcttagctccactttccagaaatcttccgtgtcatagaggaaagaaatagctgtgtgagcaggacatcttcttctaatctaagtcatgttcatgtgagcaaaatggccaaattgtggtacagccaatctgggaagctttggaccatcttagcaaacaattcaattcctcttccaaccaatatcagtgaaagagagactggttgataatgcagtcttactcttcaaaacagaaggtctgtgatttacttagtcatggtgtgataacgctgcctttgataactaatgcttgacctaggaggatttgaacttaggaagcccttagtttgcaacatatatatatagagattataaatcattctattatatatatataaatatatatatatagcaacatatatctatctatctatctatctatctatctatctatctatctatctatctgtctatcctctaagttctggggtacatgtgcagaatgtgcaggtttgttacataggtatacacgtgccatggtggtttgctgcacccatcaacctgtcatctacattaggtatttctcctaatgttatccctcccctagccccccaccccctgacaggccccagtgtgtaatgttctcctccctatatccatgtgttctcatagttcaactcccacttatgagtgagaacatgcagtgtttggttttctgttcttgtgagagtgtgctgagaatgatggtttccagcttcatccatgtccctgcaaatgacatgaacctatccctttttatggctgcatagtattccatggtgtatatgtgccacattttcttaatccaggctattattgatggacatctgggttggttccaagtctttgctattgtgaatagtgccacactgtgcatgtgtctttatagtagaatgatttataatcctttgggtatatacccagtaatgggatcgctgggtcaaatggtatttctagttctagatccttgaggaatcgccacactgtcttccacaatggttgaactagtttacagtcccaccaacagtgtaaaagcgtccctatttctccacatcctctccagcatctgttgtctcctgactttttaatgatcgccattctaactggtgtgagatggtatctcattgtggttttgatttgcatttctctgatggccagtgatgatgagcattttttcatatgtctgttggctgcataaatgtcttcttttgagaagtgtctgttcacatcctttgcccagtttttgatggggttgtttgttattttcttgtaaatttgtttaggttctttgtagattctagatattagccctttgtcagacgggtagattgcaaaattattctcccattctgtaggttgcctgttcactctgatgatagtttcttttgctgtgcagaagctctttagtttcattagatcccaattgtcaattttggcttttgttgccattgcttttggtgtcttagacatgacgtctttgcccatgcctatgtcctgaatggtattgcccaggttttcttctaggatttttgtggtcctggatcttacatttaagtctttgattcatcctgagttgatttttgtataaggtgtatggaagggatccagtttcagttttcttctgcatatggctagccagttttcccaacaccatttattaaatagggaatctttttcccattgcttgtttgtgtcaggtttgtcaaagatcagaaggttgtagatgtgtggtgttatttctgaggcctctattctgttccattggtctatgtatctgttttggtaccagtaccatgctgttttggttactgtgtagccttgtagtgtagtttgaagtcagagagtgtgatgcctccggctttgttcttcttgcccaggattgtcttggctatgagggctcttttttggttccatatgaaatttaaagtagttttttccaattctgtgaagaaaatcattggtagcttaatggggatagcattgaatctataaattactttgggcagtatggccattttcacaatattgattcttcctatccatgagcatggaatgtttttccatttgtttgtgccttctcttatttccttgagcagtggtttgtagttctcttggaagaggtccttcacatcccttgtaagttggattcctagatattttattttttgtagcaattgtgaatgggagttcactcatgatttggctgtctgttattggtgtgtagaatgcttgtgatttttacacattgattgtatcctgagactttgctcaagttgcttatcggcttaaggagattttgggctgagacctctaatagtaaagctccccttctgatagatttgccagtgtaaagctgttagagtagctgtcaataaactcagcaagtttgtaaatggcccagagaagcatagtattgggcaaacagcagcagagagaaaagaaggagatgtagttccaactccatcacctcacctttctgcaccccacttctctagaaagaggagcaggatggaatgagctctgcttatgctgaaatcttattaccatgccaagtaaaggtgcattccaggccagcatttggcagtaacaaagatgactgcacctgagctttcagggacgtggggcctcacaatagttcggagtctaggtatcagagaagcaaacttgggtttgatgccctgagtgagcctcttactcacctgtcacccatagacaattcttttgcataagccttagtttcctcatttgtaaaatgcagatgataatattacctgcctcattggattgttatgcttaaatgagagaaattcttatagataaagcactcagaacactggcaggtcatggtgcagtctcaataaatgtttgctgttttagttaagtgaatgtacacagactgtaatacttctatattctcataatatatatgtgcttcttaagttagagtgacaaacagggctatcaccattagtaataaagcctttctcacagggcagcatgtttctgtgcccagattgtctatggttttgaccagcacccacttctcaaacacacatgaaagctgctgtcagtggtattgagaatcctgcctcgataggaaatattaactcccattatttccattttaaggaagcatttttggaagtcaagtaattgcacagcattttgaactatctcataagctgtggcatttgacggcaaaaattggaatacctagaaattatttcttttaaagaaaggaaaccatggcgattatttatttatttttatagcatcacagtgtattgtaaaagtaagaactctttttgaaacttatttttaggaagggattttttctttgtcaatgaagctatataccttacattattgcagaattcctggcaatatattctagctagaattgttactttttggcagagtcacatagggactcaaggccaaaagtaaagaacatgtgatggaaggaaatccatttccacgtctttgaccgataagacccagaagatctttaagggattttctcatctagtttaggtacacaagtggattggaagcatgtttgggttttcagatactgcaaagactaggaggcacttagcttaccctttaaatcaatttgcctatgtttttgttagatgataactataatttgttacatgattaactatttgctatgataatttaaaaatgaaagcaagaaaccattttcaattccaagtggcatttcaagtccttcttttaaacatcccccttttccctgcccacctcccggaatagagatgagagtcagtaaatgctacccaggtttgtcactgatagcagtgagtcactcacacagcttccttggtgatgaaattccttcttatattggtattgaatggttttagcagtaaaaatggttgttgccaactttattggaaattgtgactactaatggaattgttatggattgttatgcttaaatgagagtaatacttatagataaagcactcggaacagtggcagctcatggtgcagtctcaataaaggtttgttgttttacatgccagaatctctgggacacattcaaagcagtgtgtagagggaaatttatagcactaaatgcccaaaagagaaagcaggaaagatctaaaactgacatcctaacatcacaattaaaagaactagagaagcaagagcaaacacattcaaaagctagtagaaggcaagaaataactaagatcagagcagaactgaaggaaatagagacacaaaaaaaccgttcaaaaaaatcaatgaatccaggagctggttttttgaaaagatcaacaaaattgatagaccgccagcaagataataaagaagaaaagagagaataatcaaatagatgcaataaaaaatgataaaggggatatcaccaccaatcccacagaaatacaaactaccatcagagaatactataaacacctctacgcaaataaactagaaaatctagaagaaatggataaattcctcaacacatacaccctcccaagactaaaccagaaagaagtggaatctctgaatagaccaataacaagctctgaaattgaggcaataattaatagcttaccaaccaaaaaaagtccaggaccagatggattcacagccgaattctaccagaggtatgaggaggagctggtaccattccttctgaaactattccaatcaatagaaaaagagggaatcctccctaactcattttatgaggccagcatcatcctgataccaaagcctggcagagacacaacaaaaaaagagaattttagaacaatatctctgatgaacatccatgcaaaaatcctcaataaaatactggcaaactgaatccagcagcacattaagaaacttatccaccatgatcaagtgggcttcatccctgggatgcaaggctggttcaacatacgcaaatcaataaacataatccagcatataaacagaaccaacgacaaaaaccatatgattatctcaatagatgcagaaaaggcctttgataaaattcaacaacccttcatgctaaaaactcttaatatgttaggtattgatgggacatatctcaaaataacaagagctatttatgacaaacccacagccaatatcatactgaatgggcaaaaactggaagcattccctttgaaaactggcacaagacagggatgccctctctcaccactcctattcaacatagtgttggaatttctggccagggcaatcaggcaggagaaagaaataaagggtattcaattaggaaaagaggaagtcaaattgtccctgtttgcagatgacatgattgtatatctagaaaaccccatcgtctcagcccaaaatctcctgaagctgataggcgacttcagtaaagtctcaggatacaaaatcaatggcaaaaatcacaagcatcctatacaccaataatagacaaacagagagccaaatcatgagtgaactcccattcacaattactacaaagaaaataaaacacctagggatccaacttacaaaggatgtgaaggacctcttcaaggagaactacaaaccactgctcaatgaaataaaggaggacacaaacaaatggaagaacattccatgctcatggataggaagaatcaatatcatgaaaatggccatactgcccaaagtaattcacagagtcaatgctatccccatcaagctaccaatgactttcttcacaggattggaaaaaactactttaaagttcatatggaaccaaaaaagagcccacattgccaagtcaatcctaagccaaaagaacaaagctggaggcatcacactacctgacttcaaactatactacaaggctacagtaaccaaaacagcatggtactggtaccaaaacagagatatagaccaatggaacagaacagagccctcagaaataatgccgcatatctacaaccatctgatctttgacaaacctgacaaaaacaagcaatggggaaaggattccctatttaataaatgatgctgggaaaactggctagccataggtagaaagctgaaactggatcccttccttacaccttatacaaaaattaattcaagatggatcagagacttaaatgttggacctaaaaccataaaaaccctagaagaaaacctaggcaataccattcaggacataggcatgggcaaggacttcatgtctaaaacaccaaaagcaatggcaacaaaagcaaaaattgacaattgggatctaatgaaactaaagagcttttgcacagcaaaagaaactaccagcagtgtaaacaggcaacctacagaatggaagaaaatttttgcaatctactcatctgacaaagggctaatatccagaatctacaatgaactcaaacaaatgtacaagaaaaaaacagccccatcaaaaagtgggtgaaggatatgaacagacagttctcaaaagaagacatttatgcagccaacagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagatttaggaacacttttacactgttggtgggactgtaaactagttcaaccattgtggaagtcagtgtggcgattcctcagggttcttgactagaaatgccatttgacccagcaatcctattactgggtatatacccaaaggattataaatcatgctgctataaagacacatgcacacgtatgtttattgcggcactattcacaatagcaaagacttggaaccaagccaaatgtccaacaatgatagactggattaagaaaatgtggcacacatacaccatggaatactatgcagccataaaaaatgagttcatgtcctttgtagggacatggatgaagctggaaaccatcattctcagcaaactatcgtaaggacaaaaaaccaaacaccgcatgttctcactcataggtgggaactgaacaatgagaacacatggacacaggaaggggaacatcacacaccggggcctgttgtgggatggggggagcagggagggatagcattaggagatatacctaatgttaaatgacgagttgatgggtgcagcacaccaacatggcacatgtatacatatgtaacaaacctgcacattatgcacatgtaccctaaaacttgaagtataataaaaaaaagtttgttgttttagttaagtgaatatttaagctacagatttccaataggcctgtgtccatttttattcttttttatgctttcatagaagcaaaatgtaaacttaatatttttacaagttttgaccattaatggcattattatttttgtaccacagcccaaaccgtaaaattttacatgatttcaatcagtttccccggctcttctcacttctcagggccttcttaggggcaagcatggttctatttgtcaacctgccccatacacttacccacagaattaagcatacacttctcagacccagtctctttctgtgcgacatatcttgaaccaccccccttacctggactccttttgtctcagctctgtaccacagcaaagtggactgtgaacaggaggcaacttcccctgctacaagctctgcctcctctctaaatcttgaataccttgcccccatctccatctgtgaagatccgagccaccttccttgttaagagccacgatttttctctgcttactctgtgtcaggtgttgtccttagcacatcatagtgcatcatcttgtgtaatccccaccacaacctaggaagtgggaaataccacgatgtattttacagatgggaatctaaagcagagaaaagtaaatttgcaccaggtcacgctgctggtgtgtgggttggagtcaggactgaaacccagatctgtggattccatgcccaaaccactgtgctgctttagacctttctcaagagctatcttagccatacagctttgcttcattccccaaccggtttttacagatcacactttagaaccggagagtggagactattttctgtttaatttcaatgccctcttgcagcacctcacactagccctttcacataatgggagttcagtacatacttgttaaattaaatttacctagaaaacaattagtcacaaaacttcatggtcttgacagtaaactcagaagttcagagaccatgggcagttacagaaggcttatgtggacgtggaactcggttaggctttgattacctgggtggatttggtgagtgagaaggaaaggagggtctactccacatgtggagatcacctaaaggaagtcaagggaggaggaaagatcatggcataccagaggaaccgtgaaaaaagcagtgcctagtagacacaatgacttaatgtgctttggggaaggatatgagattgggcagattaaataggctttatggattatggaacgattcgagtgccaggcaaagaactgtgggcctaatgcttgctgatgatttagatattcttctgtgacattgtgttcctgacattcatctatgtggtgtgtaattttagttcattcatttttaatactatataatattccattgtgtgactatatcgcaatttatctatactaatatggttgaacatttgggcttttttcctagtttttttactattatgaatgttgctgctgtgaatattcttttatgtgtttcctagtgcatatataccatttccccttgtgtatatatatatatctaatggctaggtcgtgtgacatgcatgtcttcaacttttttgataagggcaaatcattttcccaagtggttgtgacaatttacaccccaccagcagtgcatgagtttctgtttttccatattcttgccaatgcttggtttggtcatactttaaaatttttgcctacttgggggatgtgaaatgttatctcacattttcatttctttatggtattttgagataagaagttctttttattgtgggtcttttccctccatagtttatgcttttagtctcttctttaagaaacagtttcccatcaccacgttatgaagatatttatcttcttaaagctttatagttttgccgttcacatttaagtctctaatccacctgaaatttcatttagatgtaggtatgagagtattttcttttttttctacactcctttcatgtttggtaaactgttaaaagtgaggaagtctggtgtttaatctctgtggaatttttaaactactaattcaatttccttaatgggtatagaaccattcatgtttttattttttcttaagtcagttttatggcttatatttttccttagaaccgatccatttctcctaagttttccaatgtatttgcaaacagttgttcataatgtcctcatatttttttaaaaatctctgcagcatctgcagctatgtttccttcttattcctgatattgcttacatgtgttctccattttttcactttatcaatctttgtggaagtttgcaacttaccagtattttcaaatagtcagtttcagcttcgttgattctctatatttttccatctgtttttgattgcactaatttatgctctttaatatttttccctactttctcaatttattctgttgctttttctgacttctaatgttcagtctttcttcttttctgaataagtgttagaaactataaattttcccataattatcaatttagctttatatcacaagttttgaaatgtagtattttgttgtcattccattttcaatattttctcattttaattataatttcttacttggcctataagttatttaagtgtgtttctttctttgttttattcttcaatgttcagttaactcatatttaaaagatcaaattcccctaaatttttataccatttgcatactcacagtcccttagacctttcaaaccacaactgtaagttgagtatatctaattatctcaaatacttcaaacacccaaaatacagatttatacatcaaaatcaacaaaagcttcctaagtatgtaaatctagtaagttagacatcaattctgcagttcaaattctcttaactattttatctgaaaaccacaggtcaagcataacaaagagcacacaatgatagtagaactcattagtatataaaagtgtaattataatttttaaaaatacctttcttaagactgtaaatttattcatacaaaaaaataggacagaattgccttcctaaacccactgaggttactctatcaccttgctactcaaagtatggtctacagaccagcagcaccaaaatcagctaagaatttgttagaaatgcagattctcaggcccacccgaaacctcctaagtcagaatccttattttaataagatctccaggtggcttgcaggcacatctaacatttgaggaacactgatttccaatactcagtacggtaatacaagtgtgggaaaaggcaattaggtgacaactctgtactgtaacaggtcaaagaaattaaaactcctgggtggacctcccaagactaaactaggtgctcttagagtgagttctttccattctcaaattttgtctggcacaccagacatctggctttcagatgagatacaaccaatcacgtaagttttctttctttgcaacatagggctttctctgaaatttcccgtttaatctgtattataacctcctacattaagacctggtgtgtctcagtggaagtctggacacacgattcatgctgcaagtgtgcacctcttccctttcataatctaatatgtgtcattgatattcattctcatgtgacagtgtggttctaaaggagtctgggaacaggctgcaagaagggaaatggttgttgagccaggcctaatagaaggccgtgtctggcagctgtcaggaagcagagggaagttccaggcattcccagtgggcaaccccatttccctctttccacacctccaggccctgaaaatgcataggtgaaaatggataggcagaaaggaaaacggaagcaagaactaaagctcccttgtctgaggctagaatatttacttgacagagtcagccagtgttgatcttgatttcctgtgccaagtgagcatgtgttagctgctgcccaatgagaaacattaatgtcagcaagagattatatttccatttcagttgcccttttcaccaatatacaagaagtaagtcatatggcaaggtcaattaattgttggtctaactcattgttataattatcctcccctaaggaagaaaaattggtcactgggaataaaaagtcagtgtccttgaagcactgtttctgggttataatactgcacctgactctgaccctattgtgaaagcttgaccaaatctccattaatttctctgaaccacagattatttattcattgagcaggaggactagttacagaataatcagtttttctagtaagaactgcaatcaagatttcctgacctgacacccatgcttctagaatcttcccacaccatttattaaataacacagtgtgtgacccagggctattttcacaactctgggcttgacaacggatctcttagagatttttgctcagtaccgaagttctaatcactctcttatctcagccaccctcaggaatcaagaagcaaacctcctagagaatagttcagtattgggagacttatgagctactgacttctgttgactgaatgacaaacagaggtcatagactctgctgcctgagtctgaatcctgactcaaccacttactgtctgccttgaataagttaattaacctctttttgcctcagctcccacacctgtaaaatgaggctaataatgagaattatcccacagtgttactgtgaggattaaatgagacagtacatataaaaaagtgtctggcatgtggtaagcactcaattattataagctatgtttatgaaaacatttaaatataaaataccacattaaatacccattttggtacacaaattatctcaacatttcttaaaagcagatttttccatgcattctactaaaaaaacagtttttggtacttaattgtggtagacatctcccatagtatgaggaattccagaatcattgatctgggtgttcttacctgaactcaccggcacaagaagaaaacatctagaatatggctgactcctgactcagcctttttcttttaacaacagtaggacttttaatcattgcattcagagtaatacctgtcaatcacctttttttctctaattaaatttacctggagttcattttaaagacaataatttgttcagccaaaagtggttgcatatttatgccacaattagttaaggactccacaaatgaacccctctctctgagcctctgtgaagaaaggagaacgcagttgagagcccagaagatttcagagcaattaagcctagaaatgcaggtgtttgaaacacctgtttcccctccctcccacgcctgctgccctggccacccttgtcagtaggttaaaataattaactgacgctatcggaagaaaagcccaagcactgctaagggcaacaagtctccttttctcccctttctcagattaaatgagaaaaataaaaaggttcatgggtggtctaaaaacaggagaggggaaaaaacctttcctcttctttaaaaaaaaaaagacaaaaccaagtgacaaggaagacattgtttccctcaagcaaactcagtggcttgcttaagttcagaattctatgtttgttttgtgaaagtgattgcagcgctgttcatgagcatgaaaaaagctatttaagggatatttatgtgaggaaataaagcaactggggagactgtaattttgcctgacctgccttttgtgaatacctgcaaatttatactaaatctcaacaacagagtccctcccaagggtaaattgtggaaattttattgggacttttaaaaatgaaataggccatagctaggaaatcaagaaattgtttttaaaaataaaggaagttcaatgtggcaatttgattcaattttggccatgatgttttgtgtatctcagttttgttttcctgagtttcattaaagcaactgttgaatactatttggcataactcggaaagatcgtgaagatagttttgtttttatgattactggcactttccctctctattcaaacgcttttatttttttgagacagggtctcactctgtcacccaggttggagtacagtggctcaatctcggctcactgcgacctccgcctcctgggctcaaacgatcctcccacctcagccccccaagtagctgggattacggacacgcgccaccacatccggcttttttttttttattttatttgtagagacggggtttcatcatgttgcccaggctgctctcggactcctgaggtcaagccattcacctgccatggcttcccaaagtgctgggattacaggcgtgagccactgtgcctggcctcaaacacaaatttaagaagctttatgcattttaattggaacatgtgattttggaagacaaggatgatacaggccagaggacctgccagagttaggaaactagttcagtatttaagtaaatatgcatgcacctacacttttccattttttcaaagataatctaaggtgactggtccagctagactctggatttgagtaaaagctttgtgacaatgcccacatgaaatatacattgcaggaagagaatggattaccacatactgttaatttcgtccataattctgaccaatgtatattttttataatgcctgatggttttataagtattttctcatttgaggtaaggcaggtctcataacacctgtcctggaaacgaggtggctaaggtgttggatcgaggcagtcacggagagggaaggagagcatctccggttatggagggaacctttgaggacttaagcaactggccgcctatacaggaagtggtaaaactgggctcctgcaagaccacctccatccctcgccccaggtttcttgacatcagatccagtgctattgacaccaccacccaggccaggtgaattcttctccagtatagcactgccttttcacaaaccagtgttgaggctcactgttcaaagtggccagctcctgagagcagcattaattttaaatggccagcaggtggcagagtaaatcctagtcccaaatctatttcagtagttttaaatcatttgaaactaacagctgaaaacttcattatcagttcaaataagcttagcatttaaggtttcattaaaatatcggcaattataatatgtaatatagagacctaagaccactgtcaaactaaaagctgattctaacacatggcttgctttttttcccccctgagcaatctaacacagttgtaaagtagttttttgtttttagttctgttttcctcttactgtgctacttagtgagagagaaatgctggcttgctactcattttagttccttttctcattaaggaaatatttttaatagctgcatgtggcatgaatccacgaacagtacagctctgtctaggtccaggaatgtctttattaagggttcgttactaagcaccagttttccaactcctcctagcctggtgctctggggagataacccagaggaactgctcaaattacattgcactccttggctgtatcctgggcggctctaaagggaggcgaattagagaagactctcttcatcaaaaccttcctctccttcatagcatcttacttcatggtgtcgtaatttaaaggatctgtaaaccttgaggctcccaaatgctttgtttaatgccttcttcagctgctttcatgcattcttagcaaggaccaataatgattaaaaggggtttccatccaaacatttgcagagatttttacttaaaatacaatcttcatatagtgtatccatacgtatacattcatttccatacatacatgcatttgcctttacatgtatatatatttacatacatttgtacaaggatcaaatctcattacaatgaatttcattggattatctaatttcccatattatcgtggaattttgctgcttcaaatatgttttaagtaaattaaaggaattaggttctaagttgtagaaactataccacctactatcacataacttaagaacttgaaaatgtttaatctgaatttaattttttgatatgagatttgccatatgttcataggcatccataaatcaattgatcttaaaaaagcacattgagattatacatataaatatctaattatatatgctttgtctttttttcagaaaaaaaggtttcaaaaggacttagagaattacaggttacaaatatttttacacaattagctgctaagatttaattaaaaatgtattaactgatgcttctagaatgacataatatcttttcaagctgatatatatttcaactgaccaaataaaggtaaatgttaatagtgcaagttagctgtctacttgctctctaattcactgcagtcagcagttgaagaatggagcttatttagaatatctcaaatcatgtaataacactattcctttttaaatgaattcaaaggaactaaacggtataagaatccaccagtaatagaacaagtgtgttgacggtaattgtagaagtcattttgcctttccttgaaattgcaaattccatttcataaccaggttaaactcccttctgtgccaatttccccatcaacaagtacacacacatatttttcatagaccctgaaccatcccctccaggattatttatttccttatttttttaagaacaatgtcatacccacataaaatttgctttaaaaatgtgcacttttgtttgctttttccaacattacatgtttattttacagattgggttgagagctggaagacttttttttcctgtttcatcctaaaagcgtaaggatcaatgccaattgtatacttagatatcaaggcaacttttccagctgtgccctaactgttctctattgtgctccttaccatgtccttggtgtcatttttctgatttgagtgaaacctatgcaagacattaattgtgtcttattaccggttcttgctcttcttttcaatcctgataggtatgaatgccccaagagaaacacaaccaataaaacaaaacagcagtatattcctctatacattgtttgtgaagcaatgaatatgtgaaaaattcatatttgccagtgtacttcagggcattttgggaggccctttaaaaaaatccattggtctgtttctaccacagtaccacttcaaatctgactattgggctgatttagccagaagggcaataattatgaatcatttcctttaaatattatagcattttgtgcatcagtgctcaatactaacaaaattaaaagtgctggtatagcaaaactagggaaaatttaaaatggaaaagtatatatgttactatagtttcagaataattattaataaagcaacattttggcttgtgttatctacagcctggattaaaagcagtgaagaaatgagtgagctagtggaacctacatccaagttgcatttaaagtattttctaaatatgtggcataggcctgatgtggtggtggctcatgcctgcaatcccagcactttgggaggatgaagcaggagaatctcttgaggccaggagttgagactagcttgggcaacatattgaggccccaccccccagaaaagaatatgactatatggtatacaaaatactaattttgattttaaatttgataagttctgctttaatatagaagtcataagagtgaaattacaaaatggtgtaaaaatcacttattcagataatccttataatctccagaggcaaagcatgactacgaggaccaaactcttcaaccatacagcattaccttaaaaattacttactcttttgttcagccagaagtactagagattataagaaatgtgaagtccatcagctattaacttcaggcctgactaaataacagctaatataattggaacacttttatcagagagcaatttctggaataaaatatacatcatatagtaggaacacagttttaagaattacagagaacactaacttaaagtgataaaattttttcatttcaacatagtcttttaaaatttacatatttttatttatgtccgcttgattaataaccccattcttggggatgcagtgggaaagaacaatacttgtcatttttgtgcaccaacattaatttattataacactaaaatttttgtaggtttaagtgtgttccctgcagttttattaactgtgaagatacagagaatatattttgagtggaaataaaaatatatccttaacaataacattatcaagggtaaacatcttttgacaattacaagttgattttggtaacacatttcattgtataagaaaaggtggatattttttaggaccaatggcctgaaattctactttcttgtattgaaaaaggttaattaggaattgagctcaaagttaattttttgaaggtcagctgctatgctattgggtcctgtgaccctgtctcaagtaatcacagcattaacatacaagttatagctttcctttcacttgatgacataatctctttaattggtgtcgggaagcctgcatgtgaaagaaccgtggaaaacacctagagactataattttactctctccattcacagggcaaaagaaacaagccttaagaatgtagtagaaactcattacaacccataggctgtcaacacaaagccctcacatttcaaccaagggttttaggaatgatcaagtccgtttagttctaagttcggctggtgaactattaaccttttcagaaaaactggtgaatgctacatgtcacataatcttctttgagaaagctaagagggtggataatgttgtttaactgattagacataaatgtgagaagataatatttgcaaaattattaagtgtgctctctgaaagaaactactggagtgagactccctacctcttacgtttccacagccctttacataattctctttcataaattccacgtggctcatcatgcacacttgaaatggcccatttttatttggaagtttaaacttaccttttccagggagctgatcttcccctaggtcagcatggttgtgaccctgttttcccagtggattctgcctaataaagaagaaagctactgtggagtagcccgtgaaatacccactatgacacttttgcaaagatatgctttgggaaaagggagcaaggggaatgctgaagtttgttgagcccatcagcatcagtttagcaaccacttactatagcaaaggataaaaatggaccctcttcctgttcaagaaactagttctgattttaataagtaagtaaatattcaaaaccacttaattctactaaaacaacaaaatcatgtaccactgggccctagaagggaacaggagcaaaacctaaaacatgaattctattttgataaaaaaattttttgatcccaggggtgtctctgctgaaatataatggtggaaggtcctactgaaaaattctaggccaattataccacagaatatattttcaaacgttcctcaggcaaaggaaacagggtgagctcctttgcttatggaagggctcttagtaggctattaaagcagctcctgtccttatagcacacaatatttcaattttgttacctttccacgatctttttacctcttgagttctgacatgccttttaaaacattagaccatccaagcaagaggtcctgtgcctggaatgccttgtgctgagccttatattgggtgccatcagcaatgtggcaaatatagggatatgtcatctagcagagatataaaatcatcacttagaactggcttatctttggttctgatataccaggctctccctcttgtgccttgtctagacaaaactgcccagcaggtgtgggaagagatggaggtaaaaagggcaggtaggtgcttatgattgcaaacagtacatatgcctgccttcctatgacacctactagataattgctatattaggtattgacatgtctttaatcatgtctctgtgtaagtaataaatgagtcttttgggatctgttttgtgtcccatacactcttacatttttccagatgcacaatgcatataaccaatcaaataacagtgttggttgttttaatcacaggggcgtagcaactttcatttttaagacttttcaagccagaaattaactcattttgccctgttattcagatttagtcactggcacaatttcattaataagcataataataatggacaaatgccttaactgcttttctgctttgtttcatcctctgtgccaatctggtaaaacctcagtgatatcaaggattgactctaccctggaaattgaagtatttttctcctccaactcctcagtaaaaccaacaatgccgttttcccatcaggtttgttagcaaaatctgaactctacatctaactaaaattgtaattgacagtaggggatttgtattccttcattacctgggagctttccccagcaagaggaaataaaaatcacaaacacctgttaatgccactgcaattctaatcatccctgagtagtatctatcatatcttccccatgctcttcaaggaaagtccttatcctagcacgtgaggctatgtacagtctggtgctcaaatacctctccgacctccaaccccccaccatattgccctactctcagtcactaaagtaccatgatctttctctttttagaatcttgtatgatgttctctctgccaagaatttccctttcatctaggcagttattaactacacatcctttagggattagctttggtgtcatctcctccagaaagttttacctgcaagcttaataacccttcccctacattctgggccatatatcatgctaagtgttcccttaggaccctgtgccaaactctatcccagtaccctttatatgtgctacaactgtatgataatcctctgttctcttgaaggccagggctgtatattttttttatctctggatctccaacttctagaacagtgtctggcacatatgggtgtcctgtgaatatttgttgaatgcatgtttcagtgagagtatgttgttaatatgtgggaaaccatttattttttgtgaaaatcattttgtattataaaatccttgaagtgtagaaactcacacatatagtaatgcttactaatctatttaaaaatattttaagtattatttaaaaattaataaatccaatgatctggttttaaaacaagtgtgaccatgttggatgcttcttaacaaagacgccagcataatctttttatagggaatcaacttaagccccatgcaggtcactttaattgtgtcctctagattaagaagatgagctattctgccctctcttgtcgttaccccttcctctctgccaggttaaaattttaatgggtatttaaatgcatatctttgaaatggtgactgaattttgaccagcaatttatggcctcgtcacagagggcataatcaagaaatcaaaatcctgtctgtcatttttgtccagctgttgtgcaaatcaatgagcatgcatcgcctgtgtgccttcagcaaagcaggcatttgtgactgcaactctgaatagaagttttcctgtttacctttttatcacttatttaagttctagggagacagacctggccattttgttacagaatgggtgttttcaatgcaaaggaaaaaaaaatcacagttttgagtttttacaatgtttgccccttttcccagcagggatgtgttttgagtgccaggagacaaaaagtgtggcctcaacaagcagaattttaaaaagaacatcattttcattatgtagtcaatctcaattacaagcaaatgttttctctgtggagactcttctcctttcagggcattatgtgagcctcttttgtggattgagagaaaggatcagtggtcaatagggagcagagtgctgtgtacagtggatttttgtatccctcggtctcctacataatgcgttttgtcaggagaacagcccgccatcctgagcagatttgctgaattaaagagcacagcagggataggaaacttgttgctaggtgactgaccgccgctgcttggcgggtctgggccgaaggtgactctctgcttttcttccactacttaatcttgccttttaatctgcatctataattaactctgctaatgccacacatccatttgtttcttctttactgcacttcaggcagccaatttatcattatttagtcttttcactcaaacaacaaactattttttctccattagcgtcatatgaggcgaaacgttctgcagtgcaaagaaagatgtagacacagtagatattgcctcacttcctgtgagaattttcaaggtactttttgctgatctgaatggaaaatacatccttgaggaaacacttctgttggccattatctctacagcttgactgggcctaattaattgaaatgttcttggtgactttaaattcctctcagtggtgacacattataaaaattaaaaattactttattttttggaggttatataattgttcagcacatggtgttgcctccaatatctttgcaggatgtattctctgtggttattatcagccatggggcctggacatggaggcaaaacctagggatgcaaaaaaaaaaaaaaaaaaaggagggactttgcagaattcattctagcagcagcatccggaattcagcttggctgatgtcagcggttcaaatgtggtgctggacccagagggagaactaaggtggctttaaaggaccaggtctgtggcatgattttcaacactgctcctgcctagatggctccactgctggctcgctgaccttcctagacattctatgtgctcagacataatctaagaactaagaaatgtaggtcaataggccttggcctccatttctgtattcatacaggcagtctggtgtaaagatgtgacctggagacaggctgactgcctgagttcaaatcccaggtgtactacttacatgttgtttgacctgaggtaacttattaaacctctctatgcctcagttaccttgactctaaaatagtactaataatagtggctgtctcattagggttttatgtctcataggattaaatgagttaacatatgcaaagcaattagtgcttatcagctattattattatattgacaatataatggaacagtcatctgattcatttttttccatgtcttaagacaaaactgcatgttcacggtgaataaaaataatacctttcactaagggtttttacagcagtttaatcacatgatctcattaatcctccaactcctctagttttgcaaattcttaatctatgtacagagactggttaccataccaaagacagcttaaatgcacatttttcttaagaatgtatattttatgtgtactgtaattgtaaactacagtttggatttttaaaaatgttcaatctgacccacttaaattaaggaaaggcaggttatgcaggcttttatcccagacatatttggagagcattaggctgtaattagactaactggggctagttggaggttgtgatggctctacttcagtggtgcataaaagcatcttgtgcacagagaattaggaagccagaataaggaccattaggatgtcatttactacattttcatttgatcaatttgtactctttaatgtgaaggcctattttgcatcttttatgagggtgttaattctttgcctttgactaatacatgtctatgaaatgtggctgcctgcaaatctatacttgcatgatgatggaggtgagattacattgttggagaaagtgggcctagtccattgctccctatcacaccaaacacaacagggcagctagaagacttttatttctggtattctgagagtgtgctaaaatccccagtttcttatgaagagcacctgaacctatgtaataaattgagctagacttgatttcaggatattgcttccttatctttcctattgaccagcaataataaactaacataaaataacactcaaagcagatggctcaactgagaactagtgtatgatctcacttttcttaaaagtcttcatagattataaagaattcccattttataagtgaagaaagtaagccccattgttgtcttagctgcccaagatgattcagtgattctatagcaggaatgcaatggagcacagatacatttttctttaggccacgttcacatggcctctatgctaggtcttcttgctgattaaagcataccacagtcaataataaggggtttctcttcttgtttttgagaaaggctaagtgattatcttaactgaatttatagaattatttcacactttattcggagagttttacaagattttgtctccaaatataaataatcagacactctttaaaattgcagtcagtttgtgaggctccatagcatgagtttgccagataaagcacctcatgagggggaagctccatgagggcaggggtcatgggaggaatcctgtcttctgggctcactactataatcccagcattcagtacagtgcttggtacatagtaggggttcatatcatatctactgaacaataaattagtgaataaataagttattatataaaggaaaagctggtatccctatgattcatttttttccagtagttttcttacagtgattaaaatctaactctctaaaacaaatttgaagaattactataaacttgacttttaattttctcattttctctcctttttaataaattctcaacttttcagtggacagtgtagagatttgactagtcattggtttaaaattatggagtaaagtgagttcagtaatgataacttatcagtttaatttctctgtatccattatgcgatgaaacaaaaataaaacaggtaattttagagcctttctacttattgcctttccctaaggaaatataactaaaattataacatgttttgaaatcaaaaattttagtcttactctctaatatttaggtgattatgaccactagaaatgaataaaaagctcaaaatttatatttaagcttgaaagtctagaaattatataccttttccttggtagcctaatgaactatttaaagaaatgtaacaaatagttataattatgtaccaggagccattactaaattagttttgtcattctaatatagttagggaaaattagcatcaaataaagctcattaataaactttgatatttggtggctgattatctttgattttgcagcaaaaagggagtctgtttttcatttattgctaaacatatgccctttagttaataagttttgctaattgacataggtatgcataatgagagctatgcactaataggaatatgaatatccccttttcatttgttaaaaacctgacaacactacttattaatcatttttgtgcaataattatttgcagttgttttcagaaatttatgaatatttgttaggataaaggtttttagtttgcatttttctccatattttatgtgtgtcttgttaaccttattactttaatataattctatatctaataagcaaaggttatttagatacagaaaaatgcaatcaacagggaagatgttttataatggtcttccttttaaaatagaatatatctgatacttagatttatctcatcatataaactttagtcactaagatcttggtgaaaattcatataataataaacacatttgaaaattatgtttatcattgagcaaactgtactaagcaagtggtgcaacttaaaagaatatatgcagcattaagggacctcacacagctttataacaaatagaatatgcctatttgttttactgccttcagtacataatgctggcatctaatcaaatcaaaagtttaatagcccttgccaaatatgtttcttttagaaagttattttaaaaagaaataattatgcttatttttcttatgtttgtgtgattttatagctattatatagctaagagacattaacttttcaaaaagtattacacttcgaactctcagaaaaccttgcatgctgatcattagatccaaataaaattatacattttacctttaatttttttgtttactcctcagagtgctgtgttaagtgttttggataaagtgtagtaataatgaggcatctattgcgatataagacagattgtgatcctaggtagacactgtacagttctttcattctttccttcctttcctcagaaatatttattgagaatcttctatgtgccaggcatgttaaaggctgagatatgaggtctctttctatatagaaagcagcttctccagtcatatttttttcctgggcctctgatacggtttggctgtgtccccacccaaatctcatcttgaattgtagctccccgaattcccacatgttgtgggagggacctggtgggagataactgaatcatgggggcagtttcccacatactcttcttgtggtagtgaataaatctcaccagatctgatgattttataaggggtttccacttttgctttgctctcattctctcttgcctgctgccatgtaagatgtgtcttgcttcccctttgctttctgccatgattgtgaggcctccccagccatgtggaactgtgagtcaattaaacctctttcctttataaattacccagtctcaggtatgtctttatcagcagtgtgaaaacagactaatcagcctctttagaaaataaatgtattgttttaataatatttcttccccaaacattgaaaacaacttaaaaagtgataattcccttttgaacatactatattgaataataaaattccttattagagtgccaaattttttagactttttttaggtaagaaaacgaatatttatttaggttgagaaaataaataacaagaaattacaaactttagaaagttcacatataccataaacatcacaattgtgcttaattttctgacatgcctctataatatattgccccctgtattttttgaggaaaattctggaaacccccatcaagtttctttcatatattagctgtaaaagatgcacttggtgtttgttgatttcctataggtttgtgactacaaacaagggaatctgataaattctatttcacataattactatagaaatcatttctttctacatgggcctctccatggagcatctcacaacatggcagcgggcttcatcagagtgcacaagcaagagggaacatgctagcaaaacaaagccacaatctcttctgtaatctacttacagaagtgatattctatcactattcagttggaaggagttcctaggccccacccacactcacagggaggggattacacagggaagattacacaggaggcagcatccttgggaactgtgtgggagctgtctgtcacagcaccataggacaccttcatagggtggtctggactctggcctcataccttcctgtcatgtgctggctgagcaggcacaatgggccaaaggaatacactgaaagccattctgacatcattctggggttccttagatagacactgaagcaactgcaagccacctaaacataccctgttaaactcaaaatgtgccctcaactcaccagtccctcatttggatctcaaaagtgccattggccattcgaatatcatctcacacaactggctttaactgattacagttaaaatatcttattcttgcaaattttacaaaagcataactcagtgaatacatcagaagagagtcaaagaacacttcagtagttttactgtcaatctgcctctgagtgaaagccattattactgactaggttgatcccgaaaaatgccacaaaacaggtaaaatttggaaactgccttgaagaacagttttcatcactgcatttaagccccttaaaaaattgtgactttaatataagcaagccaattaatctttttcaaaaagctaaagaagagtttggagaaatatttcttagatgcttctgctcttataatgatttaacatattatatatggtttcatgtcatagtaattatatcagattccttactggtcagtaaaaccatcaaaaaaaggtacccagtagtaatcaaggactgctattatctttaggaaaaaggtcttaatcgtgaggcacagcaagaaagtgtttttattccagctcaatgcttgccttgaatgaacagtttgagcaactcagttaccctctttcagcttccacacctgaaaaactcaagctttaaactagctgagctctgagtcctttctaatttgtccttttctatcatagtacagtggtttttaaacatgtctgcaatttctttgacaat

SEQ ID NO: 466 - DNA, 52381 bp, Homo sapiens
attcaggagcaggttattcagtttccgtgtagttgtgggggtttgagtgagtttcttaatcctgagctctaatttgattggactgtggcctgagagacagtttgttctgatttctgttcctttacatttgctgaggagtgttttactaccaattgtgtggtcaattttagaataagtgcgatgtggtgatgagaagaatgtatattctcttgatttggggtgtagacttctgtagatgtctattaggtctgcttggtctagagctgagtttgagtcctagataaccttgttaaccttctgtctcgtttatctgtctaataatgatggtggggtgttaaagtctcccattattattgtgtgggagtctaagtctctttgtaagtctctaaggacctgcttcatgaatctgggtgctcctgtattggatgcatatatatttaagatagttagctcttcttgttgaattgatgcctttaccattatgtaatggccttctttgtctcttttgatttttgttggtttaaagtctgttttatcagagactaggattgcaacccttgcttttttttttctttccatttgcttggtagatcttcctccatccctttattttgagcctatgtgcatctttgcacatgagatgggtctctgaatacaacacaccaataggtcttaattctttatccagtttgccagtctgtgtcttttaattggggcatttagcccatttgtatttaaggttaatattgttatgtttgaatttgatcgtgtcattatgatgttagctggttattttgcccgttaattgatgcagtttcttcatagcgttgatggtctttacaattcagcatgtttttgcggtggctggtaccagttgttccttttcatgtttagtgcttccttcaggagctcttgtaagacaggcctgatggtgacaaaatctctcagcatttgcttgtctgcaaaggattttatttctccttcacttatgaagcttagtttggctggatatgagattctgggttcaaaattcttttctttaagaatgttgaatattggcccccactctcttctggcttgcagggtttctgctgagagatctgctgttagtctgataggcttccctttgtgggtaacccaagctttctctctggctgcctgtaatattttttccttcatttcaaccttggtgaatctgacaattatgtgccttgaggttgctcttttcgaggagtatctttgtggtgttctctgtatttcctgaatttgaatgttggcctgccttgctaggctagggaagttctcctggataatatcctgaagggtgttttccaacttggttccattctccccatcactttcaggtataccaatcaaacgtagatttggtcttttcacatagtcccatatttcctggacactttattcatttctttttactcttttttctctaactttgtcttcttgctttatttcattaatttgatcttcgatcactgatatcctttcttccacttgattgaatcggctattgaagcttgtgcatgcgtcacgaagttcttttgccatggttttcagctccatcaggtcatttaaggtcttctctacactgtttattctagttagccattcatctatccttttttcaaggtttttagcttccttgtgatgggttagaacatgctcctttagctaagagaagtttgttattagcaacctcctgaaacctacttctgtcaactcgtcaaactcattctctgtccagttttgtttccttgctggtgaggagctgcaatcctttggaggagaagagacacactgttttttggaattttcagcttttctgctctggtttctcctcatctttgtggtgttatctacctttggtcattgatgtaggtgaactgcagatggggttttggtgtggacgtcctttttgttgatgttgatgccattcctttctgtttgttcgtttttcttctaacagtcaggcccctcagctgcagatctgttggaggtttctggaggtccactccagaccctgtttgcctgggtatcaccagcggaggctgcagaacaacaaatattgctgcctgatccttcctctggaagctttgtcccagaggggcacccacctgtttgcggtgtctgtcggcccctactgagaggtgtttcccagtcaggctacatgggggtcagggacccgcttaaggaggcagtgtgtccgttcttagagctcgaacgccgtgctgaaagaaccactgctctcttcagcactgtcagacagggatgtttaagtctgcagaagctgtctggtgcagtccgcagaagctgtctgctgccttttgttctactatgccctgcccccagaggtggaatctattgaggcagtaggccttgctgagctgtggtgggctctgccaagttcatgcttcccagactctgtttacgctgtgagctactcaagcctcagcaaggtggacacccctccccccaccaatctgcagcatcacagattgagctcagactgctgtgctagcagtgagcatggctccgtgggcatgggatctgctgagccaggcacgggagagtatctcctggtctgctggttgctaagaccatgggaatagcacagtatttggtcaggagtgtaccatttctccaggtactgtgtgtcatggcttcccttggctaggaaagggaaatcccctgaccccttgcacttcccgagtaaggtgacgccccgccctgcttcagctcgccctctgtggtctgcatccactgtccaaccagtcccaatgagatgaaccaggtacctcagttggaaatgcaggaatcgcctgtcttctgcatcaatctcgctgggagctgtagaccagagctgttcctattcggccatcttggaagcatgattttaagttgtaaacttataataacttgcctaaatcagaaatctcattcctctagtaaagaaatactttcaccaacaataccctagttgtatcaccaacactagacaggtactcaaactggtcagaaactcattgactcattcaattatcctataatcatccatccattcattcaccatctactgggcacatattttgtgcaaggtgttttcagctttctatccacactaaaaagtgtcttaatcttttaacagtttacttttcagtaaatgaatgtgcaacaggtaaacattagaaaggaacaattagccatgttaaacaagtacagatatccaaaccctgatgaattacattctgagacacagaaggaactttccgagattgtttctgagtcactaccagaaatgtcagagaatttatagacaatgggaggggtgccagaattctggaataggaaaatgatctcttttgctcaaaaagaagaaaaagagtagactttagaaaccatagatttagccataattctctaactgctgggaagacgacagtgcagtgccacaagtcaccatcctaaattaacatttttattcttgacttaaaggttttttaaaatcatgtttttaaatgaactgaattataactgaaaagaaaaattaatatgatagatgatcagaacaaaattaaacatgatcttactagactggaatgttaaaccaaaacaagcaagataatttttaataagtctattgcaaatttccaggctttaacaacctgtaactacaaaataaggtcacaggtcacacttctcctacctatgaaaattacagtgaatcttgttagattgatcgaaggaaactacctgacagttcccttccccagattgtgtttcagatatgcttatgtttttctgctatgagaaccttgttatgataccacactcctactgtggcatgagcctgctacattgccaagtacagctgtccccacttataattctcccactgcaactcctctctagcctcaaaaatggagacactgctcttccctttgcatttccatccatgtgagacagaccctccactaaaacccctgaagcacagctaatgtgaagccaaaacttatgaataaaattttactcaaggttaaaggataacagacaagaagtataaaacaagtaatacagttgctagtagaagcaactattttcagagttcacaaacaagacccttgctttggaggatccttagcctggatctatctcctgggatcaatcactgttctgtcagatgctctgacatctctacccacaagagttcaagccaaattctccccaaggctcagagagagaaacaagtttaccccaccctatctggatctaatcagcactgttaaagttaacaagaaagtattcctccatagtaatcaattatgccacctagtaagatatgggctgggcagagactgagcttggagtttttagggtcagtaagtagagtaaaagagtaggctccaatattggaatccaaatgtcccaggctagatatgatagtagcaaaaaggcaccagcagacaccaagagccaaaggggaaaaatctgtagttcaaagggaacttcacaatgaaggtacaaggaaaggattatcagctattgctcaggaaagttagtgagtggagattgaccttccaaagccaaagtcagagaaagaaacagtagtataggaggacatcacactgaaaaggctgcccgccaggcagagttcagtgcaggacttcaaggcaaagccaaggctgagacaagatgagctgaataaacttgtggtaccagaaaacaaggacattctcaagaaaaggatggagacaaatcaaaaggatacaggagccaacccaaaggagtcccacatggctcctttattgggacaatttagcaactaaattacatgatgctaatattggattgtaactcatgaagtaaaagaaatatctatgagtccacattaacataaataaataattgaataaataaatggtaaagaaagggcagtatttccttatagaaaaattctaattaataatataaaatgtaaagagatatctaatgttaaatgacgagttaatgggtgcagcacaccaacatggcccatgtatacatatgtaacaaacctgcacgttgtgcacatgtaccctaaaacttaaaatataatttaaaaaatgtaaagagaatacagaggaaataagaataaagtcatcattaggcaaatactgcaatagtaattgttgcagaaaagatcctacggatgcaacaaataatgggcgaaagtctgaggaaaaccaggatattagcatactctccaagtaccccaaaagagttatcagttacaaaggggaaaagagaagctttacagtgtagaaacccagcacgaccaacttaaccaagtgatcaaattaacatcatgagtaataagacatgttgacatcatatatctctcttatgatgttcttaggatatgagatgacttccatggtattcttgacaaaaatgcataacccatcatgaggaaatgctagtcaaacccaaattgaggaacattctgcaaactgatcagtattcttcagaaatgtcaaggttatgaaagacaaggaaagaccaaaaaacatctttggaggatactaaagaaacacaacaactaaatacaatgtggggtcttgaaaaagaaaaaaagacattgggataaactagtaaaatgtcagtaaagtttataatttagatactaataatgtaccaatgttaatttcctggttttcataatgtacaatggttgtatagttaacattaggagaagctgggcaaaacatgtatatatgtatctttgtatgatttttgcaaatttacaaatttaaattatgataaaatacaaagtaaaaaatattatcacctattctgaaatcaaataacacattcttgacaggaaggcaccataatatttgtgcttccaggtgggagcgatagagcttccatcaaataaacatgtgcttattcatttgttaaactgcaaaaaccaagaaaggtaattttacataattttaattcacctaaatggaaaacattaaatttatttcccctgtccctcctccacccttccctcagaaaagactgaggaggacaacaaagaacatcctgtcttaggcaccttagctgagtcaccatgaatcactgggcatattgtttcttaatttgtatctacttcttaatgtggcgttcttgatcaatattttttagaatccttttaaatatactgttacttaatcttgaatcccagctacaaaatataacatgttgttggctccgaattacttctcaaacttgtatgaccgctattgccttctgcatagattctttggctcccttcctttcacaacagggatttagcagttatcccaaggaaatcaaagacccatgactattttatatctcaagtaaaatatggcaattcagactattcctgattctttttcttcatttgctctgtagagtcagaatttgagtgaggccctagggatcctccccatctcagagcaagttcaaaagtcttccaaaaggaacttacttctacgctcagtactgactgaagagaaggcatgaataaggtgcagagtgaaaacaagggcagatattttgaaggtggaattaaagagatagatatccctctggtgtttaaagtcctcatgctttcctatatgttgttagagaatttccttgctttataaatttttggtatagaaaatactgaattttgataacaaatctattacatttctggttatgtgcattatactctgagtaaataagaaatcagattttttcttttgaacccaaattttattattttaagagatatattcaaagaagtaaaaactagcaggacctttgggcaattatatgaactttggttacaaatctgtttatttacctactgttactaccactctggtagagagaacacatttctttctcaactggtgaattaatcaacagtgaccaactcaactcagtaattgtaaaatctcagtaaaaacctgcccaaaaaaatcatggaactttctccacctgttgataacttgcctaatttcctatccatacgtccctcctttatacttggagcctcttgatccagatccacatcctcactccctccactctctcaagctctgagatttatactccctccatcatggatctgaacagctctagttcagcactaggggaatggacatcaagccagccttaatattaggcctgtttgttgtctcctactccatcttgggcacgtaaagtttgactactgcgcttctaaacctaagcccttgccttgtagcctagttctagcatgtaccttaaatactgaccttcataaactgctcagtctcccaggttccatacctttaccttgctcatgccagtttccacactcattctccattcccactgacatcatttgattactgacacaaaatcccacttgtggagctagagccacctactttctctggtgctctgcccacctggacttctttccactgctcacaacaagatgtactcttcagcctcagctctgttctgtgggttctccaacccatcacagaccagagtcccagttctagccctccttttctcacactatattccgtcttaaggagaataacatattccagttatgccttactttagtatttctcaaaactatgtaacagtaagtgggctaatcattgctatttttctagtcaataatacttaacagatcacaaaacattatggcccaaaagaacatcaaaatttgtataataatgccccagatgaagaataattcaaataattgaatctaaaaaccttcaaaactcaacctcacatagatagctgtcttcagttttctgctggtgagatgctataaaattattccaaatgtacaagtgtcttctagaatattgctactcaagagtggtgcctggagcttgctaagagtatagactcttaggccctgactccagacctactgaattggaaactgtaacaaaattttcaaatttgaaaagcatttttctagaactccttgaactcttaactacttaggttttctccaataactttggaaaacatgtaactcttttcatctttatactattaatatttctatttgaggtgccacctctctaccattctatgtggatctgattgagctgctgagtgtcctctctctcctcccaactcccactaagggataagcctgtgagctacactgagctgattacaagatgacagcctgatatggtttggctgtgtctccactcaaacttcatcttgaattgcagctcccacaatccttatgtgtcatgggagggacccggtagaagctaattgaataatggggcggtcacctccatgccgttctcatgatagtgagtgagttcttacaagatgtgatggttttataaggagcttttctcccacttcactctgtacttcttgctgcaaccatgtgaagaaggatgtgtttgcttccccttctgccatgattgtaagtttcctgaggcctctccagccatgctgaactgtgagtccattaaacctctttcctttataaattacccagtctcgggtatgtcttcattagcagcatgagaacagactaatacagagccccctggaaacagtgtctggtttgaggagcaagtatggcaaataatccaagccagaacaattaataatttatgacattttccaaattggaggctaagagatagctttctctttccttttggagctgaagttttaggctaatgatgcctgtgttaccagaggccacatttctgccatgggaagaaacgcctcatgcaatacaaaagaatgaaactaagccgaaaggagcagagatgagagccagataaggaaagagaaccataaaagcgttgtttgagaccctggatccaggcatgcccaaggccataagttcctcagatttgccagttacctgaacaaataaaagtctctctttttcacttcagctagtttgaattggttttttatccttgcagctaggcttcttgactaatacacagttcatacatttgaagatggctatacttccagttttttttttttttttaataatcagcttattttttaaaatcccttttcccatagattttctaaactgacaaccatttgggggatatggagtgctactatgaaatctccaaacccctacctgtttttcctaatagtctatttattccaccaccccttggaacccccctccccaccgaagctcctaggaatcctgttcagagcgtctttgttatcaaagctgatgtatgtggggttttttgcctccctgattggtgatgtttctgaatatttttcaagtcttatatatgaacactcacactgttgagaggacaatagattggcatatttataagtggatcctgagaacacttaatggaggctccatgcattaatcctacaaggagagccactgtaagctaataatgatgaaggatctaaatggttacaatgctttgcttttgaaaacattgagtgcatcgtggccattttaaaagattgcttcagttccgattatttggtaaagctaaagcaaaggagtaaaaacatttgctttagaaagccaattctaactaactatggggcaaatgcaaaccatcgcatttatccacttatccttggaatctagagaaaacaaatgtgcatatagtgatacagacaggagtaacctaaaatcatttttttaatcttgaagggacatggccattataacatgccaaaggtcttttttactttgtttaaaaataaccacttatctataacactggagttagactaatgttagagaaaaaccccttcagaaacgtttccaaaccatacctgtatagtaaggtcaggagagggcagaccattcaactatgttcaacataatggatttatgtaaaccagtgagcatcactgtatttcagtcataaaactccattatttatgtttcatgattgtgtcttactgttttaaaacaaacaaacaaacaatgctagcgtaggtcagaccaatgatccatctacttcagtagctctttttttttcctaactataacttacttaattggagaaaaggccaggcaatattcctcccctacatgttcccactttctggggaaaaaataacttgataataaaatggcaaccacacataaaatcacaagaaaaataacagcaattctagtattttcattaatacaccagtaggaacaatttaaaactacagccaactgaagatagcactagtgatataccatgataatataatatcctactgaaaaattgggaggaattccaactatatgtacatatgcaacgtaagagctttgtagcatcttgtgcaggcttgttagcaagctatattctcgtatatatatgtgctgtccagtatagtagccagtagccacatgtggctattgagcacttgaaatgtaatataaattttgcttgagatgtgcagtaagtttaaagtgcacactagcttttgtagacttagtattaaagaaagaattaagctgggcatggcggctcatgcctgtaatcccagcactttgggaggctgaggtgggtggatcacctgaggtcaggtgaagccccgactctactaaaaatacaaaaattagtcaggcgtggtggcgggcacctgtaatcccagctactagagaggctgaggcaggaaaattgcttgaacctgggaggcggagatcacagtgagccaagatcatgccactgcattccagcctgggtgacagagcaagactctgtctcaaataataataataataatatttatattgaacacactttgaaataataatacttttaaaatattgagttaagtgaaatatattttttaaattaatttttacctgtttcccgtaacatttttaatgtggctgatagaaaattttaaattacatatgaggtttgtattatatttctattaaacagcactattatattatattcactattatattatgttcactattatattatggttaggagcatcgtctagagtcaggctgtctgagtttgaaacccagtttcatcatatgtaaagtggagttaataataacataattatatataattgtgaagattacaggggtatttatatataaagtacatagaacagtgcctaacacatactgagcagtcaatatatgttcactatatatatctccctggtaatatactgattcccatttatggactccaaattttagtatttcactaaattttagtgattcatttagtaagtgtattagtcaactctggttgccataacaaaataacatagactgatggcttaaacaacaaaaagtggtttccttaccagtctggaggctgaaaatgcaagatcagtgggccaacagtgttggtttctggttaggcatctctccttggctggcagatggaaacttcttgccttgtcctcacatggccttttctcttttttaattatactttaagttctagggtacatgtgcacaacatgcaggtttgttacatatgtatacatgtgccatgttggtgtgttgcacccattagctcgtcatttacattaggtatatctcctaatgctatccttcccctctccctccaccccacgacaggccccggtgtgtgatgttccccttcctgtgtccaagtgttctcattgttcaattcccacctatgagtgagaacatgcggtgtttggttttttgtccttgcaatagtttgctgagaataatggtttccagcttcatccatgtccgtagaaaggacgtgaactcatccttttttatggctgcatagtattccatggtgtatatgtgccacattttctttatccagtctatcattgatggacatttgggttggttccaagtctttgctattgtgaatagtgccacagtaaacatatgtgtgcatgtgtctttatagcagcgtcacatggccttttctttgtgcagagcacagagagaaagagctctggtgtctcttcctcttcttcttttaaggtgttatggactgaatgtctgtgttcttccaaaattcatatgttgaagccttaaccccagtgtaatgatatttggaggtggggccttagggagtaattagatatggatgaggtcaagatggtggggcccccatcatgggattaatgtccttacaggaagaggaagagagacaaaagctctcttacttgcgtgctctctctctctctttctgccatgtgagaacacaatgagaaggcaaccagccaggaagagggccctcaccaggaactgaatctgctggcactttgatctcggactcccagcctccagaaataaatgcctgttattccagccacccagtctatggtaccttgttacagcagctcaagcaaactaacacatgagaacatcagccttttgaatcagggccctgacttcatgacctcatttaatcttaattaccttcttaaggaccttatttccaaataaagtcacactaggggttagggtttcaacataggtacttggggtcagggggtgacacaattcagcccatatagtcccgtagatatatataaaactgaaagccaatggactcaaaattttggatccattcacaacccgccaagaggaccaggtggctatagatgactgagaaatattcatcttaataaacagtctgtccatggcataaaaggtatttgacaaataggcaggatagttccccatgacatcaatctcaaaacctttctgtgtatttccaaaccagtccaagtttaataacttagtataaattgagtagccttgatttttaaaaatttttatttttttttaacttttattttaggttcaggggtccatgtgcaggtttgttatataggtaaacttgtcgcaagggtttgtggtacagattatttcatcacccaggtactaagtctagcacccaatagttactttttctgatcctctcactcctccagccctttattctcaagtaggcccaagtgtctgttgttcccctatttgtatacatgagttctcatcatttagctgccacttataagtgagaacatgtggtactgggttttctgttcctgcattagtttgttatggataatggcctccagctccatccatgttccctcaaaagacatgattttgatctttttcatgacttcatagtattccatggtgtatatgtaccacattttcattatccaatttgtcactgatgggcatttaggttgattctatgtcttggttattgtgaatagtgctgcagtgaaaattcacatgtatgtatctttgtggtagaatgatttatatccctttgggtatgcacccagtaatgggattgctgggttgaatggtagttctatttttagctctttaaggaatcaccacactgctttccacagtggttgaactaatttacactttcaccaacaatgtataagcattcacttttctctgcaacctctccagcatttgttattttttgactttgtaataacagccattctgactgtgtgtgtgagatggtatctcattgaggctttgatttgcatttctctaattatcagttgtgttgagcttctttcatatgcttgttggctgcatgtatgtcttcttttgaaaagtgttcatgtttctttcatatgtttgttggctgcatgtatgtcttcttttgaaaagtgttcatgtcctttgcccactttttaatggggttggtttttttcttgtaaatgtgtttaagttccttatagatgctggatgttaaacttttgtcagatgcacagtttacaaatattttatcccattctgtaggttgtctgtttactctattgatggtgtctttggctgtgcagaagctcttaagtttaattaggtcccatttatcaatttttgcttgttgcaatttgcttttggcaggtttgtcatgaaatctttgcccattcctatgtccagaatggtatcgcctagattgtcttcctttgggttttatatttaggtctttaatccatctttgatttttgtatatggtgtaagacaggagccctgtttcaatcttcaacatgtggctagccagttatcccagcaccatttattgaatagagagtcctttctccactgcttttttttgtcagctttgtcaaagatcagatgattataggtgtgcagtcttatttctgggctctctattctgttctattggtctatgagtctgtttttataccagtgccatgctgttttggttactatagccctgtagtatagtttgaagtcaggtaacatgatgcctacagctttgttctttttgcttacaattgccttggctattcaggctcttttttggttctatatgaattttaaaatagttttttctagttctgtgaagaatgtcattggtaggacaatgatgggaatagcattgaatctgtaaattgctttgggcaatatagccattttaatgatattgattctttctatccatgagcatggaatattttttcatttgtttgtgtcatctctgatttctttgagcagtgttttataattctcattgtagagatcattcacctctctgattagctgtattcctagatattattctttttgtaataggcttgaattaattataattcttagcctatatcacctcttggagtattaagtttaacagctgcctattaaagtaagttgtttcttcttatttattttaaaattgatttgtcaaatactgaagtgtgcgcccaaatttttgtattttggaattagatataaatggtcttttttttttttaacaaatggtccttttaaaatttgattatatttttttcagattttgcacttctatatccatgatctgtggtgtcaatctatcctcactcagcaattcttttattttcttaatcatcttacagctttacagccttttctagatctttacttgagattaagcagtcaagattctaacagataggaatttgaacaaaggtaggataacattctctattttttccagtttttagtatgaggatgttactatttttcacttctgtattcatggttttatctctttctgcttttatctagttttttggctgaggtaacatattaggtaaaaatcttctggaaacaatccagatgggctcctaaatcctgtccctctgttggaaatcacagcttggaactcattagccataactatgattcccaaattgcaaatcttatacttgatccatctgcccacagcctcattatatcttcctacagcttatcaacatcagtgtggtgttgcactatccagtaagcctagatgccatgtatgaatggtacattttttctatgtacttcctttactgcataattttgaaatgtcagattctagcacagattgtttccacttctctatccaaagaaatgacaagaaattgaattggataaatattcactatataccaataaatgcaagctattaaatggggataaaaattaatgtagtctctattttcccctcaagtcaagagaggagacagccatgtaaacaattaaccttaacaagtgaaataaaatagtaccaattcgatttaagtttgggacatggcttctaactgggttgagtgcataagcctcaaatgtaagagacagttgagctgagcctggaagagtgagcaggcttttgatagatacagttgcctgaagacaaagtccacacacagagttggggagaacatacagtctcagagaaatggagctaaagccctgatcacaccatgcctggaaaccaccctatctatgtattgcctattaagtgagattatacatttccttaccatttagaccactttgacttgatttttatattacttgcactcaaattgatataatgtctctaacactcagcctctatttgtaactgtcagctaggcatctccaaatggatgtctcaataacactttgtgttagtatgagttgtctgaaaagtagacgggattaaacatacaagagatgaattagagctatcactggtgagggaaaatgaggtggaagcccatgaggcagggatagctgtcaaactggtggatatgtgaatttgatagaatccacataagaaggcccatcagggtggctcacgcctgtaatcccagcacattgggaggctgaggcgggcagatcactcgaagtcaggagtttgagaccagcccggctaacatggtgaaaccccgtctctactaaaaatacaaaacttagccgggcttggtggcgtgcgcctgtagtcccagatactcaagaggctgaggtgggagaattgcttgaacccgggaggcagaggctgcagtgagccaagatcgcgccactgcactccagcctgggctacagagtgagactctgtctcaaaaaaaaaaaaaaaagaaaagaaagaaaagaaaaattcacatcagagaaggaaggatagaggggttgggtgaaagagccttagattgctatgccgttctaagaaggttcagctaagttgatggagagtcttcaagccaatgttgctgattaaaggaagaaatttggaaatgtatctgtacagcttgatcagtacacctgccacacccagtcattggctaggagcagcccatggaaggtgtggcatgggcctgattgacatactggatgtcagagagcaacagcacctagggtttttggtcaatctagctaccgtagtcagcgaattttgagagctgcatcttcctgacctccacacacctcaacctcaaaacaaccaaagtgaattcatttttccttgctcccaacgttccctctctgcctattttccctaccttcctagtcatccaaaacagaaattacatagtcatccttgatctcttcctcttcttttcccatcatacccaacaatactcctatttgaatgaatgttcctccatcatgcctcttgcacccacccctgcttcgagcccactgtcacctgcctcagtcaggctttcatctcttgcctgtgctgttgcactagcctaagaagaactcacttctgacccccaatccagtattcttttcattacatcaaactaccttcaacacgtctatagttggagagaccatctaattcattcctcttcagccttttttccaccctagcacacctgagagattcggatatgccagtctcctccccaaatgacaattgctgacaattttcaaaaacccttgtagagagttaaaggaaccattctttgatcagggtacaccataataattgttctatgcaaggtcatttctggttttaattctctagacctttttatcccccatttccttctccaataggtaatcagtctaatgtgttggatgtgtatccttttattcacatgtgaagtttttttttcaagagttgaaaagaggtcagttattaaacatgaagcattaaaaaacttaattatataagtgatgaatgaaggataataaatatatgcaaacttataaaatcaattgctaaagcaaaatgtattttaaaagtatttcttagtgaaaacaagtttttaaatcgggaagagaggattttagctgccataataaaagtagcacaaacctcatgtttgcttgcagattctctggttctgaaagtccacatcaatctctggaaagtggctgaaaggcctccaaggatttgataatctcatatcatctctttatcctgtagttggaatcctgaggactttctcactcctttatctttattttattttttagagacagggtcttgctgtgttgcccaggctggccttgaactcctgggttcaagcaatcctcccatctcagcctcccaagttgctaggattactggcatgcatcaccacacccagctatctttatatctttgtattcttcagtggatgcaaattcaggtccacagattcgattctcaaccacctgactttagcgaactccttggccctcctctctaaagatgtctcccaggcactggcagttttcccctcaaaggttttaaatacaaaattatctacctttatagagtgggcagaggactgtcttttggcaccacctccctctttagtgtcttccaggttatcactatcgaccctaggacctccaggtggaaagagctttaataaaagctcccaagtacaatgacttctccatttccctaccatgtgctggatctacatatgcattttttgtctggggtttttttctattgaaaaaaattaatagttttatttcttagagccattttaggtttatagaaaaaatgggacagaaattacaaagagttgccatattctcttcccctgcacgcctacacgttccccactttcagttcccctattagtaagatcttgtacacaggtagtacatttgtcacagttgttgaatctatattgatatattattattaactaaagtccatatattatatttgggtttactctttgtgttgtacattctatgagttttgacaaatgtattatgacaaatattacatgacatgttacatgacatgacatattatgacatattatatgacatatataatgtatatatttaatgacattatgatagatatataacatatatctatcattcagaatagatttactaccctaaacatcccctgtgctccatctattcatccctgtcttcccaccttcaaatccctggcaaccactgctctttttactgtctccatagttttgcctttttcagaatgtcatagttggtatcatacagtttctttcacttagcaataaatacttaaggctcctctatgtcttttcatagtttgagagctcatttcttcttatcattcaataatattccattgtgtttatgcaccactgtttgtttatccattcacctatgaaggacatcttggatgcttccaagttttggcaattatgaataaagctactataaacatccatgtacagatttttgtatggatatacacttttaaattatttggataaatatctaggagcagaattgctggactgtatggcaagattatgtttggctttgttaggaaactgccttccaaaggggctataccattttctattactaccaacaatgaatattgctccacattctcatcaccatttgatgttgtcagtgttttgcactgaagccattctaataggtttgtagtggtatttcattttaatttgcaattccctaatgcaatttaatgttgacatttttcatatgtgtatttgccatctgtatatctttggtgaagtgcctgttcagatcttttgacaactttttaatgggaatttttaaattgttgacttataagagttctttgcatatatttttatttcaattttagttaacaaataataattgtatatattaatgggatacatagtgatatgatacctaaaatgtctgctgatcagattggaataattagtatatccatcacctcaaacatcatttctttgtgttaggaacatttgatatcctccttctagctatttgaaaatataaaatatattaactctattcatcctatagtggtatagaacactagaacttattccttctatccagctgtaattttgtatcatttaacaaatctcttccaatccctttctttcccctcccctttccatgctctagtgttctctgttctactttttacttgaacgagatcaagattttttagttttcacatatgcatgagaacatgcagtgtttaatgtttggatcctggcttacttcatttgacataatggtcctccagttctatcagtgtcgccacacattacaagattttatttttatgacttcaatataatgatttctttcctttggacaaattctcagtagtagggttactggatcatatggtagttctatttgtagattttccttgttttttggcttgttaagtgaagtgttgtgagtggagaaagaacaaagaaatctgtaactggttgtgatcaattagttgtatctatttgtagtgttttagagtcctccatactatcctccatagtggctgtactagcttgcatgtccacacacagtgtataagaattcccttttctcctcattctcaccagcatttgttattttttgtcttttttataatagccatccttactggggtgagatgatacctcattgtgattttggtttgcatttccctgatgattagtgatgttgagcattttttcatatatttgttggccatttgttgtctcctaataaatgtctgttcacatcatttgcccattttttaattggattgtttgatgtttttgctgttgagatgtttcagctccttttatattctagatattaatcctctgccagatgagtagttcacaaatattttctccccttcaacaggttgcctcttcattctgctgattgtttcttttgctatgcagaacattttagtttgacataatcccactggtttatttttgcttttgttccttgtacttttgaggtcttattcataaagtcttttcccaggccaatgtcctaaagcatttcccttgtgttcttctagtagttttgtcatttgaggtcttacatttaggtctgtgattcattttgattttcatatagagtaagaggtgggggtctatttcattcttctacatatggatatccagttttcccagcactatttattgaagagactgtcctttcccccagtgttcttcccacatttgtcacaaatcagttgactatagatagatcaattaatttctgggttctgggttctgtttagttggtcaatatgtctgtttttatgccacaccatgctgttttgattactacagctttatagcatattttgaggtctgttagtgtgacaccaccaactttgttcttttaggacaggattgctttggctatttggagtcttttgtggctccatacaaattttaggatttttttcttatttctgtgaaaaatgtcattgatattttgctagaaactgcattgaatcacttgatttctttggggaataaggtcattttaataatattaattcttctaatccatgagtgtggacgtctttccatttgtttatatcttcttcaatttcttccatcagtgttttgtagttttccttgtagaggtcttttaccttttttggttaaatttactcctaaatattttattattttctgtagctattgcaaatgggattgccttcttgatttccttttcaactagtttgttgttctgtgtagaaatgctactgaattttgtatcctggcactttactaaattcattcatcagttctaggaattttttgatatagtctttaggtttttgtatatataagatcatgtcatctgcaaaaagggacaatttgacatcctccttttcattgtggatgccctttatttctttttcttgcctaattgctctggctaggacttctagtgttatgttgaatgagtgtagttagagtgggcatccttgtcctgttccagttgttaggagaaaagctaccatcttttctgtattcagtaagatgttagctatgggtttttcatatatagcattgattatgttgaggtactttcatcctgtacctaatttattaagagattttaggaatgctaaattttatcaaaagctttttctgcatccatttagatggtttttgtcattctgttgatgtgatgtacgacatttattgatttgcagatgttgaaccatccttgcactcctgggttgtatcccacttcatcatgatgtactatctttttgatgtgtagttggattcagtttgctagtattttttaaaagatttttgcagctatgttcctcaggtatattggcctatagttttctttgtgtgtgtgtatgtgtgtgtgtgtgtgtgtgtgtgtccttttctggttgtcagtctcatggaatgaggcagaaagaattccttctttccagttttggaaatagtttgagaataattggtattaattcttatttacaggtttggtaaaattcagtggagaagccatctggttctcaactttttttttggaaagactttttattactgattcaatctcattacttgtcattggtcagttcaggttttctatttcttcttggttcaaattaaatgtgtccaggaatttatccattttccctaggttttcaaatttattgacatatagttatttatagtattctctaatgagcctttgtatttcttttgtatctgtatgatgtatcctgttttgtttttggcattatttatttaggtcttctctcttttcttcatagcctagttaatgacttagtggtttagtttctttccaaagaaccaactttttgtttcattgatcttttgtattttttagtctctctcttattatttctattctgatctttattatttattttcttctattaatttggggtttgttttgttcttgcttttctacttctttgtggtgcgttattaggttgtttatttggaatctttctagttttttgatgtagacatttattgctataaacttgcctcttaaaactgctttttctgtgccccataggttttgctattttgtgcttctatttttatctgtttcaagaaacttttaaatttcatttttgaggcctgatacagtggctcatgcctgtaatccagcactttgggagatggaagcaggcaaattgcttgagcccgggagtctgagaccagcctgggcaacatggcaaaaccctgtctctacaaaattacaaaaattagccaggcatgatggtgcacacctgtagttccagctacttgggaagttgtgagaggacagattgagcccaggagatggaggctacagtgagccatggtcacaccactgtactctagcctgggtgatagagtgaaaccctgtctcataaataaataaattcattttattctttatttcttctctcacccatttgtcattcaggagcaaattgtttaatttccttgtatttgtagtttcaaatgtttctcttgttattgatacctagttttattccattgagatcatgtaagatatttgatataattttgatgtcttaaattatgggggagctctcacctgttatcctaacactttgggaggccaaggtgggaggattgcttaaggctaggggtttgagaccagcttcaacaataaagcaagaatgacaacaatgcctataatacaaacatttctttacttaatggtgttgcataaattctgtagtcttccttcattcttttttgttgttgttgttatttttgtctgcgtgttatttcaaaagacctgtcttcaagtcagaatttcttttttctgttgggtctagtctattgaaactcttgattgtatttttaaattttattcactgaattcttccactgtaagacttgtttttccttaatgatatttatctctttttaaattcttccttcaaatcatgaattgttttcctggttttattaaatttcctatctatattctcttatatttcactgagtttctttaacattattattctgaattctttttctggcatttcatatattttcttatgattggggtctctcactggacaattattattttcatttggaggtgacatatttccttgcttttttgtggttgatgtccctatgttgatctctctgcatctggtggaaaatttgctccttcccattttatggagtgagtttgcagggaaatattttttgtataattgggtcttgggatgtcagtttgatggggtgtttcagccttggttctagctgaatacagtagtgtattcttagtgtaatttcttcagttgtaatccacactagtggcatttgcgacgtctcagtggcctaggctgagatagtttgtggcaacactggtgcagattttccaggggtaggctcattgggctgtttcttaggtcaggggcacatgcatgtgcacacaataggttggccaaactggggcctggctcactgggattggggccacagggctgttactctggcagagcacatgggcatgtagttgcttggctggcctggaggcatgtccacaaggggcagcccacagggctgtttctcaggcccaggacatggtcacagggcttctcagctggcatgggtgtgtgcctgctgggggtgggccacagggctgcttctctagcttgggacatggaggtacagctgcttggttgacctgggggcatatttgccaggggtgtcccatggggcatcccatggggctgtttctcaggctgggatgtggatacaaagctgctcagcgtgcctggattcatgtctgttgggggtaggacatggggctatttctcagggccagaacacaggcacacagctgcttggccagcctggaagtttgccttccagggacagcatgcatagttgtttctcgggctctgattgtaggagctgggccactggtcaagtcaggttcttgtgtgtagggggtggggcccctcaggactgtttctcaggccctgggcagagccgtgtagtcactctgcaggcctgggagcatgtcaaatgttcagagacttgagggcctcccctgcttgggagagggtgtgcagtttggccagctcaagggcgagttcaccctgagcaggactgttcttctggctggaagtgaaggtggcaggaggaggtttccctgctgttcaggaccagcatcacagcctgttccatgctgctggggttgtggcattcagccactggtgtgggctttgtgaaacgaagatggagcccagtgctagagaggtgcagtagctactggctcccaaacaagggcacactccagaggtggctctagtctcaagatggcatcatgctgcagcagcttgggtaacaaggaatgggctggggtggggagtgcgtaccttgcgctccttatccagggcaattcagttgcatgaattcccagcaggtctccaaactgggagactgtgtgattctcttgtaaggactgtaggtgtttgctgtggcaatgagggctggtgggaatcttctgcttactttttccccaaaataggaagttcttcctgactccaggcagatcggatccaggtggagaagacagggctacagaggccagattcctccgcactgtcctcctagacttccaatcaccacaggtgcaactccactcccccactgcacaccagcactctacctttgacactccagtgaaatcttggctgcttattcaattgccttggtcctctcttgttgaaacaggggatgaatgccaggcatctctagtcagccaccgttctcgggaaaagtaatttatgttctttcctttgtatattttggatacaagtcctttatcaagtatgtgttttgcaaatattttctcccagtctatggcttatcttttcactctcttaacagtgtctgtcacagagcagcagtttttagttttcatgaaatctaacatcgattttttctttcatggatcatggtttttgggtaatatctaaaagtcattatcaaactcaaagtcacctagattttctcttatgttatctcctaagggttttatagttctgcattttatatttaggtctatgatctattttgagttaattttgtgacaagtataaggtctgtggctagattcattattttacatgtgtatgtcagttgttctggcatcatttgttgtaaagactatcattgccccattgaattgccttttctcctttgtaaaaaatcagttgactgaatgtatgtggatttatttctgggctctctattctgttccgcatctcttcactttttatcagtgtctttatttttaaagtgggtttctaatagacaacatatatttggatctcgttttttatcttctctgatggtccctatcttaatttgtgtatttagatcattcacatttaaaatgatattaatgcaattgagttaatatctattatatttgtaactgtttcctatttattgctcttgttcattctttctatctgccactctttttctgccttctccggttttacttgagcaatttaaattattccattttacctcatcttagcatatcaattatacctctttctagaaaatttatttagatattgccctagagttgcaaaatacatttataactaatctaagtctaaggacaacaggaggccatgggagggttttcaatacaggtattcctctatttaagttgtatttgagtgatagatcagatgtgttttagtgatagatcactctgagtatagtgtggagaatagattggaggggagtaagagttgaagtgagaagattatttaggagatagtggtagtaggcaagaaatgatgggactctgaaggaggatggtggtaacagagtgccagtatggacagagacagatggatactagagatacacagtaggtagaagcaacaggacttggcaatttgattggatataaaagattcctcagtttccaacttgaaaaactcagtgaataatgtgacttttattgaaacaccaaacactggagaaggaaaaggcagggaaaagatcctgagatcagttttggtcatgtgaagtttgaagtgaagtgcttacggcatccccacagataaacgggtataaggtttgaagctcgggagaaatttcatggcaggagatacagagttaggggtcaccagcctatagacaggaatggatgagactgcccaaggaaagaatgtaaagtaataagggaagagggtgtaggttagagctctaagaattccaatatttaagagacaagccgaaaaggaactatggaaaggagagaataaatagctggaggaaaaggagaaaaatctgaaaggtatggtatcacacaagccaagtggagagaatatttcagaatgaagagaatgtctgaggctcaccttcacaggtaaagaaactgagattaagaaagcttaagtacattacgcaaaaaggctcacacataactcaggactcaaacccagatttccaactgtgttcataacaactccatctttatgggcctgtttcctcaccggtaacacaccgagaaagcagagtaggaagacagagattagactggataacttctatgatccccttcaagttctataggtgtacaactacctgagaaagtatgggataaagtatatgagtaatcattggtgtgccctttagtttttgtttctttattcctaataataggacagaccagacatgcaataaatatttgctgacttgaatatgggtgcacacaattattgccaaagcaaattcataggacaccattaaatgtccattaatgcagaaggcattagaggcacagctgaaatctattagtaaataatcattaattgcccaacatccaccctgccaaatgctgtttttattttttatttttccccactggttcttacttggcctggccacacagagaaagaagcccagcagcagctgtatctattagcaatatcatgatatgaaaacatgacaactggttttaaaatgtgattatgcaatatgtgtggttgcaggatgattctgtatatctgtaatttgcacaataaattcatcagagattaggacttgctctttccagggcctggaaggaatgtttggatttagttttattgagaaagataaccgtaccagtgcatgctttcaaaaaaacctccttttgttcaatcacccagggcaggaaccagacagaaatggatggccgcttgttggtgaaggactcacagtgaggcaaggaagatctcttcttcatcatgttccccgtcactgacttcatcatgttcaccgtcactgatttcccttaactctatgcctgatcagaacccacaaaccaaggagacacacctggtcctgttggtccatttgctatttcgtagttgaatttcacctcagcattctatatagaagatttgtatttttttcaatcacatgccctaatgtaaatttcatgcattcaagacagttgattggtttccaaaaaattaaatacagaattgccaaatacataatataacaattccacttaaagaagagaatttaacagatctttgaacactaatgttcacagcaacattcatggcagctaaaaggtagaaacaacccaagtatcatcaatagatgaatagacaaataaaacatggtgtagaggatatggagaaaagggaacccctgtacactgttggggggaatgtaaattagtacaaccactatgaaaaacagtttggaggttcctcaaaaaactaaaaatacagctatcatatggtccagcaatcccactgctgggtatatacccaaaagaaaggaaatcagtatatcaaagagatatctgcactcccatgtttgttgcagcactgcttacaatagctaagaattggaatcaacctaagtgtctatcagcagatgaacggttaaagaaaatgtgatatgtatacacagtggaatactattcagccataaaaaagaattagatcgtgtcatttgcaacaacatggatggaactggaggtcattatgttaagtgaaataagccaggcacagaaagacaaacattgtctgttctcacttatttgttggagctaaagataaaaacaattgaactcatggacatagagagtagaaggatggctaccagagactaggaaggggagtggggggctggtggcaaaaatgaggatggttaataggtacaaaaaaaaaataaaatgaataagacctaatattaatattttatagcacaataaggtgactatagacaataataattgtacattataaaataactaaaaaagtgtaattgaattatttgtaacacgaaggataaatgcctgaggggatagacatcccattctccatgatgtgataacttcacgttgcatgcctgtatcaagacatctcatgtaccccataaatatatatatgtactatgtacccacaaaagtttaaaaaataatttaagtatggtatatacatacaatggaatactattcagccttagaaagggatgaaattctcatatgtgctacaacatggatgaaccttgaagacattatggtaagtgaaataagccagacacaaaaggacaaatactgtattatttcacttatatgaggcatctagaagagtcaaattcatggagacaaaaagtaggatagaggtaccagaaactggggagaaagggaaatgtggagttattgtttaacagacacaaagtttccacttgggacaaagaaaacattcttgagatgaataatggtaacggctgcacaataatgtaagtgcacttaatacttaaaatagtaagttttgtgttatgtgtattttatcacattaaagaaatattatgcctacaacttctagtataatagaaagaggccgagtttgaagataagaggaagttaagagtcctagttctggtacttgcaggctgtgtaatttggggaaagtcatttagcctctcaaaggatcagttttctcatgtctaaaatgggaccgaagggatgcagaaaaaagttctaagagggaagtttatagcaataaacaccaaaatcaaaaaagaagaaagatctcaaataacatagtattacacctcactaaattagaaaaagaacaaactaaacccaaagttagtagaaagaaggaaatattaaagagcaaagcagaaataaatggaatagacaccagaaaaatagtaggaaaaaaacaataaaactaagagtggcttttttaaaagataaacaaaattcaaaaaagagaagactcaaataaattcaatcagaagaaatgaaataggagacattacaactgataccatgaaaatacaaaggatcataaaagatgactgtgaacaattatacaccaacaaattggataatctagaagaaatggataagttcctagacacacaacctaccaagactgaatcatgaaaaaatagaaaatctgaacagaccaataacaagtaagggctttaaatcagtaataaaaatatcctatcaaagaaaagcccagaatctgatggcttcactgctgaattctacccagcaattaaaggattaaagcaattctcaaactcttctaaaaaattgaagaagaaagaataaaatgaaacaataatcactagtttgcgtggttgttctgagatttagagataatacatgtaaacacctaacataatatctggtctccagtgagtgccattaaatggtattcttatgcacatttcagcctggcatggtggctcatgcccataatcccagcactttgggaggtcaaggtgggtggatcacttgagcccaggagttccagacctgcctgggcaatatgaagaaacctcatctctacaaaattacaaaacttagccaggtctggttgcacacacctgtggtcctagctactcgagaggctgaggtgggaggatcgcttgagcccagaaagttgaggctgctgtgagctatgttcaggctactgcactctagcctgaacgacagaatgagaccctgtctcaaaaaaaaaaaaaaaaaaaaatacacatttcaattcaaagaataatacatgtaaagaacaaattcacttttcaaaatttgaaattatatacataaattatgtaggtcactcttaccaataactgtttgctaaagagaaattgtttaataccaaaatactttattctaagctttgctttcaccatcaattctaacttggtcataaatcacagcaataaaggctgcctccatgtgagtctgaatgtctaagctccaagagccaaaagatgattttgtttttcatctacctttgggttccagcttacaaatattttcattaaacatctaatgactttgcaatgaagttactatttctctgttcagtgcccaatttaaagctaaacaagtggaaagatttaatataatttaatataattattgcctcataaaatatctagggttggaattaatccctaaattacctgtacgtatacataactttaggaagacacactaagtaaaaagcaattccttttgtgctgttttgtaaggttgaaggcagaaaaacagcttctgttcagaggaggcccccagtgaattaaggttaaaaggatttgcccttgcaggaccccaggtctctaattggggccttcaattcctgtaatccagaaggattgagaccagacgcttctagattattgccaaagcccacaggtgactcaaaaggaaaaaacaattagtgccccaaaaacccttcagatagaaaagaggtatttaatgaaacctgaagcaggcccagccagggcaagcttcttagtgaatattcagccattagcaaaagggaagaaaatctatttatttccctgttcagttttaatttcactaaatatctgaggtttttctttctagggtacattaatttgctactttaaagggactacaagggtgattatatccatatttaagattctttgcaatgccacaatctttaatagtaataaaaataaaacatatcatataaagaattcaaattctatacatttttattcttgtaacacataagcctgtgtgaagaatctaaaatcttacaaacccattaaactgcaagaataattcaagcaggaaagattagtatggaaggaaggttctagaagctaggctccaaatgtacagtggttctcaacctgggctgcacactggaatcacatgaggaattttttaaaataccaatgccctctacccacccatgaagattgtgacataatcggtctgggggcagcctggacattaaggattttaaaatctcaccaggtgattctaaagtgcatctaaggctgagaatgacctctttaaagaaaagtcaacaggagtatcgaagacaatcatctattccattcaggaccagctgcatgattttcagggcccagtgcaaaatgaaaatatgggtccccttgtttcaaaattactaagaattcaagatgacgagaggcaagcattaaaccaagcgtggggttcctctaagcacagggccctgtctgagtgtccaagtcacaggcccatgaaactggccttgattccattctttactaaaccaaacttttattttttaggaactagtttctttggaatggtgaggaaatatgtcatcttctcaatgtggtattcactgtgtctctaggatcccacaagtaactaatctctgagcaatatcattgtctatttaaacagcctgatttgccttgaaagctccctcactctgtcaagatgaataaaaggcagaactatagaacgattttatagagacaattgggaatttcacttcgtaacctcatctacaataaaaaaaaacttacctatgaaatattaactctgaacgaaggcttcttggtctagaaaataaaacatctggacgcagctgctcatggctatattcccaacactgggaggccaaggtgggtgaatcgccctgggcaatagagtaagatcccggtctctacaaaaaatgcaaaaattagctagatgtggtgaagcatgcctatagtcctagctactcaggaggctgaggtgggaggatcacacgatccaaccactgcactccagcctgggcgacagagtaaaaccttgtctcaaaaataaataaataaacacaacaaacaaaaatctttgagtctggaatagtctcttttaaaaactcactaattctcacatctctgccccatgcatctggcaattatcacactacaaattttattagccaacatctacagtaaagattcaaacttctaagcctccatttgtttaacaaattgttcttatctatttaccaaaagatataatatctgtttaccagtatgtatagttcttatctatttaccaatatttgtagtatattaaatattactataatttctgggaaaacctgataatcaaatatgtaggaactccctaattgcaaattttgtcactctagtcttttcaggttaaaggatcacttttttctctctttcacattatacaatgttaggagagccccctgctgtccaaagtaaaattctaatttcagaaaatttaaataaatggagcacaatgcctgccctctcctcacccagtttatcctcttagtatcactgctcttggaactaataggggaagatttaagattagagagaattagaaaaaagctgtgaaaaacaggctttgacttgggagggaaaaaaaagtcagactcctagttagatagatctcagatgcccaatcaccccaacacacacacacacacacacacacacacacacacacacacacagacacacacgcttcagcctctacccaacatttctaacccttcacttctcatttgcattttgcaatgctccactgtctgagatccgttaggttgaaatgaaccagaaactcaggggatgagagcccagcaatctgtgttttaataagcccaccagaggattctgatgcatgccaaagtttgagaaacactaatttacaacattacctcttctgatgaaatgagagatttcatttcagaggcacacaatctaaatgttcataagtgactcaaggagtttgttacaaatccagatagatttgcaggccccacctcaccctcagatattttgattcagtaagtctacagtaggatccagaaatctgtattgaacaagcaccaccggtgattccaatgcaagttaatggaaggaccatacttcctaagtcactaatatagtgagtggggtgggtaattctagagcatggagcacattaggaatatgttagacttgagtgggaaaccacaaggtgggaagcattaaagatagcatgggagtcctggttccttgggagaagggtgcagaaaaggaagctggcactggccaaatataaattgttcttgttttaaaatattttgcctgggttttgttctgcttcataaaaacaaaagaccctacttccttctcatctctattactgcatggctcctttctacaggccccagaaatcaggctacagttattgtgaaagtcattatggtttaattgaacttttgttgactagtcagagaaactaaccatcatatatgatcatttttatgggaatgtgttcctatagaacaaatatttaaaagaaacttttggaacataacccttttataagttgggaattggctgattttatttaatttttcataattttgtcttgaacttatggatatgccaaatagtgagtagggaagagttttaccgtgagtggctgccaaattaaagtttaatttgatttaaactttagaatatgtaatcactgatatatataaccctaagtcttactgagtatatagtagtctttttattgcttgctgtcccacaatatacaataaatggcagctgcatacattaatgtacagagtatgcattatatatctatatcaatactgaatacatcacacatgcacaatgtattatataactgtctcatatgcatatattacaggtactttatataatatagaatgcatatgtataaccaatttaggaacaagcagtatcatgagatgttacgtggcagtacactctgtttttaagagtttggccctgaagagattagaaatatatgaacattgagtccaattattcacacaactattcaaaacagtattttggggaaaaacatatgttcaaaacctctcctcaaagaatatcccaaaacttcagtgctaaatgaaaccacgatcaaatgctagattctgaacagcaaatatggtctgtggattccaaagtggatcagataagagtggaccaagctaaagccactccctcacctgccctgcaaaaaacaatttaaagcaactttatctccaaagggggaaaaaatcatattattctaaaacagcaacccaaaatgattagcctgaaatacttcctctatgtgccccatgtagaactctgattttttacctcctcttataaacctgcttcccacaatacttccaaggaagcagataagaaaagagccctccactaactaggctgagctttctctgtttagggagaaggtgggtgttgctcaataggaagaaaccctatattcctgatttacctggccaacccaacccatcctcccctggggatgtttctggcaacccctttcttcttggactgcatccagctaataccccatgtgagaaacaactgccactttacgctgatcacactccttagcattcccaacttaagttctgttatgagtgttaagggtccccaggtggatattttaccatggaatctgcatttttttcccttggtcttttgaaacatccataaacacctaataacttttcttaccagaaatactgcagcaattgtttaaaaaaaaaaaaaagccagcaacctctaatgcaatttagcgctttgggacatccctcttctgcctccattgcacccttccaaatacagcccttcaacagctaaggctatgccaaaagtttgtcgggccaaccaaacaaaacaaaaactcagggcatttaggtagtaaataccatatttctcaagaacactcccaggaaagccttgataactttcagcaaaagcaaaagcactcccttgtaagatgaaaatgaatagtgattcagagatgaagtagatcttttcattccaaaagtagatgtaactgggaattaaaagccctctaaggccaaggagggtaaagcccaagaactcagcttttcagcacaagcaaaagatgaccatctccactgcctccaagtggcggttagttcttgctgcagagcaccagcaccacctcgtgtgcaaaagcgttttcttttgtttcctcgagaaccactagaagcctacagtctctgcattctgaatcacagtctttaccagattttcagaagaggctgcaggcagagaaagcccaaaaagactgttcctgcctctggccagaaggtgaaatcttgggaattatctgtaagcactatgtccagtatagtctttagcacgttgtaactatttgtttactcacttgacaccccactgaccctgaactcacagaaagaagagactttcttctatctttttattcccagagtatcccagcccttggcacagagttggcacatggtagagatttaacaaatacctgatatatgaaaaggattcagtagaatttttaggtgggaaaacaaattagatctaacatcaataccaaacatcttcctccaaatagctctgcagattacattgtaaaatttacctttagaatttgatcaaatacaagaaatgaaaccaactttgagacacaaaagtgcattgatgtgtctggaaatttcaatgaaaaattaagtgatttctaattgacttgcctgaaggatgaattatgaaagcgagcatttctgaaaataggtaacaaagccctaatactcaaacttgccagaattatcctacaaattctcatacacctaaatacatgtcatatattagtacagctttagaaataatttgggcaatcttatgataataaaacaatctaagagcacttataactactcagcttctttctaggagtcctatgtaatgctctaacattcagaaagtaagtaaaactgaattattaaaagccacccaatgtggagttttgcctgatacaacaaaaaaattacagccaattcacgcacacccttcatctgtcaagaaccacagcagtgaattcagcaagccaagaaaactttaataaaattacacaggcctcagcatccaagagcagtctctccatccaaaacttacaaattccaaggccagagaacagtgtgactaatcctaacgaaaataaaaaccagctgcctgaagcactgtaataagtatatataaaaatttaagaacaatgtgatttaagtagggatagaacaaggcacagaacataatagtaaagagaggtcagtctgagaataactccaacctacttctgactctcaaagttctgctttaacaacagttcagagaaaacgctctctgatgtagtgatttctgaccaaaaaattttcaaaggtaacaatcattcctattgggattcaataataaaaatcatgtaggtgccatcattataaagccctgaatactgaaacagctacaccaaagtcctgggggaaaagtgaatatatttcatcatggatgaaaatcacagttttcatctgtttaacacactctttagtccataaagtatatgagatttttatggtggccctctgtgcttctaacataattatgattttcctttttaaaggtgccaattaaatcttagaaaataggtgtcattttagagtttcaagaggaagaaaataaaaaggaaatattaagtcttagaaaacagttgtgtctgaaaacttaatttttttgtaatgggcgtttatacagttcacactgagactttttatacattcacaatgagatatcacagtgaaaaaaggcagtactaagatacctggtaataccagcaatgccaacctaaaataaatactcagagttccaacaacaactgtggggaaactttgtgtctattttcttttaatatttgcaaattgagggcacactagaaatgctaaggtgctacgtggacatttgtgtttgttaattgtcagagcagccccaagaattacagtgaaataactaaccccctcctttctcagatgaggagggcaggatacagggaattcagaataccttattaggatcacaccaggcacgactgaaactggcaggtggagagcctgcgtttcagtcaagttgagggtctttcatgtagctggcactctgctaggcactgtgatatgaaaacagaatgccacaatccctgcccacaagccttggaatctaatcgggaagaaaagatacgcttattaaacatgtatgagccagggggcatgatacacacttacaaagcacttccaatctcttgtgtctctgaaggtacagctgcacttcgtcaccaccatcagaattaaatgggactgattgtccagatgaaacagcacaactgaaagttgaggcatttacatggttcctgattaaacccgctgaagagcaaagaaattccttcagcactcaatgggtttcagggaataaggatattctctaactccatggttcctaaatgtgtgtacataaggaaccataagggttctattaatgtctactaagagattgctgtaggctaggcctgtgttaagctcattacatatattacctcatttaatcctcattacaaacaagaaactgagagttaacttgcccaaagtcactgctaggaaatggtggcaacaggactagaagacaagccttagaccccagaccccatgttcacagtgcagtgggtctccaccctggctgtacattgtacatttgtatcacctagggagcttaaaaaaaaaaaaacttggctgggtatggtggctcatgcctgtaatcccaacagtttaagaggccaaggtgggagaatcgctttagccaggagttcgagaccagtctaggcaacaaagtaagactgcccccaacccccatctctaaaaaaaatagaaaaaattagctgggtgtggtggcatacacctgtagtcccagctactcaggaggctgaggtgggaagactgcttgagcccagaaggttgaagctgcagtgagccatgatcgtgccactgcaatccaacctgggcgagacagcaagactctgtctcaaaaaaaaaaaaaaaagtgccaatttctacaccaaacccaaagaatcagaatctctgggaataaagccagagtactggctattgtttttaagtacttccccggggacttccaatgtgcagccagctctgaaaccacagctatttcatgcactcagagactctgaaatagggtctggctaattaaacaatcagcccaggtgattctaatacacggggtccatagtcacagtctgagaaaaactcatctagggcagtggctcgcaaactctagcatgcatcaaaattacccggaaggcttactgaaccagtttgctgggccaacctccagaattcctgattcaggatgtaaagggtagggcctaaaatatgcatttctaataaatccccaggtgatcttgatgatgctggtaccgggagaccacactttgagaatcactttgattttctgaaaaatcacagagggaaaagacaggtagataaatgattatttgagtatctatgtaggtatctctattacacatttataggaatttgtttattctttctctttttttttttttttttttttgagacagagttttgttctggtcacccaggctgaagtacaatggctcaatcttggctcactgcgacctccacctcctgggttcaagtgattctcctgccttagcctctggagtagtggagattacagatgtgtgccaccacgcccagctaatttttgtattcttagtagagatggggtttcatcatgttggccgggctggtctcgaactcctgatctcaggtgatccactcgccttggcctcccaaagtgttgggattacaggcgtgagccaccccgcccagcctattctcttctttgataaacatgtataggtttccccagtgtatcaaccactatactaaactccgggatttgaatatgtatcctgctctcaaggagtttatagcccagaatcataactacatgttgtgactaaagaaaataagagtccatgagaacccaaagaagggaatgcctggcggggggtgaatgactcatccgtgtaatcccaggactttgggaggctgaggttggggggaaatcacttgaggccaggagttcaagaccagccttggaaacatagtgagaccctgtctctataaaaaataaaaataaaaataaaattagctgggcatagtggtacctgtagtcctagctactcaggatgctgaggcaggagaatcacttcagcccaggcgtttgaggctacagtgagctatgattgcactgctgctctccagcctgggtgacaaagtgagaccctgtccctaaaaaaaagcaggggacagtactcaactctgcacaaaaatagggagagttaaagacttacttcatagtggcagtaatgcttgagttgaatgttaaaagtgaagtagatgttgcctgggttgacaggatgaggaaggacatcttaggttgccttggaaatgtcaagccataaaaaggcaggtacatgggatccaaggtggggtgaagtgaaatttacagctgagcagagaagtgaccacgcaggatggtgaaagaagttcaggctttatcctgcagataatggagagtgcttgcatggttttaaggtggggagtaacacaatcagattttcactttagaatacctactcaagtagtagtgtggaaaagagagaaatgaggacaatatctgagtcagggtgacaagttaggagagagttcaggcaagagaagattaggtgtgagctaaggcagtattagtgaatgtaaaggaaaaaaaatggacatgttagattttgtggaggtaaaatcaacaacagaatgtaaagtttataatgactcctgagtttctagcttgggtgaccagtggaccatgaagctttcacaaagatagaaaaaacaggaggaagagtaagtttgaggagaagtaacaatagttaacactcatggggcaatttgcattaggcactactatgccaaagtatgccaaatgtcttacatgcatgtttttttaatttttattttattttattttatttgagacagagtctcgcactgtcgcccgggctggagtacagtgacgagatgtcagctcactgcaacctccgcctcccgggttcaagcaattttcctgcctcagcctctcaagtacaactagctgggactacaggcacgtgccaccacacttggctaattttttgtatttttagtagagacagggtttcaccgtgttagccaggatggtcttgatctcctggcctcgtgatccacccacctcggcatcccagagtgctgggattacaggcgtgagccaccaagcccagctgatctcttttaatctacaaaaaactttgagcggtaaatataattattctctctcattttacagatgaggaaaccgaaattgacaggagtaatttgcgcaagttacatggagaataaatggcagagccaagatttcaagctaggtccatttggctacaccaggggtcagcaaactttttctgtaaaggactgcatagtaaatattttaggctttgcagaccatacaatctctgtttcaactactcccctctgccattgcaagaaagctataaccaaagataaacaataacaaaaacagagtgggactgtgttacaatgaaactttcctaataaatgatgaatttaatttttatacaattttcatgtgtcatgaaatattatcattcttttgatttttccagccatttaaaaatgtggaaaccatttttagtttgcaagccttacagaaaacaggcagaaggccagatttgacctatgggcctcagtttgctaacctctgaactatacaacactactgagaaagattactttccgttttggaatgttgtgttcagaatgcctatggattgtccaggtggaaatgtcctgttggcaactgcataaatggatcaggagtttggaagggagatttgggttagagatctgaacttgggaatcattcatataaaggtggcaaagtacactgcaaggcaaagacggcaagaaaagaacagaacaaaactatggaagatgccaaaattaagaggataggagagatgtaaaaaccagaagggaaggctaagaaggatcagagagatgagagaaaaattagaagacaatattgtcatgggagccaaagaaagagtcacaagcagagtaggagtggtcagcaagggtaaattaaatgcacctgagagatcaagaaagacctgagaaacatgaagattccagtggatttggtgattaggaggtcaatggttgcctttgtcagagcagtttcaggaaagtggtagaactaatgtttcattgcggtggattctaaagcaaacatgagatgggaaagggagaaaacaggtacaatttattttttgagaagcttagcagtgaatgaaataaataaatgaggtaactagacaaacgcttatctaatctggatcccagaaaaaggcatcctgaaggcagctccttctagttcattcccacaagctatctgcctctcttgagtcatggggctgctaaggaccttcaggcaactggttatagatgaggctgtagctatacagggtcacagtagaatgacctgatgtgaggtttccttccctgtaaactaaactcagaggtgagaaccaaaggcagtgaatactggagacagcttggcatttggcaaactatggctcctactgatgatccaccttgactccatgtgtgagtacgcttgtcaccctgtcccacaaaagccaggagagagcaaatggtaggcctatgtcttccctgacttctaagctagcaaggtacagggatggcagagagcagaaggcctcctccagcatctctactctacaggcctctacagcatcaactaccaggtcaaagaccccattgtcttgcaattctgcaggattgttgccatttaagacacaccagatcaggtgcagcagcgcacgctggtaatcccaacactttgggaggccaagttaggaggatcacttgagttcaggagtttgagaccagcctgggcagcatggcaaaaccctgtatctacaaatacaaaaaaaattagctgggcatggtggcccatgcctgtagtcccagctacttgggaggctgaggtgggcagatcgcttgagcccaggaggtcaaggctgcagtgagccgagatcatgccactgcactccagcctaggcaacagaatgagaccctgtctcaggaaaaaacaaaacaaaacaaacaaaaaaaaaaaacagcagcaacatagtctgagctctaaataagcccaagagaaaaataataccttacctaaggtttccaagcagccagaaagtagtggaacaggtagaatgattagaatgcaagcccaggtaggtgcagtgactcacgtctgtaatcccagaactttgggaggccaaggcgggcagattgcttgatcccaggagttcaagactatcctgggcaacatggcaaaacctcatctttacaaaaaatacaaaaattaactgggcgtggtggcatgcacctgtagtcccagctactcgggaggctgaagtgagaggatcacctgaccctagggaggttgatattgcagtgagctgtgagtctgccactgcactccagcctgggtgacagagtgagactctgtctcagaaaaaaaaaagaaaaaagaaggcaagcccagtgaaacagagctgctcctggaggaaacagatgaacacctgaataaataataataagagcacttaagacatcataatgtagcaccttcctctctgagagatgaaaggagatgagagagaatacagatactgattgggtcgcatatgtgaggtgaaccattaaaagaacaggttccccaatggcctcaattatgtgtgcaggctgatacattagctgagaggggataatgatgggataggacacatgaggtgctgctagaccaaataacactattatgcagatcaacttctacaaatatattatctccaacctccactgggtcttcataagtgtgttatttttcaccagctgtactcagcagcaagggtacacatacagaggaagtggatgtagagagtgagatttgcagtgagaaagggttgagggagcttatctcatgcttctaggccagtatttttcaaatcctttatcacaactcatcattgggtcattaaatcaatttagtgggtcatgtccagtactttttaaaaaatgaagctaaataaaatggaacagaaaataactgtgaatcacatttagcaacttttgactcagttaaatacatgcatatattatatacatatatgcgctatatatatatgtgctatatatatacacaccatatatatgtgctatatatatacacatcatatatatgtatatatgtatatatggtgtgtgtatatatagcacatatatataacacacatatatgtatatatatacatatataacatatatggtgtgtatatatggtgtgtatatatagcacatatatatggtgtgtgtatatatagcacatatatatatggtgtgtgtatatatatatggtgtgtgtatatatagcacatatatatatatacacatacaccccatatatatatatatggtagaattgtacttctttgtttttcttgaagtaaggcatggcaaggtaacctgctttgaccagtgaaaagtgagcagaagagctatggggcttgcttcaagagtcagtgcactgttagccacatctcttatgctttgtcactgcattaggcaatgatatcacttctccatcagcctcagtcccaaaacaaagagacatggaacacagccttcagccaatccacaatagatatgtaatataggtaacaaatatgtttatgttaccataaaccattatgatttgcggtttatttattactgctacataacttagcctatcctgcctgatagagaagtcaagtctagaaggacatgattcaagacaaaaatggaagaaacaaagaacatttttacacataggtactcaatatgccctgatagtctattaaaaaatagatggcaggtaattgagtgctaactatataatacaaggaaaagtagacagacgggaaatagaattgttaatagaagccctgaattgggattcaaggtgctcctttgaaagataaattgaaaaaagtgcagaggaaagaaggctcattcagtgattggaaaacaggatgagccaagggtagtaagaatggcattcagagtggaagctgaaggtgaaggtgggcacagaaatgagacccagtctctccagaacagattgttcatgttagaatagaaggaaataaaacttaaaaaggaaggtaagatccaattttatttttttgttttttaaaccagaacatttattgagtgactaatcattgaaattcttttttttttttttttttttttgagatggagtcttgcgctgttgcctgggctagagtgtagtggcaagatctcagctcactgcaacctccgcctcctgggttcaagagattctcctgcctccacctcctgagtagctgggattacaggcatccgccaccacaccgagccaattttttgtatttttagtagagacagagtttcaccatgttggccaggctggtctcgaactcctgacctcgtgatttgcctgcctcggcctcccaaagtcctgggattacaggcatgagccactgcaaccacccaaatcattgaaattcttaagatgaactggatgctgcaacagctgccctctttggtttatgtgttgttccttcatggaatcaatgcttgaatctgagatatacaatttttaggtgcctcatccgaccagtcccagtgctatttcgtcttttagccttggcaccccagttacacttcctcttgcgcttggcagggtagccacgtttgccacaggttgacatctgaaggtggtaggccttggagctgcagtggtggcacaacatgcgcatcttcttgtgacgctttcccaacgacattcccttcatcttgttgcttctgtggtcgacaccaaagagatgggaagagcagatccaattttaatggaatcttcaaagttatgcagaaatgtttataatatgtaaagcccttagtgcagtgtctactcataattgaaggcttggctaatattagttgctgttgtgttgctgttattgttgatattgttgtacaatgaagagccataggagacttttaggagatgtgccacagaaagcagtgctttataaacttatttggctgttatgcacaggatggactgaaaaaggaataactgaaaatgagaaaaccaatgaggcagtggtctaggagtaaggcaatgaaagaagagaaatgaataaataaattctactgcaactagtatttttttgtctgtcagccatttctccacatgacaccaagtggacagtcataaaagcaaaatcttcccgtattaagaaccagtgatgcagggccagtggcatgcaactgtagtcccagttacttaggaggctgaagtgggaggattgcttgagcccaggagttcgaggtcagtctagacaacttagaggaacaccatctcttaaaaaagaaagaaagaaaaaaagaacaacagaaagaacctgtaaaagtagggttcagtaatcctataaggcatttagggattactacagcactctccagggtgacgtctatctcttgtgcttttgtgaagagtgaaattaggcagcatagttaccatttatccaacccttagcctgctcccttagaccctggaccctccagtgtatccacagtaataccttggagggcatctccattcttcagaaacactgcctttacgaactccacctaatgccatagaatctacccaggtgccaggtgccaggtgggaatgaagccttcagcttctgaaaagaagacagagccagtcagtctcatggtaactgtccctccctcactttgatgggattgcctccacttctgcatagaagacacgcatttcgacatgtctgagaactttagccaatggcaccaaggctgactggccttctttcaaaaattccttagttgacttctaccaagtgactatatagtgctgcaggttagagcaagtaacttacaaacagtccatgtggttcttaatggcagtgttcaggaaggtaatcttgggaagattctgaagtgttttgtgtctcagtttgttgctctatgtgccaggaaaacaatcataatcactcacagggagatttaagtcttaactaatgtttgcaaaacaccttgacatcctctaatgaaattgccacatctaaatgacatataattagaggcaggcttgtacctatgatctttgagaaaagaaacgcacaaagaagtaataatttgcacatctatcattgttcattccatgatcaaattcttaacaaatacatatcaccatcctaactttctggttaagaaagcaagtctttaatagttaaagcacttgaaattactacatcaccttctactcctatagccaaggacacatctgcttttaccagtccagcaaatctgagatccagtccaacttatttaaacacagcagggagaaaaaaaaatcccagacccaaaaaggtaaatgacttgcccaaggtcgatctaaatttggccccagaaacttattccaatttgacagcttcaatttttaatttttcaaaatagtctgaattgacaagttaagtcaccaaaaaataatttaaaaagcagaagaaaaaaattttttttggttgggatatcaggctaatgtgaaatagaagttattctctatgccaaccagggtaaggactcttgaaacgtcctaattaagtggatatgagccaatgatttctcttccaaaatattttagttttgcaagtaatgtcccttccatgtctgaaaaagagcatttctaaatgcatagcagatttctcatattttctctggaagccttccccaagctgtttcataataggtgacttgctactcaaagccatgatggtcccacaaagcaaaactttcacaacacattccgcttcttggctccaaacactgccgcatatggataggcctggtaccaaggaatcctcttgaaaactcccacattcttacatttaaatgctcaatttatgcactcttctatcaaaagagctttgtgagaggtgaagttattttcgttaatctcatttgctaatcaaaaaatgtgaaagaactgtgatttttctctaaaaataccatgatttataggcagcagctacttagatactgacgatcattttcctccaaggtaaatgtcctggccatcggtacaatagtacattttacaagattctggtaagaatattcctaagaagggaattaaattataagaatatttacttcatttcagcagtttttagttacattgccatgtatgaaacttaaaaacactaaagttatttatgtatggtaatgcgggtaatatcctactgtttaattattttgtttttatttagtttttagtatagaaatatattgaattaactaattcccatttttttctaacagaaaattatagtgattttttttctttctgttcggggaagggagactctggatggaaaattgctcattcctagagaggaaaaattaagatatttctccctcgataattcacacaattttttttacttcattgaaataaaggtagcattaattataaatacatttacagattccattactctatacaattttttaaaatcctgattaaatggtataataaccctgaaatatacaattggctctttattgtttaatccctaggttggcagcaccaaccaccaagcagagtcacaggccagtcaccataacttcacgctcactgtgagaagcatacgtggaaagcagatctggtaacaaaaaccaggctgggaatgcatgtggttcctgatggtgcttttccagaaagagttgtgtcataatagcagcatttctaaggagagaaaatggaggagaaaaggaatgaagaaacacctttgttgttgagcaacagtacaaagaaaagctgggtgcagtggctaatgcctataaccccagcactttgggaggctgagtagtgtggatcacctgaggtcaggagtttcagaccagcctggccaacatggcccatctctactaaaaatacaaaaattagccaggcgtgatggcacatgcctataatcccagctactcaggaggctgaggcaggagaataacttgaatccaggagggagaggttcagcaagccgagatcacatcactgcactccagcctggatgacagagcaagatccatctcaaaaaaaaaaaaaaaaaagaatgctatgctatgtaggggtatgaggaaccaagactctgtataatagatggcatagggcatagatgtgcagctttcctcccgggaacttcacagacctctgcctctccccattgaccatatgggtattacacacttatgcctgggtacaaactcctgttccacacctacatgctttgtgaccttgctaagctatgttactcctctctacctcagtgttctcatgtgtacagtggggttattatgacttacttcatagtgttaatgtgatgattaaataaagtcatatatgcaaaacatttatagagtactacccaacatgttaataaggactttatgttttagccatgtgtattattactaacatttctacttaaaaactaaactaagtccaactaaagtgtctttatagatgaagagaaactagttgttggcctaccaaatataattattgatgtcatttctatgcatatatgacatttatccttctaaccacttcgaccacattctcaactgttaggagatcactcagagaacacaaacatgtcagacacagacacagacataaataaaacacaaggcatctatgatcagtacatgactgagagtcacacagaatgctggtgatgcagaaaagagacagcaattctgtctaatggggaggagtcaaggaacacttcacagaggaagtgacatttcagctaaatcttaaagccacacagtgtttgaaggggagagaagttgcaaggcaagagtctactgcaggacatgggaacagatagcctgctgtgaaaggagcaagaaaggagggaaaggaaatgagaagaaatgagcctagaaagctggcccatattataaagaactgtgtgagacaggcaaatgtgatgaggaatgatggttaattttacgtgttaatttgactggtccacagggggcccagacatttggtcaaactgattctaggtgtatgtctgtgagggtgtttctggatgagattaacatttgtttgtttgtttgtttgtttttgtgagatggagtctcgctctgtcacccaggctgcagtgcgatggcacgatctcagctcactgcaacttccgccacctgggttcaagcaattctcctgcctcagcctcccaagtagctgggattacaggcacccaccaggcctgctaatttttttgtatttttagtagaggcggggtttcaccacattggccaggctggttttgaactcctggcctcaagtgatccgcccgcctcggccttgcaaagtgctaggattataggtgtgagccaccgcgcccagccggagattaacatttgaatcagtaaactgagtaaagcagaccagccttcccaacaggagtgggtctcatctaacccactgaaggcctgaatagaacaaaaaggctgaccctgaagtgaataagggggaattcttcctccctaactgcctgcaagctgggacatcattttattcctgccttcagactcaaattgaaacatcgactcttcttggatcttgagcatgctggtatttgcactggaactacaaaatcagctctcctgggcctccagtgtactggccacagatctcagtttgtcttagccttcataatcacttgagctaattcctcataatcaatctctttatgtgaatatatattatgtatatgtaaatatgtaaatatatatgcacacataggagatatatatatatatagatatatatatagagatatatatagagagagatatatatatagatatatatagagagagatatatatatagatatatatatatatcctattcagtctacttctctacagtaccccaatacatggggggaaattttcaaatgtctctatccatggtgtctccctcagttgccttttgaggacaattctgtgactgcacatggatgattttatgtgttgccagggctaataggtaaagctccaaaattaaggaagagaaaagggagcagaatgatttaccaaagtggcagcataagcttctcttgaagaaaagactcaactaaaaggcagcagaaagaggatgaaagagaggtgggcagtgttttgaggagcagttaagtaaaagagatgagggggaaaatgtagcttagtgtgtgacttgagagagaaagctatgcagaaggatttgggggatgttttgctgggagctatgggggaagaatttgccaaggaattcactctgtgcccagaaggctccaataaaccccaatacagctgtttgaagttagatttatgttttttgaggtgaattaccatgctgagggagcacttaagggaggaactgaaagacacagttttatatgagttgttcaaataacacctttgaattgttcaaaataagcccttcagaaaaggtaaaaatattatatttagaaaagcctactcttcaccaaaaaaacaactagaactgataaacaaattcaggaaagttacaggatataaagtcaacgtacaaaaattagtagcatttctatatgccaacagtgaacaatctgagaaagaaaccaagaaagtaatcccatttacaatagctacaaataaaataaaatacctaggaataaacttagccaaagaagtgaaagatctctacaataaaaactataaaacattgatgaaagaaattgaagaggacacaaaaaatggaaagatgttccgtattcaaggatttgaggactcaatactgttaaaatgtcaatactactcaaagcaatctacagattcaatgcaatccctagcaaaataccaatgacattcttcacagaaatagaagaaataatcctaagagttatatggagccacaaagtatggctccagatctggagtcagaatagccaaagcaatcctgagcgaaaagaacaaagctggaggcatcatattgcctgatttcaaattatactacaaacctatagtaaccaaaacagcctggcactggcataaaaacaggtatatagaccaatggaacagagtagagaacccagaaataaatccatgcatttactattgcaatgaatttgtatttatttgcactattttctctaatcctgagtgaaaatcaaaaggcatgttgatgaccaccaactatattctgtgaatgatattgtgctatttgaattacaacctcttttatttgcctaggcgatgctccatcaatacttaccccaaaacaaattttcctgtatttgtgttctactgctatgtgacaaa

SEQ ID NO: 467 - DNA, 20001 bp, Homo sapiens
actcggcaaagccactgtggccagactgcctctctagattcctactctccaggcagggcatctctgaagggaaggcagcagccccagtcactggcttatagataaaattctcatctccctgggacagagcacctgggggaaggggcggctgtgggcgcagcttcagcagacttaagtgttcctgcctgctggctctgtatagagcagcagatctcccagcacagtgctcgagctctgctaagggacagactgactcctcaagtgggtccctgactcccttgcctcctgactaggagacacctcatacaggagaggtctggctggcatctggccagtgcccctcggggacaaagcttccagaggaaggaacaggcagcaatctttgctgttctgcagcatctactggtgatacccaggaaaacaaggtccggagtggacctccagccaactccagcagaactgcagtagaggggtctgactgttagaaggaaaactaacaaacagaaaggaatagcatcaacatcaacaaaaaggacgtccactcagagaccccatctgaaggtcaccaacatcaaagaccaaaggtagataaatccatgaagatgaagaaaaaccagcacaaaaaggctgaaaattccaaaagccagaatgcctcttctccgccaaaggatcacaactcctcaccagcaagggaacaaaactggatggagaatgagtttgacgaattgacaggtaggcttcagaaggtgggtaataacaaaatcctctgagctaaaggagcatgttctaacccaatgcaaggaagctaagaaccttgaaaaaaggttaggggaattgctaactagaatgaccagtttagagaaaaacataaatgacctgatggaactgaaaaacacagcatgagaatttcgttaagcatgcgcaagtgtcaatagccaaatcgatcaagtggaagaaaggatatcagagattgaagatcaacttaatgaaataaagtgtgaagacaagattagagaaaaaagaatgaaaaggaattaatgaagccaccaagaaatatgggactatgtgatgggaagaatggaaccaagttggaaaacactcttcatgatattatccaggagaacttccccaacctagcaagaaaggccaacattcaaattcaggaaatacagagaagaccacaaagtactccttgagaagagcaaccccaagacatataattgtcagtttcaccaaggttgaaatgaaggaaaaaaatgttaagggcagccagagaaaaaggtcgggttacccacatagggaggcccatcagactaacagtggatctctctgcagaaaccctgcaagccataagagagcaggggccaatattcaacatacttaatgaaaaaaattttcaactcagaatttcatatccagccaaattgagtttcataagtgaaggagaaataaaatcctttacagacaagcaaatgctgagagattttgtcaccaccaggcctgccttacaagagctcctgaaagaagcctaaatgtggaaaggaaaaaccggtaccagccactgcaaaagcacagcaaattgtaaaggccattgacactatgaagaaactgcatcaactaacaggcaaaataaccacctagcatcataatgacaggatcaaattcaaacataacaatattagcattaaatgtaaatgggctaaatgcctcaattaaaagacacagattggcaaattggataaagggtcaagaaccatccatgtgctgtattcaggagacccatctcacattcaaagacacacataggctcaaaataaaaggatggaggaagatctaccaagcaagtggaaaaaaaaccaaatgggtgcaatcctagtctctgataaaacagactttaaaccaacaaagatcaaaacagacaaagaaggccatcacataatggtaaagggatcaattcaacaagaagagctaactatcctaaatacgtatgcacccaatacaggaggacccagattcataaagcaagtccttagagacctacaaagagacttagactcccacacaataataatgggagattttaacaccccactgtcaacattagacagatcaacaagacagaaagttaacaaggatatccaggaattgaactcagctctgcaccaagcagacctaatagacatctacagaactctccaacccgaatcaacagaatatacattcttctcagcaccacatcacacttattccaaaattaaccacatagttggaagtaaagcactcctcagtaaatgtaaaagaacagaaattataacaaactgtctctcagaccacagtgcaatcaaactagaactcaggattaagacactgactcaaaactgctcaactacatggaaattgaacaatctgttcctggatgactactgggtacataacgaaatgaaggcagaaataaagatgttcgttgaaaccaatgagaacaaagacacaacataccggaatctctgggacacatttaaagcagcgtgtagagggaaatttatagcactaaatgcccacaagagaaagcaggaaagatctaaaattgacaccctaacatcacaattaaaagaactagaaaagcaagagcaaacacatttaaaaactagcagaaggcaagaaataactaagatcagagcagaactgaaggagatagagacacaaaaaagccttcaaaaaatcaatgaatccagaagctggttttttgaaaagatcaacaaaattgatagccctctagcaagactaataaagaagaaaagagagaagaatcaaatagatgcaataaaaaatgataaaggggatatcactgccaatcccacagaaatacaaactaccatcagagaatactatacacacctctatgcaaataaactataaaatctagaagaaatggataaattcctggacacatacaccctcccaagactaaaacaggaagaaattgaatccctgaatagaccaataacaggttctgaaattgaggcaataattaatagcttaccaaccaaaaaaagtccaggaccagacggattcataaccgaattctatcagaggtacaaagaggagctggtaccattccttctgaaactattccaatcaatagaaaaagagagaatcctccctaattcattttatgaggccaacatcatcctgataccaaagcctggcagagacacaacaaaaaaagagaattttaggccaatatccctgatgaacatccatgagaaaatcctcgataaaatactggcaaaccaaatccagcagcacatcaaaaagcttatccaccacgatcaagtgggcttcatccctcgatgcaaggctggttcaacatatgcaaatcaataaacgtaatccatcatacaaacagaaccaaagaaaaaaaccacacgattatctcaatagatgcagaaaaggccttcgacaaaattcaacagcccttcatgctaaaaactctcaataaactaggtattgatgggacatatctcaaaataataggagctatttatgacaaacccacagacaatatcatactgaatgggcaaaaactggaagcattccttttgaaaactggcacaagacaaggatgccctctctcaccactcctattcaacatagtgttggaagttctgtccagggcaatcaggcaggagaaagaaataaagggtattcaattaggaaaagaggaagtcaaattgtccctgtttgcagacgacatgattgtatatttagaaaaccccatcatctcagccccaaatctccttaagctgataagcaacttcagcaaagtttcaggatacaaaatcaatgtgcaaaaatcacaagcattcctatacaccaataacagacaaacagagagccaaatcatgagtgaactcccattcacaattgcttcaaagagaataaatacctaagaatccaacttacaagggatgtgaaggacctcttcaaggagaactacaaaccactgctcaacgaaataaaagaggacacaaacaaatggaagaacattccatgctcatgggtaggaagaatcaatatcatgaaaatggccatactgcccaaggtaatttatagattcaatgccatctccatcaagctaccaacgactttcttcacagaattggaaaacctactttaaagttcatatggaatcaaaaaagagcctgcattgccaagacaatcctaagccaaaagaacaaagctggaggcatcacgctacctgacttggaactatactatgagcctacagtaaccaaaacagcattgtactggtacaaagcagagatataaaccaatggaacagaatagagccctcagaaataataccacacatctacaaccatctgatctttgacaaacctgacataaacaagaaatggggaaaggattccctatttaatagatggttctgggaaaactggctagccatgtgtagaaagctgaaactggatcccttccttacactttatacaaaaattaattcaagatggattaaagacttaaatgttagacctaaaaccattaaaaccctagaagaaaacctaggcaataccattcaggacataggcatgggcaaggatttcatgactaaaacaccaaaagcaatggcaacaaaagccaaaattgacaaatgggatctaattaaactaaagagcttctgcacagcaaaagaaactaccatcagagtgaagaggcaacctacagaatgggagaaaatttttacaatctatccatctgacaaagggctaatatccggaatctacaaagaactcaaacaaatttacaagaaaaaaatcaaacaaccccatcaaaaagtgggcaaaggatatgaacagatacttctcaaaagaagacatttatacagccaacagacacatgataaaatgctcatcatcactggctgtcagagaaatgcaaatcaaaaccacaatgagataccatctcacaccagttagaatggcaatcattaaaaagtcaggaaacaacaggtgctggagaggatgtggagaaataggaagacttttacactgttggtgggactgtaaactagttcaaccattgtggaagacagtgtggtgattcctcggggatctagaactagaaataccatttgacccagccatcccattactgggtatatacccaaaggaatataaatcatgctgctataaagacacatgcacacatatgtttattgtggcactattcacaatagcaaagacttggaaccaacccaaatgtccatcaatgagagaccggattaagaaaatgtggcacatatacatcatggaatactatgcagccataaaaaaggatgagttcatgtcctttgtagggacatggatgaagctggaaaccatcattctgagcaaactattgcaaggacagaaaaccaaacaccgcatgttctcactcataggtgggaattgaacagtgagaacacttggacacagggtggggaacatcacacacgggggcctgtcgtggggtagggggaggggggaggggggagggatagcattaggagatatacttaatgtaaatgacaagttaatgagtgcagcacaccaacatggcacatgtatacatatgtaacaaacctgcacattgtgcacatgcaccctagaacttaaagtataatttaaaaaaaaaagaaattgaggcaataatttatagcccaccaaccaaaaaaagcccaggaccagacggattcacagccgaattctaccagaggtacaaagaggagctggcaccattccttctgaaactattccaaacaatagaaaaagacggactccttcctaactcattttatgaggacagtgtcatcctgataccaaaacctggcaaagacacaacaacaacaaaaagaaaatttcagtccaatatccctgatgaacatccatgcgaaaatcctcaataaaatactggcaaaccaaatccagcagcacatcaaaaagcttatccaccacgatcaagtcagcttcatccctgggatgcaaggctggttcaatatatgcaaatcaataaacataatccatcacataaacagaaccaatgacaaaatccacatgattatctcaatagatgcagaaaaggccttcgataaaattcaacacttcttcatgctgaaaactctaaataaactaggtattgatggaatataataagaggtatttatgataaacccacagccaatatcatactgaatgggcaaaagctggaagcattccctttgaaactggcacaagacaagaatgccctctcttaccactcctattcaacacagtattgaaagttctggccagggcaatcaggcaagagaaagaaataaagggtattcaaatagcaagagaggaagtcaaattgtctctgtttacagatgacatgattgtatatttagaaaactccaccgtctcagccccaaagatccttaagctgataagcaacttcaatagagtctcaggatacaaaatcaatgtgcaaaaatcagccgggtgtggtggctcacgcctgtaatcccagcactttgggaggccaaggtcagtggatctcgaggtcaggagatcaagaccaccctggctaacaccgtgaaaccccatctctactaaaaatacaaaaaattagccaggcctgatggtgggcacctgtagtcccagctactcggggaggctgaggcaggagaatggcgtgaacccaggaggcggagcttgcagtgagccgagatcacagcactgcactccaacctgggcgacagagtgagactctgtctcaaaaaaaaaaaaaaaaaaaaaaaatcaatgtgcaaaaatcacaagcattcctatacacaaataatagacaaacagacagcaatcacaattgctataaagagaataagatacccaggaatacaacttacaagggatataaaggacctcttcaaggagaactacaaaccattgctcaaggaaataagagaggacacaacaaatggaaaaacattacatgcttatggataggaagtatcaatattgtgaaaatggccatactgcccaaagtaatttataacttatacctaccattgactttcttcacagaattagaaaaaactactttaaatttcatatggaatcaaaaaagagcctgaatggccaagacaatcctaagcaaaaggaacaaagctggaggcatcacactacctgacttcaaactatactacaaggctgcagtaaccaaaaagcatggtgctggtaccaaaacagatatatagaccaatggaacagaacagaggcctcagaaataatgccacacatctacaaccacctgatctttgacaaacctgacaaaaacaaacaatggggaacggattccctatttaataaatggtgttgggaaaactggctagccatatgcagaaaactgaaactggaccccttccttacaccttatacaaaaagtaaatcaagatggattaaagacttaaacatatgacctaaaaccataaaaaccctagaagaaaacccaggcaataccattcaggacataggcatgggcaaagacttcctgactaaaacaccgaaagcaatggcaacaaaagccaaaattgacaaatgggatctaattaaactaaagagcttctgcacagcaaaagaaactaccatcagagtgaacaggcaacctacagaatgggagaaaatttttacaatctatccatctggcaaagggctaatatccagaatctacaaggaacttaaacaaatttacaagaaaaaaacaaacaaccccatcaaaaagtgggtgaaggatatgaacagacacttcttaaaagaagacatttatacagccaacagacacatgaaaaaatgctcatcatcactggccgtcagagaaatgcaaatcaaaaccacaatgagataccatctcacaccagttagaatgacgatcattaaaaagtcaggaaacaacagatgctggagaggatgtggagaattaggaacgcttttacactgttggtgggagtgtaaatcagttcaaccattgtggaagacagtgtggtgattcctcaaggatctagaaccagaaataccatttgacccaaccatcccattactgggtatatacccaaaggattataaatcattctactataaacacacatgcacacgtatgtttattgtagcaccattcacaatagcaaagacttggaaccaacccaaatgcccatcaatgatagactggataaagaaaatgtggcatatatacatcatggaatactatgcaaccataaaaagcatgagttcatgtcctttgcagggacatggatgaagctggaaaccatcattctcagcaaactaatacaggaacagaaaaccaaacaccgcatgttctcactcataagtgggagttgaacaataagaacacttggacacaaggaggggaacatcacacactggggtctgttgtagggtgcagggctaggggagggatagcattaggagaaatatctaatatagatgacaagttgatgggtgcagcaaaccacaatggcacgtgtatagctatgtaacaaacctgcacgttctgcacatgtatcccagaacttaaagtataattacatacatatatatatatgtgtatatatgtatacacatatatatatatgtatgtatgtagtggagtttcttaaaaaattaaaaaagaaatggagatagataagtgcaaaatagctgttaagaaaaagatcttcaaacaagggaaataatattaccgtaaatgcaaattaattgagagtaagtttagaaaacattcatgatgcaaaacaaggcttttggaccatttcctattctcccagctatgccatgttgacataacataaatgttaaccaaagggctgcagttggcaaaatatatgtgatatataaagatatattttatgtaaatacatgaaaaatattttcacaggcacacacatatgtgattaaaataaacagcctaacagttgagagtaggttgcagacatgatgcttttccccccaattatgttagtgtacatttcctgaaaacaagcaattctcgtacacaactgcaggactgttgtcaaagtcaggcacttaatgctgatccaatactgttgtctaatctacagactttattcagattgcaccaacttgccataatgatgtccttcctaataaaagaaaatccaagatcatgaagtgtgtccagtttgtcacatctcattagttttctttcacctggaacagttcttgaggggagtatgtgtgtgagaaagagagtgtgtgtctgtgtatgttttcctgagtctcatgacacggcattttgaaagtgcataagccagtaattttgtaaaatgtgccaatttcagtttgtgtcatgattagattcaggttatgcacttttggtaagaacaccacaaaaacgattctgaattctcagtgcaccgtatcaggaggcaaatgctgttggttagtccttattctggcaatgattattttgatcaattaggtatagaggtgttttcactgtattttaccttttgtaattaataggtatcttgtaggggatactttaagactatgtaactatctcatgagttatcaaacatttacccaccaatttaccatatatagtcatgattcttgcctgaatgaaaaattattatgatggctgccaaatggtgatttttctatcattcctcttatgtttatcattggctttctcctgtaggcagagctttctcttcttatttattttttcatttaattaactaatttacattggtgtggactgttagattcttaatttattcaataggttataattctttactatcatcagattatttcagatttgaccagtgggtaccccttcaaagggacacctatatctttgtgacatattcccatcattctttgagcacatccttacatttttgtactatttacattttttctacttttcctgacccagccctgacatcaaccacttctccaaggagccgtgctctcccttcagtggaaaatggtatctatatccgcggagtgcttactgctactgaggtgttattgcctctaaaatctcttagcagatataactgagaaatatatatgtatgcgcttctcttgtgtgtgtgtgggggggtatagatgtgtgtgagtgtgtacatatgcatacatacacacacatatacacagtcacacacatctgtagtcattcctatatctatctctctatattcaaatctctgtgtaaatgaataaatgagccacagagaaaataggaaaaaatacttgtagtacatgtattttaaagagaacatgtttctaagatatatgaaaaactcaataaattataatgaatatattataaatactacgtagaataaaacatgcaaattgaatatgtattaaataatataagcaatataaatatgatataacccatattataaatataagaactcaataataaaaacacacacaaaaaaacaggaatgattgaacgggcacctcgccaagaaaatatgcaggtagaaacatgaaaagattttcagcttcattagtcattaaggaaaagccagttaagatcataatgaaatatcacttacttcagctagaatggctaaaatttaaaagcttcacaatgtgaaatgttgatgaggatatggagcaattgaaactcttagataaaactgatagagctgtaaaagtgtacaactgtgaaaaattgtttggcagtatatcttataaattttaacgtattcctatcctatagcccagcattttttattattatttgttcaagagagatgaaatcatttacccacaaaacatctcatgcaaaaatgttgacagaagctatatttgcaatatcagtttataataatgaagatcttggaacaactcaatgtctaccttctggtgaagagataaactgtggtacattcatacaatgaaatactacttggcaataaaaaggaaagaactaatgacatgtgcaacatcatggatgaatcttatgctgaatgaaacatgaaatattatgccaagtgaaagaaaccagacagaaaagagcacatactttatgattccgctcatacggagctcaagaataggtgaagctggctgggcgcggtggctcacacctgtaatcccagcacattgggaggccgagacgggtggatcacctgaggtcaggagttcaagaccagcctggccaacatggtgaaaccccgtctttactaaaagtacaaaaattagccagacgtggtggcgggcacctataatcccagctattcaggaggctgaggcaggagaattgcttgaacctgggaggcagaggttgcaatgagctgagatcgcgccactgcactccagcctgggagacaaaagcgagactctgtctcaaaaaaaaaaaaaaaaaatacggaagttaatctgcagcaatagagattagaatagcagttgcttggggtaagagtgggcaggggaataattgactggaaaggggcaggagggaatttttgggtgatgaaaatcttctataatctcattcatgtgtgggtaacacgagtatacatatttgtcaaaactcatagaattgcatcttcaagatccaagcattttattgtatatgaattatgctttgtgctaggcagaataatgcctcctcctcaaagaggttcatgttctaatctcaaactagtgaatatgtttctttacgtggccaaagggactttgctgatatgattgcattaagcttcttgagatggggagattctcctgtattctccagacgggttctaaatgtaatcacaagtgttcttataagagggaagcaggagggtcaaagtcaaaaggagaagatgtgatgatgcaagcggaggttggagtggtgccgttgctggaaggccgtgaaccaaggaatgcaggcagtttctagaatatggaaaaggtaaggaatggttatcctctagagccttcagaaggagcacagccctgacaacttcctgattttacctttgtaagattcacttttggacgtcacaaaaatttttttaaatattttttaagaggtgaggtcttgctctgttgcccaggctggagtgcaatggtgcacacatggctcaatgcatccttgatctcttgggctcaagccatcctcctgcctccacctcctgaggagctggactttaggtgcatgccaccatagctggctaacttttttcactttttaaaagagatgagccctcactatgttgtccaggctggtcttgaacttctgggctcaagtgatcttcctacctcagcctccaagtagttgacactacaggtatgagccactgcacctgaccatttttggacttctgatatccagaactataacgtagtacatttgtgttgttttaagccactaagtttgtggtaatttctctttctttctttctttccttttcctttaccttttccttttcctttccctttccctttttcttttccttttcctcttcctttccttccttctttctttctttttgacagaggctcactctgttgcccaggctggagtccacatcccaggttcaagcaattcttatgcctcgcctcttgggtatctagtattacaggtgtgcaccaccagggaagaaccgcttgtcatggtcggcttcaggtagaggcagctcctggggaaaaatggcctgaggctcccaggactgtggctgttggtgacaaacacatggccacttcctacaaagcatgctcatggtgtcaagaaggctgagccaggaatgttccagaatcattaccctgctgtgcccaaaccaggcctctcttaggactggctgagtttgcaatgattgttctgtcccccaagaccagcctctaccctctctggtgagtcttagggaaccctgttctcctctccggctaggaggcctcatctgaggccattttgcccttctgtcatgtttcattatgttgaaaaaacaaaacaaggccgggcacggtggctcacgcctgtaatcccagtactttgggaggctgaggcaggccgatcactttaggtcaggggtttgagaccagcctggccaacatggtgatacccccttctctactaaaaatacaaaaattagctgggcatggtggtgcatgactgtaatctcggctactctggaggctgaggcaggagaatcgcttgaacccaggaggcagaggttgcagtgagctgagatcacgccactggactccagcctgggcaatagagcgagactctgtctaaaaaaaaaaggggggggaaaaaaccaaaaccaaaataccttttaaaatgttagaattgttttaggtttacagaaaaggtgcaaagcagtgtggggtttctgtatattccacattcagcttcctcttattgctagcatcttatattagtgtggtgcatttgttacaatgaatgaaccaaatggatccattatgattaactaaaatcctcacttccccttgtttttacctaaagtgccttttctgttacagaaccccatcggggataccacattacctttcatcatgtctccttaggcaactcttggctgtgacggtttctcagatggtccttgttttttatgacattgacagtcctgagaggtactggcagggcattttgcagaatgtcccctcaattgggatttttttttttttttgagatggagtttctctctgttgcccaggttggagtgcagtggtgcgatcttggctcactgcaacctgcacctcctgggttcaagtgatcctcctgcgtcagcctcccaagtagctgggactacaggtgcctgccaccacgcctggctaatttttgtatttttagtagagacagggtttcactatgttggccaggctggtcttgaactcctgacctcaggtgatccacctgcctcggcctcccacagtgctgggattacaggcatgagccactgcacctggcccctcaattgggatttgtctgctgtttttctcatgattagactggagttatagtttttgtgtggaacaccacagaggtgaagtgccattcctaccacatcgtatcaaggaaacatactgccaacacggcttgtcactgtggatgttgaccttgagcacctggctgaggtagtgtctggcaggcttctccactgtcaagtaccttttttccacctttctgaaatctagaaggaagtcactttatggaagcctgttctatcacgtttgaatctcagtgtggagtctgtgtctccagctgttgttgtgttttacagtcattccataattgatttattaattgtggtaacagtcacatgaaaaaataatgtttggacccattaacatgtacaaatattcttcgaagcctattgctttgcaaagagactacacacttgcatcaagctaaatacaaaatagcaaaaaaggaacaaaaaagaagctttcattagtgatgctgagcattgtgtcctccaccaagagacacacctggcacacacctggcagggcccagggcatgagtacaaatggaggcctatataccatggctcttacaaattgaaagttataaattaagcaaacaaactgttaaattatgtcctatctacctgccaaaacaatacaccttcacaaaaaaatgtacaaagttatatagtcttatattactgaaaatcggcaaatatcaaagacaactgactgtaattattgttgcacatgcctgggtgttcccttgatgtgttgggcatgtttgggtgagtcataaattaaagacatatgtaatttgcaaattgtacatttattctaaaatttttatttttcttgcctaacgtcagcagtatctccaattatgctgtttaatcaagatttccacaaaatttctgttctcttgatggtaatgccaaattacataatctttcttgagtcattgaaattattatatggttttaaaattccaacctgggaaacctctctgccgaggctgtaatgattaaaactgccaataaagttcttcagacattacttaaattaaaaaatgaaccacaaatattactaacatgttcaaacattgtcatgggattttgtgtgataaactatttttatcatagaaaatactactacatattttaactcatctaaattactatttttatatcacaactgtaattgtctcttaatgtctagatccattcaatattttttctttttttgtttttttgaatagtcctgttgcaataagtattttcttcttttaaattattcaacactatggtattatgaagataacttgaaaatagcagtttgatactcaatttgttaaaatctctcttcaattaataatatacttcgatttgtgatttgcctttctgaaatttcagaattatttatacatgaatcttttttcattgtcataaaaactttataattccctttttaaaagttctctccccactgaaggaggaaaagtaaaatgcgtagctgccttaaattgtgtaagccaatgactgagcctttgatcttagattgtctgctggatggagttcaccttgaaccacatgctatgcttaccactcactaatgtatgtaaggaattttttaaaggactttgaaaatgaatatattctatcagctttaaaacaaaagttctctccccaacacccccctccacctttttttttttttttttttgtggagacaaggtcttaccgtattgcccagtctggtctcaaactcttgttctcaagagttcttatggcttggtatcccaaagcactggaattacaggtatgagcaaccatgcttggccttcttttaaacaactctttatactttatctaagcataacctttgttgcatattttatgccaattttttcaattaagaaaacaatttctaaaagtaaactatatatgtgtatatatagtttaatgcctttaacaaagtatcaaactagatctgttttgttttgttagtttttaaaagttaaaattaagcaatagattatactaaataaatgtggatggcacaaactcaaaattaatttcatttttggtgattattcactcatttgggaatgttattttgccacactctcctagtggatcctaattgttctaacatgtggtccaaattcccattatgtgtcaaatgatggtgtagggtccaatttcatatgtgtttcatcatgctagttcatttttgggctgacccaggagatactgaattttatctctgaattgttccaaagaatagtgttgccatgggtgcagatgagctcatttctcccagtaataaattccaactctgtgcatatgtagcacaaagaaatgcttctggatttttggtaaacattctggcttaatcaccttattctttgccgaccatgttagtgagattaggtaagccatgaagtttgccctcatcaatctcttaaatcaatgcctaaaattgaaaattattttctcagcttttcagtaaagtctaaacctattttcacaactgatgtcaaccagtggaatactgttgcgttttgacttgtttccttttctggtagttcaacaacacatatagtgaatattacttcatcaacattttgaccctgttacaacctagttgaactgaataatagtatctttaattttatttatttatttatttatttatttagacagggactccctttgtccgccaggctggagcgcagtgttgtgatcacagctcactgcagcctggacctccctggctcagatgattctcccatctcagcctcctgagtagctgggaccacaggcatgcaccaccacacctggctaattttggtattttttgtagagagaaggtttcaccatattgcccaggctggtctcaaactcctgggctcaagagatcacctgcctcagcctcccaaagttctgttattacaggcatgcgccattgtgcccagccaatagtatctttttaaaaattacatatgtttttttcctcaccttattactcattaaattaagagcttcattttgaattttctaaccttgagagtgatcatttgcttcattatatttttgttcattttagcatcaaaatgtgaaacaatttctactaaacctagatattgtgcttttactgacacagaaagcatcattatgcatagcaaattttgggtacgtagtgtcatccttttcagaacatcagagtaaggttctgaggtggcatttccttatctttattgaatatgatcaattattctttattcatccttttgtttcagaaattgcattgtactttttctatgtgcaaataacattttgtgacatgtaattacatcttcatttggtgaagaatatgaggttgtaggcatttcatatgacctgtgcagactgtgaattgataagaataatttgctaattttaattttttaatcgcaattaagtcttcattaaatagagaatacgtaatatcttggtcaggacttttctgtggggcatacttgccagacatttgctcatttcccttgtttccagttttaaaatacgtatgcaatctgcctctttgaggaacttctacttattttctggttagctcattttctttctgagttccacttttgtatattttatttctaacatgatctcaatgatccaaagcattaaacaataaaactcaaagtgtatgtaatttagacacacttttatttaaaatgtaagtggaagtaaatttgaaaataaaaaattgtaataaaatatatatattttagaaaattatatttctttggaaatatcaaaaattatatgctaaaattaaaggagggtataccttttaattaataaaaacattttaaataaaaaagattaaaatgaagttaaaatatttctacttaattttttgaaaatttaattaaatcacattaaatatttttataaaactacagtgatttacaattccaagattcattgtctctccagttaccaatgtaaagagtcaatgtcaagctttatacttgttgtgtctagacctatttctattaagagtaatatgaattgtttaatattgcaaaatattttattgccattatgcaactgctgtgaacatcatggaagttgtgagaatctctagaactgtaacttggagtattaagtgaataaaaaaatggatgtttggcactactgggaaatgatagtatattttgagaaaatccattacatttctgttctctaagagaaataaatcaatttgtgttgtctcttactgaagcagtgtctacctctgacattggcatcagagcaattctattagtccattctcacactgctataaatatgtgaggctgggtaatttatagaggaaagagatttaattggcttacagttccacagtctgtacaggaagcatgatgctggcctctcctcagcttctggggggcctcaggaaacttacaatcatggcagaaggccaagaggaagcatgcacatcttacatggctggaggaggaagagagtgaggggaagtgctacacacttttaagcagctggatcccgagagaactctatcatgagaacagcactagggggatggtgctaaacatgagaaaccgctgccaggatccggtaacctcccaccaggccccacctccagcactgggaattacatttcaacatgagatttgggtagagacacagatccaaaccatatcagcaatacaaagcctttcaagacttctagacacaattgccttctgtttcaaggtctttggaaagaaatgtagaatcctttcccaaccctggctggtgttggttatgagttaggtttaggttgcaggtcacaccgagccagagtgcatttgtggcacttgcagaagtgcatgtcccctaaaatatagagtctagggtggatccccttttgctgaggtcagggcaatcagtactgacaccttgcatcacagcagtgtggatcaaagaagatattgagggttataaaagttatttcttttttgtgttaaaaaaagacttgttaaatacaaacatgggctgaaactcttataaattaatagccaacacccaacaaaccaaaccagataccaaaaaaactagcagaaaaccctaacccccaaaacactgtgtaaagttttctcaagtgaaggataagcgtattcttttgccagatcagttgttttttacagctcaacatccacatgtagcccaaaaaagtgtatccaaaaatgaaaaagagcttgtgcatactatcaacaagtgtggtctccctgttgtacttcatggcgcttatcccaacttgtagttaattttaaatttatgtatcatatgtttagtgtttgtttttcttgttggaatgtgaggaagataatgaagcctacctttttcttccttctttgagttcagaatccattaagaaataagacagtttgggaggctgaggcgggcagattgtttgaggccaggagttccagaccagcctgggcaacgtgatgaaaccctgtgtctactaaaaatacaaaaattagccaggcatggtggtgcatgcctgtaatcccagctactggggaggctgaggcatgagaatcacttgaacccaggaggcagaggttgcaatgagccgagatcacacccctgcattccagcctgggcgacagagcaagactgtctcaaaaaaaaaaaaaaaagaaaagaaaaaagaaaataagacagacatcagacacataaaagtatcagcctaattactgataacttcacttgctgctggtttttataactcattcaaagggggatggagtttttgcaaatttaattataaccttgctggatacacaaaacacaatcacccattcccgagttcttttaggagatatcttaaacatttccagagattaaaaaaaaaactatttaaaatttcttttaattaaaaaaaattatcatatggctcgctgggagtagaattgcaa

SEQ ID NO: 468 - DNA, 88226 bp, Homo sapiens
ggttaattatttatatcagacctcagaaacagttttcaaaaatataaaacaatgggtaaaattgtatgtgtgtgtatattatatatatgtttgtgtatgtgtgcatgtgtatgtatatgtatatttgtaaatttttgcttatatttctctttcctatgtttatatgtaacttgtcctaaaattttatctccattgatgctattgttccagtgtaaaatttgggcaattctgttttaacaattatatggatattagtattaaatctataatttcatatatagatctgaatattctgtaaatatttatggccaaaatttaatggatcatgccagactgctgatgaaaatattgtctatatgaacttttatggccaatcctcatgtttgaaacaggaatggtgtgaaactgtggtacttgatatatagattaaaaaatctgcgtctttcttttctctttctatacataatgatatacacttatatcatcgccagtcaacagtgactttttctgtaaagaactatggatttagtaatagtttatgttatatattcaaattaacacaattggaaaatctacaaatgatgtctttagtggtgaaagttaccaaaatatttttgtcatttttcttgaaggtaagaattttctgaagcacaattatgcaatgttaggcacaattagatggtgcctccatatagaaatcgggacattagggagagaaaataaatattaactagtggatcactcaattatatatatatatatataaaaaattgtatatcaattttatggtgaatacagcaacacatgtagattgaatatataaatatatatatgcatttaaataaatatgtataaatttatatatatataattaatatgtaacctgtatgtgttgctgtatttaccatataaattcgattaccactttacttgggggaaagttatagaaaatacatattaaatatagcatgttaaatttgagacgcagaaaggtgattttcttacaaattttaagacatggattgattgcctctctaccacatcaataataatgtcaattagctttgtggtgacattaagaaataatattggaaatatatattaataaaaagttccatcgatacattgtttcctgcatttttaaaggagattactttttctttaaagagtatgccatatatatcgaaggcagttattttaattattaatctgctcattcactgtattagtccattttcacactgctgataaagacatacctgagactaggcaatttacaaaggaaagaggtttaattggacttaccgttccacatggctggggaggcctcacaatcaaggtggaaggcaaggaggagtgagtcacacctgatgtggatggcaacaggcaaaaagagagcttgtacagggagacgccaccttataaagccatcagatcttgtgagacttattcactatcatgagaacatcacaggaaagacctgccctgatgattcaattacgtcccacctggtctctcccacaacatgtggaaattcaagatgagacttgggtggggacacaaactatatcatttaccaacaaatgttatgtaagaagaactttttgaatgtatttggtacatctcaatatggccaattatctatttttcagtccaatgtacaatttttttatctaaatgattgattcttagaaaagcgagggaaacataatgaatcatataataaggtcactgaaaaaacattattgtattgatagtatttatcgataaattattttattggtcaattattagaaataattgcattattgttatatgtaacagtagttgtcattttttcttgccacatcatctgattggtttaaaatgtttattaaagttttactcttatataaaagctcatatagcagtgtttataaagctagttattttttaaatacatgtgtaaatgtaaatttataagtttatatgtgtacacatatataattattcacattcttgtacacacacattcttatatgaatactaatgtatttgtgtgtatgtgtattacataattgacacaaattaacaattttaaaacaaagttttatttaaactcatgatgattttatttgacttgattacaaggtgtcagcagcaattactgagaagaaattcagggaagatctgagaatatcaatatgcttctcactcataaataatgcagacatatctacaaggcacaatcattttctgaaaattatttctgagctctcagaatgaatagaaatagagtaaaatcagtttgcattgattagatggaaatgacaatgtcaaatgaaaaggggataaattgtaatatttttggtagcatatacatattttgcaatgtaatatacttaaaatatataaatataaaattgtatatattcttaaaattatggtaactttttgtattatttttcttccccctaaactgtcacataaattgtcaatatgatatactcagaataaggtggatggaaccttaagaaaattcttagataactcaaacaataacatgaaaaaaaactttcttagctgatttaaagaagagagtggtaggaagattgatgatatgttcaaatcatcacctccacagtttgatttctttatttcatgactcaataattagcaaccacggacagagtgaaatgtgtgtacaaaaatagactgagaaagctgacattgttttcttcctccatagacaggtgactgatgttgaaatatcatcttgttaaaaggtatacagtgataactgttttaattattaattctcattacttcttacctaggattttcttgtgatatatattttaaaattttatatatatatacatatatttataagagttaatactagtaagaagatttgctttaaacaaaatcttctgagacatactattaatttgagaatagcatttttcattcacttctacaaaacaggcatatgcaattgagaattttctcttaagagtaactaggttcaattagtttagaatttcactagaaattggattcaactgctacgaatgtaattttgaaatgacttgtttgtgggaatttaaattaaaatgccatcaggaaatcactttgaaccatttagaaactctattctcatctaaattactcatctttcttattttcatgttgaaatttcccattaatttaaaatccttttatagagaagtcagcataaataaggagttgttttctttcctgtgcatttgctccctttcacaagtgacataatttcttaaaaactgtgttttaaatatgatcattttaaagcaaagtgctgaatatatgtaggatgtctccgttcaaacactgagtcaatccattgcctaaaggaaagcaggaaatggacaataaagaacatgtctcatttaacatgtagaaacattttatatttgaaatactttgggggaaaaaaattctgtgcccaaactttctgtaatgagttggaagtaaataggaaaagagaaggacctaacgcttattaaaatctaccatgaatccaataattaaaaaaaaaaaagtatactcctttgcctctggtagtattctggcccttttccccattgtttatttacttatgggttttttgtggtttttttttgtcttgttttgtttttgtttttgttttgagatggagtttcactcttgttgccctggctggagtgcaatggcacaatctgggatcactgaaacttctgtctcccaggttcaagcgattctcctgcctcagactcctgagtagctgggattacaggtgcctgccaccatgcccggctaaattttgtacttttagtagagacagggtttcacctatttatgattctttagttatgtgtatgttactgaaggattgcctttctccgacccccacccaccgccacaagttctgtgacaatagtagctaaaagttttacttaaattagctaaattgtctttgcttgttcagctggtggtgattacgtctaaaatttggggagcatttagtatattttattcccaatattctttgccatgcaagttgtcaaaatatgtagacacacaaaaactttctgtctttctgtgttccccatcttaatgtacatatgtatagatgtactacccaggaccaggagtaatattaaaatttggatgaatccattgattattttttgaaattatgcccacaaaagactctatcttaaagaagtgttatttaaaatatatttcaatattctcaaatacctctttcccaaatgtcaaggcatttgattgtttggaggtgattatttatggtaattaaaattccctgtaggttcatcaagaccttcttagattaaaaggaagggacctattctgatatcctaaagataacgaggattttagttcattataaatttcataaacattttcaagttaagaattttttcaatttttagtattgaggaatttagggcttgtccatgtgattaagaagactaacgtatttataagaaattattaactctatatgtaaacctctctgttaacccacacatgagcgaatctctgattgaaagcaattgataactgaataaaaacattataccccttgtgtttgggatctcaagcatgaaactggcatttcatccaacaataacaaatatatgcacagcaaagacttgtgccatgatcaacgttgtctttgtatataaatgaacagatgattattattatatttagctagttttgttactctgtgtttctcaatactgccttaatttccaggagacatgtattagcaaactaagacccacatgctgataacacttttttttcgtagcacttttttggttgtttctgttgtgtttttaattttaattattctgtttcacatgatgtttatttgcctatatcccctcacattttaagtaaatttattaatgaatcctatctgaaacattcaaggtaataatacactcaatgttgaaagaaaataagcctactgagaagagatcttttcttcctatctttaaaaatgaacatattaatcactgcaagtatgaaagtcataagggaggaaatagtggtttagaaactgagatgggagacgacaggaaataattagaaaaatcaatatgtttaaatgatgaaagatcaaagcatcatacttctaagaaatgtacaaatatcaagtagagtagttttcaaaaagcagcattattcttctgggggtggaaaatgagatgagggtatgaaacatgataatagggggcttaaaataaaatggagtgttttgcagagagtgggaataatacagagttccaggaaagaagaaaaattatgacagattacaacattctatttgagagtcttgctgatagcagtgcattgtaaaatcagtgtccacgtgtgtgtttgtgcgtctttgatattcatgtgtgcatgtgcttatgcaggacaaagagagatagagtgatctaattatgtgagtctacacaacactgctttataaaaaataaagtttaacatacatatattctaaattggcaattctaacttctggtgattatccaagatagattaatagagatgtccaaagaaacatttgggcagtcatctttataataatttacttataatagtcctaacctaaaaacaactcaaacttctgccaatgcacaaaatggataatcacattgtggcgtatttgttagcaataagaaatagttatctttgtacggtaaaaatttgtctttcactgtaagtaaaattttctgaaaaaggaactataaacaaatattaaattgtagtgaataatatgaatgctgatgcaattagaagtgcagggtacagtagtctgaaactttcattaaaatgtaccaaaaataagatgtaataattgatgattagaagcatatgtatgcaataaacaaatataataataattatagaaattaaatgataggaatatgtctattagttgtacaattatttcaaatgttatatatatctaaaatattcatgataaaatgttgagttttaattctatctgtctatctatctatccatccgtccatatgatacatgtaatacatataagaatcttaaaaacattatgttaagtaaatgaaatggaacacaaagagtgtatactctatgatgccattaccaagatcaagaaaagggaaaattaatacatgattatataaatcagaaaagtggttgcctacagataatggtagtggtctgaaaaaaaaaaggccctttggggtagtagttacatgagtgtacacgtgactacagtccatcacttgtaagcttaagattttacccaaaagaaaaaagtaaaataaaaatattttaagatttgaaaactactgagatgacttatctacaatataattttaataaagcaaatactaaaaggtgttcatcagaagaattctagctagttgcacagaaaaacagcaaagtataagggacacagaatgagtaatttgtagccaaatcgagatataaagatattttaataatgttctattgtgcttaaaatgtatatgaaattaaagtaagtgattaaaatagcacacaagaaagaaataggcaagtcaagttaaagttatgaaaggtcactgagttgtgaaaatattgcaaaagtactaacattatatagcttgatatatcaaaaattattttgtaacctctacaactgtgaaaagaacaacaaattatgcataactagaaagctattagaaagaaaatgttctataagtagacaagaaaggagatactcagtaataagacttattaaaccttcagtaaagttataagcacttacgtattcagagctgaatcacattgttgtatgccactttatttgaaatttccccccaaaagtaaaacaaattgatggctaaacatacagatggaaaaattcgtaaaatggttatgaactaaatatagcaacataaaagaaagttggaagttacacttaaattcaaatatgtcaatgattacataaaataacattaactaattaattgaaagttaaatcatgtaagattgggtttgaaagggaaaaacatcctatgtcacctataagtaacccactttcaatatgaagatacagaagaaaaggagataaggcaaaaaaataggaacacactacccaaaagaaaactcatgcagctataatactatctgacaacataaaatttaaagcaacactactaaggtaaacagacatatctctaaatgatataaggatgatttaacaaaatagataaaaatattaaatgtgaaaatgcctaatagcataaactcataatatgtaaagaaaaatgtcagaaactaaaataagaaatagttaagttcagaatgacattagaagattataatctgtttcttgtggtagctggtagaacaaattaataaaaaacgtataaggatgaagaaaagttgcttctgaatgagaattataatccaattttcttttttttttttttgagacggagtctcgctctgtctcccagtctggagtgcagtggcgtgatcttggctcactgcaacctctgcctcccaggttcaagcaattctcctgtctcagcttcctgagtagctggaattacaggcgcatgccaccacgaatggctaatttttgtatttttattagagacacggtttcaccatgttggtcaggctggtctcgaactcctgaccttgtgatccgcccacctcaaccttccaaactgctgggattataggcgtgagccaccacacccagcctataatccaatttttatatgtaaaacagtaccaaccactgaagctaattctttttaaaggcccatgcgatatttaccaaaacacaaatatactgggaaatgaagtaagaggatattgtattaccaatgtaaatttaagattgacatcaccaaataaaagataattagaaacaaatcaagtagcatacctctatatatccaagggatgaaagccatacaaaatcaaaattacagaatattctgaactcagtgaaaattaaaatatggcatttataatcttttgttatgcacgcaatgttgtatttaggggaaaattgtaaagttataaatgtatatattaaaaataagaataatcatttttatatcagtatttaactaagacctttgtaaaaaagtaatagtttaaattaaaaataataaaatcaagggagtaatgtaaagaaggcatgcttattacgggcaggcatgtgggcagcatgacagggtccaagcgatgccctgttatgtatgcgcgttttgttttcaataattcacttagctgtgttcttttgaggtgtttacttttttgagagtatgtttcattgtataaaaataatgattccaacttgacctgattaatgtttccctcaattgctttaacatccctccccagatagatcatatctaaaaaaggtggatctcagctgttgtgtcacaaagatttggaaggggtcaggtgtggcactgtgccaggtcctctaattcacagtcacaaagcatgaaaacaagggacaattatgaggaacagttctctacacaccgccagtgaccaagttacaaaaaagaaaaagtaaaacttgtagacatccaggaagggaaacaaaggcacagaaatcaggatgggaatagattaagcagaaaagaaagcaggcccaaaagatttcttgtattggaaaacaagattgtgaggaagtgtgctttctaaggtaggctctcaagcttgatagtgctgggagaaaactggctccctatgaagcaaaaatattttgtttcaacttggtgagagtcagcactcctctggttgtggtggcttcagtcctcttctcctactcctgatttcttgtattggccaacaccttgttgaggcatggctcatggggaaatatggctttgtatttgatctcctttctctcacatgtcagcctctaatcaaagcagtgtcctttgcctacgcttagcacaatgtgtaccacgtcatttcatggttaactatcctgagtatgatctcctagaaactcatgatttcattttttcctttagtgaacattggaacaatattggtaaaatatacacaaaagaagttagatgattcagaattcacagcacatgtgagttatataatgataataatggtaacaaacagtttcatagtcctgaccataaaccagtctctattatgaatgctcaatcaattattccttagaacaggcctattaggtggattctattataaaccccctttatatatgaggacactaaggcaggaaatgttaattaactttctctggtaacagaaaaaataagtgctgccttaaaccaaggtagtttttagttcaaaactatgctgttggctattgggctatgccgcttcttacatatgtagaaacacaaataaatgcgtatttgcttcttcattgcctgccacccaacctctcttttttgcagttaggacccctgagttaatctaatataacctaattttagaatttatcaacccaacttattttttttttttgcagttaggacccctgagttaatctaatgtaacctaattttagaatttatcaatctgaaaaaataaaaaatctttgattttattgtagtgggtttttttaagctagagaaagataacttataaattaattaaatatttacttactagccattcaccttttaccatttaatctcatggctgtatgcatctacttcaggagatgttatgttattgttggctgttttggcagagcatggccattcaaggtaaatgccttcgtttaaatctcaactcagtgatttcctaggtaagcgagatcaggcatataacacaaacctccataagcccaacgttccgctctgtagagataaaatgataattcctgttccacagaaaagtgttgaatgaagtagatgaaaaggcaaaagtccttatacagtgagaaagagagagagagagagagagcaatcaatcaatgcatgaaaagaattataacactgtctttgacactgtcctaggtgcttgtgacaagtacagaagaaacaggtatgatctggcctttaaagagcttccattccagttgagccctgagtaccaagaaattctaaagaagaacaaaaatagcaatcacaagttatagttaactgctaattagtgtggaggaaaacagttgtcaaatttaaatatatatggcttacaaggctctctataatatggtctctatatatcccaacatcctcagttcataagtctccactggggctaggagcagtggttcatgcctctaatcccagcactttgggaggcccagggaggatgatcacttgaacccaggagttcaagtcgagcccgggcaatatagtgagaacccatctctaaaaatgaaaataaaaatgaagaaaaaaggaaaaaaaaagacctcactatatttttctgtttctaattatttattcggtcttacctggatgacctgtatcttacggctacacgttctttcttctaggaatgcctaaactgtctccatgtgtctgcgtggcaaatgcctaactgtcctttgagttctaactcaattgtcattttctattaacttttttgacttgtttacaatgttggcgtatcatttctttagactacactatattaatagtgtactaattctatcacctttacaccaaattgggagatcacatgctccagttaaaattcttatatcttaatcattgctctaataattacttatcaaatgcccacaggcgagttagttaaactctttatgccttggttaactcatctgtaaaataaagacaagcttttaccaaaatggtagtatacacattagataatgttggctggtagtaggtagtaaaccgtaacagctgacattgttgagtgtttactagatctcagatatcattctaaattcctgcatatatcaactaatgcaaaccctgtatatttgtgttattattttccacataccacagttgagaaatctgagttccagggtatgtttaaaatcatgtagaatagccttattttaggacagatagtgttactcaaatgattttttttttttactcttggccagtaaaaaaaaaatatgattttctaaatatataggatacaaagagaaatgtataacagaaaataagaatgatagtaaatattttaactttacaaaatctattttcagaaggataaattaagggtggaatgattttttttccttttggttctgtgaatgaaaaaaatactggttttcattttaaaaagcaacaaacatttatttctaattctattctgagctcatgaaattgcattatgcttcatcagttaagatgtagacacactcttatgtttgaacatgatcaggcttgaaaagtcaaattttctgatttcttaataggcatcactggatggtttataaattcaatctattgtaatgagttcatggaggaaaattatgttgtttaatattatctaacctgaacggagaggttcatcaacagaattattttgcaaatcaactatgttatgttttacataatcatgtaaattactgttgtatctatccattctatgcaatgaatgatatttaaagtaactctgcacttgccatcaaggtttaaattacaagagtatgcagcaggcgtcttatggtaatgtcaagtaaacatgttatcaggcacacttagaaaccacatatataccagtttagtctcatctaaaggtaaagttaatttcttcagccacgataaagaataaacacttacctttgagcacagaggttgatgtgggaagacactaattactttctcagaaaatttgactagacaatattaccatacttggaagttacatttttcccttaaattggagaaggttgtcttccctaaaattgatgtttgtggacctcagattcccctcttgaattttataccttttcttccacgcaacatttacaatgagtgcaaaaactctttcttaaattttgttataaattttacttttatttttccattttccttatttttgtcctcttacagaagaattactatttaccagatttatctaacatattttctctttccaaacccatactgaaacacttcataaagggttcacataaaaatattaaaaaaaaaactaagtatatgtgtcttctgtggtaatgggaatgatttcattggcaagaaatttcagaatttgttaaaatgtctatattaggataaaatcttactgaactttaaatgaatctactgtatgaaaagtcagtctatatttgagaacaactagttggcaggcatgggaaatgtttgaatgcagggaaaaccaactagtgattagtgataggccaaagttttttcttgactggaaattctgtacctttgagaaataactagtggaaggctcccaaactgatcttgtttactcaggttcccaagggagtttacccataagccacagagaatttaacagacaagctgcagagttcttgtgccatgtaagagacgttaagaagtcccagctcttgtaaagaccattcggccatcaagcatgacattttggagacaagacagaaatagattcatggtgactttgatgaccttagtaactttcagtgtaacaaaacatattagaatcattttattttaatctctccagccttaaaattgattcaatctaaccatggtatctaattaattgggttattctgaggagtaaggaagattaatttatgtaacaatatttttaaaaatatagtaacatttcacttatatgttctttgttaataataattattattgctcatatatttaaaaataaaggctatgagctaccagaggaaaaacagagtgatgaaaaggtcaagcaaagaacaaaaccaggtacgattatgacaggttcatggatgatcatgaagaagccagaataggaataaaggagagaagactttgaaatgtagagcattagctcagaaagactttgaatgctaggcagtgttgttcatattttatatcgtgtgtaataacaagctctatatctataaaaagaaccacactaaaataaaaaataatatttgagctagaataaaaaatagtatttgtgtattattttgatggtattactgacttataatgcaggaggctgaagttgtgaagatgaacttcaactaagtgtttcaatgtcttgcaatttcttatgattgttttcattcatttggatgagggcagttacaatttggagtgcaatctgtttccatggagcaaggcaaagctgattgaccgttaatgcaattaaacctatgagcttgcctcattagttaacatatttaacctaaataagcttgtgtgtttatctagagtaattgcccttgcagtcaaaagtttagagtaaataaggtatagtcaacttcataagatttcttgtgatatatttcccaacataaaataattaattttagggttattatacattttgtttttatatgattttctcaccccaaacacttagaaaacctgccttctatgaaatacagcttgaaatatctaaatatcttttgaaaaaggaatatttcatttttagtaaacttaagctacccaagtagcttacattttttctttcaaatcaatatgctcacctgcagatgagctatgaatttctataaatgcactagtatttctgacttgtgtgggttaaatgatgggtcatatattaaacacataatcaggtgattaggaagtattacatagtaaaatctgaaataagtagaatatagtagatgcaatattaatgctatgctggaactgaacattaatatttattaactgactgaaagtataataaaaaaaagttaccatttattgatcagcaactatgcccatggcaatgtactagagacttcatctacagataacagtcagtgaggatggtgtttatttccccattttacaggtaagtaaaaaagtctcagggaggtgaagtattgttataaccccacccactccatgaatgtgagaatcataatttacaagcagaactgatgaatacaaattcaaaattcataccattttgatgttttctcagcatcaaagatgtagcattcacctcactaaaatgaatacatataaaagttattaatatatttaagatgtattaatataaaaggtaatatattaataatatgtaaatgctaagtataatatgtgactattagtgtacacatggaaatacaataacaaaacagggtgtcaagagaaatggctgtcaaactacaggtggttttataagggcgagagaggcccagtcagaaggcacatgcacctgctgacctggactgctgatctgattaccaacaagtcattgctacttcttctacttggtatattttgatcatatgtaatatttcagttgtaaaaagaatgtgcctactggttccatcactaactactggtattatcttcaatgagttttatgcatattttctcattctaaaattaaggatagtcagtgtctacttcaaggctatgctgagggttaagtgctatatgcagaagacttaaaaagtgctggctacaatataagtgctaaaaaacatgactaattttcattgttaatgtactattattcctggctatttattattatattacactctggcaaaatattttactctgtttttattacaaaaagagtgaaatatcaatattcatgttttcattaattttcaatatgattgatatgcaaattcttatcttcacccatttcccaaatgcttacttttgtaaaaacattcaaagatgatatctagtttctagactactaagagaatacaaaatattcctgagatgtgcaggcctaaaacgttttgattacatcataatataggtgagtatgtatgacatagacaagtatattaaacaaatttaaaaagtaattatgcaactttatcacagcatcacgtctgaccaaaactatttctttgattctattaatttactttcaacaatagaagaatttaaaaattgacacaaaacactgtagtattttgactcagccattactacaaagggaaaagtttacttttagtttagctcagaagaaacgaaattcactcaagatttcatgaactatgcaagggagcacagttatttctcttaccaaaatctttctaagtctatttttgtgattagggtacatccagattatggatttttgtttgtttgtttgtttgtttttgttatcccaagagtttggaaccaaggcctttattcactcagtaattttctcctgtttctcaaggcaggttgaacaccgctctggaagcccacagtccagaggcacgatgccagcactcaagtgatcatgtgagccaacataaacacagaattacaaactttataacacttaagtgttacaagtggcaggtgttaaacaggaatagcacagctatgaaaaaatgcaatataaggaactgattaaactatgatgtagtaagcgcagggcaacatgaaaacatactggcctttcatcgaggagtaaaatagagagactatgtgattactttatcaattaggggtgttttgctaacttgttttggataacctttttaaccaaggtttctcaaccttggcaataatactgacatctggactggacaatactgacaattggatccaactggactgacaattggatccaatccaatactgacaattggactggatcatcttttgttgtgggggctgtcctgtgaattgcagggtgtttagcaccatgcctagcctccaccttctagacgacattagcactcagttgtgacaaccaagaatatctccagacattgcctaatgtctcttgcggaaatctcctctaacaaattgtgaatcaatgggctaaaatagcaaaaaataaaacttacaatggctggtaccactagaatctattttgctcacagaagaagaggctgcttcttctattggttcattaaggactctaagattctcttgcattttctcattcttatgcttaacgtcaagcattatgtccacatctgaggaaaagaaaaaagaaaaagaaggtaaggaacagtgaagctctacctgtcccttaccaggaaaaccaacattttcccttgccttgcacatcagcctaattttgttaagctcttacgagtgggaactgtgttttatagccattcctagttcctagagaagctgactctctttcccatgtctctgtcatggatggagaacagaaaaaagggatatttttggaatggatattgtgttactgaccaagtgccagccatgctttctaataacttctaaacatttctcttataaaatatttacttttaattatggatttgccttttttccacaatatatttatgttcttattctcaaatccactatataaataatatattttaagtatctagttttaattgtaataatttaacgtcagtggatagaagatgtcatttgactctatacttacatattgtatatacccacatatatatatatatataatatgtatgcgtgtactcttattcaggtgatattcttcaaccaccccgttcatcttcatcaaagaaagatgaatcgccatcattcttttgccatgttcatttttaccacttattctatgcttatcattttgacatcacagggatatacattatattttttcttattaccaagtttttaagcacttaactacaaaatgtcttctcatatattgaagtttatgacatgtctcatagtaagaaatcagtattgtttgtggaataaataaataaatggaataggctagtatggttgactgataattatagtgaaatctttgttaaaatgtcgttattcttttaagatgtgcacggcaccacagtgttgaatcctaatggtaccatctcatatcatcaaaagctttttgtagcccatccaatcataaaataataccaagttcaaaaaaaaaaagaaacaaagttacatgtggatagagaatgtgctataatgcattagtgccttctcaattaaaaaaggagatcagtaaatacgcaaacaccactcacaccagaaggtaacatttctgtcaaataaagcagccacttagagtggatataaaagattaatgctttcaccagccttcaccactcagctttctctctcactctttatggagtgatggaaaaaagtaagcaataaatcaatcaaaatgatccagtgatatgtaatacaaacattcctgatttctctccttcttttctttcttatttattagaggaaagataaagtttcctttcaggtatgtagccctgggcgtcccactattaggtttgtcttacaaaccctggtgccggtttgaggagcagaaacagcctctgctggaatcaaggtgttgacagaggaatatctggtacaattgattcttcagctggtagactttctttagctgcctctcttcttccaaagggaaatggcataaggacgcaagcacagaaataaaaatagtcttcaggagaattaaaaaaaaaaaagcacctcatgacgcagtaatttggtctttctttttttttttttttttttggttctatggatgttcttgaaatatactagagacacatgtgcccagcttcctgctgagcctctctgtcctgcagacatctgagcaaaagcagttgctggcagggatttttcccagtcttctcagaagttcactcctgcacagtagggtcttagaggaaaaaggattaaagtccacttatgtagtctgaaatatgtggatgtagaatcttgtcaaaatacatgtctctgactagaaaggcagctggcattaatacatttaacatacaaggagaactaccccctgagtaatggttttcagtctatttgttccactctgacacataaacagacaacactcacatatgtacgttatccaaagtcacattgaatatccagtgaaagagtaatatgattaacagtctccaattcattcttatttaagaaagggtaaaatgttgcaatttttgatgttttatccttaggaacaaatagcgtatcatttatttcaccattacctgatacattagtgagttgtgacacttgggtgagaatttctgatacagaaggcgatatcttgaagttactttggaaaaacagctattctagtgcttcctgagaccacagttgccctgggaaactcttggtagcaggtctgctttgtttttattgtaagaaaggtcaaagacaggaattttgctttcattccctcctctggacctttgaagaagtatactttgccaaccctttctgaaatcgtaggctctacgtgttctctagtttactttgtttcatgaccctgcaaaatagtcattgcttctagcacttgttttacattttttgtcttctagatttctcaaagatataaggagactgtgtgtgtgtgtgtgtgtgtgtgtgtgtgtgtgtgtgtgtctccttgtcgtggagtacttttctagaagagagtagaaaaataatgactttacgttataatcttcctggatctcagactagaatttagattgatttgttatgaaagggagacagccgtatatccctttaagtaatccattaatttcacacctattggctacggcatctgtcatatattgagttacacatatccctgaaactttccaactctaatctagactcaattactctatttatgtaagtaccagactgcaccgtgttaattacaatcttgatattctttaaatcttgatatctatcagcaatttttggcactttactttttcttatgaatttgtaaaatgtcttatggagttccaaaaaattgatgtattatttttaattgtattgaatttatacattaatgtgggtagaaattgatgcttatatctcttcatttattcacatttctatttttgtccttcaataatgttgtgtaatttttgacaagaattttaagttttgttacatattactattaatcttaatgctcctgattctattaaaaatacattctttttccaaattttacattttctaattggtcattactgatatataatggttcactattgttactgagagtcctgaaaaattttcctttgcattattatgatttgacttttgacaatctatgatttttttatgtagaaaattaaaacatctgccactaaataaagttattctcttccatccacatcctttttctctctttttatatctttctttattaaatcttcaataaaaaaagcattagacattaattaagtatagtgagattaatgtacagaagtcatggggaaaaaatagattttccatgatatgagtatgctgcaaacaagatccaacctcagttagtatttattttttaaataataatctcccctctgtcttcaagttaattccactaattctatctcaggcaatcaagttgttggtggaagtttttatcatggctcatttttgttctttctgaacattcagcctctgttcatatctgatctggtctttgtcaccagctcaaaacctacctaatctcaaaagctttaactttctcagaccaagattcttgctctcatttgatttcccatagcaatcattttcagggcaattttctgaatattaattatgcataacaatagaacaattattccactgttacaatgtgttatgtttaagacataatttaaaattttcaccttgatatgttgcttctcaaactgaattttaaatgctttgaagcaatggactgctcactgtatcttccccactagtcaaaggctgatatttactgaaacagacactcatcaacttgtgttcatgtttcttctatggccctcacaaagctttcccaggattctttgaaaatgtagggatattgagtgaatactttcctaaataagatacagaatttttcattattttcatagagcaagactagtggtagtttttaaaaatatagtgtatgaaactctgcatttaaaaaaattatcttgagtatgcaattttttgataatctaatccagaaataaacaaatttcaaaattaaggtggggaactttttcaaaaagaaggatttagtgcataggctcatacttttcctctcaaactgccccctgtctcaaaagcaattttcatggaaatttcgtgtgtgtgtgtgtgtgtgtgtgtgtgtgtgagtatgcatatatatacatacatatgtgcatatgtgtgtataaaaatatatttacatatatgtatatacatttgtgtatgtttacatgtgtatgtataaaaatatatatgtatacatttttttcacacctgatttcccataatgtaacttgattttactctatgtatttaaaattatttgtctcattaatataggaagcaaaaatatgaaagaataaagactagagaggtaggaggatgaaaagatcccgatatgttatagactgaatgcttatggccctccactccaaatgcatatgttgaaatctaatccccaatgtgatcatatttggaggtagagtacattttgggggtgattagcacacaaggacagagcctttatgaatcgaattagtgcccttataaaagagactccagacagctctcttgtcccttccaccaggtgaagacatagagagaagtcagccatctatgaaccagacaccaaatctgcaggcactttaatcttggaattcccagcctccagagctgtaagaaataaatatttgttgtttaagccattcagtttatgagtttatgatatttttgttatagcatactgaatggacaggaacaccacatacttaggatttttttttaacaggagagtatagcttatgaaaaaagaattaagaaatcaaattagatccttcagaacaagaaaaatgtcaggaatttaggggaataaatgtaatggtgaatgggaaatgaagataaaggaaaaggatgctgactgtggaaatgataaagggaaactccttaagtaaagaaaaagtgagtggagaaacttatggccaaagggtcaaaattgccacatgtgaaacatttccaaactgatttcttattactaaatgtgaaataatttgggtgtggtttttgggtgtattaaattgttttctctctgtggcaagactttggaattcctttcatttttgtaggaactgtgatgttttccagtgttgtcatacattgaattcattgttctgaatttcttgcaaggacttgtgactaccatagttctaagaatttcagatccccctaaaaactatcacttgttaaccttgactctagattctatataatatatattctatatgatatattatacatattatatattatagtataatatataatatgcatatattattatgtgtatatataattatactataatatataatatgtataatatatcacatagaatatatatgtatatggagagagatacacatatgtttcttattataaggacagctgatttgggacatacctctgaaatatttcaattccactcattttgaaacttaacaagggattgtggttaatcataaataaatggattttaaagaagtacattttttcacctttactggaaactgaatttttagttatgtttgaaagaattaagcttaacactttccaagggctggacgtaactgtcagataaagagaaattagaactacgtgatgaatctactgaaagatagaccagaacctttctcattcagtcatgctctagttgttaaactaaaccctgttttttgatttgggctccaaattcatttcttttattatttaagtgaaaccttatgacattcaaaagcaacttggagttcatctgcaaaccaaagccatgagaagagaaaaaagtgggctgtcactttcctgactgtggctgatttaggggtctaagtgctagtgcttctatttttcttcctttatttcaatttcctggctagaaactggcattttccacttacttcaccctttctgatattggcacataccatacacaaaagagtggccacaattttaagtcatcaatcttcatgtaatacttaatctttaagggtaaggataatgtatttaaaatttgctggtgaaaaaaatgacacaaaatgatatcttttacttttgagatctagaaaagctttaggataattgtacaaatttcacaaatatattttttacttcaaaaaaatacaaaaaattgcaacctcgtcctcagtttccctctctctttctccttttcttcctttttagggtcccaccatcaaactccttcttacctcttagtcttttatgtatgaaatgcaaaatatgaggaccaatatgaataatggtccccctaatttcccagggaaaagtaatctatgctacatttatttgacggctggatggatgtctctctatatgagaaaatattacatgtcataaattctaaaagctaaagtgattcttacttctttcctatcctgaacaatcagcttaagccacttatagatgggtcttaatctcctcaactgagatatgttgaggtttttcctttgttgatcacaaagaggatcttagatcccaaaggatcttagataatatccatctatgtactacagaaattctctattttcaagatctatatagaatgggatgtggtgtttctagcccctggtttacaagctctccccaccttcttctttcaatacaaattttacaaataacaacatctatcatttttaaattgattttggtgcttttgatttcattctcctacaatattagtgacctgaacaatgtttccttatgttttaatggacatttgaatttcttttttgggtgtgtgtaaaacgtttgtattttggatggtctatttatgctaatgataacaatcccctttcatgcttgtggcaaagattttccacttattgaaagcctactgttaattgctaattttatctatcaatttggcgctggtactcagttgtctggtcaaacaccagtccagatgtgactgtgagatattttttagatgtgattaacatttagatcggtagattttgagtaaagcggattaccttacataattggcctcatctattcacttgaaaaccttaagagaaaagacttaggagttccggaagatgggatttctgcctccagactgtcttcagactcaagactgtaacatcaacacttgctgaaatttttagcctgccctacagatttagaacttcacagccccagaaatttgatatttgcagatggaaaaataaaggttagagataggaagttaacgaggcaccaatcatagactagggagagacaggggttctgtgtccagcagaatctgtgccttttttgattccaaagactgtgttctttctattgtgttgctctgcttaccttattttagacattggacgccatagaagtaactctttttttttttttttttaaactaagaaaaaataagtattttgcaggttaggttttttcccttagtaaataacaaatgtttcatgtttgtgggttttgtttgcttgcctttcctgtttgttttctgaattaaaaatagaatttgtatcaaaaagaacaattatggctgggcgttgtggctcacacctgtaatcccagcactttggaaggccgaggtgagcggatcccctgaggtcaggagttcgagaccagcctgactaacatggcgaaaccccgtttctactaaaagtacaaaaattagccaggtttagtggcgggcgcctgtaatcccagttactcaggaggctgaggcgggagaatcacttgaacctggtaggcggaggttgcagtgagccaagatcacgccattgtactccagcctgagcaatagagcaagactccagctcaaaaaaaaaaattatgagtagcttctatacctaattatttattttatacaccatatgctttttaagggagccagaaaatcacacaaaatgtgtccaaaaaattcagtgatggaaattttcccaaagatatggacagagtgagggagattaataggaaatggcgaaacaattcatttgctaacaaaaataagaaactccctggttctaaagaaaggtgccatcggagttgtcggaggaaacacaaagtgatctgcagccgcaggaaatggctgtggataggagctgcaatgtgaaaaagaggagggcacctggtcttatatggagggaggcaggggcataagtaccccaaattttcactctttacactctcagcatacagatttctcccactaagtagaagcgaatggtctaaaaaacccaaccagtccactccatcaattggcctgctctccagcatgcaaacagtaatgagtagtatgacttctattttgagggcaaatagagaccgcttagcacatcgcacacaaaagagtttattcactaaaaggaaaacaaaacgtgactagtttttgctctactcccttagaattttattagtgtgatatacaaagaatggctgaaacttccaaagtgtattacaaaagtaaataattcaggtaattcccagaatatgtcatgaatgccttaagaaaaacagataaataatgatcaaactgtaaatggtttccttttgataaatcactgtttctgttctcaataattttaggagtctttccaatcctactggccttagcttacggtagtttcagcctcacaggtaacttccgttttgtacagcgtgacagtattgaaacgagcaaagccgtgtcttctacagacccatcaactgttgtttccatttctatttcacctgcccagtcatcccactcacatggcctttgtcctgtgtgcagttgcttgttttctatatcaaagctagttataaggaaatgaaatgacacatccagttgttcccaggagtatagataactataatcataccaatgtgttctgaataggtgacaaatgtctgatgggtgctccagacatgggtgctccccaaatgtctgatgggggtatgagagatgacacaagagctctagcttactgaaaggttgtggaactggtaaacgcaggattaaagaaaacacacaattcaagaaattctcagaacttttttttttttttttcagaccaagtttcactcttgttgcccaggctggagtggaatggtgcaatcttggcccactgcaacctctgcttcccgggttcaagtgattctcctgcctcagcctcccaattagctgggattacctgcatgcatcaccacgcctggctagttttgtatttttagtagagataggggtttctccatgttggtcaggctggtctcgaactcctgacctcaggtgatccgcccaccccggcctcccaaagtgctgggattataggtgtcagccactgcaccaagcagaactttttgtttgtttttcagccatgcttatcagagcatattttttcacaaagctaaggatttacaaagcatgtttgcatgttcgttaattccattgcactttaggactaccttgaggaagaattggcggatagcttctttctttttacatacatggaaactcacatcttagagaggagaaatcagattggggtcacacagctagtaggtaatagaactggtggtttccacaatttacttaatttggaaacgttattaaatactgcttaatgtttaaaagattcttactttccagtgagtgctatgagtcagttatctataattatactatagaactctgtagagtaaacaaaacatggtttgaaatactgtcttcatatcagaatcacctacaaatctttagtagattaagactctttgagagtcgcactaagacccttcccatgtacagtccagaattttaagtcagttaactaaataagagttcatagcaacattttattgtatggtcataccataattcattttccttcctgaaaaaaatataaataacactattggaagtgggagatatggagtaggaggaaaagattggcaatctaattgaaatagcaagaataaaatctatcttgaattggagaagcatatttatacttccactaaaatttatcaagcattttgagaatgaatgatgacagcagtattaacagttgacatataaataatatgctgtaagaatttagcttgaaaaattattttatgagttttcttgcattcaaggtttctgacatttacagtaaatcttgggatacatttctcattctttattttcctgttttcatttttaaacatcatggatatttgagccactacattatgattcacagtaattcctgttagatttcttcattgcaaagctgaataaaacaagtatttcttttgaattcttttaaataagtgaaatagctatactttgttgttatcaaggcttaattttgggtggcaatgcataaaaatttcatatttcaaaccataaattacttaaaattttctgtgtgtgtatctagaaataccttccttctgtatatcaagaaaaagaaagttcactatggtaaaatttatttgcagacattaaatcatgatttctttggacacatttatctatataccaattagagaggtaatgattcacacactgagtgcttagtaaatctgagttatcaactggggatgtgaatattctactatgccttttttgttctattactctaaatttctcaaaagaattcttataaattctctgaatttataaagatctctaagtttagtgaataccttaactgcttatgatttaacttaactctgtcaatgataaagaagtatttaatatatgaaggacataatttcccaatctcttagtaaattaactctttctgtgaaattactatgcacttatttatcagatatttatgaaatgaccattaagtgtgaatcactgcatgtgtgtccctatgactgttatatagataaggaattcagtataagtattagatcttgcacaattgtgaaaggatctccagaagtgatagtttaaaaggggaaatggaagatcggaggagtcactaacaagccaagcagagaagctaagctcttctagctttcagagtggaagagggaaattgcatgtggcagtctatgggaagctgttgactttttgtagctatcacttctgttgattcacagtcaagttcctggtggtgctctagggttcgctgtggtgaactgggctacgagttggtcagaagagtagaagaggagcaaaggacagtaatgacaggaaggaacttattagagacctctgcgtttattcgtcaccacatctgagtcttacagtgttcacagagtaatggtagttgtttttactctgccttccaaatatgccataacttccacttttgactaattctaaccacctattacatagaaccatttaaaaaccacctccataataattattttacttgtgagaccaaaaagaaagtaagccaggacaacataatgagacttcatctctacatctctatttctacaaacagaaaattagttgagcatggtggcacacacctgctctagctacttgggaggctgagcctggagtatcacttgagaccaagagttcaagactacagtgagctacgaccacacctctgtaccccaaatgtgggttagagattgaaaccacgtctccaaaactaaaaagaaattatgttttaaacaatttattattttttctgttactcataccatatatcagatcagattccccggaagtaacttctaagagctagatttatttgagattgatttaataagaagtgttcataggaaactctggtagaaaagtaggaaaatggaaccacaaaggaaaggaggtcaagaagagatgtgatatcacacaaagttccatagtgggcaactttgggtctgtgctaaaggggagctgtagaggaagtataggtcctatctccaagtggtcctgattagggcaaaggaactggaatactaatgttcttgcctctgtctgatacttattaagagatgcacgtggaagaaatgtacatatacaagctttttcatattcacagaatttcaggaaaagtacactctggaagtttgttggcagtcctcgaacaaagggagacatagccatggctattggtactgaaagcatagtggccaagggatccacagggaagtggcaagagcatctttccacaagtgaccctaatcctaggtaatactcttgctgctgtaataagtaatattttttaaaagtatacccacataagaacaaagaaagggaaaccaaaaggtaaaaagttggtggtgttttgttctttttaaatttaaaaacatgtaacatttttctgattttcagaattttattgaatatgcccataaaaataaaaaaaaaagagagaaaactaaagaatggtgattgtggtgaggtggttaaagcttttctgcagatgtgttaagtagaattcaggagtccaagtgaggaaatacatgccctattttatcagttacacaatagtccagtttctctgtatactattagagcttaaattatgacaacagaacagtggctattaatgggttttttaggacctgaaaatacacaccatttcccataattcaatttgctatatgaattatttgatcagttatcacaagcctctaagagaaaatgaaaaagaaatttaaatgggatccttgacagttccattcaccattggttgatagcaaggttatcttttttattgaccatgtttattttaggagatgacattctgttaatacaggacactgtatcaaacaacagaaaaaaatctaaacatactaatcacatgaaatgtgaaagtgaaataagatactcttatgaagcatattttatcttcttacggactgattttgtgattggtacttttcatgcaagtaatttattatgtcaaaactcaaaagaaaattgctaaaattctgtaacacaataaaaaaattctacagtatgatgggccatggttttaatggccatatagataatctatgttataaagataaattgctatattctgtgtgctcttttggaagtgagtctgccccagaagaggaaaaatatattcctatagactatagatgaattatatcattccattacaaaggtgtcattgataaatgttttaaatataggtatatatgggaaaacatttaccaaagataacagtttgctcatcaacaagacgacatttatgatgttaggtttatctacagaaaatgtagttgtatgactctctatgaaagctgacttatgttcatgtatgtgaggataaatatctgcaatttacttatatcttaaaaaatgttaagtatgctataggtatcaaatattatattgtttccttttttggcaggcacttataacctttatttatttaatgcataagaaaagtatatttctcttatcctctcaatgaattcttttctttttttatttttccataagttattggggacaggtggtatttggttacatgagtacattctttagtggtgatttgtgagattttggtgtattcatcacccgaccagtatacattgcaccatatttgtagtctgttatctctccctcccctcctactcttctccctagttacccaaagttcattgtatcattcttatgcccttgcatcctcatagcttagctcctgcatatgagtgagaatatacaatgtttggctttccattcctgaattacttcacttaaaataatagtctccaatctcatccaggttgctggaaatgctgttaattcattcctttctatggctgagtaatattccatcatatatatatacatatatatatatatgtatatatacatatatatatgtatatatacatatatatatgtatatatacatatatatatatatatgtatatatacatatatatatcacagtttctttatccactcgttgattgatgggcccttgggttggttccacgattttgcaattgtgaattgtgctaccataaacatgcatgtgcaagtatctttttcaaataatgacttcttttcctctggatagatacccagtagtgggactgctgaatcaaatggtagttctacttttagttctttaaggaatctccacactgttttccacagtggctgtactagtttacattcccaccagcagtgtagaagtgttccctgatcaccacatccacaccaaaatctaccgttttttatattttgatcatggccattcttgcaggaatagggtggtatggcattgcggttttgatttgcatttccctgatcattagtgatgttgagcattttttcatatggttgttggccacttgtgtatcttcttttgagaattgtctattcatgcccttagcccactttttgatgggattgtttgttttttttcttactaatttgcttgagtatgttgtagattctggatattagtcctttgtcagatgtataaattgtgaagattttctcccactctgtgggttgtctgtttactctgctgactgttccttttgctgtgcaaacactttctagtttaattaagtcccagctatttatctttgtttttattgcatttgcttttgagttatttgttatgaaatcctcgcctaaactgatgtctaggagggtttttacaatgttacttatagaatttgtatagttccaggtcttagatttcagtccttaatccatcttgagctgatttttgtacaaagtgagagatgaggatccagttcaacccctcttacaatagctgcaaaaaaacaaaaacaaaaacaaacaaacaaacaaacaaaacccttaggaatatatctaaccaaggagttgaaagacctctacagggaaaagtataaaacactgctgaaagaaaacataaactacacaaacaaatggaaacacattctgtgctcatggatgggtagattgaacatggtgaaaatgaccatactgacaaaagcaatctacaaattcagtgcaatctccatcaaattaccaccatcattcttaacagaattagaaaaaaacaattctaaaattcatatggaactaaaaaagagcccgcatagccaaagcaggactaaggaaaaagaataaatctggagtcatcacactacctgatttcaagctatactataaggccatagtcaccaaaagagcatggtactggtattaaaataggcacataatccaatggaacagaagagagaacctggagataaatccaaatacttatagccaactgatcttcaacaaagcaaacaaaaatatgaagtggggaaaggacacctttttcaacaaatggtgctgggataatggctagccacatgtaggagaatactgtttccttttagtggtacgtattttaagaagtttccactaagttagataagcgtaatttgccccaaagcagttaattgcttctgtttggattttggttttgttttgttttgttttgtttttgtgacagggtctcctccgtcactcaggttggagtgcaatggcgcaatcacggctcatggcaatctcaaactctggggcgtaagcaagcctccatcctcagccttctgggtagctgagaccacaaccatgtgctaccacacatggctaatttggttggttgattgtttatttttttattattttattttattttattggtagagacagtgtctcactatgttgcaaaggatggtttgaactcctgagctccagcgattttcctgtcttgacctcccaaagtgctgagattacaggcataagccaccatgccagggctaattgggattttaaaaataagatttaaatttgtaaaaaaacaagtcacatttccaaaatttctaaagatgtatcaacataaactaggaaggttaatggtaaaactatgattgtatatcaaaagtttttgtgtaaaaaaggtcaaatatttggattttgtaaaatttagtttttgttattccttgaaaggggataagatatactgttttcagaatgttgctttacatatactatttaatttaattttcattggaaccttgctatttactcattgcagctattaaaactaggatacattatttcaagttatattttcttgttgttggtggcagggtctgaaattacttgaatcatccacatttgggattttgtaaattaaaaaacaaacaaacaatgttttccttggtagtttattaatctaaccctccttccgtctctttgttccttccttcatggagtgtctgttaaatgcctatggtgtgccaggcattattctaggaaatggtaaaaacaaaacaacaacaacaacaaaacgataacaacaacaactaaaatagatatacctgctttcacacaaaaaaatcagcctgatggagtacataaatggtaatttttaaaaatcacaaaacctatttttacgaactgcaatatgtacctggtgtgtcaaataagcacataacaaaaagatatgccccaccctgtgaagccatggaaaacacacccacagaagcatgctgaaatatccctgatttgacagggtggactaggggattggtgtgtgggggggcatgctggcaaggcaggcaggtgaactagaatgtgcagagcccttgaggtagccacagaaagacacatttgaaaaactgcctgtccttgtggatatcacaaaggaatgggtgacgggtaacaaggccaaggtaggccagcaaagactgactaagggaaggacttgccacaggctatcctaaggattttcgccttcatgctaagaaaaatgcggcagtttaggtggatcatgctggaggaaagagtttgattttgaaattgttgcatttcaaatgcctttgagataccaaactgtaaatatggactagtcagatatattgtcctgaagatcagaacagatcagaacttgttagttggatatattgttctggagatttgtattaactctgtgtgatttattttaactgtgagtgttctgttccatccacacttattccataaatatgcatgagatagaacaagtacacttacacagagttcatatcagtctatcttatcagtcaacatatataatgtctaaacttcaaattattttcatgagtatacctgttgtgtgctaagagacataattaggaagctttcagggaaaaaaagcggttttctcaatagaatcttctcatctgacagatgaatccataattttatatagtttttaatgtttgatatttctgagcaatgatcacagagtttaatgggtttttatgtaatacatttctaataggtcatagttttatacttcataaaaagttttgtttggcattgaaaaataatatttggaaacagattgacagcactagaccagcttatatgggaataatttaaaatttataagcttatttaactataataaaattgttatttaatatgcaaatatatattagatacctatatctacctatcctatctctaaaacttcacatatgagaatatatattcactcaaatatctgctttggaaaatataatttttaaaaaaaacacttagtttcttacacagagagataggtatgagtatccagaactgtcaaaaagtgtgctttcatttgctaagtattaaccagcaatgttaaattaattataactgatttatcctaagtaaattcagtcatattgtacatttagtaaaaaatattgacaaaaaccttcttttctagaatatgatagatcatagtgggctaataattacgtctcatctattagaaaaagctggaccaatttttaaaaaatatatagagatatcagaaatctctgagctagctatagaaagtataaaaccaatacaaggttagctgaaaatcactgacaattttcccatttaggaggcattttaggtgtgagtggggagctgcttcctaaaattgttacttctgtgataccttcatgtttttttttacttttcgagttacctaggtaacagttttatatctagttaaaaaaacctctttatatcaatttatttctgttaaaaaaactagtgtgatctatattttctagctggagtttgactaacaggtggaatttaacatgtatttaaaacgaggaatatccaaacaaggatctctgagaaaaaaatatgaaatgagaaataatagagtaaagaaaagaatgaaatagaattcttgtagatttcttcagttgtgcatatcccctactgagaacatgatactgctctaaaattaatcatgctgaataattattctataattgcagattaattttctttggtaaatgtgatggttaatattgagtgtcaactcaatttgaaggatgcagagtattgtttctgggtgtgtctgtgagggtgttgccaaaggagattaacatttgagtcagtggactgggagaggcagacccaccctcaatttgggtggacaccatgtaatcagttgccagcctggttaggataaaagcaggcagaggatcgtggaaggattagactggctaaatctgtcctccatctttctcccgtgctggatgcttcctgcccttgaacatcggactccaagttcttcagcttttggactcctgagcaaacaccagtggtttgctaggggctctcgggccttggcccacagactgaaggctacactgttggcttccctacttttgaggttttgggactcagactggcttccttgctcctcagcttgcagacagcctattgtgggacttcaccttgtgatcgtgtgagtcaatactccttaataaactccccttcatatatacatctatcctattagtcctggccctctagagaaccctgactaatacagtaaagattaagctgaatgttagagctatcactcatgtctaacgctgctttagaagggataaattttcaggtgtgtttgtaagaaatgtgcagtgatgaagtaagtagctaacccattttgtggtatcctggatgtgaagaaaagacaggaaggcaattttataagaaagcaaaatagaaaaaaacaatttcaagatgtaggtggatgttttaattaatacaaatagcttttgagtcatgttcaaaacaatattgtaactattttagtgactaaacattgtaataatatttactggttagtaatatgatccaccatgaacacccaaaagcagtcttcaattatagcaggtgtagggagagtgagcttaaggattttcttttagattgtacaatgtaggtgtagaaaatagacaaatatgaagtacttttgttgtaatgcatttacctttttagcaaataatttatatagatttccaaacagcgtattttaaaatcacatattatcagttttattttctctgtgtacccaatcttttcaactaggaacgattcttaaatttcttctcaatatttaaaggagtcaaagttatttgtcacctctccattgtttccataaaataataagatttatattaaggcagcagaaatgcatgaactagaagtaaaatatgtttagctgtcaggacagagtggggtagccaattttggtatccaactcactgagcttttcaacatatgtttcaacatctcatgacttgttacttacagcacaattcacttgactctccccatcataaaaataaaaatatataaatcattcatcttcctagattttcagacataaacctggaaacatctgtggctttttggttcactatgcaatgttcagaccagtcatttagtgtttgactccccacccaaacaccccatgccctcaattctagaatctgtttttatatgaactactacctgtccaaacctgaatattttgacagagttttgggttacttttttagttttcccttgataagttttactattaaaccaggatttcttaagctaatgacagttatgacctaaaggcagtgaaaagcaccagtataatatttaagactgaaacatctggtacaggaaagaccaagaaaaaaaaggaaatattttatcactaagtaaaatgcaaggtctggaattgtaaactgtactcataagttgtttttaacttcaaggtttttgttgttttttaaaaactttattagtagtaatactattcactgctcactgtctcaaagtcaataaatagatgtattcagagaaatattttggtaacatggcgtatttgtctgttctcatgctgctaataaaaacatacctgagactggggaatttataaaggaaagaggtttaatagactcacagttccacatggctggagaggctgcacaatcatggcagaagacgaaggaatagcaaagggacatcttacatggcagcaggcaacagagagcttgtgcaggggaacagcccttttacaaaaccatcagttctcatgagacttcttcactatctcaagaacagcatgggaaaagcctaccccaggattcaattacttggaccctcccacaacacgtgggtattatgggaactacaattcaagatgagatttgagtggagacacagccaaaccatatcacatgggaatgaagcaagagaatctggaggcagaaacggctgtacaatgatataaatcctattggcagaatgttcattgagaaaacaagaagccttaggattttaaatgtgatgaacataacatgttactatatggtctgaattgcttttaaatgagtctttttttataagctatttattttcaaagaacctgtatgtataaaacaaggagataattccagattttctctattatttttctctcaaaaacttagctctaaatacagttgtctctcttaattagacaccatgcaacttcagattttagtaaagattctctaaccaacaccaaaaaaaggataaccactggcaagtatgtttctctttatttggcttttgttgcccaggtcttaagtggaagcaagctttccttaaaaaatgtgaaccaggaagaccaaacttacagagaagcctgagacatattttagtcattcattcatacatttaatcctttaacaaataaaaccatttcaataaacacatcataacagctgaatttaaaaaataaaatctctcttccctaaaggaacttacattcctatagaaagacatgatatgcagatggccaatatagtattttacccattaaaagagaaatgactacaaagtaaagcaggagaatcagacgtatcaatgaggactccctagtaaaatgtacagtcaaaatctttcactttagaggtaagactttatgtcttttaactgggttttaaaaggatgactaggagtacatcattcaaataagaccaggatgatgttttattcagatgacaatatatttgaacaaaaccagaagcatgaggtaggaagaaagcatgctaaagaactgagtagtagttttttaaaaaacaacttttgttagagcaagagtcaggaaaatatactcattggccaaatccaccctgccaccggtgtcaacatttattggaattctgccactcattctttcagtattgtctatggctacttgcatgctataaaggcagagtaaagtagctaagctagagacagtatggccctcaatgcatcaaatattgactatctggcccttcacagaaagaaaattgctcacccatgattaaagaaaatttgtacctaaaggaaagcaaaaggaattgttatgtccttgatgatccactgagggagattaaaggaatgcgtaatttgaacccatctgcatttccacaagatcagtgacagctgtgtggagacttgttgtgaacagagtgaggccaggggcttaaaaacccctgaaggaactattttcatatactcacatgaagacaattggtatcatttgtacgagttagggtccattcaaaaaccagaaattgtagaaattatactatgtgtttccacaaagagatttcagaaaaggaattcatcagaaagtgttggggaggccacatgcagtggatcaagcctataatcccagcatttagggaggccgaagcagatggatggtttgaggtcaggagtttgagacttgcctgaccaatatgatgaaaccccaactcgactaaaaacataaaaattagctgggcatggtggcgggtacctgtaatcccagctacttgggtggcagagacaggagaatcatttgaacctgggagggggaggttgtgtgagtcgacattgcgccactgctctccagcctgggtgacaaagcgagacgtcatctgaaaataaataaataaataaatagatagatagataaaataaaatgttggggagttgaagaggcaaaacaaacaccaacaagcaacgccgaagcaatgcagagacagtaactgcaggaaacagcataccacctcctcccgctccccaactagagtgatggggtggtagagaagttgtttaatgtattaggactagaatcactgaggagccaatcctcagaactgagtcagccatcctcagaactgagtcccagctctaacaggaggagctgtctacctggtgctggtactccaggagctcagaggaaggaccttgcagggttaggactctgaagaagggcagtgcccaaatggtgaagtactcctgaggggcacatggaggctggttccaggactgcctgagaaagatatggtttctccctgcttaacatacacattttgcaccgattatatgacagacattattagctagtagttccccagtagtgtgctgttacaatcattaaagtaacttttgtttctcacttacttttttttaacttctcagttcttacctattttaccacttctttggtagtaaaatgcttatgtccaacaattgagagaaattgctttatgagctagtaatactttttacaaaggaaattcaaagaacttttctatattttatacatagtccatgagtcagatattctctatattttattgactgaacacctgaaatcttgaaagtgtgaacatttttttttcctaaattcagataactttcagtagcttcaatacagaccttcagattcacaggcactgatgtttctgcattgacaaagctctcttcaaagccaaggagtattttagagcaagccagttatccagaagtctattctggtattgctggtccttttaacaatattaactgttcatttaggttaaatgtaaagattgcctttgtttttctatcttaggctagttttcctaaataaagcagagccagtaaaaggtttacatgtaggtagtttgtttgggaagtgattccaaagagtagaaatgacagggtaatgaaaaacagaaagaacaatggcaacttgtgtttacacattgaccataggtgatgctgagctttacttgagccctgtgcccctggcaaacagcaatggctgagaaatcttccatttgtgttccatgagagggcttactacaaagaaccacctttaggtaagactcctggatgactgacccccttgtttacttgcaataaagacagacacagactttacaaatgcctattcatctcatagttaactgaactgcttgttcctactcaccaatctggatgaatctctgctaactcaatgaacctatattaagatttcttccctcagatccctaaattttggctctcttctgagctttggaaaccaaccctctcaatggcttttccatagaatcaactgacctcatggaaaaaacattccctaataaactctctaatcatacccttggctcagcctaatcccggatacccagttttgtctcgtcttgtttacttttgtttctctgcaatagtctccctattgcaatagtctttttgaataaagtcccttattacctaagtatgaatttgctttttttatttgacttatgggactcagaacatgctatcccaagtatggcaccttggcatttaagaaaatagcagtagtagaaaggtatctctgaccttctcccagcattctcccatgaagtagaccacagaagaattatctgaccttccaacaaagtagctcataagagcttcatttgagaggtgtcctccctgtacctggagaaacagagtgaatacacagagtcaccaagactaatctgaataagtgggccttgctaattttcccttagtttattaccattagatcgtacttttttgtcctgcagtcacacttctgcatgactgtcataaatgtacacagatttccctgtttctttaggccttcatttctgaagtctcccatgtcatgtaaaacttatataatacattagtgtgtttttctcttattaatctgtcttttgttgtatgagtctcagccataaactttgcaataggcaaggaaaagatactaattttctctcctatatgactatgttatttgaactttgtgtatgtgccttctgtctccttctttaatactctattaagccatctccacttcatttactgtaggctagcacttcttaaaattaaatatggagcaaattacctagggtcttgataaaatgcagattctgattcaatatacctaatagaacatataattccgtatttctaacacacttttgggtgatactcatgctactggtctgtaggtcaccctttaggtaacaatgtttctgacagttattatgctgcaaaaggacatctcattaaagacaggttccaagtgcttctaagtcaataaatctctgtcttatatttgaaccctttgaaccagtactcacaagacttactgcacatattctgtgggtttttttcttcccctaggacctcttggtggttctataatttttccaatatgtgaataatttcctgttagagaagagaagatattttcctgttggattttggtgagcctggacacctcaaaccaagaggaaagaataaaacaaatagtgaaagaagtaaagccacccagtgttcagtccattatgacttttggaggagctttgtgaaatacttctcagacctttccattcaaggaaaaaatggtttgatttcttcccaaatgcataaatccactagtttgaaattccttgtccttctgtgtgcatatgtataagattggaggaggtttccatgggtattctatgtaaaggcttcagaaaagccctggggtaggaagtaaggagatagcatgttgctaaaacttccatggattgagtcaatgcagtactggctaaagctcaaggtaaggccaaaagtatttgaaatgccccagaagtgtgtttatataccatttattgtcccgaacccaccttcctcatggtgttctcccctccccactctcttctactcatgtttaggtgccatctgtcagcaatagccactcagttaccaaatatagtcccttaaagactttttctagcactgggcctgtctttttcagcctctgagctctgaaaaccagctcttatctagtcctactgaaatagagttccagatacttgaacctgaaaacctgcattgaagttaagctccaactctgaatctctaagctggagtattttattctattccctcatctgaaaagcaagggtaatgataatagtacttgctaatatgcaaaaatgtaatcataatatgtggaaaattgttctggaaacaattgaattctaagcaaaatataatctgctgtttttatccaacaattaattaataataatacataacgaggaaaaagacctctaaagtgcttaaaatgtgtattcctcccagaactacttgacttaaaaggaggaaaataaaagagctcgtaatttcagcaaattttgatgggaaaggtattttcatagtgctgtagaggtacttctcaaaatctcctaaccagattatctgcctctttgactgtttgttcttctgcttaaaaacaaaaacaaaaaactcagtatcagtacaatataactatgcttttctgagcactcacttggtaccaataatcttaactttttaaatcttatcacatttactcctcacaatcaactagaaagacagatattgttatggttacaactttacatataatgactagtcttttttgttgttgttgagacaggatctcacttagccgtccaggctggagtgcattacggtgatcttggctcactgcaacttctgcctcctgggctaaagtgattctcccgcctcagcctcctgagtagctgggattacaggcatgcaccaccatgcccaactaatttttgtattttttgtagagacagggtttcaccatgttgcctagtcttgtctcaaatgcctgggctcaagcaatccgtctgcctcagcctcccaaagtgctgtattacaggtgtgagccaccacatctggccaacagtagtctttagtgctttaaatgatgtcctaggtaaagtacatttagttaatggcacacccagagcctgaatccaggtttgtgcaaaaatacttctaagtccctttatacattgatttgatagccttgatcaatagcatgaccacaactcttgaattgtcctgagcaatcttgagcctgtctcattttggtctaattatcaatagttcatttcactctgaaaattatcctacttttaatgacaaattatatggtcactctattagtcagcctttttttgtctcgttttgtttttatataaagtttacaagtatctcaaatacttcatatttttcaatctgtttttggtatttttcaatcaaaacagtcagattgtctaagaaacattgtatttcatgagagtagctaattggcttcttaagctcatttgggcgtgaatgatgccaagaaaagatttgcaatgaagtaattgttatagctaatatcctaaagtagccaacctacatttggtgctaagaatcaaagcaagcaaaaaaatgctaatacatatttcttgtgtttctagaactaacatgtttcttagatttctatccaacatttttatataagtttgttttgtacaaacacacagatattacagttcagagaatgtttaagcctaaaactttctaatatgaacttgtggagaaaaaaatattaagctctctaccaaagagttaagtcatctgtaatggattatcctatatttaaactcaaatgtggtattatcatttgtagaattcacgtgtttctacagtgtgttcaaaaacaggttttataaaatggctaatttgtggagccaacacagctataatagaatcattttgtgatttttgcgtcatttttataattgtcctggaaggagaaaaaagtaacggattgttctttttctacgtatcatctatcaatgaattagggatggtaaattccagttttcagctgctgatttcaaattcacgtaataacacgagttacaggtaaatgacttaaaattgcaatcaagaactcttcccttccaagtcgtgttacttggtcatagtgacctgatttagagtgaagaggagatctgactaggaaactaacatatttcatagatatttcaattcctatggtgcaacaattgacagaatttttactttgataattaaattagaagtgtagatttctttctctgacaggtttagtgataaatgtatttcaaacatttagttaaaaataatccacttcaaacaattagttggtaatatattcaagcatactgcttacctaatatatacatatacacatatatatacacacatacatatgtgtgtgtatttaagtgccactttaacttggtatagtattggctttgtttatttgggctactattgcaagaataccgtagactgggttgcttaaacaacaaatatttatttctcacaaatctagagactggcactagtctccaaggactagtccaagatcaaggcagcagtagatttggtgtctggtgagggctggcttcctggttcacagacgaacatgtggttgcgtcttctcttctcactgtgtactcacatggcagaagaagccaggaatctctctagggccacttttatgaggacatctattcataaaggttttaccctcatgacccaatcacctcccaaagtctctacttcatattgggcgttaggatttcaatatatgaattttgaagggacaccaacatttagccagaacatatacatgttggagtttttttactagaagtaatgatttttaaatagactcaagtgaggctgtttataactacacagactacaaaatgtagcaaattaaagagcaatgtcattacataaaagtacctagagatattctctataaaagtattggtattagttttaattgttcttttaatttttttattatttttattttgtttttgaaacagggtcttgctctgttgctaagtctggagtgcaatgtcatgacctcctgggctcaagatatcctcgcatctcggttttctaagtacgtaggactgcaggtgcacgccaccatgcccagttaattttcaaaatatttttgtagagatgggggtctcactttattgcccagactggtctcagactcctgggcttaagtgatcttcccaccttggcttcccaaattgctgagactacagacataagctaccagacctagcctagttgttctttttaaaataatttcttattttcaaaaatttatctatttccatgatggtatttttgtcatatatctttcatgatgaataaatttcaattgaaataaattatcactaacacttttttttttcctaatggatgttgtaatgaaacagagaagtcaagaactggagttcaaaaatactgattactgtctcttgttctcccattgttacttattgggtgtgtgaatataggcaagttatttaagatgcaggagttcaattttattacctttctaagacaaatgaagttgttttagatttaggtgccaatctttccagtcctaaaatttaaaccttctcctccatattttactttagaaattggagtaaatcttattgatactgatgcgctattcctaataaatttgttttttagaaatgtactaaaggatacaggacttcagatatgaatgtctcccctttttccaaattttaggaataatttaacatctatactctaacagcaacatttatttggaatcaattataattttataatattctgtttgtaattggtggtaaaagatgaattatctctaataaacttataagcttcaagttccttcttgtcaacagtgactatgaggactcacttaataaaaatgcaaacccaaattaaatttttatggaagtaagcagtataatgacctcccaagaatgttcacccccatgaagaggttatgttatatggcaaaggggaacaaggtagtggatggaattgagattgttaactagaagacattaagatataaagattatcctggattatcagggtgggcacaatgtgatcataaaaattcgtaaatgtggaagacaggggcagaagagtaagtgtaagagtgatgcaatgtgagaaggattgaaaacaattgctgcttttgaatgtagccataaaccacggaatacatgcagcctctagaagctggaaggaaatggattatcccgtagagcctccagaaaggaatgcaaccctgacagcaagatctgtccagactcaacttccaaaactgtaagatataatttttttctgttttaagatgataagtttgtggtaacatgttatagcagccacgggaaagtaatacaatcactaacaggaaagaagagtatcttactaatcagccactttggtaggcattttgtgttatacatttaataaagaaaatgatttttaaatgacttcccaatatcataatattctttttaaaaattttaacacacaattaattataaaatactgtttgtgtagtactgtgttaggcaattcttgtattgctataaaggaatatctgagactgggtaatttatgaagaaaagacatttaattgttttacatggcagtgataaccctcggcttctgtggaggcctcagagagtttttactcatggcagaagcaagagcttgtgcattgtcatatggcaaaagcaggagcaagagagaaagtaggagggtgccacccacttttaaatgaccagatctcatgtgaactcaaagcaggagctcacttattaccaaggggatagcccaagtcattcatgagggattcatccctatgattcaaacacttcccaccaagccttacctccaacactgggtattacatttcaacatgagattaagacacggacaaatatccaaactgtatcattacaataaccataaagactttagaaaaataaaatatataaatataagcataaaaataagataaaataatatatactatcatttcaatggtatactctatgaatgcatatagagaaggtttggaaaatagcatgaaacataaattttatagtgcaggtgaaatgaaagtttttaaatttcatgtattttcattgttaaatcacattgttcttactatttgtaaaatcagtataaaaatcaaccagtgggcacctcagggagctaagccttcatatagccacctgacatcaataaggcagaattaggtggtgcaagatgggttagacaatactccgtatttcctttccctactgttagtttagctcagtggtgagcctcgcttccaccccaagccagtatcaacgaggtagaacgacatggtggttcaagtgaaggtagttgtcactccacatttcctctccactctattctgcctcactccactcctggtatgacagtcccagtaaagtgttgaacttttacctacccaaacagcaacaagacaatgagggttagtcctttacttactatcttcctggtgatggagggcccagtgtgaagctaaacctatatttcaacctgaatacaatgaggaggtgaaaattggtgttttctttctctgagaaagcatcagcagggctgagggagaggtgaagtttcacatctgctgcaatgaggcagtgtgactgagtactcttgctagggtgtgtgtgcgacacagtggaaaactaaatatatacacccacctggccctttcactataccctagggaacatccagctgaaaaaacaagattaaataggatccagagtcttataagaactaaaatgtcaagaatataattgagaatgcattcatcataacaagaaacaggaaaatcacaacatgaatgagaaaagatatcaacagacacaaagtgagatgagccagatttagaatgaccttacaaggatttttataatacagtaagcacaatcattaacaatcaattatgacttctcttgaaacaaatacaaaatagaaaattccagtaagatgtaaaagttataaaatggaaccaaatgaaaaaatatagaccttaaaaataatagatgatttaatatatgttgtgttgaagttattttgcaccacacacatgctaaaggttatactgtattttaccatttggttctgtcttttcaagggaaaattctagcaaaatgaagtcaatggtcctggatttttgctgttagtgcttgttaatacatttttgaaaagcacagtatgtttagaacacaaaatttcctttctggtacattaaactagctctttccacactgtctccatctcagtaaatggtaattctattcatctgtttgctcatgccaaaaactttggggatatcttgatatcttacattctcttgtaatcaccagatatgttcttccttcccactgcatagacaaaaccaattcactgagatcatggcattatagtaaagacagtttaattgatacaaggccagccagccacacaggagctggaataatcattcaaattattatccccaaaggctcagaagttagagtttttcaaagataatttgatgcacaggggactagggaacgggtgctgccgattggttggaatccaatcatagatatttggaaaatggtccttgtgcactgaatctgcctctgggtgggggggcccacaggactagttgagtcatgagtcataaatcataaatccaggtagggtcagtcagttaccagaatgcaaaagtctgaaaaacatcttaaaagacaaatcttaggttctacgatagtgatgttagctataggaacaactgaggaagtcacacatcttgttacttctggccttgactcctgagaagtaagagattatagaaactatgcctatatcttagtgggattcaggattcttccataattctaatcttatgacctttcattagtcctacaaaagctgtttcagaccccaaacatggaggagatcagttttagggagggactattatcatccttgttttaaagttaaactataaactaaattcctgccatagtcagcttggcctaaacccaggaatgagcaaagacatgtaaccttgtaaccttgcttctaactataagattagaagcaagatgaagtcagccatactaaatttctctcactgtcataatcttacaaaggtggtatcatcttacttccaatatacacccaagtgcagtagctctacctttaaaacaacttattctcacttctctttctgccacttgtgtatctaagccctcaccatctctgaccagcttttctaacactgttcctaatatgattcaagtgtacggtaataacaaatcctcttacaatcagtgagggctgaagaaattagagaaactgggaacaattcctgatgctgagcggcctcttttgtcttcctaatgtatggcataggcactcttaatttctatatgagcttcctagaatgagaaagattggagagaagtggtttaagctattgaagcaaactgcaatagttttctgttctatcccctcccttccttcaatatattttgcacagagaaaataagtgattaaaagatagctagatagatattcatatctatctctataaccatagctatctatctatctatctatctatctatctatctatctatctatcatctctatctcaggtaatacctatacctactcaaacatttctaaagcttactgccagttgtggccatttaaaatttggctcaatgtcaacactgttagtgacacacacacacacacacacacacacacacacacgggtctaaaaaggtttctcacataggatattttttcgataaagtggggccactcccaagggaagctgaaaatggcttgagggagcaaagcaagactagcttgaagctttcactgtggttagacagttgggttgggatgagagtttccactttgggatagaagcatatgtaacttaaacttcctgctggcaccaaaggagggagcactagggcattctcctcagcttactcagatatgaggcagaaaagaaaaaggaaggggtcaagcttgaaagctctcagccatcaaacatcaaaaatagagtcagactcttcattacatcatcttagtgaaagcactatatatatatatatatatatatatatatatccactatatatatatccagtctctataccatggcctagaattccctcccttctacatctctgaactacttttaccttcctcattacccattctgcttcacaattgcccccttttcttccaacaacccaagcaaatgcccagtacctagactattggttggtaaatatttgttgtgttaagcaatacaatttttttttctaatggtttaaagtcattcattgtacctattcttctttcaaacaaaatgagattcttatgtaaattaattacttatgaaaatgtatgaaacgtgtatctaccacttttcttattgtgggggctgaagctattgaaatttcctttgcaaaattatgactgagatagtgaaagagatctaacctaaccaactccatcttggttctaaaccttaagctatccttgtttcttcctggacgtaggctgaactaactttgagagggacttagtttaaagtttaaaacaaagacaataaaagccttttcccaaaaggaacctggagactagactgcttttgtaggactaacaagatagctgcaagattagaaattatggcataagagtcatgcagctggaagctacaagattctgaccctccctaaactgctcccaagatcaatgcttgagatattttgcagaccctgcaatggatgtatcagctggcactgcccagattgattaactggctcatttgatcttgtggcccccacccaggaactgactcagtgcaagaggacagcttcaattccctatgatttcatcttctacctaaccaagaagaactcctggctcaccggattcccctcacccaccaagttgttcttaaaaactctgttccctgaatgctcaggaaggcagatttgagtaataataaaactctggtctcctgcacagctggctctgcatgaattactctttctctaatgcagttcccctgtcttgataaattggctctgtctaggcagcaggcaaggtgaaacccttgggtggttacacttttgacttcctaaagttttgctgaaaagcactgacatgaggcaaattgaataatcgcagaaaaggcataccaatttatttaatgggtatacatagaatgaagaccttcagaatgaagacccaaactcccaatgaggaacagaagcttatataccaccttgaggttacagaaagaatgggggcttggatgctggtaaaacagaatttgggaagggagagaagaggaattctgttgaagggccataaatgattactatctaacagaaactgacttgtaaatagctctctttagatttgaaatgatcctcagaaatagtcattatcctgaaaacaggtctgttcaagtgtggttacatttgtcatcttctttcttgtaatgaaaaataagacaaaagggagggaaataagaataatttttctccttggtgggtgagttctccctttatgtagatggggaaaagtttcttttgtcacttattgatctcttaggatttttcatttaaaatactcattataccagggagacatattttgggtgaaatattttgatttccttcattattaatgacctctggacacttaatttcaacctttttattaagtaaaattaatgatgaatcattttactttaataataaatcagtttattttaatagtcagtttaataataattaaaagaaatagtatattttaccagtttctaaacacccatttattttttgctctgtacttcttacaatccagctagtttctcccttaagtaatcctctattggctctttagtaacatctatctagacaaaaacaaaaacaaaaaaactcttgatttgtatgcattgttaaaatagatttagcctagagctgtttccttacatattttaaattcagcctaaagttttttctgtgcatggtgaattgtatcctgactggatgtgtaaacagactgtaacttcctcattccagtcaccaagttttggccaatcaaaggcagccaactgtccaaattgtgttcaaataaggcaaacgctgaactgtaaccaatctggctatgtcggtacctcacttccattttttgtacatcaccttcctttttctgtccataaattgtcttccaccatatggctttgctggagcatctctgggcctcctctggcttcggaagctgcagaatttgagaatcattctttgctcaattaaacttgttaaatttaacttgtctatgtttttgtcttttaacagatgaagtcagaagtgtgatctgaaatagagcttctagcgacctgcaggagcattgagtgaccaagtgggatgcctggagtgtattgtatccattgcgctctcacagccgctgggaatcgtggcaagttctctctgggatactgaagctcgacagatttgtgttttgaactatccaagtttatttgaacgaaatttttgatccaaactttcttcagaagtctcaacagaaaatgaactgggtccagaattagattcaatctgtaaactaaaaataaaattctaaggcccccaaccaactgaatggaccccttctctcagccaagggcattttaaagttaacctgaaaaactagttcaggccatgatggaaacagaggttccatatacctcattatactttcctccctttggaattcaggcacaactgaccagcgttaacattaaaacaaagatctaaaaccggcaaaacagactctttgtagcaataagataccaaattccaatctgacctactatagactcacatgacagataacaggccctgaaagaaatgaaagcattttatccaaaaatatttttccatgacatattttaaaatggctttgcaaagctgtcttgtgtgtggggggggaaacttacagtctgtagagaatctccttcccttactaggtcttttcaggggagtctagcaccttttagtgtctgataagaagacctttaacatctattgtctctgaagcctgctaattagaggcttcatctgcataacaagaagtttggtttccacagtctcttttatcttgaccccacgcattttttttttctgctaacttcaactctttagccaaaattaaactctttcaaccaactgccagtcaggaaatctttgagtccacctatggcctggaagcccccattttgagatggcctgcctttccagaataaatcaatgtacaccttacatatactaattgatatttgcctataacttctgccctcctaaaatgtataaaatcaagctgtgaccccaacacttgggccatgttcccaggacctcgtgaggctttgtcgtgggcatgtccttaaccttggcaaaataaacttctaaattaactgagacttgtctcagatattttttggcttaaagatcctaaaaataactggcttggatccagttataaaccccttatgtctgactgggtcagattaaaaaccaatagtaaatggtaacattgcaggaggtgcaaactttagcatttagaaatttgcagagatttttgtattttaactcctttctttcttgtgtgcttatatgaggaaagacatcggctaagttgatttaggggatatgagagtcaaagcaaagattcaagataaaaatgagatctttactttcttaagaactaagtaatctaccttctggctgtgtctacatttacatgtataagtattagcccagaattagcaaatgcttatagaaatggcaaaatcttactaaatgtaatgtaaaatacaatgtaacattccaaatgaacaatactgcactttaaaaagtgcatttgaaaatgaaatctcctgaattaatctcatctgatgaggtctattaatgtccagaaacttctaaaaaattttcaatattttattgttattttaaaaaggactctttataaaaggcaaataaaagatttaagtgactagtagataagaaaaattaaatcctccaaccttttggcttagttactatccaactttgaaggcacaaaggaatctcttctagatagatagagtgtttattaaagacaggccctcaggtaaagtagacttgcttctttttcagatctatctgtcctgattccaggcagagagaatgctttatttgccctgttccttaatgggcttcatcccaaacatagtgattttagctagaaaccatagttaaattgaaaggttcacctatggaactaaaatacagctttctggtatttaactagctatcttgaaattcttttgtaaaagaaattacatcttggtatggtttggctgtgtccccatccaaatttcatcttgaactgtagtgcccatgatccccatgtgttgtgggagtaacccagtaggaggtaatagaatcatgggagcagttacttccatgctgttctcatgagtgagttctcatgagatctgatggttttataagggtcttttccctgctttgttctgcacttctccttcctgccaccatgtgaagaaggatgtgtttgtttcctcttctgcaatgattgaaagtttcctgagacctccccagccctgcgacactgtgagtcaattaatcctgttttgtttataaattgcctagtctcaagtatgtccttatagcagtgtgagaacacaccaacacagtaaatttgtaccaggagtaaggcactgctataaagatacccaaaaatgtggaagcaactttggaacagggaaacaggcagaggttgaaagagtttggagggctcagaagaagataaaaaaagtagaaagtttggaacttcatagagacttggagggctcagaagacagaaagatgtgggaaagtctggaacgtcctagagacttgttgaatggctttgaccaaaatcctgatagtgatatggtcaataaagtccaggctgatgtcatctcagatggagatggggaacttgttgggaactggggtaaaggtcactcttgctatgcaaagagactggtggcattttgcctctatcctagatatctgtggaactttgaacttgaaagagatgatttagagtatctgacagaagaaatttctaagcggcaaagagttcaaaggaagcagagcataaaagtttaaaaatttgcagtctgatgatgcactagaaaaggaaacccctttttctggggagaaattcaagctggatgcagaaatttgcataagttatgaggagcccaaatgttaatcaccaagacaatggaaaaaaatgtcttcagggcatgttagagaccttcatggtggcccctcccctcacaggcccagaggccaaggatgaaaatatggtttactgggcaaggcctggggacccttgctttgtgcacagaaatcaagaattaaggtttgggaacctccaccttgatttcagaggatttatggaaatgcctgggtgtctgagcagaagtctgctacaggggaggagccctcataaagaatgtctgctagggcagtgcggaagggaaatatggggttgggtctcacacacagagttcccacttgggcactgcctagtggacctgtgagaagagggccaccatcctccagaccccacaatggtagatccaccaacacttgcacagtgtacctggaaaagtcacagacactcaacaccagcctgtgaaggcagctgggaagggagctgtacctggcaaagcccaagactatgggagcccatatcttgcatcatgacctggatgcaagacatggagtcaacagagatcatttcagagctttaagatttgactgctccagtggattttggacttgaatggactttgttttggctaatttctcccatttggaatgggtgtatttaccaaatgcctgtacccgcattgtatctaggaagtagctaacttgcttttgattttataggctcgtaggcagaagggacttgctttgtctcagatgaaattttggacttggacttttgagttactgttggaaagagttgagactttgggggactgctgggaaggcatgattgtattttgaaataggatgagggcgtgagatttgggagaagccaggggttaaattatatggttggctgcatccccacccaaatctcatcttgattgtagttcacataaccacctgtggtgggagggacccatcaggaagtaatttaatcatgggagcagttaccctcatgctgttcttttgatagtgagtgagttctcatgagatccgatggtttcataagggactttcctccctttgctctgaacttcttgctgccacaatgtgaagaaggacatgtttgcttcccattccaccatgaccgtaagttttttgaggcctccccagccctgcagaacggtgagtcaattaaacctctttcctttagaaattttccagtcttaagtatgtcctcatagcagcatgagaacaaactaatacacatctctaaaggaaatctccatatgttacgtgcctttctgtgtacattagaaactcttcttaccattattttaaatttacacaagtcataccttagtttaaggtgctttactggccatcttgctttaactgtacttttacttatgccattttttctttggcttgagcaaaagatgcaatattcaggctgtattagtctgttctcatgctgctaataaagacatacctgacactgggtaatttataaagaaaagaggtttaattgacacacagttccacatggttggggaggcctcacaatcatggcagaaggcaaagaagaaggagagtcacattttgcatggcggcaggcaaaagagagcttttgcgggggaatgcccctttataaagccattagctttcatgagacttactgattatcactagaacagcatgggaaagacctgcccccataattcaataatctcccaccaagtccctcctataacatgcgggaattgtgggagctataattcaatatgaaatttgtgtggggacacagccaaaccatatcataggccttaaatgttagctctttgcttttgaaatataaattttcttgtttcacctaagaattgtccctttagaaatgcacatttgttgcctagttaacaattactgagggcaatgaaacaggtaattaaagaattaagagtctgaatggggaaaaaattatctaaaagccagcaaattggaatcctttatgaaagctatattttctgttcttatgtttgtatgtctatatgtattatgtgtatgggataatattctgtaaatgaagctagtttaaaaattgctaataaaatagaaatgactttaaaattatcatttatatataatttgacatgttcttgatttggctattagcttttgttttttattttgagcctctagatttggaggcctggataggtagttgtagtgaggtctggagacatgttctcagtgcccaggccagcagctaaaagtcagagtcaagtccaatatagccccttcttcacacccaagctttgtctccaggctaatctggtaggaatatatatacattttttatatataaattttatatataaatttatttaaatttatataaatttttatataaaaatatatataaatatgcacatatttgtatacatgtatatatatacacatgcacacacatatgtatatacatgtagatgcttatgtatgtatgtatatatgtatacatgtatataggtatggactctggctaagcagcatactccatattctcctcctgataatattatcctccttctgatagtcataatagcaatctccattgtgggttatattctcccacaagttttaaatgtttgcatgcagccatgtccagaatattaaatgatctcttgtcaactagaatgacaaaaactctaagaaatatatgaccatgaggatgcaattatctatgtttggtatgccgagggcagaaacccagaatgatggtaactgagaatgtgctaaacccctcagttttggtcactctcacttgagtaagaacttaaccaaacggtgggaatttttttagacatatttgtgggaagccattgtttaagactgagtgtgtgcactaggccccaacagagcagaacaaaccaaaatgaagtcattcatgctgaatgcgacgtaatcaaactaaaacttgaaggtgaaagatcctaaaacagagcatgttttgtttttctactcaaaagaggtgattccagcacaagaaggtcccatctagtctagtcttttaaaaaaataatagcctggagtcctagtttccaccttataaaagccagttttgctatttaccggcaatgatttgacaccaaataagaaaatttacaatggtgacagtgacgtcaatgcctaaaattttgatcctctctcaacattgagaggatgaccaaaaaggaggatgttaaactaagtttagcctaaagttatgttcttacatatgtaaagttcagcctaaatattactccgtacgtagtgaactgtagcctaactgcacatgtaagctgactgtaacttactcttgtgccaatcactgagctttggccaattaaaggcagccaactgtttaaacagtgttcaaataaggcaaacactgagcaataccaaatccgtttctgtacctcacttccgttattttagatgttattttcatttttctgtctataaatattccaccactttgcaatgctggaggctctctgagctattctgacttgagaggccaatcaattttcagatagttctttgcttaatttaacattgttaaatttaatttttctacatagtttttcatttaatagtataatttcaaaaagcttacctatttttttttaatacactgttttgtgacagtaattttctgtaaatgttttgaaaggatactcttatcttctgccatttgtcatttctggtgagaggagggcttgtctaattattgctgatttgtgggtaatccatctttttcctatgtctgatggttcattaaggaaagaatagatgtagatctgtttatttatttgcttttaatccagatacattttgagtgagtttgtttgttgtaaaggtcagtgttggtctattatcatactactctgtctaaaattttcagttgctgaccgctggagctctgagtccagatcagattgtattttggtaagccatggcttctgtgcacttgtatggtttagaatatggcatattccgtctatgagacagtgaacaggcctctgcaggccccagccatcaggctctgtctatctcttctcatctcccggggtatgaaattttaagtagcctgtggatccagagataggtaacaattttttagtctcttcccagtcccaagttttatgcagtaagcacagctctagtcaattttcttattttcttagagtacttttcatttctgactccatcacagtctaatccatgtcctgctctgcaggcttccacacctagattccagcacacatgcagactccaaccctgatcgctgtttttgtgttgcttttccaactagtcatttctgggaatacagaacagcaatctctctctctctctctctttttttagtaaacattttttaaaagtgtgaaagacagataagagcacatacaatcaatttacagcttgataaatcacctcaaagtgaagacacacaaataactacaaaccagatcataaaatggaatactatcagtatcccagaaactcttctcatgctcctgcctagttacaaatcacatcccccaccccaaaagatcctaacttcttccaactaaggcaataaaaaaggctatgacttttcaattttctcttttcacattttatttattaatgctatgagtttgcagcagaggtaagagggaggcaaggcttaaagtaagagcaatgatgatacctctttagaaagtggatccagatgaacatttcttagacagttcttgcctttggcgccccctactggaagatttatgacaaagccccttccctcttgtctgtgtgctttcactgatgtcatgttattctggaaccagcctctgataattacagccagtaagaataacattcactgcttctgtgcttatacggattgaaaatatcaggattaggagtatttacatgaatgtgaataataataatataatggactactaagtgctcacacattcttttaattttaccataaaacttcctttggcctaattctcatagataatatagagttggggagattgattttagtcttacgtgcgtttcttaggttagccctgtcagtctaaactgatgccatttctgtcttccagattcctattaaaataagtgacttgggacattgcacatgtgtctgtatgttttttaaatgaaatctaaaactggtaaaaattatttcggtttgacttttttctatgtaaaccctaaatggggctcctgagaagtgtcaggtgaacttggcccaagtttcaggagaactcactccctcccaaaggatataaagaaaagatttatgactccaggtgaaacgcataagcaagctggtgactatagatgattttagctttgggtttctggttcattgggcgtctaaaatgaaacttggccaatgcaaggggcatgcttctataaatgaagagaaaggtcttgcagaatctgtgcaaaatgggcttcagtctgtgactgtctattcacatacaccatttctccaaagaccatagagtaaacttggagaaagtaggctgtatttttatcttgagctcaaatgttgtcaatgacgttttattaacagtttggaattccctatttcctcaattaaaacaaatcttgataacattttgctttacttgcaagtgtgactgaaacactagccctgaaatggtcgtggtctgtattccaatatgctctccagtattctgaacaggaaatcaagtcatgtctgtctgtatatccctcaccacgtacataattcattaaggaattagagctctgagtttttggagaatttttttcctgcgatggaatttttaatatgtaagctaaatcagggtgtctgcttgtgatttaaaagcccccaaattgaagacttttgcaggtgcatgttggcatgtgggtgggatctagaccatggactagctcgcatttcaacaccaaagtagaaaatgggtgtggaatgaatccgctcttgccccgttaacaactggcctcaggggcaccatctggaattctcataggtattttgcgaataaaattgcagtagtcattccaccattggctgtagtacttctgggctaagaactgcaacaaagtcattgaaagaacagtcttctcattgattaaaaagcccgagtatgtttctcctccaatttatgaggattatgcaaaactatagacatttgctctaccctctgtttctaatttagtgtagtatagtgcttgattgtctcctgtcatgtaagaaaatagaagtgagcagttcttacaaagatcatccccctttagtcgacccctgatactgctagtcttgctttgctcacgtccatggtgtcagaggtctcataatacataggaaagtcaatagaacttaaaaatggtcaagatacgggttttctcctccatcacagtgaaggcaattggtatattataaagctgatttaaggcagtatttagcactctgtagtttcctatattcttttttcttaaaagaataaggttctcagtggttcagatcaattgatttgagtgagataaagcacctgaggaatattaagaaacagctgacatcttcagagaaacaaatgaaatagagagaggcttctgaatgcttagataacttgatcttgctgaagaaagagggtcttacatttgaagagataaattaggaagtattttctcagccccatgataacgtgacaaggcacacatactactcgggagctcatcattaccacgacgttagcactaatacataccgaatgcttcaagaagcactttctttcttcaacgaagatccaaggaccctgaacccagagtaaatgacacataagaaaagagcatgggaacaaaccctcactctcaagaaatcaaattctcatttataaataaaggtagctgtttttttttatggaaaggcaaagtcttcatttctttcaagaaatggagaaatgttttaatatttcagtcacagtgttaggctctggacatataaaagcaagctggatacctggtgtcattagccttatggagttggcaacctaatgcaaggtaccaataagtaaacattaggaatgatttgatgatctaaatcatcagagtgctcggagagactgaaacagaagtggtaatggtcagaagaggccactctgaagaagtgatatctatacagataatggaaaaaaaatgagatcttagcttttcaaaaagcagggacagagaatctcaaggcaggtcaggatgtgctaaggccctggggcaagaaaaactgccatttgttcaagtaattgaagagaattgggcaagaggtaaaactgggcaggaaactgggcaggaaggcagaggatgcatgaaataaaggatccactgaaattagcatgtgccaggggattgtaaagatgttcaagtctgaataattttaacctgagaagacagcaagaggaaaactgtttctttatgacaagaaaacttgtatattgggcagaagatcatttctaatagtcctgtatatttgtatagagcttttgaatcagcaaatatttttcacaagtgttctttccagttctacaaaatgttcctaagtgaagaggatttaggtttatggtcaatttctcaaaaaagatattaatacaatccttgaatatacaggaaaatcgatgccaattaatctagattagaggttaggcaacttctattgaaaaagctctcatgatagctgttgacctgattttgaaacatgaccaaatctaagtgggatctaaaatctgtttttgcctggtattctctaaatcaatgcatgggatgaaattcaagttatatgaagttcagtaacagtcaaaactaatagtggatgccgctggtagttaatgtttgattggaaatgggaatacagaaatatgctaggttgttggtaatttcctatacacataaaaaaataaatgaaatagttgtgtttggatccccaggagattttaattcgtggtcagatttgaaaatcacagttattaatagaatatcttgatcaaccagattttacttggtgtcatagaaataaagaaaatcaacaaatcacaaaattgataattgtgacagttctagcttcaacccccgtgctaaaaaggagctgtttctcacaagcatccttgtaattgtaatattgaagagatattgatgtaaacttttactatagttgtaattatgccctgaaatgaaactttaagtcataagaaataattgatgtgatgctgatattgaatacctggaaaataactaccaggcatttagaaattaagatttgttccttcttaatgaaaatatgtttcattcatctgtattgatttatttacatttattacctgtcacattggaagttgtgagaagtacaaaatatcctgaacaaggagagctcacaaaatacttggagaatttagctatgtcttcatatgacacttgcaataattgtcaaaatgaagagtaatagatctcaaatatccactagaaatctgttaatattgggactatgatttagttacttaaaatgttttataatgtaatggaacattgttattcacttttatatgcctgatcagtatattttcaatctttcctaattcctttttaataccaaccaaccttttttaaaaaaatcactcccactatttaatggtgatatatcccacttcttaaaagtattatagcatatattgtttagactagaactataaatttggagaaaatagtacaaaaatctaaaatccatatttggaccagaaattttatggactgcattttttgtgtatgtctgcctttaggttcatttgcctgtgttctaccttgctgacttttattcagaaaattttcaaacactaatgcttcattaattactcattccagaacccacagaagtcctggttgaattctaaacaactaatagagacaagaaagaaaggagtcatgtaagacatgtttaaaatgcttttaaatgcaggttgcaaaacaaattcgttcctccagtgtaaacctcaaagtgcttcatctgtaggcttttgtggtctctactcttctgaaatagcaggaaatgttttaacaattagagtgagcaaattgtaaagggaaatacggtagtacattaccagctgagtccttaaataaaacattcctttcttaatgtagtcctgatgctgcgccatcttctattagttaaggccactgtattgccataggcaagcatcaaatatacagtagtttgataatggtaatacatacagcaataaaacaaaaatgctattatgacaggggcaaaaaacacatacactgcatttaccttcaggcatctttttggtttcccttgaacaaattaaaacagagactaatttcaatgatgtgtctttatctcctttgcattctttaaaaagttctaacttttctaaaagctgatgttagtttatttattgtatgaaacttggcaaaggaaatgtgggtgcacgcattatatccatttattgttatttgtgggacatggcaaggatatgtgttcacaaattaaaatgttccatgagtagatagaaaagaactttaggtaaaaaatacaaattttaaaatttctaccagaaaaataaaaatattttcaaagtcttcatatattaatattaagatgaatgaactcatcaaagctttatctcatccaaggacgttgaggggtggagggagaaatgctgagtggatacttagtgggtacaaatatacagcctgattcaagaaataagacactgtttcatagatcagtagggtgattataatttacaatattctcttgtatatttcaacatagccagaagagaacaagtcaaatgattctagcataaaaaaagaaaagtatttaaggtgattgatattccaagtatactgatttgatctttacaaattatatgaatgtattaaattacatcacatgtgtccccaaaatatgtacatctactatgtaacaataagaaataaaatttaaaaagggaaaaaaatccaagaaaaaaatttaacatcattctatgtgatgtttgtgaagattattttcctttaagagtactgtttatcctaggccaaatttcctgtgtaattttgactaagaattagaatcacaaacaacaagtgcagtaaccaataagaagagctaaaaagcaaatcctcaaatttgtatatatgttttgagcatgtgtgactgtatagaagatacaaagttagtaataagtttgaattcagatatgacctgtgtttaatagtatatcccattataaaacatttgttaaaaacctgagccttggggtgagacttcattggttcaagattgttctctaccactttacacattcttggacttccaggaagtatttaacctactaaggctcaattttataatttcaaaagcttggataataatgtaatctatattgttgggtgctatgacattgttatgaagtaattcatccaaggtattccacacggtagttgctttcatatcacagttagctaatgtcaattacttgaaatcgttaatgtgtttggtgtatttagtttctgtctcactttattgtagtctttagtcaaattattttttctaattcatgtgtgtttgggaggattttgaaagaaaagataaaaaattcagttggaaccagtagtttccttatgaggtaccatatttagtaaagaaaaatagtcaatcaaatggaccattttgaatactgggaagtttggcaatttttgtccattggattttctcatgttttcactaggctgtctgttgcattgtataatttggtgtagaacgtaaatctaggaattattcttcaccatttcatgcagccttatttggtaaacctgcagacatctatagatattctttctgaataatatcttctttgatcctgtatacaattatttaaattcaattttgataaaatttacattttacttcttctctccctcaaaaatatttgccttgtttggctgctttcctctataatactgttacctttattatcagcagcataaattaagtacttagaattatcctttattgctagttataaatgcaatatgccttctgctatatcacagtttccacattttacctgttggaattcatagtacttacaatcatttcatgcatatatttggcactaaataaagatttggtattaataatagatacgtgattgtaataatatatatttgatgataactctaaatttttagaccaagcattaagtttatacagcgtctcaactacagcactcaaaatcataacacattttaagaattttaattatgaggaatttctctgtatattatgtaaatgattgtgtttggaggaggacatatctatttctagacatattatgtgagtgattgtatttggaggagaacatatatacctattcattttatttggaaagagaggcactttggactattagttaagacaaatagccacattcattagcaaatagtcacctaatacaaaattaggaatgcatttaaaatagtgtcagagagaagaaaaaagtggagtgcatcagaagtttaacaaatctgactcagagatctcaacttcttctacatgtggaatccatcaagctgactttagtggcacttgcaaacttcccttttctgtaactgttcctcattaaactcggagggatcgagaataacttttttcagtaatttatgacatttgtgtctatttgcaacagttgtaaaaatacagtataaccaggaaacatcataaaacactcataaacccttcgaaaggcagccaaaaagctagactttccacagcagttaatgatacaaatgtgagcgaattatccctcagctgaggctatgtgagatctgtgaactatgtaatgcctttcagcaaatatttaaggcataaaaataaaaacaaaatcagttttatataaaagaaaatttctcaataattccaccaacttcaagtacctttttgtatgggagaaggacccataataatgtaaaatatctattttttataatcttttaaaataaaattttttctgagaagttacaagttacttgcttcttaaaaccaatgagctctgttcattataggtgtaaagcgaattgttttcctaatagaaaaatgcatactaatattctatagatggacaatgctataaaaaattgcaaacatggcagatacccatttataaaattgctgatacatgtatatatgcatatatcacttcagtttaattttattttgagtgatatatattttacaacttcttcagtaatatctgaaggactttggtgctttgagagttcacatttttctagttccttttactcctccatatgaaaataattctaaagtaatattagcaaaaaaaaaatttgctacccaattgatagtacctgctgaattcaatttattttctattttctgagttcccaatgtgtctttgtatttattggaatatatgagacctttcctctccaaaccatacaagaaatgccttagagttgaattacagtcatcagactaatcttttccccagaaactaagctgttgagaagattaagaagagatggagtttcatggttatgctactagtttgaatcattcctagactgaaaagaacaaaaattaggtcacattctaggtttgcttgacatcagccacacaattcctgatgctactattgaatctcttggggatgcctccttctgaaatccaaacattgcccaaacacgaagatggaactcttttggcccagagatgctctgtacttcagccaaaaaataaataaataaataagcaataatcagttggaagagtcacttgccaaactacatttattctagattttcttcccaggagattcagaaaaatgaaatattagagaaaaacataaacacattgtcatctctgatagtcagctaaagatagtaaaactagtgataagatacagcaaaataaagcagaaacactaaggacagtgagtcttacatagagctatggacaatgaaataagtttagtgaacctgcatgctctccacaactcctcacactcaacaaactcctagtctttgagtactcacctctgatcatctatcactgaagattttaagagctgaattgtagagtcagaaaaaaaataaagaatgagtgcattttaaaatgagaagcggatttaaaaaaagcagaatagtggaggtgaagatttgtcagacttgaagacgtagaagggatagaaaaagattgaggcaaaaagataataatgtcagtctcctttatttctttaaattggaagtgctaaatgtaggggaccacgtctttgtgcataattatttcatgatgcgtatctgtatcaatcagtcaattaaatgcacttacacacacatatgtgtaggtgtgaatttaaacatgtgattttaatgaaaaatcaaaattttcataaataacaaaaactaattgaaaacgaggatggacacagtccaaatgtcctctgtcatctcggtctcattgtccaggcaccagcaatgcagaatattgacattacagaaagtaaacacatccatgacacttacgtcactatgtcacatgctgttaatcactagcatgctgtgaaatcagctaacctgctgtaaaatacacagtttttttttttggaaatgttttaacttattgcctttctttctaaaaatgacttgaaattgatgttttcaagacatggctaaacattcatgacaattgtgaagaaacaacataatcatgtatacgctcactaacattcatttaataaagttctgctggcatatatgatgtttctctaaattggttgctacttaggagctttattctaatggaataaagaagagagttctccatgctgattaatagaaaaatgtgttgaataatatttcaaaaacaaaaagacaatgaagaagtcattgctggtgagatttgtgttccagattttgctagtaagatctggcaagccactctccacaccttcattaagattataaatgctaggtgaaaatgaggaggaatggctaggatgttatattagccataaaggtggtttattttcttgattcttctgctcagttcttagatgtggtcttgattctataccctttgaaatatgagagtgttcaaaaaattcattttgatggattttatgcttgcaatagcgtgatattcaaaagcagatcttatacaaccagaattctatcctgacttctgttgtcttcctaaattccttgagttatttttggcaactgcataataagaatgatttctgatcagtttttgcttcatgaaattaattctcatccaccttctaaatcttacccttacccacttcctctgtttctttatttactttgtggaaaacttctacatttactcttaaactagctcaaatatagtgtcttaatattgctgttctcactcatatgtgggagctaagaagttgatctcttggaggtagagagtaaaatgagagataccaaaggctgggaaaggtgtgcataggagggatggggtaaacagagatgggttgataggtacaaacacacagttgaatagaaggaataagttctaatgttccatagcagagtagggtgactgtagttaacaaaaatgtaccatatatttcaaaatagctagaggagaggacttgaaatggctccaacacatagtagtgttgaatactcaaggtgatggataccctaaataccttgacttcatcattatacattttatgcatataacaaaatatcagaggtgtctcataaatatgtacgtatattatgtatcagttaaaaatatgtcttcttggaattgttctctgcttcatagggggagtaatccctctctgcttgatgttcccataggactttgtatataattattacagcatttatcacattgtttcattttatgtctggttctacaactaatctgtgagtaaccccagtggaatggatagtattttatacatctttttttttccattcttctttaaaacttgtggaattttacactaagaagtcactaagtgcctgcttgttagttttctagtacaggggtgataaaagtcatttctttttccaaccactatgtatttaagttttcaataatgaaactgcagagagataagatggctggttttacattttgcgtagtggagcagtggaattgaagagttcaaaggtcaagacacagccttcctattttttcaaacagtctttacatacgatcttggctaatagtacaaatgagaagtgaaccagactcacatctaatacattttctgaattttttttttctgtaattacatctaggggaaggaagattgataatgtaaaggactaggagacaacataattattgcttcaaataaagcttttcagcaaatgaagcttttcaggaagggaatgtttagaaaacagattttctattgctttgttctcagtcgtctaactttgcacacaacgactcaggttacatgagagattccaaaatttggagataagccattcatcttatgacaacaaatagagaaagaaaacataaaaactatttcaacctatgtatgaaatctgtatttcaattcaatttaaacaaaagttgtgtaatatgttcctgaaaaataatttatggagcaccttaggccttgaaactattttaaatcaattaaagtcatatttgtttttcaaaaattactattcttaataagatagtcctcaataataggaatgagaaaatttaccaagaagaatgtgtggttctttattattcaatataaaaaagtaatattatatggcttctataaaaagacccataatactgcttaaaccgtgtcccataggtgtgattccacaataatgggacagatatcccagcactttttaaatttgggcataaagacataagtagcataaatatgtaaaaatccaggaaactaaagattattataatttttcagttctgccattttaataaattttcataaagcaaaatctagtctatgatgaataaaatataaaaatcttttaaaaaaatctgacctgaggacataaattgtaatattgtatataggacctggtattaatctttccaatacattcagtgaggtccatgtcctttctatagtctaattaaaaaaacatatcagtggagaagtaaagcacaaattgtggtgatgggcagaaaattaacttaatgagaaagccatatttagagaatttcaccttatcgaataaaaatatgattaataaaagaacattaaagggagtgtattttatactgtttgttcattaacaaatggaaaagagacagaacaaaatggtttaaattaaaataaattatatttaaacaggattaatataacaaagtttcctagctaacaaattcccttcatgagaattaaagttattctcaggttactctctatggcttgaaggaaaagtggagcatatttgttagatttagtgtggccctgtacagctaaagttaaaatcataatgtattagatggtatgaagggccaagcaagacatatttcattgcaatacagcttctgttacttactacccgagtaaatgcttgaaaggagaaaaacaatatgtgtcactattttcagctgtaaaatgggaacacttatctctaaaaaggcttggttaaagacattagattaaatgagaaatgcaacattacccattttggattatcataaacttaatttcctttcatttcccaccttcatcatttttacgttctgagaaataaaaatgtaaacgtttaaattgatttaggaatatttgtttttgtttattatgaagtagcctatgaagacaaaaactctccataggagtgactagaacagctagataagacatcaaaaaaaaaaaaaatctgctggaaagcaccagaggattgctgagccagtcaggggttcagaggcctagattatggcaagaagaaagccatagagaagggcgtttgttttctttaatctctctccccattggagaatttgttgattcttggtgtggggtcaatagttaagaatccaggcagaggggaagaatctagaggcttttttttttttcaattctgtggggctgaggtagacaaaatggaaattttggggtgccaaggtttacattatctgagtaaccatgatgctgggagggagagagatacaatgaagtattcaaagtactcaactcttattctcctgagacacttggcaatctatgaagatttataaggaaagaggcaaagatgtcaagtaaaaagccactgagggccgggtgaggtggttcacgcctgtgatctcagcactttgggaggccaaggagggtggatcacctgaagtcaggagtttgagaccagcctggctaacatggcaaaaccttgtctctactgaaaataaaaaaaatagccaggcatgatggcacatgcctgtgatcccagctacttgggagtctgaggcaggagaatcgccacctgggaggtggagggtgcagtgagccaaaatcacaccactgcactccagcctgagtgacagagtgagagactccacctcggaaaaaaaagaagatgaagaaatttaaaaagccactgaaaacacagtcaacttttctagtgtcttaaaatatagactggagaaaacaggaatttaaaattttctaagtagcggggggtcttagtacacttctagtttctcagttgagaagccttgtgggctacaccatagcaatgaaatgtagatcaaacaaacgaagaatcccgtagaaattcagtacttgtctgaattaaggtaattgtccccaactcaattttggagaggcaaacttccaaaagaagatagcattagcatcattcagatgccatactttttaatacacagtggctggcattcgatcaagaataaccaggtatatggaaaaaaaagaagaaaaaatacaaagataaaatgcaacttatgtattaaacagatttgtagtttgaaaaacacagtttttttaaaaaatgtgtttaatgtgataaaaatagaaatagtaagatgaagtattccaaacaaatcagactgaatagaaagatcatgtaatcacatttatattgtttccaaaatgaaactgtagcaggctgaactagttccaacaaatgaatatgcagaggctagaaaactataagaaaaccaacaaatacaaatgtgagaactgcgaaatgcaataaataaaattaagaacaaaattggtagacttaacaacagattcatccgttaaataaatagattaacacagaagagaggagtgtgttgtattataagagagtagacaatatcctggctgaatcaaaaataatttcaaaaagttaaaaaaaaccctaacacatatacacacacaaacataaaagacatatggaatgtagcgaacatgtgtgaaatatgtatatttacggttctagaaagactggatatttcagtctagaaagttcagaaagactggataagttactggatataagtaatattttaaatgatggtagccttttattttttatttttcgaaactgatggcgtatctcaacccacagatcaagaaacactatataactgaagtgagacaaatataaaacatacctaagcacaactcactcaaactactaaaatatcaaagacacagaaaattcaaaaagtgattatagatagaaagatatattgttacttaaaatgagtgacaacaaaacatagctcaactctcaacagacacaatggaatctagaagatactggaaaaaagtagatttaaaactattaatagttaaatggtgggtgatagtttcaactatttattggtattcttaatttttatcttgagttcaagcttgcaatgaattgtagtagtcaccttataaaacatgttcataaagtagcagattatagaccttgtttttatgactttgaaaatccacatattcattagtgttcttaagaagacttagaggactggtcaataggtgcagcaaaccaccatggcacatgtatacctatgtaataaacctgcacgttctgcacatgtagccagggtttttttttttcataagaaataaagaaaaacaaaaatcttaaagaaagaaagcaaagttaccattagaaggctgtgattaaagtagtacaattgttttttctcttgcttatctactatgacttattcctgcaactggttagcctttcaaaacttctaagttcgaaacaacatgtggaagacttgctcatgttcaattgttttttcgttttttacatattttctgtgtaattttgtggttttcacattcaagaataaaggcagcatttcaattactttgtaaaagtatgcttgaaataaccaaaaatttaagaataataatggactgcatttattaagactttaataaattagatattgggtattttaaaatacagaatgaagccaatatttccatatttatctgtcattctttcctacaaattagcttagtttggcacttagtattaatgtttcaggttataaaatagaaataaatcagtgtaaatgtaagtatagcataagagagttccaaaaatatatcattttcaaaatgacagtggtggagggggacataatatatgagttatacaaacacatttaatctttgtgaaatttttcccagctgtaactcaatctttccttcatctttgcttcctgaatactccacctcctccagtaagtggaaagccttcaatatcttgtggtccatatagaggtcactcttcactctcatattttctaccttgtctctgatagtctttagctcagcttgaacttagtaggtaacttatatgtgaacataggagctaacctgagaatgcgtcagattaatggtgtttaaagtacatgaaagtgatcagcttctgtgaattttcttccccttacagttgtgcgtatggcctgattcatcagtgaaacatccaggaacttcttcagattccgcagataccgactttttgcttgaaagattaaacgttgcacattcttttctagacctaggccaacgttattaaagggagctttgttttagaagttttaattcaataattgctgatgtcctgttcattccatagagagccctacttctgtgaaaagatggaatatacaaagagtttaattttttgttatgtcactgtatgcatcttatcagcaaatgttattgcatctgaaagttgaacttctttttgatccttattaataaggaaaggcaaaaaacatttaatttggtaaagagaatacaatcaccttccatatggaaagcaaatcgtgaaatatgttaatttaaaagaaaaatgagactcaaaatagttgggaaattgaaattttgctttacaatattctcttttggtagaaaaaaaaatctgtacttaaaataagatttccacatgatagtgacagcttttgagacagaaaagcacaacatctacaaagcagtgaatcaagacactactgagatttcagatgggaaaggtacttttagaaaacagcacatttaattggaaaaatcatttcttcatgtttgacctgcttagtttaatggagatgtttgagtagagggccagaccacttcactgaatgctcctgaagcaggaaaatagggtcttatcttatccaaactgtgtgtggacaagtattttcaactttctttttggtgagtgacagttagttatgttctataagtcttttgactggatgagagatacagggatgagttcttgtcaccgtgtgaggtaaaaattaactcattcattaatttaaaagaatatatagttaaagagtcatattaaataaaaaatgctgagtataagtaagatggattcttgtttgaaataagaagcaaccagtttacccttgctttgctaatttaaaaactcattaaagattttatactttaaaagacagtgtacctttaatcttcttcaaattgaactgttttaataagtcattaacactgaaataataatcaatgtatatggtatgatcatggttatagtgatcaataattattttgaagttttttttctagtttagttaatgataccatggaaaaattacaaaagaatgagttgttagagttgtgtagcagatagccaaccaaggcctactaaattaaatctaagaaaggtattattttgtattccaggaaataagaagcttagtttgttttatgtactttttccttgtttttctctactaatactggtaaatatattgcatcaaaatggcaataattttttttttactttttacctcttaggaaagagtgcttgctaactatagcatacactttgttttataaactagtatgttagatatattaccaatgcctctgtgatgaataaatgctctactgatcacatgtaaaaactcacagctgcttctccacagctcccagatttctcatattttcctgtcattgctaagtataattgtttgcacattagcttttaatgtgaaacttagccagatacagcaaggtaagatttaataataatgactgtatttatagttctccaagagtcagggagctcaactgtgttcacatcccccaaattgtgtaaatgtggatcctggggatgattgcaggacatacagcaagttgacagcaaacctggacaacaatagtattttatacgtctataaatgttttacaactgtcaacacactttccaaaattatctcattatattctcaaaatagctctaggaaataagtagtctagacattatttctttatctttcctcctcttatggaagagtaatttaggggatggggagtctgtatgacttaaccaaagtcacagggttagcaaaaaacaaccagtagaaaaccttaatttccttgggaatagccaccattcccttcaaatatttactcagcaccactgtggaccaaacactattttaagaatacatcagtgagtggcccaaacaaactcagtgtctgttcttttagagcttttttataatatattctagtagggaaaatatatactaaacacattaaggtaaaaatacatattaaaattttctataattatacatactataaaaatgaaaacacaataatgaagtggttggcgacagtggcaatggtgactagttttagtacaatggtcagggacacactatttgatgaggtcacagtgacataaagacctgaatgatgagaataaacaagtgatgaaaaatttatggaaaggcctttctaggcagaaggaacagcactcatatgagggaaggggtatatttgatatacactggacaatgtggcctcagactactgagagggtatgaggggagaaaagggaagggcagaaggtcagcagacagatgatcttggtgagacgcttgagttttatcatcacttgcatgtggaagtcaccgcataattttcacagggaagggtacattttaaagagatctttttgaatgctgttttactttttatttacaatgtaatcttcatttcattttataaagtgaaacctaattttaaagtatcttttgtcaaggaacatgttggtgtttagaattagctctatattaaaacttgtctgcacatttgcatgccatgcaatattctggattccacttcctttatcaggaagacggatgaataatgactatctattcatccatgagggctagcataacacatggtgatataacatatataccaggcagcagtatttttttaatttgtagagacagggtctttctattttgcccaggctggtctcaaatacctgggctcaagccatcctcagacctctgcctcccaaagctttgggactgcagacatgttctaccatgcctggccagtatttgtttgttttttataaataaggtactattattaacttagaaaaactctgttaaaattagggcttaccagttagatatagggcttaccaaaaatacattgattaaatatcctgaatgtctattgtttaagggttattttgaaatatagatggacagaggataagctacataaatttgtcctttacattttgatctttaaactttaaatgaaatgggaagtcttaggctacagaaaacagaaacttataccagatggcaatagcacacagatgcatttctttaaaacggaaatatataattcatgtttataatgcaaattctccaagagaaaaggctgcatttggttatttagattgtcagtagatttggtaataaattcatatatatctgggtgttttaaaaaagtttgttaattaatagctaatgagagatgacatcagtgggaggtgacatttatgaaaggttttagaagataatggtaaaagtttcaaaattaggtttttcacaatttttaaatgtcaatgagcattacaaaccttgctcacaattctttgtaaagctcttggttcacttcctaaagctttcccctgttatgaaaaatgtaaaaataagcttcttaggaaaagatcatttttttccaaaatcaatagcagcaaagacaaataccttggaagtcacatgccattttcactgggctaaattttctatagacaaatgcagatttatattggtaagtaaagagaaacagtttttatgagtgcaagtatttatgagcccagatgaactaaagtccatagtaggactcattagtcaaggcacacacacacaaaaatcctgggctgtatacaaaacaagataacttcattgtgtataacatatttcatgtaaactgcattccaaaaaatgttttacagtgttaaattataaaaggccttggatagtacatgtaaattatggactataaattatagaagcatgtaaatacattgcattgtggctaaattaagtatttaatcataatgccaagagctgaggatgaagggaaataagaatcacaagcaaaaataggaaatataaaaagaatattttaatacagtatctatagtcagagaaaggatgcactggactacagataggatgagagaaatgtccaaatacagaaaactgtgaatagacaattgaaaaaattataagaaagcaaataataataagagaccttggaagtcaactgtactgggcaactctgggcagttggctcatagctcacacagctgtttagctttaaacacatagcaatgacaaatatcaaaagatacaatctcagaaattagatctgcagctctgtgaatcagaaattcaaactaggcagttggactaaatctgaggatctgttggattctggaggaggtggctgggagctcagtgtttgtgagtaaagagaatatagataatagaacataaatggttctataataagatggtgagtcagcatgaattccaaagcttgcagctaagaactgaagcaggactctcaagcatgtggaacaaagttgaaaaaaaaatgctgtaggttgggttttcgttttaagctaactgagaacctagagaaatggagacaagtgcacagcctaatgacaaagaatagatccaaataatccatagttatgtaactggatctgtgaaagcatcaatccatcttttgtgatgccatctcttggtattgatggtatcacagatctagttacataactagaaaaataatcaatcatcaccaataacaagagacagcaggcaaaatcacaaaataccttacattattttaacttaaacactgaagaaagtcaaaagcataatggaaatctaaagaggcagaatttaagttttagaaaccatacaagtaaatatcagtcaataccacattttgtcttgattctgtcctaagagtcatctgttatgctaatagaattgtatgagaggaaaaatataaaaggctagcaggagttaaatcatgtgatctttagtctacttttgcgtcactgcttggagaaaaatcaggactccaataacatggattgtgctcctgcatttaccattcacccagaaggttagagttacttagagtgaaagatactggaggagttatccaagattgctgtagaggataatccccaaatgccactaatgtcttatttctagtctgagagtttagatatctagcctgagacaatcacaaaagttagacaaagaaatgagcgaaaaacaaacaacacatacaaacaaaccaaaaaacaaacaaacaagccaaaaactactcaaatactgagctggaaaccaaagtcccaagttttataagaggttctaatgttaacaaaaacaacctacagaatcaatgactagaacataaattcactctaaatttatatataaatttagacaataaacactagcttgaacacactgaagagagaaatggcgaattttatttcctgatatacaagttcttgaaagtacttgataaacccttgctctccaaacatctagagtgataaagatatttctaaaaaggataagcaatggacctggatgttctaattacacataaaagaaacattctaacaatatttgtgtagaaagcagctggatataggcaaaatttttaaaaaaaaagtaattcatagattgaattattggagaaaaaggaaggataaagataaatttacaaccacacattttatagtaaatgtgcatttcatcactgataaagagaaactgttaaaactaccagaaagataaaagtgatcatatgcaaaagatttaattaaggctgatcacagacttctcacctgacagaagatgaagaataaatacccttgtcatgtagtttggttatttgtccccacccaaatctcatgttgaatcttaatcccaatgctggaggtggggcctgctggcaggtgtttggaccataggagcagaaccctcattgcttgttgctgttttagtgaaactgagttcttgcaagaactggtcatttaacccttttcaactctaccctgagaaaacttgcagctgcagcatttatcccgagataactttgccacaaactatttccctttcattattattttcacattgctctagcacagtgactgaaaacaaaagacatcattccatttataccattctgtttttagtagcggtatttccattgacaaaatatagtaattctcaattgctgaaaatgtcaaatcctggaaaacgtagcattcctacacatgatattaacatcattctccagcagttgttggctggaatcatttgatgaatttgatttttctgaaatagacaattctgatcattcagatgattctgatgttagttttgtttagaaataactccaagaacagtttctatattttcttttcacattgaaaatcagtcagattttgttcaacctcaaagagtgtgtttacataaaattaaacgagtgttggcagtgagctgcagggttttttattcttaaacaggaaaagggttaaaggtgtgtggctcctccctctgccccccccccccccgccatgttctctctctctcttgctctggttttttccatatgacgttcctgtttcccttcaacttccgccatgattgtaaccttcctgaggtgtctctggaagccaagcagataccagcaccacaattcctgtaaagcctgcagaagagtgaacccattaaacctcttttatttataaactacctagtatcagatttttatagcactgcaacaatagtctaatacaccttgtaaaactaagagaatataattccagtattatatatcatccaaactgccactctagaccaaggacaggatattgagacatacaaatgtaagagagtttaacactctatgactcaagctaaaagagtgagtaaaggctatacttcactgagaagagtgaaaccagagagaggaaatgatacaaaaaacatcattgagcacagagtatgccctggctaacttcattaagattgactcaaaagtaataagtattttgtatttaaaattatatgaaacttaaactctataattagttctatgagaaagaagactcaataggccatcaatatgcatgaaaagttcctgaaggtcccttagttatgtaaagcaacatctagagttacctatgtatgtgacaacattgtcacaccactaaaatgattggaatatattctagatgcttcaaaccagaaatgggaggggggatatcaagaacttgatcaatccagtcaaaattttaaaggaggggtggggagagatttcaaataaaatggagagcatacggaaaacaagatggtactatacatatacacaatcacaataaatataaaatattaagttttcatattgaaattattattatactggattaagaacaattccatcaatacaaaatcagctatattctgtatatggggcacacttaaatacaatacagcaatgaaatcccttatgccatgaaaacaatggcaaatgaaaatagtaggtagagatatattaatgagagataaaatgtactttacggtggaagtattagtaaggatgacacatgatactacataataaagaaaatacacaaatctcttaaagaagatataaaagtcattaatatataatcacttcacatcacggcctacaaatatatgaggcataaggtaaaacactttcaataagcaattaagaaaatcagtagtgatggggaagttttccagtacatatccagaaattgataaaccagttaggaagagtagtcagttaacaaaaactacagcatgttcaaattaactgctatttacataggccctagccctcccaaaggagaaaaaaaatgccaaaacccttgtatttgcttattttcatttacagtataagcgtcaatatacggtgatatccccctatctgcagattccctttctgtggtttcagttacccgcagctcactgcagtctgaaaatattaaattgaaaattccagatgtaaacaatttgtaagtttaaaatcactacccttctgagtagtgtgacaacatctgctgccatcttactccttccccttccaaccacatgaatcctccctctgtccaagagatctcactgtagatgctctccaattgtcagtcacttaggagccttctcggttatccatcagatggaccatcgtggtatcacagtacttgtgtttcagtaacccctattttatttaatgacgtctccaaagcaaaagagtagtaatgctagccgggcacggcggctcacgcctgtaatcctagcactttgggaggccgaggcaggcggatcacgagatcaggagatggagaccatcctggctaacacggtgaaaccccgtctctactaaaaatgtattctaacaaataagtgcctactcccagaaatgtaaagcaatatacatttcagagtaaatgataactatactatgctaatggagttgaaaggtgaaaaaagtatatgagcttctcaaaataagtaggtgtagcattcaataaatttcaatatttaacttatgacagaaactcctagttggttttcagctcaaagggtaattcgttaatcatcttaagggcatcaagaatgaaatgtcttagacattgcattatagagactaaataaaagaaatggtgcaaaaaaatagaaattgttcttatttatggtgttataaatatctcagtaaaacatcagaaaaaaattaaactattaaaattattttttaagattatcaagttttttagattcaagatccacataagaatcaatagtatttctatatttcaataacaaataggatatatagtagaaataacaatgctgtatttataaaaataacaaaactttaaggtccccagaaataaagctgaaaaagaagatatataagaacttaatggagaaaattaccaacaattattgaaaatataaaagaagttttgcacaaagaagtatctatgctatatccaggggatggaagaagccaactttaaaatacaatttttcccaaattaatttatgaacctagaagtaatttaaagatagttattttaatgattttgatatattgatactaatgtgcatttggaagaataggggtaataaataatacattttaaaggaaatataggaggtgtcaaaggaggtaaacgttttaaaaaaccattttaaagataatatggaaagccatagctttatcaaagcataatattggcagagggaagggcaagtagaccaataatattgatagtaactctatataatgtttatatatgtgagaggtaacattaccaattagtggggaagagccgctaagttcaaatagaagttgtcccaatcactggaaaaaactaaatctctacttcataccataaacaaaaataattacaggttgcacattgagaaatatgtttgaaagtacaatttgaaatcataaaatatgtcaacaatatttttataacattgagattggaaaaaaaattcttcaggcaagactcaagaaatataaaccataaggaaaagacagagaaatctggctcaattaaagtggaaacaaccgtccttctattattgtagatagcataaaactttaaacatacaatcgaactctatgagaatatatttgccgtagatttaacaataaataattagtattcagattttataattaacatctaaaaataaaaaaaaacttgaaaatgaacaaaattttatgaactttctattaatttaatagaatttttttaaaataaaatatactaatagatgctgttcttaataattataaaatttaaaccacaagtagataatattttacatctttgaattaaaacttacataccttcaaatgttattgcaaatgtgaaaaaatggtacaattcttactccattcaccaactggaccacaatgtggaaatagctaatgcattttaaaatgaaaatactttttacaacaaaattatacttttaggtagacatgtcacataaaaatgcagaaaagaaaatatatgttcctgtatcatttgtaatagtgagaagctggaaagttttcaaaatattcattaactgaagaatgaataaatatgtattatattcatacaaagaaacactataaagtaagctaatgaattaccattatacatgaaattgtaagtaactcaagttgagcaaaaaattttacttaaaaatcagctgcattatgatttgtactatacaatggcattcttacaaagttttacaaatataaatgtagaaatacaaattatctgataatatatgaacatgcataggcttgataaactccaaatttacatatgggtaacctgtaggtattagagagtaatattcaatagtcttatcaaacatctataatattctatgtcattcaaaagataaagagattttagcaaaatattaaaatctggtaaagttgtacatggatatatagatgatctgtatatttttaaatgacctctttatttttgaatagatatagatttccaaaaaaattgcaagatagtacagagaattcctgaatggctcataccatttcatttattaatatcatcttgcattagtattggagatttgtcacaattaattaaccaatattgatacattacttttaaataaaattgattttattcagattttctaagattttatcttaagtccttttccagaattgcatccagattacaacattacatttaattttcaggcctcctgaggctcctcctagttatgccagttccttagactttccttgtttttgatgatcttgagagttttgaggtacatttataggagattttgtataatgtcactgtattgaaatttgtctgatgtgtactcataagtagcatggttataggtttgggagaggaaactcacagtggtaaagtaccattctcattacattatatcaagggtacatgctattaaaatgacatcactgttgatgttaacttggtcatctggctaagcaagtgtttgtcaggtttcaatattgtaaaattattattatttttttttttacctattccagtagtctgctctttgaaatttactatatgtagtccactgtggagatatgccccacctctttgagagcagaggatctacattagttatttgtaattctttggcagggcatatttgtttcttcttccatttatttattggttcagtcttttatttgtatgaatatggatttataaatatttatttgttttactttgggttataatgcagtacttgttggactgattttttttcaaaaggttctagttttggccattgagagctctttcactttcactgtgtcctctttacataccttcatcatcttgtgtttttgtgtgtgagagagagactttgtattttcttccttgctaaagttctacaaaatagtccaggttcatcacatcatgtgcaaatgaaaacagattgattgtcctctctcaccactcctatttaacattgtgctgaaagtccttcttagtgctgcaaacaaagaaaaataaagatattcatgaaagaaagaaagaaagagagagagagaggggagggagagagggagggaaagaaagaagaaagaaagaaagagaaaggaagaaagaaagaaagagagagaaaaaagaaagaaagaaagaaaaaagagagaaagaaagaaagaaataaaggagggagggagggaaggagggaaagaaggaaggaaggaaggaaggaaagaaagaaagaaagaaagaaagaaagaaagaaagaaagaaaagaaagagaaaaggaaagatgttcatacttacacatgatttgtcccatggactaaagtctatgttaaaccaaaaaaaaacaagaaaaaaaaaaaagaaacattctccaaaaatcctggaattaatagttattacaacaaaattatgttatgtatagttaatatattaaaaaattgttttcctttatatcaacaataaacaaaatattttatttaaaatagaaaatacctgacaatagcaacaaaaaacaagaaataaaaaacaaactactcaggtgtaaatcaaacaaaatatgtatatgcagaaaacactaaaactctgagaaaaattaaataaatagaatgagagatattctatgttcatggattggaaaacttagtgtttgcctatatcttagtttgttagggctactctaaaaaagtaccttatactctgtggcttgcaagcaatgacaatttattttttacagtcaggagaatgggaagtccaagattaggtgcggcagatttggtttctgatgaggatctgctttctggctcacagatggtggcttcatgctgtttcctcacagtgaaaggggcaaggcaggtctctggagtctcttctgtaagggcactaatctcatgcatgaggattctattctcataacctcatcacagccaaaaagcctcactgtttactgttattatcttgtggattagaatttaaacatatacatttggggagacacaacatttagacgagagcaacccatatgataaagaatgacacacctatgaaactcaaaggcaacagtcatttcagatcacccactgagctcactcagcactcagtttctaattatctagattgaaagtccacaagatgtccctgagtaattatgggcatcagcttttgtttcatagacagctgagaatacttatttattttcagttattaggatttcccaggtgggtgtggttgtacaatgtattctagagcatgagtgttagaaagcaaagtaagactaattctaatgaatatacttacagaagtatttattcagcagtctaaaaattattactgaaaaaaattcacactttgagaaacacttgtgtttcaaaatgtttaaatttttacaatttaataataaaataaaaaaacaaaatgaaaataagcagaaaaatggaacagacacttaataaaataaaacatatggctggccaataaacttattaaaatgttttagcatcattatcttcagggacatggatggtaagatgtccctattttgagctgactagaaagagttaacttaaaatattgaaaatgccaaattaccatgaacaacttcaattctcatactttcatggtaggactgtaaaattgtatgatcactttaagaagatgcttggcagtttcgtgtagagtttaacgagacctacccaccctatgatctgtaagccttaaaatctgctttcttattgtatgtaagatgtacctcaattaaacaaaacatagtgggagaggcaaaaggaagaaatctctccaaaacatctggtctaatttttcttataatttaattacattattttaaactcacattcttattaatgaaaacatacatggaataatgtatgtaagaagtttttgcttattaatgaatacacagtaaatattagccttgattatttaaaacatttgattcaaaaataaaaatttcttataaaccttcttaa

SEQ ID NO: 469 - DNA, 40001 bp, Homo sapiens
ttccttgtgaatgctcttccctcacctcttcataggcatgtggctgagccaacccatcttgcaagacccagcctccagacacttcctgagttcccctgtggacctggactttctgcctttgtgctctcttagcactttctctgattgtccctgaagacagcctgacctgtaaaagtctaatagcacccccaacttatttcttgcaactgtaagctccttgtgggcaggacccaaatttgatcctgctttgtatctccttcctctgctattggggccctccccaccctgccaagtgaccagcccaagaatccacaaaaccttttctgtaaatgtttctgatagtaaatattttcagctttgtaggctataaggactcttgcaactactcagttctgccattttagagtaaaagcggccatagccaaaatgtaaacaatgggcacagctatgttccaataaaactttatctacaaaaacatcaagctatcaagctggatttggccatgggctgtcgtttgctgacctctggttcagccagtgtttagcaaaggtgttatgtaaatgtttgttgattgttgggatggatgggtgggggtatggatgaatggatgacagaaagaacagcttgtgagtatttggaaactgggttaacccaagtacataaagtcggagccctgctactaaccacatggccacttgcagaagagggaaaaaagagttgcctgtgttcagggagcattgcctcgctaagaggaggatggtctctgagaaaagctggaggggcccctaggtgtggtggcatgggagaagggttggagggtgcagtgaggccagccttgtggatcagtgatgtgagcagtagctagcagagagcagaagcttgccatagtcctgcccaggatgctgcgccacttagctcactcttctgtcaccccattgagtaaggaggctggcgtcctggggttgacgcctccatggagttgatatggtttgggcagtgtggaccttctcaactagtattgtttcttgtctacctttagttggcccaaagccaagacagtggcctccatcatccagagaaccaggcaggtaggtcctgagtagcctctccagtgtggccaacatcgtcctgtgccataaaacctggagcctggcacctgtacccctgaggaggacagctgacatccatgtaaccctttattgtccacacagggctctctgtgtctcaccccacttgatccctcctccaacttttcaaggtaagcagcagttattattactgttcccatttgccctggaaagaaacaggcttggagagtgtatgcagattttgctcaggaccacaaaaggtggctctgtcttctctccaagcagagaagaaggtggctctcaggaagcccatctccagcctggggctccctgacaccagctttgctaccccgaggtggggcccatcccttgcagacactgccgtgttgtatttggtttgagtccctctgtcaccacggcacacaggtatgttcaccagctttccacaggatttgcagaaaccctcacctttaggaaaactgtttgccaagggagcccctttcaaagggccgtgacaggcacagttgaggatttaaactgggacccacatcggaaggaagggctatgaactgctggggctgatacaaggacaggtgcaacatggaactgatgacccaccagacatttaaccatccacatatttccaagctgaaagtggagaatttttccggctttcccaggtaattaatgatctgctgatcatctgaatttccctctcctccttctgtataacgatgcaggcaaaaggaaaacaataaccacatttcttaaaaagaataatattatagtgatagagtggtggtataatctctcatccatggttctttggataaaaatgcttccttggacagaaatataattctctgtaataacacccatgatttttttccatacacctggagagctaggggagaactttaagaagttgacgtggaacacaaagtttgctttttgtattctgtcagatgggcaagttcaggaccaaaccatttaagaacattggggaaataacttgaaatataatgatccattcaatacttttatctttcttttttaagaggtgagatcttgctatgttgcccagtttggagtgcagtgattattcacaggcgagatcatagctcactgaggcctcgaactcctaggctcaagcgatcctcctgcctcagcctcctgagtagctgggactagaggtgcatgccaccacacccggctctatacttttacaaataaaacaggccaggagtggtggctcacgcctgtaatccaaacactttgggaagccaaggtgggaggattgtttgagccctggagtttgaaaccagcctcggcaacacactgagactccatctctataaaaaatacaaaaattaaccaggcatggtggcacacacttatagttccagctactcgggaggctgaggcaggaggatcatcagagcctggggaagttgaagctgcagtgagccgtgattgcaccactgcactctagcctgggtgacagagtgagaccctgtctcaaaaaacaaaaaataaataaaataaaggatcttgagatcctcttcatctttctaattttttccttttaatggacaagagaaaaaaaaatgatcaaattatgacatgaaacaaaaaggaacccaaatgtggggtaatacgccatttccttccatgattctaagagggacaataaaaacatccacttgggaagggaggccccactcctttcctctctttgccaaggtttccgcttgtccctggatcacttcttttacttcttaagcctcacttctctttcctgtctctacctcctccttcagtgtttaaagctgtgcctccccactctctcaacattttaaatattcttaatgatgcaacctgaagttgccatggcaactaatttccttgctgaggcagaggtagaggcctgtgatcagcctgccattgaaatctccaataattttccttttctttcaaaattaagtagggcatctcaagtgttccactgtggttttccctgcccccaaagaatcagactcccatgcactgaaatatccagttattgcatttccctggtatcttttatgacttccttcttcactggcatacacactatccctctggaaaaataacaacaacacaatctttgttatttctcttttgtcagtatgagaaatggttctgatgaagtctaatgacatttgatgggttttccctcctctctctctctgtcttcttaaaaattgcctttagtttcccattcttaaaaacaagtttctttctccttgaatcttgaggacagctttgtaaatagcacttccatgcacaaaactatttgagcccaagatgctgcactggtgtcaccatgtggacttgcccgggagctgtgcctgcctcctctgtgtgcctgagtggttctcagtacaggtggggctgggtgccttctctcaggatgccactattcctgtagcaccttgaactagccccatctttctgcccttcctgctccccatcagttcctccagccagggacatccagctccttcctgtagcaggccactgagtctgctctccccaaagtccagtaactctgtaacacaatgtcagtgtggcatgcttcctgcctcagtttccatggagagacctgtcattaaagtgagcaggagaatctacaaaggaaacaaggaaaaatcagttctgtggttctggggccctcaaccaggtccagaatatttaaaaaggagtcagagtgtggagcagggaagggttttgcacagaggccatctctgggcaagttgggctgtgctgaggagggggaaggtggagaagcagggggcgtttaccgtggctcttcccactgctagctgatgagtccagtgaatacttttcagttcttctcgtaacctccctaggcccaggacactgttattacttccttctttttgaattctttccttctttggcttttacaatagcagtctctctgggattccctgctacccctccaactattcgttctcaggaccttcccagtcatcctctgacactgacatttgccagggttacagactcagttgctgcttctttcctgcccccctcccccactctctgcgccatctcattgtaccatctgtacaactatcccaaatgtgcattccaatccaaagctcccttctaaacaaactctacacccatgcaactggctcctgaaagtcacattgggctgtcccacagacctccaactaaataggtcccaaacataactcaacattttgccctcacactcttcctttggtcttataaacatggtaagttgtatcatcatccacacaggccagaaacctgggaggcagctttaaatcttctctcccacaagctctgtggtcgaccagttaccagggctgtcaaggttccatgtgaagagccccctgggctatgcccagcagggctcaccaccccttggatggccccctatagcagcctccccttcatggcaccacctgccacccgtcctgccctctctgccccagaggagctgtttctccaatgcaaacatatctgggacaggaccctgctcagagcaaaccatccttgccttgagaatgcaagtccaagtccctattatgtccttcaggtcttgcagagatttcaagggtcagcgcagggcagggaatgcctccaggctgaaaggaaataggaacaaagaccagagttattgtgaaggtcatgttattgtcccttcctcacacacgatgaagcaaagagggggtctctgcagtatactcgcagtgcactgggacagagccaggacatgaacttgagccttctaagtcctctgcttttcctagaggactaggactcgttgctgcaggcaggggccttggagtcttttttcctctgtccctcagacccatggatacagcccacaaaccatgacagtgtgactgtctcttgccacttggctggctcggttattcattcagttcccatttgttggtacacctgctcggggccagatcctatgccaagtgctgggacgtggaaacaagtaagaaactctctctgtcctccaatacctcccagtcctagggagtgtttgggagctggatgctggatcagacccctatgaaacaatggtggaatcaggggaacctcttaacttttctagctaccagttcagcctctgtgagatgaaggaaattatattttcctatggctgagcttgggagctacacaggcctgggtcaattcctggcatccccacttagtaactgtgaccctggtcacattgcataactacacaatctttgtttccttacttgcaaaatggaaacagtcagaatctccaccttacaggactatggcagtagtcagatgagctgatgcatgaaaaatactcactgcagcaacctaacctccagtgagcacttgggatacctgaaggagagaacttagaaggggagttggtcaggaaaggtgtgctgggggaatgaatggcttaagttaacgtgtggggataagaaacagcgagggagtgtacactgttgctgggaatgtgagttagggttgccatgatagacaacagtgtagcagttctcaccaaattaccatatgacccagcaatccctgttggttagatacaaaggaactgaaatcagcaccatgtagagatatgtgcacttccatattcaatgcagctttatttacaataactgggatacagaaacaaaatatccatgtctcagacaaatggatatacataatgtgtcttagtctgttttgtgctgctgtaacagaataccggagactaggtaacttgtaaagaaaagcttattctctcacagttctggaggctgggaagtccaagatcagggcacctacatctgggagggccttgctgtgtcctcacatggtgggaggccaaagagcaagagagtacccagctctctctgtcaagcctctttataagggcaccgatcctatacatgagagaggagccctcataccctaatcacctcttaaacccttacctcttaatattatgacattggcaacacctgaattttggaggggacatattcaaaccatagcacaatggaatattgtttagcctttaaaaaagagatcctgccatttgtgacaatatgaatgaacctggaagatattatgctaagtaaaataagccagacacagaaagaaaaatactgcatgatttcacatgtatttggaatctgaaaaaacaaactcatggtgggtactggggagaggaatgggaagatgtaggtcaaaggatacgaagcttcagtcacgtaggatgagtaagtgcagagatataatgtataacatgaggactggagtttaataatattgtattgtatactggacgttttttaagagtagattttaggtactcttaccacacacacacacatatgaggtgactatgtgagatgatggacatgttaatttgcttgagtgtggtaatcatttcactatgcatgtgtatatccaaacatcatgttgtaccccttaactatatacaataaaaaatagcaagagggagtgtgtgtgtgtgtgtgtgtgtgtgtgtggtgtatactatgtgtgtatatggagtgtttgtgggtgtgtgtgtgtgattttgtcatatgtgcatagtggtgagagatgaggctggagaaggaggcttaagggtggacttaggtaaccaaagatgaccttgggcctcgttaggtggttttggctgtaacctgaggggccctgggagccactggaaagttggttgcaggtaaggtgatgtgtggcctggtccctccagcaggcaggactgtgggggatagcctgcaggggtgagccagggagaagaaaggatggccaggagctgtctgtggagccccagggatagaggcaggccacggaccaactggcgtagaaagtgtctggatgactcccatggagccaccaagcgaatacctctgagcccccgatgggcaggtgtgcgctggttgcgggcatcaggacacaaataagcccagcccctgtcgctgtcatgtccctgagatctgagacgagtacacagctctctccacagattcttgatttctgattttcaggcctgtgatttggcagcttggaatcactattatttagcacctaaaataagtagtccctgacacatagtagacactcaataaatatttgggaaaagaatgcatgatttctgggtgcatttcccatctttgttcaaatggcagaagtattcatgtcttgatttaaagcagaaagtgtcctgaattaaggccttggcctggccctgcagacaagctctgagtgtcttcagctgacaaacctttccagcctcagtttccttctgggtcctgctgccctcttccccttgcaccaaggttaaaggagagaacagatgtggtgctgtttttgcaaacggcagaggctaagaggtctttgctacagtttgctgcatgagcggctggagcagtggaggggacgggacagaatccatccccactagcctcagggctatgccaagggagactgcattccaggacaacagcagggctcttctgcactttctattttgtctgcacccgggaggtattaggtaactctgtgaaacctaagtgccttaagggattagagaaattcaattaaattcagataaccttcacactcatcatccaatttgcacataccaaaccaaacagacccccaaatcatctcaagttcacccagcactatctctcttctctttgtattcctcctactatctactgagataaatggaggtccatgaggaaaattcctccctttgagccttttcagacctcctaagcaaaaatgacttatccagcatcattggaggttaaagaatggctcaaagccttgaatggaaacagaaagtgtatctatttacttggagagtttcctctccaactccttcacattaggcatcaatagcgctggtggaacaatgcctgcaacccatctggcggaggagccccaaagcagaaggcaatgtgattgactgcgagtcaaggtctccctgtgatggaaggagaacactcggtagcgatgataaagcactcggaaagtaatgatgtacttaaatgtacatatgaagcacttttaatgtttcttcttttgacaaagagaaaactgaagtgggcagctttggtgaaacgaacacctctgtccctaacttatgctgagtggttgatctaggaatgtgagcactgtcaacaaaggcattatcaccaacaaaggattcttttagaggctgagaagcaggcctttgactctgttgctttatctttgcctgtgaaaacatttctgttaacatgctgctggaagagagaggtactccaccagtgtctgcaggagacagacatttggagcaaaacttgtacatcaaggaggtgagacagtatggcagtgagggaaaaacatgctagattcctttccaggagagatggggtctatttcaggcgtctaagttagcagacggcaacctaaggagcgccccacggaaagagatgtattggttagctattgctacaaaatgatgcataacaaaccaccccaaaactcagtagtctcaaacatcacttattcttaccaatctgcaggttgtctgggctcagatagcagctctgcttcacacttggatctggtggtgcttggtggggcatctctgctctatgtgtatctcctttctgcgctcaggctaagagacagcagctacccaggtgaaaggtttcttacaggaatggcagaagctcaagacaacaaggtctcctaaggtttaggtctggaaatgtccagcttactcctgcccatatgccactgccaaggaagtcacaccactaagcccaaagtcaggaggtagggaaaagcgctttgtctacaacaaggccatctcaagcttgtgagtgcagggaaaggtgaggaattggggccgatcatttaatctgcctcaggaaatggcatctgctgagcatccaccatgtcccattcacatatgcgggtctgtgatacatactttctcatttgtttttctcagcagttctggaaaataggcattactatttccacagatgagatttgacaaaggaaagtaacttgaagaagcttacacagcagcgttgggattagtacttaggtcggcctgattccaaaacctagacttttcctggccatgccactgacccatgctgggatttttcctttggcaaacaggactgaaatcccatttttgcctcccttcacaagcttgtatgaagctcaaacaagataatgtatagaaaattgcttttgaatctcaaagcaccatataaatgtaaggctatgttgtttaatattatccaaaccttcgctgtgattagtatagaatttgagtgaggctacctcagtcccagttccaattaacttcatgagtaatcctggtcatgtcctctttccttggtctaccccactcttttcattttgaagaggggatatgaattatagtattaaatagtgatgttttgaatggccatgggcaaaagggatgggatggttgactttgggcacctcttgcctcaggcctgacctcgccattggctattccattggctggtggagttgcgatcccccggcctagcctctgactctctgttctgccattctccttagagcctgtgtccttttgcccattggcatcttcctggcttgttctgacctctaggatcagtaaacagcctccattgaactgattaacataactagccttattttgccttgaccacattgcttcctgggctccacccttcctctggcttctcccaggatgtttcttaaaggttcccagctgggaagtaaaccagtctcagaaagtgggctgtccagggactacaggtaagtaggagttctggctggaagaaagggaaagcgggcagaaagaagagtagagactgcctaagaaagacgagtaaatgaaccctttgtgaaaagactgagtgttagagaaccatgaattgcatcaatatttttagtgggcatatcatctccagagagttgtctagaccatttgtgaatccacctttccatctatccatcatgtaaacatcaaacatccatccatccatccatccgtccgtccgtccatccatccatccatccatccatccgtccatccacatattcacccttgcaaccaacatttcttgagcactgatcataaggcatacaatgagtaaataaaggcagtaaaagggcgaagttttcagaatgcctactcgctttacataaaatgtccagtttaattctcacaacaaccctaagattatgtgtggtttgacaacagtgaaaatgagattcagagaagtatgtcacttgcccaaggtcacacagttgtcagagacaaagccataattcaaatccagtccctctgactctcaaagccctcttccttccaagtatggtccatctaccctccttaagtttgtttcactagatgggcacatgccgctgtaagtcctaaccatttcttggtatgaaaatcccatcatggcccttggccatgacacccaaggaagcctgtgctgcaaattacaagctggaatttgccccacaacactgcatctctgattgctagagatagcagaagagtgacgagagctgggacagatgaagaagtttcttggttgctcatggtgccatgttgacgagcctcttgctagagcatcacccgcactttgtgctccttaccaggcttctggctgctgctgagaggaccattgttacttctggatggctgcagtgtcttcctgagcccccaggaacagcctgctggggatgggagtattatcttgaggtcacatagccagagaaagtttgagttagaggagacctgagctctcaccttgtccagatggcaaaactgagcctggaaagggtagcagaagcttcacttgtcccctcaagttcacttctccacttcatcccctgtgatcacttgatcattttctggcccacaggctgctgatgtgtctccactcccagcagcctgccgtaggtctttgtgctagaggacttccttcagcacatgttcatgaaggcctggccgtgcttgggaactgggttgatgttctgcagaggccatcccttctccagtgatggactggtacagaggtatgaatgctgcagctccctcaccctgactgggacaactctcaggttggggcactgagccgcagttgacctccatggaactttgttcgatgccaattccttgttggcctccttccctcccctgttccacctcctcgtccccctacctgattttcctggaacacttcctcattgattatttcacaggaatccgcatttcaggagctgcttctggggaactcattttaagtcagagaggcagagtggtctcaaggagaaccaactgagaatcttgcaccaagcagagccaagctccgggttttcaactctccgagttttctctgggtcatataacagtgaaattggttgctgcttctactcctacagccttccatgatagctgcacccggagttatcagcggttcaaacccaaaaagctgatttatcactcacactacaatctaatgcaggtgttcctggccagtcagccaccctgtgttcactgcgccccttccatcttgtgttcctgtgtcttcgggtgctcttctgttcagccagtggatgtggaaagagcttgcaggagcgcatggaagggtgttatgtgctgggcctagaggtggtgcccatcccttcagcctgcatttcctcggccagaacccagtcttgttgccacacctaacaaagaggcctgagcatctcattagctgtgtgtccctgtggaaaaggagaggagtttcaatgaacacacactgtaatctctaccacaggcaagagacttaacctctctgacctggttctgctgtaagtggggagccataacacccccgcttcctctggtggtgtgaggttgcctgtgccaagacatagcatgagcttccagaggaactgcatacagtaagcgcatgggacacgttgactctcatttccttcttaaattgttgttttcaaatctgggctcagcaccactgcatggggacaaaaactattagtgcccttggcagcatctcataaaaacctccactctccagcccaaaaggaagccccacagcctcctcttccagatcccacaagttgtctgagagctgaggtctttcatcctcccctgcctaaaagcatgagatagaaacacaacatacgaaagggcaccgtgaagcgtacattaacctccgacctcgttagaagccgcgtgctcaaggcctgttggtgtctccgcatcacagccggtcccctgtgcccctcataggtgttgtcattgtcattcaaaatacctgggaaaatgtactttattgaatctgtttccacattgaatgcaaacatgcaagtctgcttctttcagcagaaatgctctcagagttctttttttccccctcatcaaattcctccttccttaaataaaagactccttttttccgcccttggcagtgttgttcagcaggtggtattatatggatgtttttctacagtggaggccttcagtgaccctcatcttaaggaactgcttaagcattcaataatagcccatacagtggctctctaaaaataaacatctgcttagaaagaatttaacctgaggacacactttagaggagggggcatccttaatggacttttagtgcagagccgaaaaggagtccattgcagctgaaaactgccggcttctcgtcgtcatgatacccgggatgttgttaactactgggccaggtgggctcagggagtggaggtgacggcggcctgccgagggctagagccggggagagaaggcgcttcctgcctggttcctttgttagtctgtggaccagcctttctgcacacatgaagaggaacgaaggggagaggaagcgccctgggtgtgacatgaggacagtcatgggctgcagccgggcctggcgtcctgttctggttttgccatgtcctgcttgggtgacccgtggcaagctctctaccttctgagcttcacgtctgcatcagaaaactggagctgggaaacctctctcagagtggctgtgaggattagagactgcatctgggaaactccagcgtggggcctggcaaatcacgaacattcgataatacagtgggtgtggtcaccagatccccgagctgcagaggaaaggaagcggcattgctggtgcagctcgaaaaaagatgaaactcatgtgtcaaatcccagcaagcagaatggggaaacacccagggcatggtttggaaagtccccgacattgcgtagggggttatgtgaggcaaattcaaataacggatcatgcaagtgtcatctcaggctctccccacggcagccccgtgagaaaggtctcatgatcccattttacaggtgaggagactgtggctcagagctgtgcatatgccacccagcctgcaggggggggccagagttcagtctcagaactgggctctttctacctggcaattctacttcccttagtgtctgccttagaatttctcccccagaagacacgacctactactcttcagtatagattccaccattttccattgcacagagtgcctggtatggaggtacaggtaggagagagtggctaaggtaaagttcctgcacagctgcggagctccttgcaacggcatggatcatgagttagggaggaccagataataacaggtaatggtgaggatgcggagaaatcacaaccccatacatgctggtggacatgtaaaatagcacagccacattggaaagagcctgacagtttcccaaatagtaaactgtagacttaccatatgacctagcaattctgctcctaggtgcatacccaagagaaatgaaaacatgtgcccatgcaaaaacttgtacagaaatgctcatagcagcattgttcataatagccaaaaggcagaaacaacccaaatgtccaacaatgggtgaatgggtacacaaagtgtggtctatccacgcagtggaatactattcagctataagaaggaacaaagcactgacacatactaccatgtggaggaaccttggaaacactgtgctaagcgaaagaagccagacatcaaagacaacatagtacatggttccatttataagatatgtccagaataggcaaatctatagagacagaaagtaggttcgtagttccttaggtctggggagatgggggaatgaggagggaagctaaaagggggtacatcattttattttcatttatttattgttttgagatggagtcttgctctgtcactcaggctggagtgcagtggcttaatctctactcactgcaacctctgcctcctgggttcaagcaattctcatgcctcagcctcccgagtagctgggattacaggcctgcgccaccatgcctgggcaatttttgtttatttagtgcagacaggtttcaccaggttggccaggctggtctcgaactcctgaccccaagtgatccacccgccttggcctcccaaagtgctgggattacaggtgtaagccactgcgcccatcccagggtttatttttgaggtgatgaaaatgttcaaaattggctgtggcgatgtttgcacatagctgtgaatatattaaaaaccactgaggccaggcatggtggcatacgcctgtaatcccaacactttaggaggccgaggcgggaggatcccttgagcccgggagttcgaggctgtactgagctatgatgacgccactgcactccagcctgggccacagagcaagaccctgtttgtaaaaataaataaataataagacagtaaaaaccattgaatcgaacactttaaatgggtgaattgtatggtatgtgattatgtcttaatatagctgttatttgaggaaaaaagagttgtagggggtgggtgcctaaaaaaggaaaattgggtgccatttttagaagattggagaacagatgctgggcagggaaaaacggtcaatgctcacttttacgcgactgatagatgaaacgctctcatctgtgtaaaggcgcctcgcctgtgcctgctaatggcaggacttcagcaaacatgagtttcttttcctttccctcctccttgaatacctttctgtagacccctagtctcaatggacttaccaagcagaacagagtttcctccctgctttgaggtgggaaagaaaactgttataagccagtatttctaaatgagagggagcggatggaaaggcacccatagtcaaggaatatagggctgtgcttggtgacatagaaggtcactggcatcttttggagtgtgctgtgtgctgggccaggaccccccctcccctgcccctcccacctagaagcaccgagtgtgactggtttcctatggaaccccctttggaaaagagcttgagtccacaatcaaagtgtcaagaagtgactgacctctcccagcctctacctgccatggtctctgagctctggacttggttcccagtgagagactccacatcccctgaggatccagccctggcccgagagctggcctgatccttttgcctggggctcggcagtcagttgtactctggatgctcttcctaatttcatctgaggcctcactgtgttgacctggcctcttcctgcttgcccctcaggctactccactcctcagccagcaggtctcactaaatattccaaggccacttggtcttagggacaaggtgagaggtcagcaaggctgggagcatctcttgtgtgtctggccacttaggccatgtggccaggggaggggcttgattctcttggagcctgagatatctgtgcaggcagcacaaggggttgggttctgacagggtccttctcaaaagaccttctggctcccccacttgacctctccactagcattgtcactcaatccttcgagggccagctctgcatctgtgaaatggggtcataatgcctatttcttgaattgcagggaagtttaaatgagaaaagttttgtggtaacacctaacagagtggcataaataggtgcttattaaagcttttcatcgtcaccatcatcatcaatgatatagcccgggggggtcagtccttccagatcattcaggtagatgggtcctttttgcagagtattgtgtgctgtatccattttatttttcctggattggaaaatggccttcccattcattttgttgtggaaactgaggcacatccagatgacttagctggggtaagttcccctgtgagcatacggtataggtcagctttcaaccgagattgcttgggatgtgtgtctctctcctctccctgggagcccctgccttcccctgggatgagcctggcacagtttcagcaggggactgagcaggtcattaatgagggacctgttcaaaaagccagaaaatatcaccccaaagacatccacgtaatgtattcatgccataggtcattggctgagcctccctaattaaggagatctggctgtcggtaccagttttgagggaggtatgtgtctgcagaaaaactggctgctttcatcagcctgggcagaatgtggcaggccaagcccctgggctgctgatcttagcagagggaagggcctgggagccaggctctggggctggctgagaaacacccatgggggacagaccacccctgcctggtagcttggttggtgccttgagggagagggccatttgttcattcgcttgacagctattgagcacctactacgcacagcacagtgctaaatggtagcagacacgcagctagtaagtgagcatcatccctgccctcatgttggaggaagacagaaataatcacatgagaaaacacagtagagggtatggtagtaagtgctactggggaaaataagccagagtgggggcggggtgaaggggggtgggaaggactgtgacctccgttccttgtgggatgagtggccagcagggtgtctggacctgacttacactctccctgggttgtctgttgaccaaagtgagcctttctccaagtggtttgctactcacctggcacccactgtggacggggcacaggggacagactgcagggtggtggcttggtgttctgaaaagcagagcttatggagggaggaagtggggttgctcatagtaacaaggaacctcgaatgtggacgttgggtagattctccagatgaggttacggacacagtctcatggacacactgaaggatggaaacaaggagactctctctgtgcaacttctgtgtgtgtgtcccacagagaacctgatatggtttggctctgtgtccccacccaaatctcatcttgaattgtactcccataattcccacgtgttgtgggagggatccggtgggagataattgaatcatcggggcggtttcctccatactgtctcaaataagtctcacaagatctgatggtttgataagaggacccatgacctttgcttggctctcattttctctttgcctgccgccatccacgtaagatgtgacttgctccttcttgccctccaccatgattgtgaggcttccccagccacgtggaactgtgagttctccattaaacatcttccatttgtaaattgcccagtctcaggtatgtctttatcagcagcatgaaaacgaactaatacagaccctgttcctggggtggaggcagggtggtaaaaatccattaagcaaaaccaatgcggtcattatcttgtgactagcacagtaaattatactgtattttttttcattaaaagcgttggtttagtaaatgtacacatgtgatgtgtatcacaaacattgtgactgttgtggtgtttctgtttttctgaccctctcttgacctcagagaaagtagttctgatacctgggctggctctcttcgttgttcagcatggattaaatacttactgactgcctactgtatgggcagctctgctccaggtgcagggatatggcagggagtgaaacaggccgaagcatctgccctcctgaggccgtgctctcagtgggtggagacaaacaagtgggtgaatgtgtcatatgtcaaatggatgtgctatgaagatgatgcaggagttgaggctggagagtggggagctgggcaggggcagggggttgagcctggggcagggaatgggttgcatggtgggagaataggtcctgggggttgcctggcttccctggaccatacagggatgaggaataatgtcggaattcccagcaccttgggggaactgatgaagccagagggggactcactgcactatttttccccatgacctcaaggcagatggaggggtgaggctgtgagtggtggtggtggtgggatgcagggagtgagtgaggggcttccaggagcaggcaggcctcctggggccccctcttcacctgtgcttggccagaggcaggaagatggagctagagcaggcagagctcctgggtttgagttgtgggtccggaaggggagaggaggtagagaacactttgttggtgcccacgcatgccccacggcctgttccagaggctacctgcaggcagctgttagccccatgccgatgattttctgtgtctttctcccaccaagggtattccctccccacagggcagtggtgaggcccgggagcttgtaaccatggaggacccttcaaccagtgaggaagggtggctggtagacaaatgctccccggcccccacttccttgttcctatgggggatgggtcaagggttccctgagggtccccaatgccaccatttacaggctcttgccctacctcagcctcacttcccaactccctcacctgcttcctgggatcacctctgaaacaaactacttgcacctaagtccttgtctcaggaagagacgggggaacccaagctaagatgaggagagaggcattcaaccctcatgttgccaccagctcccttagccctgctggagagactcgtggccaggagggaggaaagtgatcttgcaagatatggacatcttctggccccaaacctcatggataaaactggtgcagacactgtctccatggtgcctccttcccctgcctccacatgccctgtgtggcagggcggccagccctccctggtctctagatggtcttagttctctcttcaaatttcacaaagaagcagtgtccaggcaagtttactagggccagaaagtgacattcaaatctcactcccagccctgggagagagattcactaagcaagtgtccagctgtgacatgctgggcatgtggcacgggcctctccgggctatgctcttctcttccgtatgttggggtgatcgtgcccctcagagctgctgtcatgtcactgtgacagcaaagctcaccgaaggccagtgcatatccatggcaatggttatcctccatgggaactcaaaatcctgagtgcgaaggcagtgggtgggtgctagggcagtggtgacttagtagattggggtgttcctgcaccccagattttccagaacctccaacaactaaataatggattaactgattcattgcattttcctctcccttgcgtggggaacacttttctctgccccgaagttcccaatttggcccataaataggaagtgatgtcaccctctgcctcaccagggaagtgctggccaccttcctgcaacacctcagccgtttgcagggaggactgagtgggagtttccctttccctttcctcccctggggaaaagggtatcttgagaggtccaggccatgggctggggtctctcttgggccaggttaataggacagaatcgctgctcctccatggcccctcttgttttatccctttctttggatcagcagtggctcgcaaacagtttacactggctggatcagctgtttaccatggagcaaaagccggccatggttccatgctgtgggtccctcctgctggccagtcatagagcccctgttttacctgcgtggagcccacaagcctgttcccaatctcttctgtgttgatcttggagggggaagagaggtgaacgatgtggcttaatatcaaccttgggccgattttaaattatgattttacttttataacttgacgattgtgtctttcattgtgaactgttttaaatccgccccagaaaatacaggatgtggacaaatataaaaaattcttttgggggctgggtaaggatgaattttatttatttgtttgtttctaatgtcattttattttataataggggttaaatttaaaacgaaatgagatttaatttttctctctaaaagcaacctgaaacaattagacatctctgtcagcactcaccaaagttcttcacacacaatggctttgtggtcaggcctctgtatgttttatcaataaattcacaaactagggagaacttcatcagacgacttggctccatttggatgaagaaaatgtggtcgccaggtgcgttgtcacatgcctgtaatcccagcactttgggaggccaaggcgggtggatcacctgaggtcaggacttcgagaccagcctggccaattggtgaaaccccgtctctactaaaaatacagaaaaattagctggcgttgtggtgcatgcctgtaatcccagctactcgggaggctgatgcaggagaattgcttgaactcgggaggtggaggttgcagtgagccgagattgcaccactgcactccagcctgggtgacagagcaagactccgtctcaaaaaaaaaaaaaaaaaaaacaaaaaaaaacaaaaagaaaaagaaaatatggtctccttgaaggggatagaaaggacagtggcttgggagcagctgcagtccccactcagccccgaaatggcagtgtggccttggacgagtcacggcctcttagtgaggggggcctcagtttccccatttataaaatgacatggctgaatgagttgattggaaagcctcttttgccctctacttctaggtctctatcaaatacaaatcaaaacagttgttagtgtgagtgctgacataaatacccattttccaaggctctgaatccaccgggtcagattgtatgtgcgcctgccccatggagattcagtctgcctgctgggatgaagcctttgtacacagagtcttgaaggataataagtcctttgcttagggagcagtgcattagggagaagatgactataatttcttgtctgcaaagatacagcttcaaaaggagaattcctacttgcagaagtgcaaggacagcaacgacaacaacaaaaacgtatgtgaaattagagggaagaaaggaagactcaggcatagctattttggagattttccatcattcagattgtttgggaaataggaaaagcacattgtctgcttcaaaaacccttcaggaaattattaaaaacgctgaattcctgtataatcaccaaatctcctgaagtgcacacattatacacattgtgaatgagaataaatttatgactaggaactcgcttgaaatgaactaaaagttggacactctttgttgtggcgctaaatgagattttaaaagagaaatcttgtaaatagacacatccatattatactcaaaggggaaaaaacctatcaatagattgttgggacgtttctttttcatttgtgttgagaaaacaatacgacagcaacattaaagaggatcgtgaaaaaaatctcttcttcttactatacaaatcttccaacaattattttcatttttctatgttttattgtctatgagcacacatattttataatactctaaacacggtataaatactttgttatgtcttcatctttttctctcaacagtacatcctaagcatctttctgggtagtacagttttttttaataccacagttgttcaaagctgtgtaatattcccaccagcaggaatataccagtcgaggggttcattccccgagacacaaacattgggttcatctcccctctgtttttattgttgctgatcaaggttcaggtaatatatttttctcccactttgtcatctcttgaattagtcccaggagtggaaattgttgattcaagggcatttttaaggcttttgatagttcatatctttcaccatcctaaagcagtccattgtaacaatgcactattttatcaggccttcaactctgtctcacaagcatggcacaggtttatttaaaatagttcccccccccagttaattgttatgacctggtatttcaagggtgctttaaagtgaatttctttgcttaatagctagaaatagtatttttgcttgggtttactctttgtacagtttcttcaaagagtacacaaaagtgtacaatttgtacacttactattgtacagtgtgattttatacctgttcttcgttcttcctcaattggcaatagcagcagtgatcacagtagaggtaataataacagtagtagcaggagtggtggtagcagcagcgagcagtggaagcggtctcagcagtggtggcaatgccggtggcactagcagtagtagcagtggtggcagtagcagcagcagctgtattgatagcagcagtactggcagcagtagcaatcgtaatggtagtagcagcgattgtggtagcagtggtagcatcagcgcagtgctaacagtagcagcaacagcagtactagtgacggtggtattagtgatagtggtagtgttgttttgataatagtggtgctggcagtggcagtaatggtggtcatggtggtgggagcagcagcagtgttggtcattgtgggagtagcaacagttgtggtcatggcagtaataccactggtagcaatggtggtagtggtgacagtagcaacagcggtggtaatggtggcaatagcagtagtagcagtggtggcagtggtggtgggattagcgcagcagtggtggcagtggtggtgggattagcggcagtggtagtggtggtgggattagcggcagtggtagtggtggtgggattagcgcagcagtggtggcggtggtggtggcaggattagcagcagtgatggttgtggtggtgggattagcagcagtggtggcggtggtggtggcaggattagcagcagtgatggttgtggtggtgggattagcagcagtggtggcggtggtggtggcaggattagcagcagtgatggttgtggtggtgggattagcgcagcagtggtggcggtggtggtggcaggattagcagcagtgatggttgtggtggtgggattagcagcagtggtggcggtggtggtggcaggattagcagcagtgatggttgtggtggtgggattagcggcagtggtagtggtggtgggattagcgcagcagtggtggcggtggtggtggcaggattagcagcagtgatggttgtggtggtgggattagcggcagtggtagtggtggtgggattagcgcagcagtggtggcggtggtggtggcaggattagcagcactggtggtcgtggtggtgggagcagcagtggtggcatccgtggtggcagtagtaaaagctgctgtgtcttgagcgttgccaagtgccacgcattcagtccacccaacaactctgtgatggtttttgcctactcccctttcacaggtgaggagagacaagtggacaggagagtgggggtctatttgccaggcattccaggggtgagttcctgctgggcctggacggtgggtggaggggagtgagggtgggtgtgagtgagggactgattctgaaatttggcgctcattctggaagcaacaggaggccattatcgcttcgttctgctagcaccataattaagcacaggccttctttccccagatttgggttttgtccatctcatatttctccatagaatctagcatcaagctatgcagcagtagcactgaatgagtactgagtgaattcatgatgtagccccagtgatgtttcaaatgcagtcctgaccctgccaacacctgctcagaaccctccctctgcttctcagggcccctagggtggagtccaagcaccttccccagcctgcaggtcccacagcagcccgtgtcctgcctgggttaaaatcccagctctgccacttactagccatgtgacgagtggcatctctgtgccccatttcctcacctttgtggagagaacaggagaatcttactttaggattaaataagagaatgcatagaggacattgttcctggcacaggagtgttgctcgctattagtactttctccaccactgtaacctcaccaaggggaccctgtgtgaataagtcaccataagaaagtgaccgtaaccaccacggacacaccctgcacagagtcagctgcagccctctcagggtgtgggccccatggagggcaacaggtgcaaagataatgattatcaccctggtaatcagaaaaaaacaacaaaactctttgcattttaggaaaaaaaaaaagaaagtgatctcacttaaaactgggcttgtttcagtttatctgaaaccttttcatattttcagttttaataagatgtgacggaagctgacatttttgcaagcaccaagaactcgcgtcactttgaaaacttgcaagttgatttgaagaagcaccaagaggtagccaagactcgctctgctcacagatggtgggtgattaggtgccagtttgccgaaaagcttggaattggcagacggtggagggcagccggctgagctgcccgtgggcaggcaggatgggctgcctggcaggagggtcttgaggcctcggccataccccacctggcccaggtgagggctgccaggcccagaaggcgatctgagcctgggcacagcttaacctcttccaggggcttatgtccagggcaagactggctccagggactgggaaatgttgtgtggccttggctcatgcagattctaaagctcaggctgggacccatttttgtgaccacctacctgtgtggccttgggtgagtcattaactctctgggtccaagtctcagcattgggagaaaatgaaatgaatatttctgtgaggcagcgagaaccccaatctcttagggttactgtaagaaataagatcatactggagaaccctttttaaagataaaatctagctagttaattatccaaattgggtaacatgggggtgcaagggtatatggggaaaatgaggaatttataactaattattaaatgtttaaatgtatttttacttattattactattattatttttaagagacagggtattggtctgttgtccaggctggagtgcagtgacatgatcatagctcattgtaacttcaaactcctaagctcaagcgatactcttgcctcagcctcctgagtatctgatctacaggtgtgcaccatcaggcccagataatttttttttaatattgttttttgtagagtcagggtctcactatgttgcccaggccggtcttgaacttttggcttcaagagatcctcctgtctcagcctcccaaagtactgggattacaggcatgaaccaccgtacctgacctagttattgaatttattaaccatgcctatattcagttattctgggtgtgacctgatcaaaaagctgaagctgcaaagatgaacacccccgaggagttttgagacctttcctcaaatatagctgggggaggggtgatggaggggctcagagaagaggaaatgattcctttgtccaggagcagagaatgcagacaggcaacgtgagagagcacctggcagaggggagggctgaaacaagccagggcctgaatggaaacgggcccctgggccattcaggtggctgcagcctgagggaggtccgaggctgggcaggggagcacacataccgagttaggatatcccgggccatttgctgcattccagttgtttcagtgtggcgcgcagttgagttgtcctagcaggaaatgcgtggctctctcgtgcccttctttgtgtccagggcctgagcttctcctctgggccctccctgagggctaaaggtggctcagagatggtgtctctcctcctgagaagcttgagtggatgaggagggaggctgtttcctctcctgagtaagtcctggctccccgaagtggcaatgccaagtgccagccccgcagtgccgggcagtgggagatgcatggacaggccctagggctcagtctcccctcttgacgctccggtaccctgctcagcacacggttcctaatcccttaataaacctctccttatcctgcaccccaggaaggcttcaggttcatggcaatgcagaaataatgatttgcctgtattcactgatatgattgaactaacaataagttcaccctttctgcaagtcaggaacttgggtctggaacggagccggtctccagttgcaggacagatacctttctgagtgtagccaggaggtctgtgtgaggagggggtttttggtccctgtgtgggtcttcctcggacacccccatccctgaagggaacctacacccttccaggtgtgaagtaatgaaagaccagtagtcattcagctctagctgcaaatgcctgctctctcacctctaagctgtgtatcctcgggcaagtcacctggcctctctgtgctttctgagactgtccactcatgccgctatcaaaggggtgagagaactgagattaaactaggggaggaggccgggcatggtggctcacacctgtaatcccagcactttgggaggccggggcagatggatcacctgaggtcaggtgtttaagagcagcgtggccaacatggggaaaccccgtctctactaaaaatacaaaaattagccaggtgtggtggcagatgtctgtagtcccagctcctcgggaggctgaagcaggagaatcacttgaacctgggaggtggaggttgcgtgagccaagatcatgccactgcgctgcagcctgggtgacagagggagactctgtctcaggaaaaaaaaaaaaaacaaaaaaaacgaggggaggtgctgctggaagtgcagggcctagaacagaggattacttggaaaatttttgttgactctgaatcctaagacactcttccacctgggaatgagaatagatagatcaatgagaagcgtgggttattggccgatcagaagtgccagctgtagacgttggttcatccacatcagggtgaaaatgaaaatgcactcttgtccctttcccctctttttaaaaagtttccctacaaccctccataactgtggtggaaagagtatacagcgaggacgtagggacatttagctagaagcatcccaaccagcctcctgcctgataataacaacaagagctaacatttatgattgttataataaacactaacattggttatggctgggtactgtgtaaggtgttctcccagcagcaccccatccatgctcacaccaatcccctgacctgcgccctggattcatccctatctggcatagaacggaactttctaggaaacagagcttgcctggccacatcagctcagtaaatggcagagttgagacacaaacccaggctgcctcccccaaaacccaaacccaccaaattagattgtcttccaaatgcagaaatcctctctgcagcccaacttggcccaattctctaggttttgggagaaatacatttcctctcttcccgtagcctaattcgaaaacgaggcatctttcacttcacatttcacagccgcaattctttcttgcacataaaatctatccatcccgctggcccccttccctcttctgggcacattacaggctgttggcgtgtgtgtctaaataaacacccatcagcctggatccttgcaggctgattctaaacatttggctccgaagggtagcactgggggcttgtaaacccttcacctttctcccagcacacttcaaacattccccttcttgcatctaggaaaaccagagcggttggtttctctctctactcttacacagaactttgtgaaaacctctgttagactgaaataaccttctttatttctgtcttgctcctcaagctgagagtgtttctaggtcagggtggagggcctgacatttactgtctccttggtactaggctctgtgccacacattacacaccttgatttattctttttaacaggaccacgtgaagtattaatggtcccccttcacaagtgaggaacaagaggctgaaaggagaggcacattttctcagataacgtggccactttgaggcagagctgagatttctggcccccccctcactgtgctagggagaccctgttctatttagccccatccgcctggaacctccaaagggcctggcacagctttccagcaaatgtttgttgactgaccaactgactgactgaataaaagaatgaatgagcaagtgtctaatttccagaagaactgtggagtgggagctgtaaagtggtccaggtgccttgcttagaagcacaaactaggctggaagaaaactagctaatagagttgcggtcagacatggattacacttttccaagcattggaatatggcaatattaatcatgtttctacaaatcgtcttttatttcttcttcttttttttgagacggggtctcactggagtgcagtggtgtgatcttggctcactgcaacctccgcctcctggttcaagtgatcctcccgctttagcctcttgagtagctgggattacaggtacatgccaccacgcctggctaatttttgtattttctgtagacatgatgtctcactatgttgcccaggctggtctcgaactcctggactcaagcgatccgcccgcctcagcctctcaaagtgccgggattacaggcatgagccaccacgcccagcccaccttttgtttcttctcattctgcatatgtggaatttgctgcatctggtaagtcaggtcaactacagttgacccttagagaaaacgggtttgaactgcacaggtccacttctctatggattttctcccacctctgccacccctgagacagcaagactacccttcctcctcctcagcctactcaacatgaaagagcaaggctgaagccctttatgatgatctacttccacttaatgaataatacatagattttctctttcttatgattttcttaataactttcttttctctagcttactttattgtaagaatacagtttatagtacaacaaataacatacgaaatatatgttaattgactgtttatattatcagcaaggcttccagtcaacagtaggctattagtagttacgttttgggggaatcaaaagttatacagattgttgactgtgcatggggggcggggtcagcgcccctaacccacatgtttttcgagggtcaactgtacttcatttagtctgttgactgagaggaaggctttgcacattctttaaattatttagaatcattgttcaacaaacatgcaggtacaacagatgctgtgtgtgtacagaatagagagtggctaaatactttttaccatggtttaatttacaaacctcatggcttggacttttaagatcaacatttggttatctggcatgaattgctcctaattttccctggcttttcccctttagtaatggtctccaagaggagttgctataattttctttctttcttttttgctttttttgaagacagggtctcactctgtcacccaggctgaagtgctgtggcatgatcgtggctcactgcagcttcaacttcccacactcaagtgatcctcctatctcaggctcccaggtagctgggactacaggcttataccaccacgcatgactactttaatttttttttttttttttttttttttttggtagagacaggtctcactaagttactcagcctggtctcaaactcctggcttcaagtgatcctcctgccacagcctcccaaagtgctaggattacaggcatgagccaccttgcccagccactagaattgtgatagaagagagcttaaagttatcatctgggcttcctgttttaaaaacgaggacatccagttaaacgtgactaggaaatggcaaatctcaaaccagagttcaggtctcctatcacccagccagtgttctctgcttaaatgaaaaccaagcagatcagcttcaccatgcaactgtgtacactgccgtcctgcgtccccaaggttcccctcagaaaacagagttgatttaaatgcatgcactgatcatcaacctgagtcttaaaaatgatgacatggtttgtttctataatatccctcctaagaattgaccccaagaaaataatcagaaatgtggataaagatttacgcaccaagatgttcattactgaattatttataacagaaaaaaagagaatgtaacctaacaaagaaacatctatagtatggactgttagtctgccattaaaataaagttctgaagactatttaatgactttagaacttattcagaataaaatactaagtgaggaatgtaggacaaaaacacacggtcatagaacaattgcaatagttaaaatatgcaatatacatagaaaaaagactggaaagaaatataccaaaatgttagcagaggccattcgttcagtgatcacacagtgcatttatggatcactgctatatctcagacactgagctcttcactggagtgggttcccaccttcctgggccctactgtctggggaaaggatgggcaaagtgacattatttttaaaataatcattaaggctgggtgtggtggctcatgcttgtaatcccggcactttgggaggccggggagggtggatcacccgaggtcaggagttcaagaccagcctggccaacatgtgaaaccctgcctctactaaaattacaaaaaatagctgggcatggtggcagatgcctgtaatcccagctacttgggaggctgaggctggaggattgcttgagcccaggatgcagaggttgcagtgagccgagatcgcatcactgcactgcagcctgggcaacagaataagactccgtctctaaaaaaataaataaataaaataaaataataaaaataaaaataatcattaaaataaacctgtaattacaaatcatgatcattactattacgaaggctatttctagaggttgggattatagttgagtgtcattttttttggttttggtttgtattcttttattttttttctttttatgttcttccaatttttcttcacatcttaaatttctgacagtgggactttattagaaaaacagaggacttttagaaacacacaaacacaaatgcccaagcacctgcatggcttccagtggccccactgacgatggagccttggagctcctcagaaggagcctggagtgcctgcggaggggatgaagcccccccccaaccccactgacaatggagcactcggagctcctcagaaggagcctggagtgcctgcggagggaacgaagccctgtccctggagcttcatgactgtctgaatttcctttgctgctgtaaaaattcctcaaacttagtgacttaaaagagcaacatttattttcttacagttctagagaccagaactgtaagaaattttgttcaaaattgatgtcaggccgggcacagtggctcacgcctgtaataccagcacttcgggaggccgaggtgggcggatcacgaggtcaggagattgagaccatcctggctaacaaggtgaaaccccgtctccactaaaaaatacaaaaaaaaaagtagccgggcatagtggcgggcgcctgtagtcccagctactggggaggctgaggcaggagaatggcgtgaacccgggaggtggagcttgcagtgagccgagatggagccactgcactccagcctgggcaacagagtgagactccatctcaaaaaaaaaaaaaaaaaattgatgtcagtgggctaaagtcaaggtgttgatggggtcagttccttctgaggttctagaggaaaatctgtttccttgcctttttcagtttctggtggtcacctgcaatccttggctcatggccttttcctcaaatgcaccacggcttccaccatcatgcggcctttgaccccctctctctctcacagccaagcctccctcttcattttaaaagaacactcatgattatatttagggcctacctggataatacaagatcatccccatctcaagatccttaacttaatcacacctgcaaagtgccttttcccgtaaggtaacatacagaggttccagggctggggacctggacatctttgggggctatgattcagccttccacagtgttttgtcaaaagtttgcagatttactgaatgctaaaccttgttagccaatcccagaaaagctttgcctaatatgtgtgagttttttccgttttgttttgtttctcttgagaaaaaagaaagagtggcatgtctgaaaattcatttgtgccattagcactacttacacctttggtaactctccacacaccccaccaggtctactctgttaaagaatttgcttggcagtttgtatcaaaaacaggagggatgtctgtatatgcaaataaaaagagagagagagagtaagggacagagacagagagagggcgggggaggattattgtaagctaatgcttgcatttcaaacattcagtccagttaaaacgttgacatcaagcattgtgtatgttcctgggagagggctctctgagttgtgtatctcatgggtgtcattgaatgttattgttgcctcgctaaatattcatggatgaatatgtggaataaattctcttgtaagctgacagagagcaagtaaggcctgtccttgagtctctcatctgcatccttatttctgaaaaactgtctatttgggcacgagtgtgtgtgtgtgtgtgtgtgtgtgcatgcaaaagtgcgggcactacgtgcttggttaatttaagcagaagaatcccattttcttttcttttctttctttttttttgagacggagtttcgctcttgttgcccaggctggagtgcaatggcacaatcttggctcactgcaacctccacctcccgggttcaagcgattctcctgattcagcctcccaagtagctgggattacaggcatgtgccaccttgcctggctaattttctacttttagtagagacggggtttctccatgttggtcaggctggtctcaaactcctaacctcaggtgatcagcccacctcagcctcccagagtgctgggattgcaggcgtgagccactgcgtccagccaagaatcccattttcagagtagaaaagatggatctctccagtttggtgacctcaaagtgggtggtgtttaaagaaagcaagtattgctcatcgaatagctttgataaaactgctccctttgctctcttgtttcaaacttcaaaaccagcctcactttttctgtcttttttgtttttttgagatggaagctcactctgttgcccaggctggagtgcagtggtgtgaccctggctcactgcctgcaacctccacctcccaggttcaagtgattctcctgcctcagcctcctaagtaactgggattataggtgtgtgccatgatgcccagctaattttgtatttttagtagagacaaggtttcaccatgttggcaaggttggtcttgaactcctgacctcaagtgatctgcccgccccggcctcccaaagtgctgagattacaggcctgagccactgcgcctggccaaaaccatcctctttaggggttatagtttgtttgttgagaggtgaggtgggttctaagagttccaagaatgtacacacgcatgtgcacactcacagagaagagcttcttttgactcagaacaaagtctctaggggtggccatgggccagagtgcttctgagtggagagagagagagagtgggggtggggacactgaggacattgagttacagacctatgagacatagaggatgagggaggaacggtgattcctggagactgcttagatgctgccttccttaggacacctactgtgaccctgggtcttctcctccaccaggactggccagttgcccagccttggggttcccacgccatgctgcatggacacccatgagagcaaactatcccctgatggtctgagggctcctcaagggcaggaactcccttgctgctgtatctctagcaccccagccatgtgccatgtacttagaaggtactggtggaagacacttgcccttgttcactccatcctccatagccacagaactttcaatgatgcccacggatgctgagaatgagaactgcatttctctgccttctttgcagtgaggtgaggccaactgcaccagcaggaatgggagggaatcgataggattaacttccacgtcctgcctttttaagagtaaacacacaccttcctctgcccctgcaggctggctggaatttgggcatgacagagagcccccttgagctgtggagccaagggcaacgcactaacagggcacagcaacaagatagagggggcctggcccatgatgctgtgaggctgccgcccagccctgcactgtttgccccagctgtttacctggggagataattacggttctatctaggcaaggatttggtatcttgggtctctgcttcagcagtccaagctaaacactatacaatgctcagaatgtttgctcattcacagatgataacaggctcagagccttccctcaatatccccagccaagactcttcatgtctccttgttataggaaaggggtcccgatccagacctcaagagagggttcttggatctcatgcaagaaagaattcagggccagtctgcagagcaaagtgaaagcaagttaacgtaaaggaataaaagaatggctactccatagacagagcagcgctgagggtggctggttgcccatttttatagttatgtattgatgatatgctaaacaaggggtggattattcatgcctcccctttttagaccatataaggtaacttcctgacgttgccatggcatctgtaaactgtcatggtgctggtgggagtgtagcagtgaggacgaccagaggtcactctcgtcaccatcttggttttggtaggtttgggtcagcttctttactgcaacctgttttatcagcaaggtctttatgacccgcatcttgtgccaacctcctgtctcatactgtgacttaaaatgccttagcctcctgggaatgcagtccagtaggtcccagcctcattttaccaagctcctattcaagatggagttgttctggttcacatgtctctgacacccacactgtgaacagaataatcccatccctctaggaggtgtccacatcctaatctctgaaatctgtgaatatggtaacttaagtggcagagagatctctgcagatgtgattaaaataaggatgggagtgaggaggccacgtgttgtgtgaccctggaaccagatccagggagcacagggcaatgctgcaaagaccagtgggtgccagagcagggcatccagagacctgacagccacatgtctccttacaggacagaaaagggactagggctgtcatctgtcatcccatggggtgggtcacaccctaactgaaggtcactgggagcctcaagcaacatttccccatccccagcacctcactgaccccttgaccccagattccatcatgaaaggagaggaagatcctggaaaatggagcagaagcctagaaagaggttaagatctcacctgacaaccactgagcagccttacttggcaaaatcgaggtttctgccatcacaggattgggactcgagagcaagaggaaagcagttatagacaacacagcaagtcactttttttttcttttgcgcatttgcacatctgcacaaatcccagccagctactgaaggggaagcggaatgcaggagaggaatgtggagtccactccggtcactgactttctagaaacttctcattggcttgttgctgggagagtttcacaaggagagcacggaagtagatacagcagggtctgtgggctggtggaggctgagccagcctccctctgaccaagtctgtcccgggagctgcggggagcagcaaggggcatggtctctactctccagacctctacaggctcctttctgctttttgcctcactcaaaatgccccagaagtgatcaactgggcattcatctttttcttttaagagtgaagattgtgagccttctctgggtattcctgaaggtcactcagcttgggaaaagttgacacagcacctgcaggaaggatggagctttgtgagaaatggccttccaattgctggggccactcctgttggggtcctcagtgcagggcttggaaaggcaccccgtccctccatcagtgctggctgagctggcctgagggtggagtgacagaacccacattatgcccttcctgagatggttttcctatcagggtcccttgaatggaaaaccttctccatgtccaagggctgggggcagatgaggcctgaggtagtaattattattgttttattatataaaagagaaatctttgaggctttgacaggatggaagtctgttcatggcatatgaccaagcagatccaactcagatgctgagagtcactacctctaagcgtctctaaggctctcagtctctaaagctaactcttgccatcatcatgatggccacgagggagctcattgtcttgtaaaatctgacccaagcttggacacagctctcctcccgaaagataaaacactatgctgacaagcagcaggtgcccactaaagagtacttaagtaaggagtgcttaaaatgacgaggggccctgtctgcctggggcgtactcccaacaccctactttacaacttctataggggctgatagggtctgggccattgccttctacccaaagtccagctgaggcttgtcacagccaggcccgaataaacacgcgctgtagttgaaagagctgagactctcggcttgcttgaactatgtggcctcccctgacgtctaagattgcaagttgagttgtccatttattcatgcagaaaggatttcttctgggtgcttgaataagttttatttcctctcttacttctgggtttctcattaataagagtgacattccaactctcaagactaggaccaggggtcaaatttccaggaagcctccatggatgggtggggcctctttctgcccccagccctttgagcttccctctaccctcgagcggcactcgtcctgccgctgtctgctgacatcagttttcccacgcagagcttgagctccttcattgtcaggggcgtggttctcagctgggcctggcaccatctaggccctcaatgcgtgttcttgggatgagccaaggaaggcagggatagatgcaaatccataatataaccctagggataagactaccacacaccatggcagcaacgccctggcagcaatgcccaggtagaggtgggacctttgctctgtggcgagaacacactctccttactatgcattcagagattcgcattcgggaacatgactttcaaggggagagttccattagtgaataggaagctctgacctgctgtgttgccatgacaggcaagggcaatggagggccctggctcatttctttataaaccatgtctgctttaatgctctctcctcctgtctgttcccccaaataaaccatgaactgagggatgacaggagactgagggatgacaggagaaagtgaggcaaagtctttatagcttctgctccttgattctggccttcccagctctgggctggctacctgggtggatagggggtccccagggccaggaactagacccatagcacatgtaatttcctcctgggcctggtgtgtggtgctgcaggtggcacttaatcttggctggtgactgactgactgaccagaaaccggattccagatgggaaaggaacaggcatttgcccccagccaatagctcatgaggacaagcaatcaattattcagggagcaattattaaattagggacctgtctggaccttccagcctcgactgctctgttcctgctgcctggcggggtggattagcacccctagaaagaggaaagaaaatgcatccaagcaagggcaccccagctctgtatcccaagagactgtgggagtgcaggggttccaggacctcccgactcgctgaactctcggggacgagcccgttcgtctctccgagccttgcttttcttgtgtgttaggattgtaaaccctgttctgcctaactctcaagtcgggttgggatggggactttgctgcctgtaaaatgtgtgccactatgagcaagccattgtaggtagcaccccccaaaaccttggcaagagaggaagtggagcccatttgctgctgtgaggatctgggttttctgtgggttttgtttgcctgccagccccatttggccaaggcttgggaatctggcccggattttaccaagctggactcaatgcaagtggatgctgtggtccatgttcacaagtcactgtgtggccttcccttcaaccctctgcctgtggaatctgcacctgagccccacctcccctcagtgcctaccctgcgccgagctctgtatccctagggataagactaccacacatcatgtggatgcatgtgacacatgtgtgggttagtttcctcctgtgactataacaaatcacgacacatttagtggctttcaataacacaaactcattctctaacagttccagaagtcagaaattgggtcttacaaggtgaaaatcaagtgcggcaaggctggttccttctggagcctctcaggagaatggtttcctgccttttccagcttgcagagactgcctggattccttggcttgtggcctcttctttaatcttcagagccaaacagggactatcagactgctccctcctcggttattatagaccttcttctctgtcctctgaccctagcctccctcttacaaagacacttaggattatacttagggcacacccaagatcatccaggagcatctcctagctcaagatctttcacttaatcccattggcaaagtcctgtttgccatgtaagatgacatgttcacaggttcctgggatgaggcggtgggcatctttgggggccaggatccagcctatctcagaagttctctgccctatgggtggaagggatgggcagcacccccattccagttcccagtaaccctggccaccctggtctgagcacgcatctggggatccccacttcaccagaacgctctacaggaaaggagcacatcaaactggacttaaacaatggacctagttagtagggtgaaggaattggtctcctgaggagtggcagcaagacaatttttaattatttagcagtgtgtgcattagaaggccattatatagaatagcaaattataaacaacaacttccacaataaggtaataaaataaataatacatgaacaaggtgcagtgctcccgagtcagaggggctgacagtgatggcgccctgccagacgcagcggtctgccggagcagaggccagaaagctgcgcgtactaagtgaagcaagtgagtactgggggctgggcctcccaccttcccagcccacaggtgtccagggcccaatgaggaagggtcaccaccaatgctgagacagctgggctgtgtctgtctgaagcttattgtgaggtttcctgtgaagccgcccggccacactcccctcaactctggactctgggatgaccaccacggcgcttacaggtgccgtgacgttagtcgcacaggttctgggtctcgacagcctggattcaaatcctggctctgctgcttactgagcctccaggttctcatctgagaaatgggagtgatgacaatggtatgtctctcatagcactaccaatgct

SEQ ID NO: 470 - DNA, 20001 bp, Homo sapiens
tggtcacctgctctgttcttagtcatcctgagtcacctgttctgtaactgtccttcctgcaaaccactcaccccaccactctgactctctttaaaatagccaataggaattagcttagaccgtgtggtccagccctagccaataggggaacaacacagcagtaggcgctacctgcatcagggataagaaccccttcctctcccttgttcaggtgtgctctcaccattgctccatctatgagtcacacccttctatagaagtaaaattgccttgctgagaaaattaaatttatgttcgagtgctatttcttttacagcactgaaaatttatttctaacactatttttttaagaacaaggataaaattagcaacttccatagtatcacaatagcagattttatttatgagggttaatgacaggtaccaaaatcaaataagcaagcaggtttgctggggagaatttctcctggttttccttcctctgcaaatgtctttatttcatcttcattcctgaaggaaattttcagtggataaagaattctgtgttgacggttttctttcagcagttaacaaacgccatcccactgccactgactcatgggcctgtgaaagaaatctgcagttgtcagagttattgtttccataaaggacaagaaaggacaaccactaacacacgagagggaaaagaattttctccattctttctgacctgtagggcccctgtttcctgtctttcagactagaaacagagggcttgccttgggatttttctgtgcatagtcaatatgtaattccaggttttcagctgcctttgaggtcaaattggaagatactggagggaaaagaagaaagatgggtgtcgaatgagactcgctgctgatacaataattctttcagttccagcttcctcctccagtcagcctgttaccatccacttccaggaatcctgagggctgccccctgtctcctgtccagggcttccgtttcactcacttcttggagccccagaggaatgtacttacctagtcttgaccccagtcatgttttattttatttatttatttattttttaattaatttatttatttattttgagatggagtcctgctctgtcacccacgctggagtgcagtggcgtgatcttggctcactgcaacctccacctcctgggtttaagcaattctctgcctcagcctcccaagtagctgggattacaggtgtgcaccaccacgcccagctaatttttgtattttttagtaaagacagggtttcaccatcttggccaggctggtcttgaattcctgaccttgtgatccacttgctttagcctcccaaagtgctgggattacaggcgtgagccacggcacccagcccccaattgtatttccatagattcttctctgacacattgtaagttccatgagggcagagaccgcatttggcttattatcattcttattattcatcttctggccttagttcagtgttttttgcacaggagttaccccttaaaaattcactgaatcaatcaatcaatagcaaaccttaaattagatgacattttaaagcaacttacacaatgcttgcccataaagatgttcgatatcaataactgataacgtctattattgcctgcagagacttgaagcctgccaggtctaacttgtttagtttctaaccagttaacacagaggcatttgacacagagcgaagaactcctgcaagtcaataatctatgtaaacaagtgagacaccgctccagaaatgttatccacagccccaagaaaatcagcatttattgtgccaaatcttgtacataaaaatacaagaactgttttgcatacacacacaaatacaaacagtatctaaattgaaattcttgaaagtgtactttttccatttcttatattatttcagccaacagaaggaaacttacatctttcagggggaacccttagtaccgaatactttgaaaagatgatgcccattcttttctgcaaaaattatattgcagaacccctccctgccccaaggcagggcgtgcacgttgcacagctccaagaggattcccatgatagtcttctgtgaatggtgtggaaccaggctcaggcagtctgtgacctgtgcaacagcaatcacatctccagtccagccttcttcaccttttgccaaactaatgagtacctctcagtggtagaaactaaactggaaccattgccagagagcctgggaaatggagcttccagacttctaatccctgcaagaagacctcagaaggtcaggtagaggatggagcagcaacacactatctgctatgtttactgagacggtcatatcgtcggtctcttttaactgttattgcaggaaattacactgataggttccctaacctcgaaccatcttttcattcctaggaaaaatgtgatcttctagtacatcgcattcttgtatttgctcatgttttagttggaatttttttgtatcatttgcacaagtggggtggcgtatatattttctgcactagttatgtctggatttggtgtcagggtaatactagctttattgaatgagttggagatcatctttttatattctgtggaatagcttttataagtataatattaatatgaatgtcattattccttagaaatgcagaatatgcctgcacagcagtgtgggcctgtagtcctctgattacccttccatttttttctatgggttatccttctctttagacttttccccttctttagattttttctcctcttctgaattttagttaatctattcccaattatttctaaatagattttcattttctttctttcttttttttttttttttgagacggagtcttgctctttcacccaggctggagtgcagtggtgctatcttggctcactgcaagctctgcctcccgggttcacgccattctcctgcctcagcctcccgagtagctgggactacagccacccgccactgtgcccagctaattttttgtatttttagtagagacgggatttcaccttgttagccaggatggtctcgatctcctgacctcgtgatctgcccgcctcaacctcccaaagtgttcattttctttttaacccaagttatctagaattttttcaaatttgcaagtagatagattattttttaatatggcagagatatcatttgtcaatcccgactgcgatccttgactccttcctgctttagggaccaggccctctgttcagcatggcagtgcgtcctgctctcaggcctggctcctgcttcatttaaggtggaactcctgctctttttcgtcagatacttaatttcccggcctcccttgagattgttgtggctacgtggcctcatgtggcctctttcttcctgctttggctgtgaaaatacaacacctggagttaaaataaaacttagaaagtaagcacagactatgggctatgcctgagcttaactcctggctgtaccaattattagctgtatgactttggacaagttactgaatcgctctatgcctctattttcccatctgcaaatgaggaaaaattacacctagctcatggacagatgtgagcatgtaatgtataacaatacgtcaggggctcagaacaacaattggcacaaagcaagtcatacgaactatcattatctttataataataatagttattaatactagtataatcatcatcgtcatcttgggaccatgaggccaagacaatgagaatacagagcagaaggaacgggcttggattcttcatgaggatgttacacagagcctggaaaatgtacctctagacattcaataaacaatacatatcgttactttagctcctctgttaatttttattggatgtgttctaatcagtatgcctcattacgtttttcactaattcagaaattgatgccaggcactattctaggctttggggctatagccacggacaacaacaacgaaaaccctccgcctcttagcgccgacattctttggatactaatttctaattgtcttccgttgaagtcagagaaattagcctagtgaattctgccttggggacttggctgagattttgttcctaacaggatttttgtaaatattccacaggtgtttgaaaagaacacatacacacgctcttagtatatgaggagtgaagtctaggttcaggttttttttttttttttttttttttttttgagacggaatctcactctgttaccaggctggagtgcagtggcgccatctcggctcactgcaacctcccactcccgggttcaagcaattctcctgcctcagcctcccagtagctgggactacaggcatgtaccaccacgcccagctaatttttgtatttttagtagagatggggattcaccatattggccaggatggtctcgatctcttgaccttgtgacccacctgcgtcagtctcccaaagtgctgggattacaggcatgagccactgcgcccggcccaggttcattttttcacatatggatgtcccatttttccaataccattggttaaaccgactactgactattccgccattgaattgctgttgcatctttgtcaatccaaatggctgtatttctggaggagaggggaggaaaaagaaaaggcaaataacgaaaatgtgcaccagaaaaataccaagtgttgaccaaaatgtatggccaagatgtacccaagcaggactctccctcctggccgttgcaaactgtcatggccttggttgcatctgtctgttaaagattaacgagcccttggccttagcatgtcattcccaggtatgccctccagtagacacgctcacagacatgcaacaaaaagtgtaaactacaatattcccagcagcactgtttgtaatagccccaaactggaagctaactacgtgttcctcatcagtagagtagataaactgtagtacattcatgcattggattaccatataacaaccagaatgaaggattgaaaaccacaggcaagactgtggctaaatctgactaaatgactaaatgttgcaacaaaagaaacaggcgcgaagaaggcacatactgtgtagctccgtttatgtaaagtacaagaacaggcaaaactgctctgtatcattggagggcaggctagtgatttaccgtggtggggagcaggggagtggggcaatttcagaggttatgggatattctgtctcttgatctggatgccagttacacaggtgtgttccgtcaatgaaaaggcatcaagctgtacactcctatgcacttttctgcctatgtattatatttcaaagaaacgtttagaaaagagagagaacaggaaaggtagtacttctctggaagaaaatagctaaagaccttcacagtaagaataaaatcagccccatttttgcaaacaggggtgcaacacgcctgcctgctccataaacaagtgtcaaagccaagccctctggcaggccctccccacacagttatcattaagtttcaggttctagagggttacagaggttgctggcaatgaggcacagggcaggacgtgcctctcatgagcttaaaatcttgctaaaagagaggcccccccaccccatcgcaccctccaaagctgaaagcacaaggttccaagtaattcagggtccccgtggtaagtctcagctcagagtcacgggaattctgcttgaagacccacatgtttcctgcctaacacattgtcgtcatgagattgtctgcaccaggaggacacagctctttttaaaaccagtcatcttggaccgcaccactaaggcagtgtgtcgttaaggcaggctgtggacaccagagtggttgttaaggagccaggctaagaagagcttaatgtatatgtctgtctatagtattgacatttcgtgcaatttccagagcagcacagggcccctgcaaactcctattgggaggaaggaaattgtcttttttctttatgagagtggaaaattgttcattctctccaggagaagccacaggaattaatattctcaaaggcacggaaatggcctatagataggagttttgcctgcctcctctctcaatctctctctcattctttttctctctctccactgcccccttctctttctctctccttcctccctagttcagaatagggatggtgaaaaactaggcctgtatccttcaatattattagcagagatcagggacagagaaaactcccactcaccaccctagacccacacgtatgcatcaggaacattctagcttcagaggtggaaagcaggcattaaagagtgaggtgagactagggctataaagctttcaatcatcaagaattagttaactgggctgggtgtcatggctcgcacttgtaatcccagcactttaggaggccaaagtgggaggattgcttgagccaggagtttgagaccagcctgggcaatatagcaagaccccatgtctcaaaaataaataaataaatttttaaaaaaagatttagtaaactgtcaaagcacctagatatcaactttcttaataagccatgccatatagctgtcactttggaatcaggatgttaaataataatacatagttgttttaataaagattctcatttttgctataaaggaaaatatctagtattgccactagaaatacaccacagagtcaacttagaaccactgttcgagatgaggaacgatgcttaggcactgtctgcatttcctggtatcttgccctttctgtagcgaagtctgattgaattgacagaggcttaaataccgaaaatgccaaacaaagcatatgaaatagggacagtgtcctgacccctagctacactgtaaacaacgtgggagatgaaggggaggaagctacggagttcactggagggtgccgcccctggggccttccacctcacccccaccaggactctgagacgggagctgcccacctccactcacagacagggcagcccgagctgcgaagggttttgccagagagcagaactgagttagtggctgagagagtccacacttttggcctctaattctgaagccagtgtgcctgcctatgatatccccacccggctgtccccttagaaaatcagctggtatcaaataactcttcaggtgatccagacggttctggatccaacaggatccgcagaggcatgccgagaggcccagagccttggccgcccccgtgggagccggcctccgggaagacccgctccaccttctccttctgcccgacggctccagaccctcccaggcatccagagtccaagggtagctcttgttgacttcgttctagtaagagatcagtttgctgaaaataaatgaataaataataaataaataaataaaagctcattatccaaaagtgaacattttcaaaagcctcacaagtgggtctcacctccatgacttcttcagcactgcgcaccctctgcatggccgctgggccactctgatccctcccacggccgcagatggcggcaccaagggagttccctcttgaggagtctcagcccaagagcgagtgcagaaacgggaaaagtggcttgacagagaggaggagggaacagccaccagcaggcaccaagagtcctctcccagagccctgggaccctggagcccaggcctgcttcctttccgtcctcaccctgtagaggactcaagggggccttcaaagtcttctcgttgctccgttaaagctcaaggaaatacagtggaaaggggacaggtttggtttgatgtctgtgtcagtctcccagggatgccgtaattcacaaagcaccacagaccgtgtgccttacacagccgaagtgtactcgctcacagttccggaggctgcaagatccagactgcagtgtcagcaggactgcttctttctaagactgtgagggaggatctgtccctggcctctcccggcttctcctaactcactggtcatccttggccttccttggcttgtagaagcaccacgctgacctctgcctccatcctcaggtggcatccaccctgagtgcgggtctgtctccaaatttccccttttgataaggacctgtcctattggacgagggcctaccccattccagcatgacttcatcgtaactaattacctctgcaactacattacttctaagtaaagtgacactccaaggtcctgggaggtaggaccataacataaatctggggggaggaacacagttcaacccataataatatggaccgaagtccagcctgcaactcagccacttacaactcagccactttccttccttggagacaaactgcaactgcatctgcccacaccatgcttcctttggctgtgaaatgggaaggcagtggctgcttgtcatgattgtcataaacaatccaggagacacagaagcgcctctcaggtgtaccacatgcctgaggcttaccgtgtgctcacaatggtgtggatggcattgttctcattatcaggcagctctgccagtctctcccagcctgagagaggccatctcccggccccaggtataaacatcctttttccacacttcctgccagcatcagtgaccttcagaaaacccttaggggacaagcggagtgttgaagtgctgagagttgaagagctcaatccactgctccaatgcaacccggggccagagccggcttttctctttgacactttcctagtggcactggctgggcacatgcttgaaaggaagaagtcatctgcaaggagctctgggctgggctgcacacgctgaaaatgcatttatttgatttatttttacatccaatcttgttccagaaaggatttgaggggccacgtggtgaatcaaatccattgcaacttaatggctctccgcttcgcacttagtgggagggggctgaacaattggaaaatagaaataatcccaaactcccatctgatcccaaaggtggcatcttagacctgttgcacattgttaaaggcattttgtttttaagctacaaagctcagcgtgtcaaggtgatgaggacgatgatcatggcaatgatggtgatgacggaggtgttggctaacacgtgaaagctcgtcctctgatggaccaggtactgttcaaaggaaggaaaggaaagaaaatgagggggacaaggggaagagggaggggagaaaatggaacaaagggttggagaccgtgttagagacccacagtgtggccaaagcagtgtgctccttaccctctaaccaaatcaaatcccaggagaaagctcactcattctttcaaagttgtgacttatttcagagaacaatctgtggtcataggtggatcatgttagtcgttcacttccagaaagccaaatctggacctggctctcaccacgaggctctgatgacctctccatttggcccctgggaagcctttgccatattaaatgctgtcacctctgcagcgagcagatagggaggcgctgctccagggccatccccaaggatgccttggccagcttagggtgtgagacggcacctggaaaactgtaccagtgaggccagagggcatgcagctgcttcctcagtgcctggcatccgtcacacctgcagtgccccttccacatcagccacgtgtggcatcctacacggccacaagtgccacgtctgcaaccagtcacacttaagccctctggtgacccagaagaaaaagggagaaaagtggatgctaagctgctatttggtaaagagtgaatacgactgcactcaccacatggggttggggaggggctccgataaggtgcctgagtcacccaatgggcacttgtccatagccgcaaggatgtcctagcagggtgatcaccgggtgctctgttgagcaggttccagggtgacaactcctttggtttgctcacacatcggtagccactgctcctagcaaggccccccagccccacttcccatccagcacacactgctggcacccccactcagcccccggcactgcccctgaatttctctcatagctagctagctctccattggcaacgctggtgcctgtccctgccagcagccccaagtcagcaccatgcccggctgttcattattaaattgaaaaaaggaggagggtcctgccttgattcccttccaacaaagaggctccttggtggctatgcaaatgtgcccaccttctcctggaacttgctgtgcaaaccggctttgaaatttcagaggggccctgtgtcccttcccccaggggcttggctagcattccgtatcactgaggacttggcaggaaccatggaggaaggtcaggagcacctgctcccagtgcacatcctgccgagatggcccacgaaccagtcagcggctcttcttcagaagcaatctcaggtctgcctggcagtcacagccccacagtgaaatacgcaccacgtcccaactgtgcattcacatgtaattctcatctcattctaagtcttatctgattctcaccaaaaggctgagtcctgcttgccatctggggaaaccgaggcatggtgaatccaagtgacttgtcttctcatacatggagaaggtgaggttgaaaccagatccaggacactgcagagacccctctcatccctttgacctttccagaaaaggacctgcaagagataaagtagtttccgaaaggcctccaggcaggggaggggcctctgataatactcacagctcaaagttggtttggaacaaagccctcctggtgccatggcactggggcagcaaagcggggcagaaaatgatgggaggggagccgcctcccaaagggctgcaaactggggtgaattgaggctacttaatacattcaatccatcagagtaatgccttgtaattaagattcctggaaatgaagtagtaccggggcactccatggaagatctgccttcaaacggttcaggtcagccttaggctcaagcacggctctaattgacggctccccttgggtctgaaagaaaagatgtaatcagaccacacaaagcacgtcctgtccaattacaaggatcggcatggatgggctgacctgtgacctataaaacaaaattaagatttccaaacatcaccaggaggtagggggagagatggctcgtccgtgctccagccttccaactccccagagtggagacagaacaaaatcgtagccctggaaagaaatgtggtggactttgatcagccattgtgcaacctttcagttggagtctttctggggggtgggagggtcagggggactaatgctcagtttcttgcactggatgtccagatgcgttatcacaaaagagcatttctttgcagttgagccctagagtgccaggaagctagttctcgaaacaagccagaatctccaacagccataggacatgctaattacgtttgggggcagtgtggggatgcacttgatgtcatggtggaaaacacccccatactcacgccttatgggacctgcactctggagcatgaggccgactgcctgggttctggggtgagaacctatcaacagcaattgaggaatgtttatccattcttctgtctcctgactcagggagctgtgtttcatcttccaggaaagaactgggcgggcacattgcacttagcttattcaactatcagggacctccagcggtcgggaggttgaggaagagtcatggggcctcacaaagtctttgcagaaacaggcctttgcctccgcgccgccgagccaggagaacctgcagcgagcaactagctcttctttccttctcttttaaaatcaacacccgtccccagatttgcttttggcaaacattgcttaactgctgctgttttccctgaagtcactgaagagagagttagataatgagctggcatgctcttttgaaatgtttactgtgttccttaaagcaagggacatgctggttcctaaactaatttggggttgctagatcttttctactctttttggagatctccgaagtaaacacatggacttaagtataattatccgagagtcaaataaacagtcatggggctttctaaaggatgaacctttgcagatttgtcgatagaaattttttctcaattctcccaacagaaaggacagagaatgcatgagtattaagataatgcaccatagcacgccccaaagatttgaggataaaagatcaggttgtcttattttcagttcaaggaaaccaaaggtgatgacaggacctcaatggccatggcatatgggatagacccagatagttaaagaaaacttcctcaatgcaaactgttcttcataacggaattcacatttgaaaaatttctgagtttcaacctggcaggttgcaaagtcttgttaaaaaaaaaaaattaaagctcaaggcatccagtcatgtgtaatttcggtgagaactgtaataaatgcatccacgtaagccctaaattcccactgtcaaaatgaagatctagggttagcatgacatttatataaatcccacttggtattttggttgcatgtttttccaaaggagttcaaaggcatttatagacattctgattagtgcttgtgatatcccagtggggtggcaaattctattagctcagttttacatttgggaatagaaaatcttaaagcagccaaatggtttggcaaaaaccatatggcatgtcactgatagtgctttgagaagaaaacaggttttcccagcatctctccctgcttcagtcctctgtccaatttgcttgcaggatttttttttaatgttagataatgtcatggtgatttttagagtctatgtaaaatctcatctacatttgcagcctgctgggccaatgtccacctgtgcaggacagagtaaccttgagcccctcccttccatttgttgggaaggacagacctctctgaattgctccagccagctggaaagctgagcccccaagcaaataatgtcaagaagagacgataggagcccagaaagtaattccccaagccccttttcctctgcagaatgtttgcaggctccccgagcgtgaggcataatgacttcctccactcccagagtccaaacaagaagtggagaaggaagaacaagaagaaagacgtgggcttgttgtctagggcagatggtgtatcaggaacagatgtcagggatgaagaagacactcctcagctcctcgttggttgccatcatctcttcaagaagtacctcagactgcaaggaacagagtgagcagtggccaggggaagaggtgagcagtccaggactgccgcccaggggaggagggtgctatgctcccaggccacgtgattccattccaaggcatttcaagaccttgaagacaaaattgctcgactcagccagtagtaacatttgaggagttgctgtggccggaagaaggtgccaaaatattgccaccatgaggcaacattattacttgtgggcccagaagtgccctcccctgcaggctggctccatgaactgctctcctttcacctggttacacccacactgtctgtctgtcttttctttcctcattctgcccttcctgctcgggggcctttacatgctatgccgtctgccagaaacgcccttccccaccttgtgtgcacctgcctgtatccttcgaatgttcaaacatggcttcctcaaggaagccttctttcccgagcctcaatctggggtcaagcccactcattccaggctttgcagcctctcctgcaagtcaccggtggcaaatgagatgaaatcattggttgttatttagttgtgagttgggcgtctctaccagtggcagataaaccccatcgaggcagcaggctgagctttctcttattcatcgctgtcagcccagcatccatctatatttaacaaattaataaaataaatagctcatcagtctggtttgaagaaacagccacatgagcagtgtagaggaaggtgctgtagggtgaacttatgggtttatttcccacagccatgaaaacatttaacaccaagtcatatgattttgcctccttttctccatggcccaaatttcccattctaggacctcagtcttctgacctccactagccagcctctgctccaagaggaaaagggaatgacaaggctcagctcacgttttctgaataggaatggtctgctcccccttagtgtcattcctggagatcaaggagggtcccttctctaaagggctagctctttttctgctgggaaatagtgaatttgtgtggactttataatatttatttttaaaggtaaattttttccatggatttttgtaggctttgcttgtttggaagaaatcaattaggatttattatattttagccatgcttcaaaatacacaggagattaaaaatctaaactcctgataattgtattttataaaattaggactgcttatttaattatgaggaaaagtctccatcatcattaatatcattgtttataagcttttgggttttgttttcctctcaaacacagttccacgtttcccaatgggaacatctttaaaatatcattagaaacaaaggtgtcagccactcttcacagcttccgcagctgcttttatcaaatatccaggggcctgttttaaaagcagagaaattctccaaggaagaaatggcttggagatctgtcattgctactagaacataacaaccaatcttcataagcagtaaaaataattccaagagaagtaagcgacaggtaaactgggtcttaaaaagagacagaataagaggaaaggtaggaggcaggggaaggatggaagacggaggctggaaaggagccgcagaacggcacacaggttgctgagacgcgattgcactgaccagggtctggggagtctcaggtggtgtaatgtgtcatggagcttcttcttctttttttttgagacagagtcttgctgtgttgcccaggatggagtgcgatggtgcaatctcagctcactgcaacctccgcctcccgggttcaaggggttctccaccctcaacctccccagtagctgggattacaggcatgtaccaccatgctcagctaattttgttgttgttgtatttttggtagagatggggtttcaccatgttggccagactagtatcagactcctgggctgaagtaatttgtccgcttcggcctcccaaagtgctaggataataggcatgagccactgcacccagccacagagcttcttattaattatagaaattgtcctgaaactttgaaaccaatgggagtggggagttgggggacaggtaacaaattttgccatgataccattgacttaaaatcacgagatctatacatttagaaaagaggagttttattttttataaacgattacaacctgtaggctgttctgtttaacaacttgttaaatcaggaacaggcactttgaagaaggaacagtaaaagaggaaactatgctgaaggagctggctaagcgtacagatttagcaggttataggaggagctgggaagattcatgaagaggggctgtgtgcacgtgtagtaagcaaacatctttgttacatccatcaacacacacatgttcacctgggagtgaagacttcacatttaaatgttttacagttgggccctatatgtcgcaaggtgcagctgggactccaaggcactcagtgcacagtccccatggaccagccagaaccagtccctggagggtggtctcccatcaggggaaagttactgaaatcagtctcttgttcactcgaagctgtagttatggcttgcgggacagggatcagttagtcagcatctggtggagctgccattgttttaatattgcttatcttgaggtcaatgcttatttagctgttagaaaaaagacaaaacctcgtggcagtgagagcctcgtttattcttgaagcacagaggtgcgtgatttaacccttgcctgccacggcctccggtcttacttgcaatttggcatcctatcgtcagtctgattatctctagcgttcatgctggtcagttgttgtgtctaaactgcaaaaggcagggggtctggctgtaacgtcaggtgactggttgaaatcagcagtggagcaaatctttcaaaagggctggtttctgtttatctctttaaaaagaaactctaatggcggttagcgagggaggggctgtcttgaggtgtgcctgacctctcatccatcccatggccgggaactcagtttttaaggttctctgggggtctctttggccaagaggaggtccattcagtcagctggggggcttaggattttatttgtatttctcaatacaatcagatctttttcaattcccttccttaagcttgaatatcctttgaaaactccacaaacctaaaataatatgtgcactgaattcacgtatccaaaattatgagcttatgaaatttaaagatgcatttcgataatggtcacacacttataattcccatttgcttcaaatggttttaatttcatgacaaaaggcactggccatttacccagaggcagacacaaatctgagaagaggccattagcactcctataaaaaacaaatggaagccttctgttttcttgacttcatagttctacagtgtcaagcaaatgtggagctgtcattttcataccagaagccaagggggaaaaggacaaagggaaacccaaaactcatgcaacagattttcagcagcagggaaattaatctcattggactcctttgctcagctaccaagatgagcaacttatgcttcttcagtaagttcttttatcactttctcagattctagaagtggaagatatctgcccagattgagacaaactcctctcccctttcccatgttagtctcttttcgtatcatctgtgagttcccaaacaaggactgaatttctgccacctgctgccaaagatggtggcctgtgacatgcgtgaggaggcagggtctcctgggctagagcttagccatcgtcgtaagaggaaggtgggaactgactctcccatcctctgtgcgatggctaattgtatgtgtcaacttgagcaggccaagggctgcccggattaaacatcattattgggtgtgcctatgagagtgtttcaggatgaggtgagcatttgagtggattccgccaagcaaatcaccctccccagtgtgagtggacagcatctcaccccttgaggccctgaatgtaacgaaaggtggaggaagaaggaattcacctttctttctttcttcctacctgcctgcttgagctggaaaaaaaaagatcatctcatgttcttctgcccttggcctgggacttaacaccatcgtctaccctggttctcaggactttggctccaactgaactatagcacctggggctttcctggggctccagcttgcagaggcagatcatggggtttctcacctccataatcgtgcaagccaattcctcataataaggctcccacacacacacacacacacacacacacacacacacacgcacgcacatgagtcatgcactgaataatgtcatttcaatcaatgatagaccgcatgtactacagtggtctcacgagattatgataccatatttttaccgtatcttttctatgttcagatatgtgtagatacacaaatacttaccactggattacagctgcctgcagtattcagtacagtcacatgccgtatgtctttctagcctaggagcaaaaggtgctaccctctaggcctgtatgaatacactctttaatgtttgcacaacaaaatcacctaatgacacatacctcagaaggtattccatcatcaagccaggcatgactggatatatcccctggtggttctgtttctctggagaaccctaaggcactctgcctcggcctcatccccactttgccaaccggatcctccattccttatgtcttcactgatttcgtaaaatcacttctccgcaggtgatgaacaatctcctatggtcagtgtgatctttgaaacaggcaattctgtccatattggcccctactgaagatcctcccatagctcccaggatagagattgcatcctgagtgtgaccttcccccacaccttccagcctcatcccgtgtctcccccttccacctcctttgctgcagccacactgaatcagtttccaaagccgtcggctgtctacactgccatgtctgccaaccaagcaagcactcagggcttgctgggcattgtgatgggcactgggtacagcaatggctgcagggagttcacagttgagtaaatttaaagcaatgttgcagagtgctggactcagctccaatcaccccaaccctgggaaagtgccctgcccaccatcccccagccctgcttgaccgggagcccattcttttgtgttctcagaacaaagtttaaagattgcagtgcagatacttcacacccattagaatggctacgatcaaaaaacataaaagaagtattgaagagggcatggagaaactggaatctttgtgcattgctagtgggaatgtaaaatggtacagccactgtggagagcagtatggcacttcctcaaaatagttgacatataatataattattatatgatctagcaattccacttctggatagatagcaaaaagaacagaaaagaactcacatagatatatgtacacctgtgttcatagcagctttcttcacaacaaaaaggtagaaacaaccaagtgcccatcaacagatgaaagggtaaacaaaacgtggtacatccatacagtggaatattattcagccagaagattttgaatgctcccaatacaaagaaatggtaaatgtttgaggtgatagatatactagttacctcgcttttcattacacattgtatacacatatcgaaatatcacatctaccccataaatatgtacaattcttatgtgtcaattaaacatttgaagaaggaaggaaaatttgacacaatattacaacatgagtgaatcttaaagatgttattctaaataaaataagccacacacaagaggacaaatactgtactattccaagattaagaaagtagaatggtggttatcaggagctgggtggaaggtagaaattgggtgttcttgtttaatggggacatagttttaacttggaaggataaacatgttctagagtggatgatggtgatggttgcaccacaatgtgaatgtacataatgccacacaactgtacacataaaaatggctaagatagtaactttcatgttctgtatattttaccacaataaaaaaatatataggtaaaatttctttcttttcttttttttttttttgagacagagtcacccaggctggagtgcagtggtgcaatctcgactcactgccacctctgcctcctgggtttaagtgattctcccgcctcagcctcccgagtagcttggactacaggtgcccaccatcaggcctggctagtttttgtatttttattacagatgggatttcaccatgttggccagcctggtctcaaactcctggcctcaagtgatccacctgccttggcctcccgaagagctggaattacaggtgtgagccaccatgctctgtccataggcagaatttctgtttctgaccatgatgcagtcacaggaactagctttgccctcccacactaaacaaccaaacaaccagacaaaacaactataaaaaaaaaaaagacaatgatttttggacacagaacaacaggccacacagagcagagatcctttaaagaagggaaacaaatgggcaagccttaccacggtcctcacttaccacctagaaatcctttccaggctacgttccagggaaagctgacccaaacagagcctgctgttccctcaaaggaggagacagagctgagaacccagggaggcccaggcagctagaattgtagggcagagttcaacgaggcttcccctggagacttccatggagtactgatggatgtatgcctgcaagacaactaccaaggccaggaaactcccaccagaaaggaacaggcagaaaaatgtgtgagtctcagtgggccaggaacagattgtgttctcaccagtccaagtag

SEQ ID NO: 471 - DNA, 20001 bp, Homo sapiens
gggtttgatgatgagtttttaggtacaatatcaaaagcatgacccatgaaaaaaattggtaaggtgaacttcagtaacactgaaaatgactgctgtgtaaatgatactgttaaaagaatgaaaacacaagccacagactcggagaaaatgttcacaaaacacataactgataaacaactggcatccaaaatatacaaagaactcttaaaactcaacagtaagaaaacaacccaattgaaaaatgagcaaaaattctgcatagacatcccatcaaagaagatctgcatatgacaaataaaaatataaaaaggtggtcaatcacctaaggtctggaattcaagaccaacctgggccaacatggtgaaaccccatctctactgaaaatacaaaagattaggtgggcgtggtagtgggttcctgtaatcccagctactcgggaggctgaggcaggagaattgcttgaacctgggaggtggacattacagtgagctgagatcacgccactgtactccagcctgggcaacaagagcaaaactccatctcaaaaaataaaaaataataaaaataaaaatgaaagatggtcaaaatcttttgtcattaggaaatagcaacttgaaacaatgagatactactacacacatactagaattgctaaaatctaaaaacctgacagtaccagtgctggtgaggatgcagagaaacagaaacttccattcattgctcgagggaatgtaaagtggtacagtcactttggaatatagtgtggcagtttcttacaaatctaaacatagtctcaccatacgatccagcaatcacactcataagtatttacccaactgatttgaaaacttatgttcacacaaaaacctatatgaaaatgtttacagtggctttattcgtaattgtcaaacactggaaacaactgagatatccttcggcggatgaatagatggataaactgtggtacatccatacaatgaaatattattcagtgataaaaatatattggccatcaagtcattgaaaatgtggaggaactttaaatgcatattgtgaagtaaaataagccagtctgaaaaggctacatactgcaggatttaattatataacattctagaacacacaaaactctgtagcgacaatgaaaagatcagtagtttccagagtttcagagagaaggagagagatggaacgggtaaagcgtaagggtggtgaaactattccgcatgatcctgtaatggtggacacgtgatgttactcattgttcaaacccatagaactggacagcacgaagaaggaaccctcgtctatgcaaattttaaaaatcatttaggtcgggggattccaagagggatgtagttgatagcaacagactctaaaggtgttataaatgcatgaaaccaccccagtgaagcggaagagggaaaagatggtgagccaagtgactctggaaattaatggagacaaaaggaacagtgcataaaccctgtgctctagttgatggttgtttgcagtcgatagatggtggtaccggttaatagttctgataccgctggacatgtataatggaattgaacaattaagtaaatggatggtggatggtagaatccaggtttctccccgttggagtgggaatttacagataagcaaggagaggaggttagaatggcccatgaggtcagggatacgagttggagacatcactattgactcacgtttagctcaatatagatacaggtggttacatacagaagcatttatagatatgttgatctgtcagctgagagggtctagaagcaaccacactcaatagcaacaagcaggtccggcatccagaccttagtttccaatgccattctgcagtagaaccacccagggctccttggagaaatggctgattctatggctggggcaggaaatctacaaaatgagtatctcgtagtgccagaaattgaggaagtgctcaaaaataaaacacaaaaccccttcattgatgggggaatgttaaagggactcagaagtcaactgtaagtgctcccaggggccaaagctgaaacgatttgagcaacaaaatcagctattattggattatagcccaaagtatgaaataaatatctgtgagtccatgctgatataagtaaatgattaactaaataaataagtgggggagaagagaaaaatctcccttgcagaggaattccaaataatgtatataaatatttcaccctcaaggaggaggaacataaatccccttccttaagttcgggatgtgcatagtgacatccttctaaacagtgtagtacggaaaagggggaaacagtaactttacaatggagaaaactgataaacatctcagctgtgtgatcagggtcaatgaagtcatgttgatagcatgtgctcttgatatggtgtgataagaatggcattctcatctggaaaaacctctgtggtttttccacccaaaacccataaacccagcctaatcattggaaaaacatcagacaaatcccaatttgggggcactctgcaaaagacctgaccggtactcctcaaaagtgccaaggtcgtcaaaacaaggacagagtaagaaactctcatagccaagagaagcctgaagaaacatgagaagtaaatgagataggatcctggaagaggagaagccactgtgtcaaagctaacaaaatctggataaagtctagtacttagtggttgaagataacataccaatattggttcactatatgtaacaaaatgagagaagagtcagtgaacttcaaaatacatcaacagaaatgatccaatctgaagaacagagaaatgggatcaaaaagaaatgaacagagcttcagggacctgtgcagaaatatcaaaaggccaaacacaaatgtaattggagccacaaaaagagcaagaaaagaaaatgagggccaggtgtgatggctcatgcccataatcccagcactttgggggctcaaagtgaaatgactgcatgaggccaggagtttgagaccagcccgggcaacagcaagaccgctgtctctacaaaaaataaaaataaaaaaattatgcagacatggtgacacgtgctaatagtcccagtactcaggaagctgaggtgggaggatcccttgagcccaggagttcaaggctgcagtgagctatgatcatgtcactgcactccagccttggtgatagagcaagaccctgtctcaggacaggaaaaaaaggaaaagaaaagaaggaaggaaggaaggaaggaaggaaggaaggaaggaaggacggacggaagggagggagggagggaggaagggagggaaaggaaggaagatatttaaagaaataatgcccaaaatttcccaaatgtgataaagacaaaaattttaaggattcaagaagttcaggagaccccaaggagaatgaaaaaatgaaataaaaacacatactcatgcccaaataaaaacacaacagtcaaatttcagaaaactaaagataaacagaaaatcataaaagcagccagaggaaactacaattacgtgtagcagaacaattgaaatcaccactgacttctcatcagaaactatggagacaagaagacagtagatcttcaaaatatcaaaagaaaaagactttcaactcagaactctataaccaaagaaaatcgtcttcaagaatgaaggtgaaataagaacactttggatccaagaaaaccaagagaattcattcctgtactgcaagaaatcctaaagggagcttttcaggctggaaagaaacgataccagatggaaatgtcaatcttcaggaagaataaagagcctggaaaatgataaatgatacatacctagtaaatattaacactttcattctatttcttaaaaagcaaaccccattttcctatggagtttataatgtatgtggatatcttacatataacaactataacataaaggatatatatatatatacacacatatatatggttgcaagatttctacattttacatgaagtggtaaaatattcatttaagtagactgtcaaaagttaagaatgtatttttaatccctagaacagctaccagaattttttaaaatacgagaaggtatagctaaaaaatgcaatagataaaacaaaaccctaaaaaccattccaattcttcaaaagaagacagaaaagagagtcagaggaaccaaaaacaaaggaaataatcagaaaacacataataaaatgaaagatatgaatgaaccaaacaacataataaaaagacagagattgtcaaaatggatacaaaagcaagaaccagctataaacctatacaggtgacgccctttaaatatgaagacagggaaggcgcagtggctcacacctgtaatcgcagcaccttgggaggccgaggcgggcagatcacctgaggtctggagtccaagaccagcctggccaacatggtaaaaccctggctctactaaaaatacaaaaattagctaggcatggcagcaggcacctgtaatcccagctactcaggaggctgagacaggagaatctcttgaacccgggaggcagaggttgcagtgagccaagatcacaccactgcactccagcctgggtgacagagcacctttatttatttatttatttatttattttgtacactttgaaagtgtagttcaaagtgaatggatgtgaatagagagagggaaaaaaagtagttgtaaaaaagctggggtcagccgggcgtggtggctcacacctgtaatcccacattttgggaggccgaggcaggcagatcacaaggtcaggagatcgagaccatcctggctaacacagtgaaaccccgtctctactaaaaatagaaaaattagctgggtatggtggtgggcacctgcagtcccagctactcgggaggctgaggcaagagaatggcgtgaacccgggaggcggagcttgcagtgagccgagatcgcgccactgcactccagcctgggcgacagcaccagactccatctcaaaaaaaaaaaaaaaaaaaaaaaagctggggtcattatcttaatatcagataaaagagacttcaagaaaaagggttttattcgtgatcatgaagcccagctcataaagataaaatggttaattcatcaggaaaacataaatatgtattcatataataacaaaacctaaaaatatatgaagccaaaattaacagaatttaaaaggggaaacagacagctctttgatcatcattaaagatgttaactctactcttttagtaattaatagaataatagattaaaagttcagatataaatgaaatagttgatctgaataacactatcaaccacttcaattgatatttatggaatactatattcaactacagagtccacattcttttaaagggcatttccaaaaataggctatattctgagctataaaacaaggtttaataagtactgaaatcagccagagtacatccgataacaatggaattaaatccagtaataatacaatatctcagaaacccccaaatgtttttaaacaacatacttctcaataatcaatggatcaaaggaaccacaaaaactgaataatcatgaaaatacagcatatcaaaatcaatgatatgcagctaaaacagtgcttgggggaaatgtataaccctctaagtgtatatagaaaacaatagagaaaattaacaaagccaaaatttggttctttgagaagatgaacaaaattgattaccccttagctagattgatcatgaaagagagaaaacacaaatcatcaatacccagatttagcaagacatggtcactacaaatcctgcagacaactttacatgaacaaattcaacaagtgctaggaaattgacaactccctgaaaaatacaccttaccaaaactaacacaagatgaaatagaacactttaatagccctataattaatttaaaaactgaatttgttagcaaacccttcacataaataaaactccagactcagatgtcttcattggtgaaccatatcaaacactgaaggaggaacacagcctctttgaaaaaatcaaggataaagagaacacttctcaagttattttatgagactaaaataatcttaataccaaaacctgacaaatacattgcaaaattgataaatttgcagacaattacagtccaatatctctcatgaaaacatagacacaaaaaaatcttaatgaattattagcaaatagaatccaacagtatatttaaaagaacaaaaggacttatctcagcagtataaagtgttttaagatttgaaaatcaatataatttaccatataaaaagaaaggagaaagtaaaaaacatatgatcaattcaacacccaaccctgatagcactctcagaaaactaagaataaagagaatcttccttacccaacaaaggacatctgagaaaatgctatgctaacatcatactaaatgctgaaatattgacactgtcctcctaagatagacattctcaccacttctattcaacattatactggagaccctggcattgcaatcaggaaagaaaaacaggataaaaggcacgaaaattgaagaagatgcagtaaaactgtgtctccctgcagtcaagaagggtgaggccagaggctgaatgtgccaggatgctggagcgtggtccaggcagaaaactctggggtggaataaaccaatggggctaggacacctggaccacaatgggaaggagggagccccagagtgccaggttccctcactcgggaggcaaatcaggggaccgtgggaagaagaagacagagcccagggcggtgagctgctgcccctgcttcatcctgtgcacggcagcaatggggccacctgcccagagaccccgagtgtcacacttgctggtgggtagagagggcagacaggcctggcctgaggcctgtccagggctggaggaggacacagagccccttggccagtggatctgtgcttgttctcaatagtgggacgggctagacagtcagtgactgggaccactggagtcaagggtgggcgggggtggcacacaggacaggctcagccagggagagctgttaatttgaccacgtagcccagcagtcctacaccccaacacccccatcccacttcccccacccccacacacacacacctgttcccaggtgtgctcaagcatctttggaggcttcctctcaacttggatcctcaaaaatcagaggcagatgctgagacccttttggggctaggacataccttcaagaagctggaaatgggggtggcaggcctggattcagaggcaaagacacagcttccaggggaggcgagagtcagggtcaggcacaggtcacaggccacacccaaaggcttcaggtccagggcccctggctgccccgcctcagccctcctcccaggctccttccccagtctcctctggccacagcacgcttcctccagatgttccagccacctggcttagacactcctgctgccctctgagccagcatgagaccgtctgcagtgctggcatcaaaagaccccagagtcagggaatgtggaggctcagagtcaggcctgggatgagctggaccccagagccagggaacgtggaggctcagagtcgggcctgggatgagctgcccttggcatgggtcacctgccccgagacgcgggtcactgtggctgtgctgtctccatttctgtgcaggtcccaggccccaaaacacctcaaaggaaggagccagggcctacaggcaggagatgccagggagctccgggccctcaggcaggatgtggatgggagacctggagttggggtcccaggtgggagtgggggtggggaccagcctgggccaggccccaagtcagacacatgggtttccatcctgtcccatttcttcaggcaaaggctgagggtccccgtcaagctgttaacactggagtgggaattatcttctcagacaagccagtccccagctgggctctgagacagagagcccagaagcaaagagtgaaagtcaccagtcaggactggggtgccttgggagacggctggaaatgttcccagcgtcacctcgtacaccctccacaaataactgtcccgtcatctgtctctgctgctgagattccccgctggggcttgggaacatttccccactgtctctgacagccctgggcctgcaaaccagagccccacttgcaggccgcatgtctggcaaatctcttaccctctctgaggcccctcagactctacccagcaggggccctgccccaggccccacgtctcggggagctccagctttgatgtgccctcctcaaattgtctgagacccctgtggtgtctgggacaagccctgacctggactgtggggaccctagttcccccttctccccatttggggcgctctctaactctacccaaccaccaccccacatggggtaaaccaggtgtccagaggtaccctgggaatgaactaggtctgggagggaggcctggcaggccggccactcggctggaggatccacgcttctttcgtgaggtcacatgaggctgggccatcagaaccgcacacgtggggtggcactcacccatgtcaaacacaagacaagctcaagtctctgagtccaccaccaacacttggacttgagccacagcgtgagcctgagtgctgattcccgggtgctgacctctctctgttctggccagggtgctgcttccagtccgtggcacccaagaggcatgatggtgactggcgctaaccgggtagctccgctgctggcagccacactctccactgctgcatgccaggtcagctgtcctccagggtgctcagaggccactgtccccagtgccaaggggcccctccatccatgtcttccctgccttcagttggaggcagaatgtaccttcagtctcaggctgaatgtaccagggtcggatgttcactgcatgaataaaatgactcttctcggtcacccactggccgtgcagtgtgggaaggcagggctccatcagccccaagagagaacacagggagaagagatgtttaccttcctgctacttcctaaaggtaaatttaacatgaccagaaaacaaattagtttccattttcccacatcctctgggtacaacttgcatttgtggtcatgtcaacaaaaaagccacagacgggtgcagtggctcacgcctgtaatccagcacttgaggaggctgaggtgggccgattgcttgagctcaggagttcgagaccagcctgggcaacatggcaaaaccccatctctaccaaaaatacaaaaattagcagggtgtgatggtgcatgcctgtggtatcagatacttaggaggctgaggcaggaggactgcttaagcccagagggcagagtttgcagtaaactgagatcatgccactgtagtccagcctgggcaacagagagagagatcctgtctcaaaaaataaaaagagagagagagagagaaaccacaacgtttggagcaacaaccccaaagccaaccaggaggagacccacagtctcccagagccaaccagggggagcccaccgttctctgcattggctggacaggctctctcctgcagagccccttccctagaatgcccttccccctgtgctgctcgacctgcttcctccaggcctggttctgccatggccttctccaggaagttccttgtcactcccagcaggaaggtagagcactagacgtcttgccctctcaaggcccggccccaagccccatcccaccgtcacctgaggcatgtctgagctgactgcccagactaagaggcccaacaatgagcgcccaacctggagtcagaggcccaggctgtgtgacactgggcccattccctacccattctggaccccagcatcctcacgggctgaggagagacgagacccctgcccggcagggctcaagagaatctggggagcagcgggaccacctgtctccaccgaagcacccggcacccgctcaggtgttggtattactctctctcccacctgctacatgccagagccggggcagcccagggaggagaggaccctgccacagtcctcagcttgctgctggggcaaaaatcaacgagacaatgacaggaagtgtgaagaatgctgggctttcagggagggcttcaggcagcctgggaaggcttccaggaagaagtggcacggagctctgtttccttgtaagttaccatttcttgggtactagtggcaggcactcgtttatacctccagcaccccgtgaggcaggtacagaaaggattactcccattttacagatggggaaactgaggtttagtcccacagatggtatactcagggccaggtgcggggagtgggggaggtttcaggacaaggggaacaacagtgtggaggcaggaagcagctgggtgttttgggggccggacactttggtgtggcgagagcctgggtgggagactaggagaggtgagagcaggagctacgggagggcagagccctggggtctagtccgcctaccagggccacagggagccatggatggtgctaggcagggaggaacctggtcagatgggtgggttaggaagacggttctggatctaagagggaaatagctcaggaggcaggggagaaggtgtgagggaaaatgcaagggccagtgcaggcctgagaggcgcttgtctggagtccaggggtcactcctggctctcagagcaacgacagtggggtgagcagcttcctgtgttcccagctctgggaaaagcttctgctttccgtctctaggtcagtgtcttctcccagctccagattcacatggccacctgcccggcagccaccccacccataaacagtgaatgggtggttagctcctaacctggcccctcaagctcctcatctccccagcctgctccaccaccatcctccccatctcagcacctccctccctccagggcttaggcacctccctccctccagggctcagacccagaccctggagtcaccttagctcctgtctgtcaccccagcacctggcccaccatgcagctctgctgtctcctcctatccaggtttatcccaaatccagccggtcccctccatagccacagctctggtctgagccaccaccctgctctcctgtggatcacagtaggggcctctcggcaggcagccccagccctcaccccacatcctggttctcatgcagccagaagcaccccgaaatcctgcactgaatcaccaccctgctctgctccaaacccaccaggaaggtccagctcactctcagtcctcacccactgccacacctggcctggccccaaccctgccctggcctcatctcccactgtccactttcccctccgctggcctgagcactcctcaaactcaccaggcaactcctgcctcagggcctgtgcgcttgctgttcctggaatgtcctctcttctctctcttccccctcccatccccaggcacattgtatggtccctgtattcattccatttaaatatctcctctccagcctggctcctgtgggaccccccttcccgttagtctccatcccgtcacccagattttctccgcagcactgcaccttcaccctgcattcggtcatgatcgcactgctcactgtctgcctccctctctagattgtcagcgccctgagatcaggattctgaccttcttgttcacaactggaaccccagtgccgagaaggggcctgctgtgagcagggcagagcatgtgcacccactgagtgagcgagtgaccattgcagcctcactcctgcgctgcattccgcagcattctttcacatccatggtttcccccgaggcccctcaggaacaaaggctcagagagggtgggagaagtgtgcagggtcacacgtgcttcccctcctccctttatggggtcctgtggaggaaggggaggcctgactgcacactgcagaggccagggcagggcagagagactcccacgcatgctactccagggatggggcctggagggaggctcccgtgcgtgctagtccagggcctgtggaggaaggagacgcctgacctcacactgcagaggccggggcagggcagggagattcctgtgcatgctactctagggatggggcctggattcttcagtgggtccctgggcaagtcaggctccctaaatgccccactgtaggtgcctgcagtaacaagaacaagaagggcagggcatgcagcaaagccacaaggcacaggctgcgcacacctactggctgtgaccctgagcaagttacataactactctgtgcctcaatgctctcatctgtaaagtgagagtaacaatttctgcctacctgacagggctaagggaggattaaatgaaccaatatctgaaagttctcagcatgatgcctggccgatgaaaaaaacctcagaaagtgttagtactactactactaataataataataagcaataacaatgaagagttcatggccccgtgacagtggtgcctggcactgacctctgtgtttgttctaattctctcaagacccctgagaataactgccacacagatgtcagcacaggggctgggcctccctgcccactttctgcttcccagaaagtggccaacttccccctggccaactatgctttctagccaatatgtaagttatggcttttcctctgtggctcagcatagggagcagggcaggagaaaggcagggactccaccaaggtcacacaaagagtgccagtggggcctggtccacccttctcaggaaggtctgagctccctgtcctgtgctcccataatacctaaccttcaccttgcagatgagtcactgcaactgtgcttgctctttaaggtctaccttgcctgtaaaagccagagctgttcatgcaaaatttcctgcacctgggcctgagtcagagttggttctcaaccaatattttttagtggatgagtaggtaggtggatggatggatgattggatggatggatggatggatggatggatggatggatgcatggatgcatggactgacagatggataggtggatggatggttaagtaggtgggtggatggatggatggatggatggatggatggatggatggatggatggatagatggatggatgcatggatcgacagatggataggtggatgtatggttaagtgggtgggtgaatggatggatggatggatggatagatgagttccagtgtgaatggatgggtggatggataggtggatgagtcctgagatgaatggatgggtggagggtaagtggatgagttccagaatgaataggtttgtggatgagtttgtggatgggttgtggctgggtagacttcagagacagcactctcctgggacatatcattgagcctttccccataatctgaaacacaaggaggcttcaatggtgtgggatccaaatgggatccaaaaaagattctaaaaccttctgagtcaagtgcatttggcctcagtgggcctcagtctatccatcatgaagttgtgagaagaggaccagcctgcctgtgtttcacgattcccgggatgaaccctccttaaaggagaggtacagtagcaccttgaaaagggtaagtgctgcaaagacctggtttagaggataatgttagccctgccaagggtaccaagggtgcagcagggagacacgccctgccaggcctgtcctgggagcatgcacgggtttgccctggcaggcatgcaggtagagggagacagccgccctcaaggcactcatgccctctaacccagtaattccacttctaagaatggaccctaaggaggtagtcaaggatttccagagagactcacctatgagtgtggtcattgcagggtcagaaaagggaagatgtccatgtaataacagacttcagcgtaaataactcatttctctacactgcagggcactcctccacagcggaatattacgcagctgttcaaagtgggtttttgaagaatgactacatggcatgggaaactcttaaaagattactggaaaaaaatcaagataagacaaactgcacgtggagtaagatctcatgcctattgggaggaagtctctttctgagtatttgcttgggaaaaaagtcctcaataggtatataccagaacgcctggttatctctaggtggggggattatagcgttttttcttcctagtaattttccatattatccaaattgcatttcaggggtgcaggccagggggtggccctgagtgggcctctgtctctgaacttccttccctggggaccaaacaggaaaacccccacccttcccctccagaagggagggattcctaaggacagaagagctatggagggaggaagtgccctgtccaagccctttcaaacatcaggatacataaaactccaggcccttactgcctgcatcttatctgagaagtgggatttttggagctatgtcattgccagctttgctgtctctccgtgtttttttcaccttccacttttttttttttttttttttttgagacggagtcttgctctgtcgctagattggagtgcagtggcacgatctcggctcactgcaatctctgcttcccgggttcaagtgattctcctgcctcagcctccccaaactcccactgggactacaggcgcctgccgtcacgcccagcaaattttttttttttttttttttttttttttagtagagacgtgtttcaccatgttgcccaggctggtctcgaactcctgagctcaggcaatctgcccgcctcggcctcccaaagtgctaggattacaggcgtgagccaccgctcccggcctcaccttccacattttctacaatgaacaagaagaacttggcaagtcaagagaagaagcaaagccatagagagctagccaggggcgttggccggctgtggatctgtccagacccaggccgccctcctacgcgggcctgctgcaacctgcgctggggttgaggcaggaaccaagcttggggccaaccgactgcgtgggacgtggctcccggatctgcccctcaccagctgaggacaccggagcgtctctctccaggactcagtttccccatctgtgaagtgaggatagtcccaccccccagctcaatggatccctgcgggaggagggaatgcgaggctggttgtgggtcggggggcctctttccgattcttcctgaagaaccctgcacagaggagacgggggactgggaggggcctgggtctccgagtgtgggcacggggagctgaggtcttgcagctcctgggtctggggcgccggggttctgtgagagccccagcttcgtcacgtacgacttcctctcctctaattgagggaattgcagaagccccggagggcggctggttcagagaccgaaacaaaggcaggatcaggaccctggatcagaatggggtccacgcgtgagtctctgtaattaacgctctggtgtctcaaattacgagaaaatatataaaacatgtaattgcttctgtattttggacactcattaggagaataataaatgttattatttattaatatggtaatgaatcatctcgcttttaaaattaaacattaaaccgctaacaaattaaatgtaaattattaggccccgagttgatggaaagagttccccggggaggggccgctgggctccttctttgcagaaatgagtgcgtcgccctttaactaggcgcggaggctgcgagcggtgcggggtgacctgaggacacccgaagacacgggcgactcgcggggacatcctgccccctgccggccgcgagcgggaccgcagcggcccgcgggtagcgtcccgccgcggaggtggtttttccttgtgatctttccagaagcagtgaagccctcttgggcacccgcgcccctcgcctggcagacagccacccgctcgcgcacgaactcgctgcacagagctgtcaggagtggggcgtgtggcctggagcgaggctgctcgcgtaggctgggcctgggctcctggccgtgttgtcaccgccaatccccacacacgcaagagaaagcagcttctagcctcatctcacacacgggaaagtgaggctcagagatgtgtggcctggccggggtgcacagccagtatccggtgggcctgggatgccagcccagcctgccaggccccagggtggccatcatggagtgggactcccgggctggccccccagagcctgttccaggcacgtgcatttgaattaatggggttactgtttcctgagggctcttgccagacaccagctacttactgcacgtggttgagcccaatcaagtaggcagtgtgccctgtgcccatcttacgcacgagcagactgaggcacggagaggcttcagcgacttgcccaggtcagcagcaaggaagtaggggcaggagagagaagtaggtcttgctgagtctagagttagctcttgaccactccaggccagactgggttctccctccttccaggaggagggcaggcagccccatctgtgcccatccctgcggtgcacaaaacagtgcagcttccgggccactggctgtgtttctagggatcacctgagttaaagcaagaaaaggaatcattatttttttaaccaatacatgatttggggcttagaggttgtttgcagtcactcttatgaagaatgctacagcagacaccgtgggttcaaggttatttccttgggaaagacttccagaagtcaaactgctggaaccaaaggctgggacagcaggattttggcatgcatgttattaggatccttctcgtatatgtgtcccagcttgcactcatctggggagggactcagaaaagagggcctcctcccctcacaaccaatagcacccttgagatggcccaggctggcagggttggaaaagtccagctcatctatggtccagttctctggtgggcactgacccttgagccagccacacccacacccacacccacacccatgcctgtggggatcagaggtcaatagatgcagcctccaatggtctgaggctccctgactttcctcccgccttctctccgtgtgtaatcccagcccagggccaccctttggtggcaaacacagacacccctgtgtcagccatacgtattcagccaaggctttatgagtaccttccacttaggaaccctcacttctgtctctgccttcccttgcgattatgagtcccagcaatggcagctgagcactcaggatgcccactcctggctctgactttacgtcactttctcaacacgttacaggtgaagagcctgccaagtggccgagccacgatttggccccagagcccaagttctgttctttccttgggtctctgctgtctgcccaggcctgagcatggtccctcagacaggctcaggaagtatttgtggatgaatcaatgaacgaccccgtgagggcctttgcctttctcccctgccaggctgggagcccccagaagacaagtggggttgaccatgtgcctggaaggagtcacggctcctctctagaccggaactccccactagagcgatggggtgccacagggtatcccagcaggcccggcaagcacatcacaggagcgtggagaagcgggaccagccgtgcccccatccctgggagccctgcccccagccttgtctaaggcctcacttgccccatatctggtttggggagcaggtttctcaccccaatatgattctgttctctgccccctctgccctcctaccccacacatcccagcgtggatggacgagacttcgcccctgcctcctgcccgggcccctgccatgggaaggggacgcattattgctctctctcagggctattcagacaccaactaatttatttccctcctgcccccttccttattgatcaatgctttagctgagtggctgttaaatgacttgttcccatagcaaccatcagatacatgctcggatctgatgtgtctgtttcctgagccagatcgcctcctaagagcttggagagaacaaatctcctttcatatccgtcgctgtcttctgaaaggcacaggatattgttcagaacaagtcattttttaaaacaatattaaaaaaagaactaggtttttcaacagatataaagttgtttcataaggtgcatcattcttaagaagtattaaatcagattttaaaagctttgaccaagttaatctttcttctgcctacttttccttctgcacagggggaagtatggaaacggtctctgcataaagatactctgctgcatcatttataaaaagaaaaattgaaaacagcctaaaagcacaatagacgattcaaatgatctatggttcacatacctgtgagggttttatagagatgctgaaacgctgcttagaagagagaaacacacatgtcaacaacgtgaagtgaaaaaaaagaaacaagattaaaaactgtgtctgcacgggtgagcataatgaatggaaaacaaagctaaattatgtagaggaaaaaatactcaggaaaacaaacacagtgaaatgttgacagaagtgtttcttgttggcagagccatgggattttcttccttattcacttacttaatacatatttattgagcacctactacgagcccagccctgtctgaggcattaacagcacaactgctatttctactgcctatattttcccaaatgtgtttaaaactgttttaaaactatgtatttttttcttatttttgtttgtttgtttgtttgttctgagacaggctcaagtgatcctcccacctcagcctccccagtagctgggactacaggcgtgcactactacaccccactaatttttgtattttttgtagaaacagggtctcgttgtgctgcccaagctagcctcgagctccgggcctcaagcaatccacccacctcagcttcccaagctctgggattacaggtgtgagccaccgtgcccagccaagtataattttttttaatgacagggtacatgtttcacctgccacgttgccaacaaataaacataagacgctctgttggtgaggagaggatataggaacaccagccccgcctggcagaagaatgaatgaccacgaccaataaaggaccagttatcaacacttaaaaccgacatactttttcccagcaattccacctgtagtcattgtccctactgggattctctcccacctttgtcgtgggatgtttacgaagcttgtttaccgtggcatgtgactgctggaaccccgaatggtcctcgccaggggatggctacccagatcgtggttcagactcaggaaaacactgagccctgagaagaacgaggcgatctgccagtgtgtggaacactaagctgaggtccctaagggacagagcaaggcggatcacttgagatcaggaattcgagaccagcctggccaacatggtgaaaccctgtctctactaaacatacaaaaattagccgggcgtggtggcgggcacctgtaatcccagctccttgggaggctgaagcaggagaatcccttgaacctgggaggtggaggttgcagtgagccgagatcatgcccaagatctctgctcttcccccgtcttgccttagtgatcctgggcatgtcccttcacctctgcggcctcagtttctcatctgcacagtgaagatgctgatgcccgcctggctgatgcccgcctggctgcttcctggacagatttcccaggatgtgctgtgtgacaggccttccacacaggccctcaggcaccttttcttcttcctgagatggaaacaacaaaaaagttggtgcatggtcaccagcgatccccaaactacgacctctgccctcttttcctgcagacccctcaaaaatcacgaaaggggcccttgcaatagggggtctctatggactcaaacaaagggctttccctgggaggggctgccggcctttgcctataacatgcgtgatgtagtttttaagactagcaaaagcccagcctggcattatctagcattgaggtacagcgtctcacggaaagttc

SEQ ID NO: 472 - DNA, 40001 bp, Homo sapiens
tgttgtcatcagtgttctggatttggtttattctattaggggtgtaatagtatctcattgtttttttaattttcatttttccaataacatatgatataaagcatcttttcacatgcttatctgccatctgtatatcatctttggtgaggtgtctgttaaggtctttggcctatcttttaagtgagttattttcttattgttgatttaagaaagttattggtatattttggataacagtacttgatcagatatgtgttttgcaaatatttcttcccaggctatatcttgtctttttattattctcaaagtatcttttacagagcagaaattttaaaattttaatgaagtctagcttaccaattctttcttacatgaatcatgtctttgatattggatctaaaaagccactgttaaacccaagattatctacattttttcctattttaccttctatgagttttataattttgcatttaacatttaggtctatgatctattttgggttaattattgtgaagtgtgtaagatctgtgagtcactatttctttttgttttgttttgttttttaattattattatactttaagttttagggtacatgtgcacaatgtgcaggtttgttacatatgtatacatgtgccatgttggtgtgctgcacccattaactcatcatttagcattaggtatatcttctaatgctatccctccccccgccccccaccccacaacagtccccggagtgtgatgttccccttcctgtgtccatgtgttctcattgttcaattcccacctatgagtgagaacatgcggtatttggttttttgtccttgcgatagtttgctgagaatgatggtttccagtttcatccacatcccttcaaaggacatgaactcatcattttttatggctgcatagtattccatggtgtatatgtgccacattttcttaatccagtctatcgttgttggacatttgggttggttccaagtctttgctattgtgaatagtgccgcaataaacatacgtgtgcatgtgtctttatagcagcatgatttataatcctctgggtatatacccagtaatgggatggctgggtcaaatggtatttctagttctagatccctgaggaatcgccacactgacttcctcaatggttgaactagtttacagtcccaccaacagtgtaaaagtgttcctatatctccacatcctctccagcacctgttgtttcctgactttttaatgattgccattctaactggtgtgagatggtatctcattgtggttttgatttgtgtttctctgatggccagtgatgatgagcattttctcatgtgttttttggctgcataaatgtcttcttttgagaagtgtctgttcatatcctttgcccactttttgatggggttgtttgtctttttcttgtaaatttgtttgagttcattgtagattctggatattaccccttggtcagatgagtaggttgcaaaaattttctcccattttgtaggttgcctgttcactctgatggtagtttcttttgccgtgcagaagctcttgagtttaattagatcccatttgtcaattttggcctttgttgccattgcttttggtgttttagacatgaagtccttgcctatgcctatgtcctgaatggtattgcctaggttttcttctagggtttttatggttttaggtctaacacgtaagtctttaatccatcttgaattaatttttgtataaggtgtaaggcaggtatccagtttcagctttctacatatggctagccagttttcccagcaccatttattaaatagggaatcctttcccgattgcttgtttttctcaggtttgtcaaagatcagatggtcgtagatatgcggctttatttctgagggctctgttctgttccattggtctatatctctgttttggtaccagtaccatgctgctttggttactgtagccttgtagtatagtttgaagtcaggtaccgtgatgcctccagctttgttcttttggcttaggattgacttggtgatgcaggctcttttttggttccacatgaactttaaagtagttttttccaattctgtgaagaaagtcattggtagcttgatggggatggcattgaatctataaattaccttgggcagtatggccattttcatgatattgattcttcctacccatgagcatggaatgttcttccatttctttgtatcctcttttatttcattgagcagtagtttgtagttctccttgaagaggtccttcacatcccttgtaagttggattcctaggtattttattctctttgaagcaattgtgaatgggagttcactcatgatttggctctctgtttgcctgttattggtgtataagaatgcttgtgacttttgtacattgattttgtatcctgagactttgctgaagttgcttatcagcttaaggagattttggactgagacaatggggttttctagatatagaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgtcagttttcaaagggaatacttccagtttttgcccattcagtatgatattggctgtgggtttgtcatagatagctcttattattttgagatatgtcccatcggtacctaatttattgagagtttttagcatgaagggttgttgaattttgtcataggccttttctgcatctattgagatattcatgtggtttttgtctttggttctgtttatatgctggattacatttattgatttgcatatactgaaccaggcttgcatcccagggatgaagcccacttgatcatggtggataagctttttgatgtgctgctggattcagtttgccagtattttattgaggatttttgcatcaatgttcatcaaggatattggtctaaaattctcttttttggttgtgtctcttccaggctttggtatcaggatgatgctggcctcataaaatgagttagggaggattccctctttttctgttgattggaatagtttcagaaggaatggtaccagttcctccttgtacctctggtagaattcggctgtgaatccatctggtcctggactttttttggttggtaagctattgattattgccacaatttcagagcctgttattggtctattcagagattcaacttcttcctggtttagtcttgggagggtatacgtgtcgaggaatttatccatttcttctagattttctagtttatttgtgtagaggtgtttgtattattctctgatggtagtttgtatttctgtgggatcggtggtgatatcccctttatcattttttattgcatctatttgattcttctctgttttcttctttatcaatcttggtagcggtctatcaattttgttgatcttttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttgtgctataaatttctctctacacactgctttgaatgtgtcccagagatcctggtatgttgtgtctttgttctagttggtttctaagaacatctttatttctgccttcatttcgttatgtacccagtagtcattcaggggcaggttgttcagtttccatgtatttgagtggttttgagtgagtttcttaatcctgagttctaatttgattgcactgtggtctgagagatggtttgttgtgatttctgttctttcacatttgctgaggagtgctttatttccaactatgtcgtcaatgttggaataagtgcagtgtggtgctgagaagaatgtatattttgttgatttggggtggagagttctatagatatctattaggtctgcttggtgcagagctgagttgaagtcctggatatccttgttaaccttctgtctcattgatctaatattgacagtggggtgttacagtctcccatttttattgttgggagtctaagtctctttgtaggtctctaaggacttgctttatgaatctgggtgctcctgtattgggtacatatatatttaggacagttagctcttcttgtttaattgatccctttaccattatgtaatggccttctttgtctcttttgatctttgttggtttaaagtctgttttatcagagactaggattgcaacccctgccttttttggttttccatttgcttggtagatcttcctccatccctttattttgagcctcatgtgtctctgcacgtgagatgggtttcctgaatacagcccactgatgggccttgactctttatccaatttgccagtctgtgttttttaattggagaatttagcccatttacatttaaagttaatattgttatgtgtgaatttggtcctgtcattatgatgttagctgattattttgctcgttagttgatgcagtttcttcctagccttgatggtctttacattttggcatgtttttgcagtggctggtactggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggtccccactctcttctggcttgtagagtttctgccgagagatccgctgttagtctgatgggcttccctttgtgggtaacccgagctttctctctggctgcccttaacattttttccttcatttcaactttggtgaatctgacaattatgtgtcttggagttgctcttctcgaggagtatctttgtggcgttctctgtattccctgaatctgaatgttggcctgccttgctagattggggaagttctcctggacaatatcctgcagagtgttttccaacttggttccattctccctgtcactttcaggtacaccaatcagacatagatttggtcttttcacatagtcccatatttcttggaggctttgttcatttctttttattcttttttctctaaacttcccttctcacttcatttcattcatttcatcttccatcactgataccctttcttccagttgatcgcatcagctcctgaggattttgcattcttcacgtagttctcgagcctgggctttcagctccatcggctcctttaaagacttctctgtattggttattctagttatccattcgtgtattttttttcacagcttttaacttctttgccattggtttgaatttcctcctgtagcttggagtagtttgatcgtctgaagccttcttctctcaacttgtcaaagtcattctccgtccagctttgttccgttgctggtgaggagctgcgttcctttggaggaggagaggtgctcgctttttagagtttccagtttttctgctctgttttttccccatctttgtggttttatctacttttggtctttgatgatggtgacgtatagaagggtttttggtgtggatgtcctttctgtttgttagtttttcttctaacagacaggaccctcagctgcaggtctgttggagtttgctagagatccactccagaccctgtttgcctgggtatcagcagcggtggcttcagaacagcggtggctgtaggacagtggatcttggtgaaccgcaaatgctgctgcctgatggttcctctggaagttttgtctcagaggagtacccgactgtgtgaggtgtcagtctgcccctcctggggggtgcctcccagttaggctgctcgggggtcaggaacccacttgagaaggcactctgtccattctcagatctccagctgcatgctgggagaaccactactctcttcaaagctgtcagacagggacatttaagtctgcaaaggttactgctgtctttttgtttgtctgtaccctgcccccagagatggagcctacagagacaggcaggcctccttgagctgtggtcaggtgggctgctttgtttacctaatcaagcctaggcagtggcaggcgcccctcccccagcctcgatgcccccttgcagtttgatctcagactgctgtgctagcaatctgcgagactccgtgggtgtaggaccctctgagccaggtgcgggatacagtctcctggtgtgccgttttttaagcccatttgaaaagtgcaatattaggctgggagtgacccgattttccagatgccgtctgtcacccctctctttgactaggaaagggaactccctgaccccttgcgcttcccgagtgaggcaatgccttgcccccttcggctcacgcacggtgtgctgcacccaccgtcctgcacccactgtctgacactccctagtgagatgaacccagtacctcagatggaaatgcagaaatcacccgtcttctgcttcactcacgctgggagctgtagaccggagctgttcctattcggccatcttggctccacctctgagtcactatttcttaaatgtggaatttccatttcttcagcgccatttgttaaaagaactatcttttctccgttgcctttaatctttcatcaaagatcagtcgactatgtcagtctatttctgggctctctattctgtaccactgactgcttgtctattccttcaccaatatcacacagtcttgattactgtgttattatagtaagtcttgaaattggatagtgttaattcttcatttttgtttttctccttcaatactgtgttggctactctgagtctttgccttctacatataaactttagaataggcttcttgatgtaaaaagaaacctgctgggattttcattgggattgcattgaatctgtaaagttagcaagaacttgttatcttgaaaacattaagtcttctataaatgaacatgatatttattcttttatttattctatcagaattttgcagtttttcttatataggtattgtacatattttgttatattcatatctaagtattttattttggagatgctaatgcaaatgctatttttttaatttaaaatttcagttgtttatttctggtatattgaaaaggaattaacgtttgtgtattaaccttgtatcctgcgacattgcgctagttccaggagaatattttttgtctactctttcaaattttctaaatagacagccatgtcatttgtttaaaaaaagaccatttaattttttctttcccaatctgtattacttttgtttccttttcttgttttattgtattatctaggacttccattacaatgttaaaatcagttatgagaggggcatccttgcctcatattttatcttacaggatttttttaacaccattgtaaccatttttttttaacaccactaactgtggtgttagctttagaattttttgtagatgttctttaccaaattgaataagttcctctgtatccctagtttactaagagtttttatcatgaagggatgtcagattttgtcaaatgcattttctgcatctattaatatgattagaagtttttttctatagcctgctccttaagttaatgatagattacattaattgattttcaaattaaaccaaacttggatatgtagaatgaatctcactttgtcatggtatataattcttttttatacagtgttgcattcaatttgctaatattttgttgagaaatttgaagctatgcaaaactttgatctagggaaagtagtgaatgccaagcctcttcatttgtcagatctaagtgcgttagaatgcagtccttcaggtgggagctatacaagtagcttcagtgcatggacaaaactttttccagggaaaatctatacagctggatttatcactagatcaagccaatgaaaagacttgggaagtgcccaagccccactttggttcccaggggcctattttttgctgcctcattaactctgggattcaggctagttagaagatttatcatcaagtaacaactacaagagtatgcagggaaacctctttcaggaaatgggagctatgcattttagctcctctcttcactgatctctggagatgtagcccctggaagtgtttgtgtccccatttaaaaccacctctttgtactgtgatctgagaaaaattacacgtttagtcctttctactcccagaagtaggtggcttaggatgcagtctctaatgtgggagctgtggaatttgggacattcagtgcatggacactcttcccagcaagaattggatttatcactggagtgggctggggaaaaaccttgggaagtgcgtgagctcctgttcaggactttttgtctgccttattaactctctaatacaggttagttagaagtccaactgtcagcagcagctggtagagtgtgctgacaaattccttctggggagagactgcgagctgtgccttttagccccttttctgccctgatcccacagatcgaagcccctaaaagtgcttgcacactcatataaaaccagtgctttttctgtgatctagagagatttctatatgcctggccccttcttctcccagttaggtcaaaaactagcaaaccataaagaacattagagttagagcactatatatatagcctaaattctcccttctcagtaagacactgagtgttgaggattccttcctgattgtatggcacgatgctgggatagggtttgtgctcaagtgtgcctccactttttctatccattttgatgtggattttttttttcatttggccaggtgtaggagtctctcaactcatttctgactttcttctggaggaacttacacatgtatagatgtttatctggtgaatctgtaggagaaaggtcaggagcctcctattccaccatggtttttgacatcactcttctcaggatttctctttaccttagattttctgtagcatgaaaataatatgcccaggtgtttttgtggcatttaaattgcttggggttttctgagtgctctggatctctggtttgttatctgacactaatttggggaacattctcagtccttgtttcaattgttttttctcttcttttctttcttctcctctgatatacccattatgtatatgctataccttttgtagttgtcccataatttgggattccttttttttttttgtctttttctgattgattttcaggtttgaaaatttctattgagatatctttaagctcagagattctttccttagttatgtccactctactaataagtccattgaaggtattctttgtttttgttatagtgtttttgatatatcatatttcttttttcttagaatttccatctttctgcaacttgcagcttacaatggttcttgcaagctgtcttctttatccattatagatagccattaccatattaatcatagttgtttttaatttctattttgaatttttcatatacctaccatatctgagtctgattctgtgtgtgtgtgtgtgtgtgtgtgtgtgtgtgtgtgtgtgtgtgttttcttttcctttttttttttttttgcctttcagtatgccttgtaattttttcttgatatttggacatgatgcattggataaaatcaactgctgtaagtaggcctttagcaatgtgttggtaaggtgtggtgggagaaatgttctatcatcctctgattaggtctcagacttttagtgagcctatgcccctggattgtgaactttgcaagtgcttctctgccattcacccttctttaagtggaattggatggtccaagtgggctcaatttgtgtacttcccttctcccatgaggaaggctaaaggaagctagagttgggtatttcccttcccttgggtcagttagtctccgataaaaccctagcaagttggcctatgcttaactagtttctgtggagggcagaccttgataagaagaatagagtgctctggtgtatttcaaaatggtttctttctttctcctgccagaaccatgaagggattttttttttttctgattatcactgtgaggatttgatagagctcctggagataaaactcataaaaacatgggctccccctttgactagctccccctgaaggttttaattctcattcatatccctgatgagcctccagcaattcatcaattatagttcggattttcctgctttccacagttactgtagggcttctattttggtaagctgtgattctctgtatttgcctgtctgcctcaaatgttaggggcagtattcactctgtgacctcatttttcttgcagattttagaaaagttgttgattttttaatttgttcatttttcttgttgttgtcacttgttagatgaagtgaggacttccaagcttcttatttgcaggagtaagagctaaaaagtccctcttatttttctaatataaatgtttaatgctatcatgtcccctctaaaaactctttgaaatgcatctcctcaataaaacatgttgtatttttattttcattaaactgagaatattttctagttttctcattgactcatcagttatttagaagttttgtttttaaattttcaaatatatgggatttcccatataactctctgttactgatttctagtttaatttcaccatggtcagagaacatactctgcatcatattatttaaaatatattgaagttttattacccaaaatatggcctcttgatgaatgttccatgtaaactttaaaggaatgtgtattctgctctttttagatagctgagtaaggagtgttaatgttatcaagaaaaattgtagatttgtttatttctttttttgtttctatcagtttttgcctcatgtatttgaaactaagttgataggtacataaacattaaaaattgtcatttcttcttttgaattgactccttttattatatgtgattctttattcctagtaaattccttatactaaagtccactcggtctgatattaatatggtcattctagctttctttcagttaatgagttcacttttcacctatctatattcttatgtttaacttagattctttttagatatgtagatatagtttgagatagtttggtttacttttttatccagttttaagatacctgtcttttaatttgtgtttaaatgtttaagataattattaataatgtagaattaaattttacgcttagtcgttttcatttaatatgttattttttcttttattcttcctttttgcctacttttgatcaattgagtattttattcaattttaacatcaccatttgtttattactaaatactttaagttgtttaattgtttccatggtttacaatatttatattttttaatagtaatctatcttcgtgtaatatactactttacatgtagcataagaaccttccatcaatatatctccaattgttagtctatcttttatgctatttttgtcatacattttaacttttatgcactataacccacaatacattactactatttttgtattagacagtcatttatgttttagagtaattacaaataagaaacagatgtattttacatttacttttattttaaccatttctgttgatcttcatttcttcatgtagattcaagtttctaagtattatcacattccttctgcctgaataacttccttatttttcaaagtacaggtgttcttggaataaattatttcagctttggtttgtctcaattaatatttatatcttattttttaaaaataactttttctggttattactttcttgatttggcaggattttttttcagcatattgctaatgttacttgatcatctatagtttctaatgaaaagtatgatgtctttcttctatctttgcaactatatgcactgtgtatctgtgcctttttctttctgtctacctcctagatttttctgtatttctggtttaaagcagttgaaatatgatatggaagttgtgtatgcatgtgtgagtgtatgtatctctgtgtgtatgcatttatttagctcaggaatctcttaccttgttaaatctgaggtttgatatcctttatttttgtgaaaattattaccaattatatcttcagatatttttgtctcccattctgttgctctttcagtagtctgattgcatgtatgttacattgtctgatgacattccacagctttggaagctctcttttctgtttttctcctgtttttcttttctttttatattttactttggaaaatttttattgactcatctgcaaactcactgatattttactcagctgtgtcagtttactcattagcccattgaaggcattctttatgtccacgattttggttttattctactatttccattcaacttttttgtagttttcattctctgttgaaattcttcatctgttcattcatgcagtgtatctttttcactaaagcctttaacataattatcataactatattattttcctgttcattttaatatctagttaatctgagtcttgttctattgattgcttgatctcttgggattttcttttttatttccttaatttttttggtgtttctcatagttatgtttgattatactatgtagcacatagaagtattgagactaagataaatcatatttatgtctggcattgggaacaccttttcttctgctaggccattaatattatgggttgagtgaatctacttaggatttctttgacatctggattttgttgttggtattttaccttctttatactttttatgtggcgtgggatttggtttgtcagagagtttttctcaatgtttatgctcaactatgaacttcagtttacccctgcactcatgcttttcaaatagaatctctctttttacccttgtccttgcccccacccttccaacaatagtaaaatgccattgcttcttcctcattgcttgttagcttggtgctggtcattgtgaacattttcttggaggtggaatttctcaacattcctgcccctcatctagcagtaagatatctctgtttcctgttctccatgccaagggctagattttcttttcttttaaccttcccctagacacaagagatcttttcctgcaccccaggaactacagggtttactgctgctctctcagccacttaaggctttgttctgtggagaaaaggtactaggtgtgagctttgcgctttctaacagtggcagtcacatacttcactcagacctacaacaaggatggagtctttctccatccttgctttctccctagcccacatttgccattttgtgtttcttcaaaccttttagctaatttccttttatatgcttatattgcaaaaaacacctattccttattctaccagaaatgaaaacaatcaaaaatacagaagacaaatcctgcccttgggcaggttcacaaactctcaggaatgttttgtactgactgctttttcactttaagtccatattagttgctttagtttttgtaggtcaacataaattctgggcatttaacactgtaattagtttatcagataggatgtattaatttgcttcttgctcctaactctaagagtaacccaattctactttttgactaatgtcccaaatcactgcttgagtttttctagtagatttacttcatgtccaagcagctaagataataaaaacaatctgttgaatgagttcttgaatccttcctccaaaagcccgtaatattcttctaccaatgggatatggtagccttgggaaccacccccattatcattcaactacacttgcctcccaaaacgtctagcactaagatataatagaattactttgctaacctctttgttcttgatattttgcaaattggcataggcctctttgagaattttcatttttcttaaatataacggtgcagttcacaaagttagagatttttttttccttataacatctgtttcagaaatcattatagctcaagtttcttcatggcataaattgccttattttgatttcatcagtttttatgtcatttctttttcatgtcaatatgattatggctatatttagaaattgcattttcagacaacctttgcttatctggctgcacttcttatgcacatgtttttgggctttaatttccatgcagatatattctttctcttggcaacttaccttccttgtttccactagctacctacacacaaaatctagatagatttaatactttagtgcttttaagtcaaaatggtggaacacttttatttctcactgatatttgctttcctactcttcataaacttgtatacaaattatacaaatgatctcaaaatactgtttaagtaagattttgtgtttctttttacattgctaacttgaagaatagcacacatattctcaatccaagtgatcagggaagtagacagcctcccactgaggtccccaaaagccagtgctaatggacccatacagagaagctattgtgctggggtgaatctctcaaccagtgcagcacagcaatattggttttgacatgtatatattcattacattgacttaatgatacagaagactcatatctatataaaattgtacatcctgttggctaggctgtagtcctaaaaatgtggccataagaaaggagaatgacaataggaagtggtgaacatactaaatagtatttcctttttaaccacaaattttaaaagtatattttagctctttatgcatgcatttaatatatttatttatttatttatttatttgagacggagtttcactcatgttgccaggctggggtgcaatggcgcaatctcggctcactgcaacctccacctcccggaaagcaattctcctgcctcagcctcctgagtagtgagattacaggcgcccgccaccacgcccagctaatttttgtatttttagtagagacggggtttctccatgttggtcagcttggtctccaactcccgacctcaagtgatcctcccacctcggcctccccaaatgctgagattacaggcgtgagccactgcacccaacctattttttgttggtggtggttgagagtacttttgaaaagtttataaaaatctactgaactctttccaaatagtgatgtagatggagaaacttccattttggcattggctcttggaaagcttcccccatccctctttgagctttgtaattagtgctacctcaagcaccaagttatgagtaaaattgcttaatgaaagacccactctcagaacctgctatgggctggtggaatatagggctgctaaacaagattagataggagaggccaaaaaacaggcatttctcttgtccactccccaaatgctaattttattacagcatcacagtatctcaattctgctttttgattgggccactggagactccttcaaaatctttattttatcattaagagggactatggcccaaatctttaagaacatgggccatagaacaagatcctttgtgctataatctttttttctgatactatgggaaaattatttaatcttattcctaagacaggaggtcaagagacctcttaagattgctatgagtaaataaaatatccataacccattcttaaaatagcccctgacacttagtaaaacactccttaaatattagcaattagtgttattatctaagaggagaaagacattcattgtgaaacacttaagtcctttgacagaaagtacttctcattatagcaggattctgcagggatgaaacagagaaggtcagaatctgtcttaagcactaaaagctgataagaaaacgaaaacttggttttgtctattatatctaactatacatacacatattttatgaatgatatttaagaatattgaagaacaatgacaaattatatatatatgtgttatgtgtacacacaaaacaatagctatacttatatatacacataatatttgtcattctttttttttttttttttttgagacggagtcttgctctgttgcccaggctggagtgcagtggcacgatctgggctcactgcaagctccacctcctgggttcacgccattgtcctgcctcagcctcccaagtagctgggactacaggtgcccgccaccatgcccggctaattttttgtatttttagtagagatggggtttcaccgtattagccaggatggtctcgatctcctgaccttgtgatccgcccacctcggcctcccaaagtgctgggattacaggcatgagccaccgcatatttgtcattcttaaagatggtttccaaaattgtatttcaggcccaagacaaggatcctctcctgtcaagctgagcagtttgactccaaatttaatgtacctatgaaccacttggggatttttttataagacggatttttattatataggtctggagtgaggcccaagattctaatgggctgataacaatgctgatggtctctctgggagaatattatgggtaacaaggaccgagagcattttgagtagagataaaagttgagcacaagactctacctactcattctctgctgtgtcccatcaatactgccagcacagctaccctgatccaaatcccttaataaccagtgctattaatgagcctgcactttccctgggtgatatactgtgctgtcagaacatactcagcatagctgaagagtggaaatgcaatcagattgtcatttggctgtttgggtactgatcctgttgcctttgattaaaaatacataagctttcctgcttccaagtcataccctctggggacataatgcggctcagggaagggtctctaatgcctccatggaaaacactccattacctgaccctctgataattataaaccccttgtgaggtcagaatctcattatccaacacttacaggatgtttgctatttggcactggataggccacagtttcacaaatagtggcactaatagaaacattagagaccctttaatccaactttctctactcacagatactacatgtgaagtctggaggtattaactgacttgtgcaagataacacagcaagttaggaacacaattttctcctcagcccatctctcctctaaacaatgttattgctgagaggatggagggtaagctttacataggaaaagaatgctaaccacccatggtaacttgtaacatgcagaacagtggtgcgtttactgaggcatttgaatgggaaattctataaggacagagatggccaaggaaagtcttaaaggatatatgggaatgaagttggactttaaaagaagaaagaaccagatccaaattcagtcctccagtgagagaatcacattaaaaaaggctatgcttgatgctcatcctggaacctggatggttataatgaaatctatgaagatctcaagaaagcatcttcattggtataattcgaaaccatgccagctgggcaggtaaatcatgtaaactgcatcactgctatcagaatattttaaggaaatgaggaaaggctaggtatgtttctattcatggaaccaaggggatggctgtgataaagaagacttagtctttggagagaccaccaaacaaggtatgtctgggttctaaaaacttgagatattgatgaacacctctcagatgcaggagcagaaggtccaggcagatcctggagatgactctattcctggtgactgggatttaagtaacaagagcttaatccccaggaggatgttttgagtaaatagatcctggaaaacaaaggatactggaaggaaaacaaaggcaggtttaggcataaggatgtaagataggctggaaccaggatattaagaggttaattaatttccagaaataaaataatatcaggggtgttggcattcagacacatggtcagagcagggcccaggacatggctaacatggcacttgccggccagcctaaggatttgaggacaaggacaagattatctacaggtagagatggatgagttaactggctacaatttggatggttatggcaatgaaatctaggattgaagcatttcaccataaacagggacaagcttctctccatgactatgaaggtcatcggctacgttaatgtgcaagagtgtgctgtaaagacaaagacatcacaacactaaaactaggtagctagagcttggactctgaagccaagtcattatgtcattttgctgcttccatgtacctagggatgatgtgcttggcctgtgagcagatctcagagatcggaggtaagtctgggttaaagtttggagtctgacactgatctattgtgtgatctaaatcaaagcacttttttttttactgccccaagccaaatttgttaatccataaaattgaatagggaggctgacttgatcatgccaaaccttttagggtattgttttaatatttttttatttcaaaataacttcagatttataaaaagttacaaaaatagtcagtaactacatacactgtatacctttcaaccacattccccaagcattaactttttaaaaaatcatgtttgctttaacatactgtgtgtgagtgtcactttttttccaaatcatttgagagtaggttatagacatgacatcctgctacccctacatacttcagtttgtaattcctaaaagtaagaacattctcttacatatgcccaaataattataaaaatcaggaaatttactgttaaactatattattcatcctaaaaggaattattcagattttgtcagttattccaaaatcccctttagggaaatctgctttttgggaggtagcaaggtctggtgtaggcctaatccaggattgcatgttgtatttagctgtcatatgtcttaaatttcttttaatctagaatagtttctgtctttgtatttcatcttcttaacattttgaagagtgttagccatatttttttggtaaaacgtccctcaatagtgtttttgatatttcctcatgggttaattcagggtatatgtattagtccatcctcatgctgctataagaacatacctgaaactgggtaatttataaaggaaagaagtttaactgactcacagttctacatggctggggaggcctcaggaaacttacaaccatgatagaaggggaagcaaacacgtctttcttcacatgatggcaggagagagaagtgcagagtgaagcagggaaaagccccttataaaaccatcagatctcgtgagaactcactcactatcacaagaagagcatgggggaccacttccatgatctaatcaccttccacaaggtccatcttccaacacgtggggattacaattcagattacaattcaagatgagatttgggtggggacacagagccagaccatagcagtatgaatttttgacaggaataatgttgacttcatatttgtcatcagaatcaaatgcaataatgtatacgaatgtgctttggttaaatgtaaagttctattacaaacctagggttgaggaccgaattctctatcttctctctgttcttatctcctagaatgcatgaaaagtaccctggggagacaaatgtttcatttaggtacagtaatgaaactggaggatataagtcagttctgcatcatgttcgccgtgacagaaactttaaaatactggcattagaataacctagaggatccctagcctcctctggacctctatgttttttccttacacagggatttctccttgtaaaatccttacacatttaattccttcttggtatttgaggacctgaactaatacacggaactactgttctgctgaacactgtgggaaaaatatgagagaaaaaaattatctctgactgaagagtggagcacgctactgaaatagacaagttgtctggcagaggacatctcatgaatacctctccctgccaaagtccaaactacagcatttgataaagtaaacactgaaataccccaaccatttacatttcagagagagcagagaatgccaactttatcccagagtgaacacccagtttggtcagggatagaaaggcagaacagaggccccaggaagggaaaggagaagggaagatacataatatggatccagtaatttgccataataacaagtgtccccttaagcaagaagagtaaagtttattggttttatattagttgatagtaagaacaatgattaagaatgagaggaaaacatccacctccctgaaggagattctaaatggggtttctaacatttccagctctcaaatgaggatgggtaatgatccctcatatttcattcttaatgtgtcatgtaaacaactaggagacaagcctgcctggagttgcagccaacataccagttttctctagctaagactatatctgatgtgtgaaaggcacatcagcctttcagaggtggaagagtcaatgttccccagggcttcctgttggtttgcatctttggtgatgcttggaaggcaagtatgctagtcccagaatcacccacagtctgacttgcacagcctcaggggactgctccggcagcctttgtgaggagtctaaagtgcctctggcactcctcaaagtactgaatgatccaggtggaaacctgggagtgaaaaggaaaaaaaacatttgacttatgtctacatttattgaaaaaaaaaataggatgctgtgttcagttataaagatctcaagaaaacatcctcattggtctaatttgaaaccataccagctgggcagataaatcattacataaactgcatcactgctatcagaatattttaatgaaatgaggaaaggctacgtatgtttatattcatgaattctcttcatcacacacacaccaatgctgaatttgctataattagttttgttctctacagaaaacttcatttattggggatgccattaaacaagtgaaatacaaattacaagtgacattgatatgatcataatcactccttcctggcttccagagatattttctgagaggagcctgcatttctacagatggcataaaaaaatgaggcctgcagaacacaccattattcctgcgaggccctcagttcattagttgaagcagccaagtcttcacgagccgcaactgatcagcaaatgggaaatgagcaagagtataaattcccagcaaaccaaatcattaacatttgctgcctgcatcctggaaacacagtaaatcaaatgtgtcatcatttatcaagacaaaatatcattactaattgggattaatttgctgctgtgggattgctgacctttgctgaaagaaaataaaactgctcgttagctgtcttcatttaattttccttgaagtagggagaggggaaaaggcattctggcttagggaggagggaggaaaggtagggtggagtgttcttatcttcctaacactacacattttaaagtcacaacttgatgagagaacctgctcctatgctgttgccaatccataatccagggttttctatttgtgataacaatgcctctggttgtcattgtctgtgatttaacactgtcttgggaaataataattaaaataattgccagggtaaaattatacctggtttcgtttataaataggaaaaggcaagcccattgcaactctaggatttatctttctgcactaacattaaaggtgattcaaaagaaataacacataagtctgagcatccccagtgattctacatctgcctggggtctacatggaaccattgactcaattattttgggtattaacttttactctagtaggtatcaatttttttttttagggcagatgaatatgtgtgctatgctaaatggctgtaaatgctggagtcaggattcttgtctttagactctaaggaaactgtggatcctgagatgtcaactgtggattcaaatcaacacattaaacaccactgatatttacattttgtaaaacactgcatacaaattttatttatcttgatcgttgagttatttgatgcccccttaaattttgcttctgaggaaagtatctcattcaccttaccctagttgtgacaggcaatgttgaagattaaatgatttactcatcacaacacctaatgggaaaactgaagatgaataaccttccaaacctggcaaacagtagaatcaggacccaaatggagagcatcaatgccttgtttcagcatccatgctcctaatactgctattcctcttagctactgcgagcaaatcagagtggattaagaagtggaccatgccaccaagtggcgtcatgggaattttagacacacatatactaacatgcgaacacacatacacatacacactcacatacacgtacttgaaacaattatataccaggcaataattaagaatgtgtgggtgagccaatgtgtgctactgtgaaattgaaggtgaaaaaatgaaaccccaattgttttatttaggacttctacaaagcactgcactgccaaatctgcaagtcagcgctagccacttgctatgaaacacaaaattctggaccaaagcaggaaaggggttaaggcaaatgtgcagtccaaggcctggacacatcgtaagtctctgatcaaactgttttgggagtttgcaaatttccaattcaaaaatgccttacttattttgtcaacataagctaatatgcagtggtaggaagcatattaatatttcttcttaattgttttaaaacaattttctcctcttaactaggaaaaacattcttctcatatttttgcactgtagtgtgagttgcaaactttgtgtaacttttttattttttaaatttttgtgggtacatagcaggcatatatatttattgggtacatgagatgttttgatacaggtgtgcaacatgtaataatcatatcatggagaatggggtatttatcccctcaagcatttatcctttgtgttacaaacaatccaattatactcttttagttatttttaaatatgcaattaaattattattgactatagtaaccctgttgtgctaacaaatagcaggtcttattcattctttctatatccttttgtacccattaatcatccctcaactccctaccaccatccccgctctaccctttccagtctctggtatccatccttccactctctatctccatgaattcaattgttttaatttttaaatctcataaataagtgagaacacgtgatgttggtttttctgtgcctgttttgtttcacttaacataatgatctccagtaccacccatgttgttgcaaatgactggatctcattcctttttatggctgaatagtacttcattgtgtacatgtatcactttttaaaatccattaatctgttgatggacactaagattgcttccaagtcttggctattgtgaacagtgctgcaacaaatgtgagtgtgcagatatctctttgatatactaatttcctttcctttggatatttcccagcagtgggactgccagatcacatggtagctctatttttagatttttgaggacactccaaactgttctctatagtagatgtacaaatttacattcccaccaacagtgtatgatcttttcatcctcaccagcatttgttattacctgtcttttgggaaaagaaaaagccactttaactggggtgagataattcatagtagttttggtttgcatttctctgatgattaatgctgttgagcaccttttcatatgcctgttttctatttgcatgtcttcttttgagaagtatcaattcaaatcttttgcccatttttttcctatagaattattggagtttcttatgtattccggttattaaccccttgtcagagggttaatttgcaaatattttatcccattctatgggttgtctcttcactttattgactgtatcctttgctgtgcagaagctttttaacttgatgtgatccctcttgtccacttttgctttggttgcctgtacttctgaggtattgttcaaaaaatgtttgcccagaccaatgtcctggagactttccccaatgttttcttgtagtaggttcatagtttgggctcttagatttaagtctgtaatccattttgatttgagctttgtatatgatgagagacaggggtttaatttcattcttctgcatatggatattcacttttcccagcaccatttattgaccagactgtcttttgtccactgtatgttcttggcacctttgttgaaaatgagtttactgtaggtgtgtgaatttgtttttgagttctctattctgttccattggtcaatgtgtctgtttttatgccagtatcatactgtcttggttattgtatttctgtagtataatttgaagtcaactaatattattcctatagttttgttctttttgtttgggacagctttggctattctgggtcttttgtggttccatgtaaataataggattttttttctatttccgtgaagaattttattggtagtttgataggtattacatagaatctgtacagtgctttgggtggcatggacattttaaccacattattcttccaatccatgaacatggaatatctttctggttttggtgtcctcttcaatttgtttcaacactgttttatacttttcattatagagatctttcaggtatttggttgattcctaggtatttaattttattttatttgtggctattgtaaatgggattacatttttatttcttttttttagattgttcacttttggcatattgaaatgctactaatttttgcacgttgattttgtatgctgtaacttcactgaatttggttataagttctaatcatttttttgtggagtctttaggttataccaaatataagatcatgtcatctacaaacaagtataatttaaatttttcctttccaatttggatgccctttatttctttcttttgtctgattgctctaggtagggcttccagtactatgttgaataacagtagtgacaatgggcattcttgtgttccaaatctttgaggaaaggctttcagtttttcccatagtgcaggtctgataaatggcttttattctgttgatttatattccttctatacacagttttttgagagtttttttcaagaagtgatgttgaagtttattaaatgtttttccagcatcaatttaaatgatcacatggtttttgtacttcattttgttgatatgatgtatcacattgatagatttgcatatgttgattcatccttgcatctctgggacaaatcccactggctcatgatgaatgatctttttaatgtactgttgaatttggtttgctagtatttttgaagatttttgcatcaatattcatcagagatattggcctgtagttttctgtttttgatatgtctttgtctggtgtggtatcagggtagtactgactccacagaatgagtttggaagtatttcctccccctctattctatggaatagtctgagcaggattggtattaattttttaaatgtttggtagaattcagcagtgaagccattagatctctgattttacttactgggagatttttttatcatggctttgattactgtattagtccattttcacactgctatgaagaactacctgagactgggtaatttatgaagacaagaggtttaattgtctcacagttctgcaggcttaacagaaagcacgacatggaagcctcaggaaacttacaatcatggcagaaggtgaagggaaagcaagcacatcttactatggcagagcaggagagagaaagagagagagtaaagggggaagccctgcacactttcaaacaaccagatcgtgtgagaactcactcactattatgagaaaagcaaggggtaagtctgcccccatgattcaatcacctcctaccaggttcctcccgcaacatgtgggggttactgttcgagatgagatatgggtggggactcagagccaaactataccaattacgtttcttgttattggtgtgttcaggttttggatttctttctggttcaatcttagcaggttgtatgtgtctatgaatttgtccatttcttctagattttccaatttattggtcaataagtggtcatagtagccactaatgatcctttgaatttctacagtatcagttgtaatgtcttcttttcatttctgatttatttggattttccctttttttttttttttttttttgttcaggctaaagttgtcaattttgtttaattttggtttttttttagttatcaactttaacttttcaagaaaaccaaccttttgtttcatcaatcttttgtattgtgttcttcatttcaattttatttattgctcagattttctagttctttaagatgtatcattaggctatttattgcaagtttttctttctttattataaccacttatactgcctttgctgtatcccataggttttggtatgttgtttttattctcatttgtctcaataatcttttattttttttcttaattttttcattgatccactggtcattcaggagcatattgtttaattttcatgtatttgcataatttccaaaattcttcttgttgctgatttctacttttattccattgtggtcagagaagatgcttgagattatttcaattgttttgaatgttttaagacttgttttttgaggtggggggaggggggagggatagcatttggagatatacctaatgttaaatgacgagttactggctgcagcacaccaacatggcacatgtatacatatgtaactaacctgcatgttgtgcacatgtaccctaaaacttaaagtataataataaaagaaaagacttgttttgtgacctaacatattgactatccttgagaacgattcatgtcctgaggaaaagaatgtgtatgctgcagttggatgaagtgttctgtaaacatctattagatacattcggtctatagtgcagattaagtctgacatttctttgtggattttctgtttggaagagccactcaatgtggaaaatgggctgttaaaggctccagctattgatggtattgggacctacctctctctctttagctctaatactatattcctttatagatctttatatatgcacctatctttattgggtgcataaatatttaaaattgttatatactcttgttgaattgacccctttctcattatacagtgatcttatttttctctcttttttttttatcttgaaatctattttgtctgatgtaaggatacctactcctgctctttttttgtttccattggcagggaatattttttccatccctttattttcagtctatgtgtgtctttatatgtgaagtgtgtttcttgtaggcaatagatgattgggtcttgttttttcatccattcagccactctatgtctttttattggagagtttagcccatttacattcagcgttattgataaataagtacttgcttctgccattttaaaatttgcttcctggttgtcctatggctttcttttccttctttctttcctccctgtctttcttttagtgaaggtgattttctctggtaatatgatttagtttttttcattctattttttgtgtagccattatatgttttttggtttggggctacatgaagcttgtaaatactcttataacccattattttaagctaataacaacttaaaactgtttgcttaaacaaataaacaagcaaataagcaaaaagaaaactgacaaatactctacatcttaactttgtccccctgctctttaacttttttgtttctatttatacgttattgtactgtctatgtctcgaaaagttgttgtagttctttttgttgttttgttgttactcgttcatcctttagtcattctgctagggataagagtaatatacatactacactcacagtgttgtaatatcctgtgtttttttctgtgtacttactattaccaatgacttttatacttttaggtgattacctattgctcactgatatccctttctttatgactgaagtactcccttcagcattttttgcaggagaggtctggtgttgatgaaatccctcagcttttgattgtctaggaaagtctttatttctccttgtttgaaagatattttcactggatatactattctaggataaaagctttattccttcatcacttttaatatgtcatgccactctctcctggcctgtaaggtttccactgaaaagtctgctgccagatgtattggagtttcattgtttgttatttatttcttttcttttgctgcttttaggatcctttcttgatccttgatgtttggggatttgattattaaatgcctggaggtagtcttctttgggttaaatctgcttggtattctataaccttcatgtgtttggatagtgatatctttctgtaggtttgagaagttctctattattattgctttgaataacctttttatccctatctctttcactacctcctctttagggccaataatgcttagatttgcccttttgaggcttttttttttttttattttagatcctgtaggtgtgcttcattttttaaatttttttcttttgtctcttcttgcaatgtattttcaaatagcctgccttaaagtttgctaattctcttctgcttgatcacttctgctattaaaagactctgatgcattcttcagtaatgcaagtgcattttttcagctgcagaatttctgcttcttttttattatttcaatttctttgttaaatttatctgataaaattctgaattcctttgtgttatcttgaatttctttgagtttcctcaaaacagctattttgaattctctatctgaaaggtttgatatctctatttctccaggactggtccctggtaccttatttatttagttcatttggtgaggtcatgttttccttgattgtattgatacttgtagatgtttgtctgtttctgggccttgaagttaggtttttattattgttttcacagtctgggcgtttgtatgcattcttcttgggaagtttttccagatattcaaaaggacttgaattttgtgatccagcctgtatctgctttaggggccattccaagcccagtaacactgtggttcttgcagactcatagaggtaccatcttgattgtcttggacaagatagacacagggggattctctagattaacaggcagagacttttgctttcctcccttacgttctccaaaacaaatggagtctctccctcttttctaagccacttaaatctgacagtagagtgacacaagtagccctgcagcccccaccattataactgcactgagtcagacctgaagccagcacagcactgagtctcacccaaagtctggtgtaacatcttcttggttattgtctgtgtttgctcaaggtcccagggctccacaatcagtggtgtcaaaaccagccaggaacatgtttttccctttggagcggtgagttttcacaggccccagtatggttcagaggtgctgtccaaaagccagagactagagtcaaaaatcttagaagtctaactggagttctattattgtactgcagctgaggtggcactcagaccacaagagacactcattctcattctttactcccatttccaatggcagaggagcttcaatccatggccactgccaccataggcccatggggagtactgccagactaccagtgatgtttccttaaggtccaagtgctcttcaatcagtttgcagtgaatgctgcctggcctgggactcatccttcagggcagtcccctctggcctaggaaaggtgcaaaatgccatccaagagccaagtcctggaattggagaccccaagagcctgcttggtactctaccctgtggccaaggtgcaagaaaaagccccctctactttccctctgcttttctcaagcagaaggtatcccacaccataggcaccacagctgggaatgtgctgagtctcactggaagctgggaagtctcagagtctcatccaaggcctttgacatagtacctgggtatcactgctggttattcagagcccaaggctatccacttaccaggtgatgaattctggcaggactggatccttcccttcaaggcagcaggttcccttctggcccagtgtatatctagaaatgatgtccaggagctagggcctggaaagggagcctcaagactctgactaatacactatcctgttgtggctgagctggtatccaagatgcaagacaaagtccttcctactcttccttctcaagtgaagaaaggggtctcttttggagccatagtctgtgcagcctgtggttaggggaagggtgatgccagcactcccttagctgtcccagttggtgtctaagtatgtcacgtgcccactgtctatacactgtcttttggcccagttcagcactagcattttcctgggagctgcagtccttgtgccctcgattgcctttcacatttatttagatcctcagagcacttttgctcatggtggtgaggcttgagggaactcaagttctgaccactgggaacagcgatttccctctgactagggctggtttaaatgctccctctttgggtgggcatcagctgagtttggtccagtttttctttatgctataatagggcagcactgagttcaatgcctcacaattgctgtgctctccctccccaacacacagaaatgctctctgcaccatgccgctactgccaggggtgggtatgagtgaggggtggcatcagcaattcaagactgttctttctacctcttcaatggtatgaagttaaaaccaggtactgtgagtgctcacctgatttttggttcctatgaaggcgctttgtttacgtgtagatagttgttaaattgatgtccttgcaggggggatgatcaatggagttttctatttcactatcttgctccacctcctccctataataacttgtgtaacttttaaaaaaagatgtgtgaggtggcacattgaggttgggcgggaggagggaggcaggggtgtcaaaccaggccaatttcccttaattctgatataataaattataattttgctaaaatgtgtgatatttcatagctcagtgtcatggagagaccccaatgcatgagttgtagaaactcttgaagaagatgggtagttaagctcctctgaaggagaagagctgtgagttaatgcactgcctgcttatgatagagagaacttgcaaagaagtgaggaccaggtggacacatttagaagtcccacagcccttaccaaaatcatgttccttcaagccttgtccaagtgcagctgactttaggaaactgaattgatgactctgcaatgcttcagaaaaaataagtttatgtacctgaaagttattttagttcaagacggtcttgttacagatttttcttcttcctattcactcaaatctaatcttaaatcttgttgatgttagaattctcaggcattcaaccttggtccaaataggtcacataatttcaaccacattactttgtttttatcactgattgctcttagtgcctttatcttaccctgaactcaatatgggacagccaaggatttcatgaatttgatttgctagtacccagaattgactgcctaacattgttaggagttaagaaattcctattcatatacaaactttaaaaaatctccctaccctgcaccagctactagtttcaactacatgatacacagaagtagttttaattaaagataatatctatagagacatcaattttataacctactccttctccaaaactcaattagactctgaaagttttagttaacagcattataataactggattgtatgcttaatccttatggggccttgtagttctaccctaaatgtcatgtaaatgtatttttttatttgggagttaagaaataaagacagcattgtttttttaaaaaaagcataagatgaggtaaaagtttatgcaattttgctaaatcccctaacatttcaaattatagctacagctctaaaattttgtctgccagcacctttctagtgaggagttgctagtgatcctctaactaaaaattagatcaatgccctgcaccttcagactttgggaggcttctggtggggccaactgaatgcaatgtatgaaaaattgaagccagatttgcttgtaaaattttactaatatttaataatctcatggtatatagctcaaaggaggaagctttgacaaaagtgtatgcaggctcagactttccatattacagtatcactcagtcctctatgagttatgccctaacatattcacactactcacaccacagcagaggacgtggggtctacaagatctgcactgtgtctgggggttatcttatctagtgatcttgcacaagcctgaggccagtggttccagatgctcagaatttcaagaccttttattaaattgtgcatatttatgggatacagagtgatattttaatacatatatacaacgtgtaatgattaaatcagggtaattagcgtatcatcacctcaaacattattgtgctgtgaacagtcaaaatctagctttcaaaaacatacaatcaattatagttgatcatattcacgctacagtgctgcagagcatcagatctcatttctcccacatagctgtaattttatgtttgttaattaatttttcctcatcctccccttcccactacctttccttaccctctaacactcacaattctacgttgtagtatggctttttttaaattctggatttttctggcaaagaatgctgtatttctggcaaagaatattgtccagggacatgttaactttgtcccccccaccccatgatccaattcaaataaataaggcaacactaaaattgtataggtcttccagagcaagtattgtgaaagtcagcaacttcaaatgtgctttatactaattcccttctatctaatcagtaaagtaaaaaggtctatatatattataatgtaaaggaaaagaaaatattatatactatagagatatgtgtgtatatatcctatacactgtatatgctataaagatatactatataaagaatcacattataagtagcttgcaaacttctagagacagaaatgatgacataaatttcttgcttatatgctataaagatatataaagaatcacattataagtaccttgcaaaattcttagagacagagatgataatgtaaatttcttctttggttgttttgttttttgagtgccaggcgttgtgatgggaacctagaagtcctgaataaattcttgttgatagtttgaacaactaaataattcaactttatctggctaatgttggtccactcagagtccaggaagatttgaccacaaatcccattataagctcatcttttgcccatctctgaaatgaaggttattacaaccatatgaatgggtgggacacatttttcatacaagtttgtcaggatcgtagtgtagacaatctcacatgttttctttctcttaactatctcttaatttctccactgcaagataatgatccctgaagtcataacatctcctgcctcagggtaatgatccctgaattcctatctccatttattttactcatttttctactacatgttttttataaaggatctgtcatattttgttctcttgtgtctatttctgtatttctgtcttgtattctccttctattttagcttgattaaaattcaaaatgaaaaatattattgatatctggtcaagtaactacacacttcaaaactccttgttagattttgagacctaattattcttctaagccattcttctgctttacctacggataacccacaggaacctgataaactgatgagaaaagattgagctgccactcaagcacgcccactgccatgccccgtcttccatctcaaggatgaaataacactatttatggtatttttcaataacattttagatttagctccagagagctgacctttatctaaataagttcttttgtcccatgttcatgtttatggtagcataaaaaacctgcagaagcaacaagaaggcagcaaatgatatctttgaaatatcacagggtatcttggcagcaataaaatgtactaagccttccaagaagatgcaaagtcatccctcaaagaaacgacagaattacagagttagtagctgctgattaggcttacaaaggggactactcaaagggaatcatggagtgctttactgagcaatcccttaaagcaaagaggtctggagagttgaaacaagctttagtctgcattctccttatttccacccccacccctcatttcccttttaggctctttagaacttaataacaagccatattgtctttgatccaagaactcaagccagtccaaagagaggttttgttttacaatatataattttgatgtcaaactccaaacttttcatttttcttattttcttgataaaaggaagacctggcaatatcaggcccacatttccacagggcaacaacggttattgctgggcaatgactttctcatttggatgggttcatgtctatttttaccatagtatctactatctcttaaattatttcacttaataattcatttatgtaatatagttgaactctgaagacatttgcaacttctgccttaaaccttctgagaggtaaaaggtaacttgttcaggacttatccctggcaacctggccttcccaagctccatagaaactgagtatagtccagtgatcatagcaagcaatcctagtctgaattctagtccatctctcaaaatactaaaaaacaagactgatgcttcctcaaccatggatacttacatgatgaattttgctgttagcatgccatgtcacataactgcaactgcaaagcttgagactagcttcttagtcattccaggagaggggttggttctcaacattaaccatgaaagttcagtcggtgagatatggacaaaggcataattctatcatgctatgttactattacatcctggtccttcaccaaatcagcatgggctgatatttttcttatcacgaaactgagaagctcaagagctcaagggttagggtcttctccccagagtttgacgtttcatgttgctagatctctgtgctcacacctagcacataataggcaataagaacttacacacctgctacttctttccttaatttttctcataaacaggctttatgacagtgccccttggctacttcctcttgtttccataacagctggtactgggaatcttaccaagaacccaccatgggctgtttggtgtaaatcagaggattagaaatcaacgttctgccttggggatgggatcagtcttgggggtgtctactttgggctgcacaactgactattggcatcgctggtcactgtttataaaaattagttccacaaggtcctgagaaatggcatcttttcagaaaatgataaaatctggaatgaattcctaggttgttaataagggccttagagagtcacttagaaaggagtgcactccatagaggtgaatattgaactatgttccctgataaaccatgcacaaacactctctttctctctccctccccaacccttccacatacaagcacatgaacaatggagtataaggacccactggatatttgctgaaagtctgactagttggtacaagggagcaacaatattagggaacagcacaaaacacctgtaacacaaaaataaagaggtctccaaaatataatccatgagaggggaactagctgaccacttctttgaaattccagggttatccagtgactcagatgttgatacagaaataagactgtctaacttgaaatgtctccacaaattactgtgttggatagataactcgatttcttactcaattagatggtgaaacaccagcaaacacagcacggtgatgccccacagtgatgagcttcttcagctaatgtgtcatgatgacagacttgccacccagtgccagaagtgttaaagggagaattggtagccattttagtgtttgctaatggaactactgtgctcccagttcctctcacttgtttgcccacctccatcaagacatatcatcagtacatgccaataaaagtgactgccaacaataggtcctaagaagagaagctggccgggcacggtggctcatgcctgtaataccagtactttgggaggccgaggtgggcagatcacgaggtcaggagttcgagaccagcctgaccaacatggtgaaagcccgtctctactaaaaatacaaaaattagctgggtgtggtggcgtgtgcctgtaatcccagctactcaggaggctgaggcaggagagtttcttgaacctgggaggcagaaggttgcagtgagatgagattgtgccactgcactccagcctgggcaacacagcaagactccatctcaaaaaaaaagaggctaagtcagtcatacagtgtagctcttcctccctccaagaatatatgatttcctcagccagtagaaaagtcctggaagcaatgatgcaagctttggttaacctctacttgatctttcagtcacaaccttattactttttctggacttgcagatgtgaccctcctaggctattcttacaaatgacggtgccctgtttgccttggggaaatataatctgcacactgtgactagtgaattggccaataatcaccattttttagagtctcccacaacaataacaataagttgcactgctcctgggttgaaatggtacgcgttgctaaaatagggaggcatgccacatgtttagaggccgtctttgtgaggtgaaccaagttattaagaaggcagttatttaagactgagtgcctgcaggctctcttcctggactgagttgaattccttcagagttcaatggaaactagatacagccctagcttcctgattaacaaacgtacttgaatccagtcctccaagctgcctctgatattatgtctaggcagggttagtgctgtcatggtgacatcttcctgctaagttgccaaagtaattggccaagtcatatggctagtgtcaaggcttgtgcatctgccctggatcaccccagaagagagactacttatttctaatcataccacctggaagccccacaacccaagagtaaggatccattttctggagcccaatatccagtcaagcaaaatttctgtggcctgttgtagaaagcagtgggtcactgaggacctgtacacctatcactgctgctgtgagctttccctactgaggggaatcaggcctcctgtgagagctgcttgggtatgtatcttcctttgcagagcaacacctgaggagtttgcatttgagccttccagcccccgcccccagaaaacgtctgtaacagcctctatattgttatctataaatcatgctgaattcttcaactttctcctatttatatgtacagttctccattataggctactaacaatattgatatttgtcttaatatagaaatgctgactgtcggagaaaacaaggatggttttaaccgatatcattgtggccaaatactgaaagcccttatatgcctggggatgtttacagttctaatgggaaggtgttgttaaacacaaaatgtcaatagccacaggaaaatcaagagaagcattgaattttcactttcttttgtcttgagaatagcttcatctgggcctatgggttcctgctctctggccaggttgctgaagcctagccttgtgaagggctgtaaatatcctgaggatctcccaggaagaagcccagaagaaggagaaaggggttcagtgtccttgtaatttgaatataaaaggattttaaaaaattttattcctcaaactgatcaagcaggtaatatccataacttatttcaaatgcgtaatgaatttgtatagttgatttagtttacctagaaaatgttaaatattcataattaaactatttataagccagaaaatgtgggcagtaaattctgagaaacataaaatacagagtaatagtaaaattgttatgtaatctaactatatatatttttgcatctaaaaatagttttaataactctgtttgctagtgtcatttgcttattagttcttaaactgtgatttcaacctctttttttttatagtaggttaggtgaagcttagaactgggtcactcagtcctttgtttgttttctcctggttcaagatacatgtgtccctaacagcggacatactcatatgggtaaagtcacagcacaaatttactttaggaaactctttgaatacccaccttttccctgactacaagaaagaaaaaaggaaagaaggaaaggaagggaaggaatggagaaagggacgaagggagggaaggaagaaaggaggaagggaggaaggaagggaaaagaaagaagaaaaaaacaaaagaaaggggatttagctgaaagggcatttagtccctttcgcttcttgtctttacctaacagaattgggattactgcacctattactcattgctagcaagtcaagtagcaaaggccagaaggaatgatggtaaaattgctttggtggtcttaatcatgtctgaaaaaacgatgtcagaggttttaaagtaagaataaaagcttcatatcctcaaagtcaccatcattttactattgccatcactttctatttccaaggcatttggggatctctttaaatagttcagatattagtaactgagaaaacaaagggagtaatcaaacatgccattttattttagccttgcaaaaatccccagatccctctgattttgtttctcttttgctgtgcagacagcctcagggaattagatcacagccagcctcatgaggctgaatcaatcattcatacgttatttgaaatctattgaacaaataagagaaggaaaacaaaaaagacaccaagatgcctgctcagttcttagtatttggctacatgctttatttatctgaggtcatccttcgtggacccagagccccttggagagcttttggttgctacgtaagcacttaagtaccctcctataattgtctgtaggttcatattctattttgttctctgcccttttgtgtttcctgggccatgtgatgaaaccacacaggttcaaaaaccatggactgagggcctgaaagaatttgtgagaggcttgtaaagaaatcaggttgtgaatgtgccaaaagggttaaaaaagagaaaaaacaagacagacctttccccaaagtaactgtgaattgaaagaaggtgatagagaaattggtgatagatgaaaagaacacagtgttattgttttattttaatgctgcaggttagagaaattgaatggatgctcatcagcaagcgaatgtacccagagtacctgatcttcatgttgcttaagcaagctgatggggttcggttaagaaaaaataaagtcatatgagtttttagagaccctgtagcatcagaaacaccccaaggggagccccaggagttgaaagacaatggagcagctaagtactgatttattacttgaatcagtaataaggccggtcgtggtggctcatgactgtaatcccagcactttgggaggctgaggcaggcagattacttgagtctaggagttcaagaccagcctggccaatatggtgaaacccagtgagctgacatcacgccactgcactccagcctgggtgacagagcgagactttgtctcaaaacaaacaaacaaacaaacaaacaaacatcagtaagaactgaagaggaagaaagctgagaaaactctgagggatgtggggtttccatctggagaggctcagtgtccacaaggccctctctccttcctgtcacctactgggcctcttgcactgtatcttagcaggc

SEQ ID NO: 473 - DNA, 20001 bp, Homo sapiens
atgatttatattcctttgggcatatactcaataatgggattgctgggtcaaatggtatttctgcctccagatctttgcagaattgccacactatcttccgcgatggttgaactaatttacactaccaccaacagtgtaaaaccattcatttttctccgcagaagttgactgtctttatatgcttaagtcatttttatttctttttctcttcactttttgtgtctgctgtctatttgtctattgtgttgttgtctttttcttattgatttgtatttgatttttaaaattatttttatttatttttttgaaatggagttttgctcttgtcacccaggctggagtgcgatggcgcgatcttggctcactgcaacttctgcctcccgggttcgagcaactctcttgccttagcctcccaagtagctgggattacaggcgcctaccaccttgcctggctaatttttgtatttttagtagagatggggttttgccatgttggcctgggtggtcttgaactcctgacctcaggtgatccaccctccttggcctcccaaaatgctaggattacaggcgtgagccaccatgccaggccttgctgtttatgtattatggaaattagcatctgtcacatgctgtgaatactttccctcattttgtctttgtcactagctttttcactgcacaaaatttgttttatgtagtcaaatttattaatctttatgaattttggattttgtatcatgctccatgatatcactgttgcctgccttctccactctatcaggatgtttcttgtgcctacttgtttcaaacttacgtcacaaacacatttctccgtacttcccattgctttctgcatcacagatgtcctgctaacctcctgtttgacctgcagttctaattcagttgtctgcctcatcatttattcagtcatccattgatctattagttcattgattccacgttccctctgagttccaggcactgtgctgtgtgttaaggatacagtggtgcgtatctgtcctatgctcaggagctcatggaaagcatagccaggcttccacttaggtggaattcaaactaacagtccttggcaactgcagggagtgctgtgcgggaggacctggtgttctaccctggcctggggtgaggcagagggcgatcagggaagacttccttgagggaatgtgtccaaccctataacctgagtgggagtttgccagcctttcgtgagcaggtggcaggatgtcagtggaggaggaggaagagagctttccctattgagaaagctgcctagggaaagccttgcagtggacaggagctcaatgtgtttgagaaaccagtgaaggccagtgtggctggagcaggcctatgagaggaggtctcaagggacttggaggaatcaggttgtttgaattgttgaagagttgtgtatggcttggttatttgctccatgattctttgatttctctttatttatttattttttttagaggcagggtctcactctgtcacccagcctggagtgcagtagcacaatcatagctcactgcagcctcgaatttctggattcaagggctcatccttccttggcttctgagtagctgggactacaagcatgcatgcaccatcgtgcctggctaatttttaattttgttttgtagagacagggactaactattttgcccaggatggtctcagactcccaaccccaagtgatcctcccgccttggcctcccaaagtgttgggattaaaggcgtgagccactgtgcccaacccaattgtatgatttctcttttgtatacatcctctaatatttcagtagaattcccaacacattggttcaatggactttttaatcactttggctttctttcatttgcacagttttgtttcatctctcattgattatgagccacttgaggaaaaataccatcaagggctcttaggagggcgtctcccatgttggtgtacagcctgctagaggtctaggaatcctttctgaggagcacattcatcaatagcagtgtattaggagttatgggggacacatacaagtttcatctttagttttatctcctggtgattggtggtggctgctgagagagatcatgaggccaggtcagctagctgggactataagtgcgagccaccacacctgacctttttttttttgtagtcacaggatctcacaatgctgcccaggctggtcgtgaactcctggccccaagcagtccttctccctctgccttgtgaagattataggtgtgagacatgacacctggctgaaaggtgctatttcatcctgcccctaggtgtttgttggtataggtacatttgggcaagagtcataatcatagtactgtgtgtcatctggagccattctccttactgacatgagcttctagtcctagcccttgcctcaggatactgatgcctctgttttaggtcaggtttacttttttcctctgtaaaacggtactttcaaaaaacaccatgggggtgtgtgtgtgtgtgtgtgtgtctgtctgtctgtctgccaattggtgcagtggcctctgcatcctgagctatattttccccttgaaatgatcagggttaatagcatctgcaaaaatgtattgattaacatagtcatgaatcatttatgcaacaactggcaatgcaacggattgatttacagacttctgggtgtaggaggagcaccacacatctatggaccatcccctttcccactctcgcctctggtggcagcagatgcaccctggtccccaagagctcactggggaaggcaagtgttagagaggatgtagtgggatgagctcagggccaaacagcatttagagaaccattacaagccagccttggtcaggtagtcaaacttacttccaggatgtctggcaaagagccatcagttgctgctctagaaagtccacaacatggcctaatccagtagtggttatttaagggaaaacaggggcactggggagcagccagatcacatccttgctttttgcacatttggcagaatgtttaaagggagtgggggctattacacttctcccttgtggaaatatgccatatccttgttaagttgaagacagccttgtctgtaaagcttagtctatctgaaaggtcctttcctatccaaattccagtcagcctcattcccctctgtagatggaagtgcacctttatctgctgagattttattctaaacatgtcaacctttaaacattaaggagttggtgatctccttacctctgaccacttgcagcatttatttatcccatacagttcggtgcataatcagtcagcccatgttgtttacagcgtagcaagtgtaagagggaagtagggaggtaggtggggccaacattcatgtttaggttcaagcctgagaataaggatgagcacaaggctactgagaccatataaaacccctggaacaatgccttgtccagtaaatggcactctgcagagtcagtcctcttcaccctgccaagttcccctgtgtatgatatgcctggaccaggacagatgctcaggtgatcccaaggacctagggagggaagggtcccctggctgagcaggcctcaacagttggatccttctagcaacagctgtgctagcacatgctggactcggattaaagtcatacttcctactcttaatttcctgtttcttttgtacttaggatttaacaatacggttgtgatttagatgttgctatctgtaatagggcttttctttattgtttaaaagctaattagggaaaaagataattatatgtggttgtaaatatatgcattatatgtttatgcatatgtatacagtataattaggatcaaggataataaatgcctgacccctgtgccattactttttctcttgctgtcatggcagacatcgctagaagattatgacactttactatgtaccctaggaaaggcagccactgccaatcgattggagttgtcacatgtgataaaacctatttgtcagcctagataaaacctgttaatagattgatcctgggatacagaacatttgacctatctgagccagttgtttttttttgagatggagtcttgctctgttgcccaggctggagtgcagtggcatgatctcagctcactgcaccctccgcctcctgggttcaagtgattatcctgcctcagcctcccaagtagctgggactacaggtacccaccaccacgcccggctaatttttgtatttttagtagagacagggtttagtcatgttggccaggctggtctcgagctcctgacctcaggtgatctgcccgccttggcctcccaaagtgcttggattacaggtgtgagccaccgtgcgcctatcttagccagtttttatggattgggtcagcatgccaccagcctctggaagccccacagtgagaataaatgtttatttctggtgaatggccagtcagtgactctctgattgtgaaagcctctgactagtgttagactttttccctttgggtatgcattgtcctttgtgaacattgagacttttggccttcattccagtgagcttacaatttcgaaagttgatttggcttgcagtcagaggccattaattaggggcaagaagatgtttggtgtttctgtatttcagctgtctctgggttaaccagggtcagggtttttctagggacaggaactccctgtgctgaaacaggggcgatgataccatgcaaggcaggactcccagggcagtgactggattttagacagggcaggataacctggatggtctcttcatttacttggtttaggcacgtttgtatttactcattttacagatgttcatgaagaacccgccatgtgctggacactgctgtctatcccaggttcgttttataccttggctaacctgtctcctcgatctcgtggtcttcctgtctttcaagtctcagtttgggcctctcacgaacttgattctttctgcctctcagagggagaatgtaacttaatgttagcatttaattaatgctgagttgaaacattgatttatggtatgacttacctctttaaactccttgcatttaagattgagatagagaccaaattgtccctaattcttacatatcttccccctctcctttcttaagtatatggtacaggtttcattcattgggagaacagcactgtgaacttggcaagagcacggtcctggctgcagatcggtaaatacaaccaaatggcagagcattttttctgtaatagactcctaacctaacgggtggggtggtgtttgtgccaaacgtcagggaggacggtgctgactgtcctcactgtcctcctctgctttggtgaatgtttccatggcaacctctcttgctgttctcttatacccctatccctgtcttgcccttggctgtggcctcctggatccccgcagcaggaattattgaccgtcctacttttacttaggattgatacctcccttctaaagtagagctgtcatggaaagcagcatgtgataccagtgtacatctcttatcccttcaaaagtttagctccttgaggcagtttcaaccattttttatatcctccctgtgtggtgctcagcaaatactgaaagcacgaatgactgtgacagcaaatactgctctgaaggaagcagtctataaaacaggctatttctatcctggaaaacggcctgtggaaacaaagccaggttctggttatagtcacattggtatataatacatagctggttcatcaggtgctttatccatctcctgctcacttcacattcatgctctgggacagcgtttcctgatgaagctcatttcctagtgaaaatccatcgaactaatgatgggtcagatgtgggtaagtgtaacgtggttccagtacaagcagagatggattggtcatgaagattagctttagggcccctcacatggagggatcccttccaaggccctgtgctcatttgtattatttacttatctaatatttttgagacaccgtcttgctctgtcacccaggctggagtgcagtggcacaatcatagctcactgcagcctcgaactcctgggctcacgtgatgtctgtgcttcagcctcctgagtagctgggagtacagccacatgcaaccatgcctggctttttaacttgtgtgagcttcatgtgaatccacccctgaatacatgtaaacagaaaacactgaggtaaactaaagatagaagaaaccaagatattatttcctactctctttcacagtcactcaacaatcctgactccattgtctgttggggcgggaggacgttccccacacaaagcaattctccggcagattcttcagtggacagcaactggatgtcctctaatttaactcaatttttacaccatctacctggagatatagggtcagatcccataggttgagggtttagccccacaagattgcccacttcagatgccagtccccactgctgggaaagggagaggggccagaggttaaattgatcagcaatggccaatgatgtgatcagtcatgcctatttaatgaggcctctattaacaacatgaaggactgggttcagacaagcttccagatggataaacacgtggaggtttgtggcgggtggtgtgcccccctagagggcatggaagcttcacaccccttccctcatacctcgccctaagcatctcttctatctggctgtccatctttatgcttggtaatgttgttaataataaaagggtaaaggtaagtgaagtgtttcctttagtgctgtgagttgttctaacaaattaagtgaacctaaggatggggtcatgggaaccctgatgtatagcctgttggtcagaacacaggtcacaacctgaggcttgtaggggacagtcttgtggaactgagcccgccaccccgacaccatgtccaggtggatagtgtcagaactgagttaaattagaggatgtggcctggtgtgttgcctcatgcctgtaatcccagcacttgggaaggccgaggtgagtggatcacctgaggtcagggttccagactagcctggccaacatggtgaaaccccgtctctactaaaagtacaaaaattagctggtgtggtggtgcgtgcctgtaatcccagctactcgggaggctgaggtaagagaatcgcttgaacctgggaggtggaggttgcagtgagccgagactacgcagttgcactccagctggggcacagagtgagactctgtctcagaaaaaaaaaaaaaaaaaaaaaaattagaggatgtccagctggtgtctgctggagagtcacctgggaaactgcttggttgctgtgtgaggttgctgtgggaggagaaatccccatacattttggtgaccaaaagtgtagtattgagtgtactgtgtgagataatagaaaaaaaaaatttgttttttctttctctatattttaatacccaaccttcaaaataaaatcaaaacagaaacattttgctgctgtaacaaattactacacatttagtagcttaaagcaacacacatttattaacttaggttctagagttcagaagtcctaaactcaaggtgtcagcagggctgtgattttcctggcggctctaggagagaatccatttctttgctttttccagcttcttgaggccgcctgcagttcttggcctagtggtcctatcttccgtcttccgagccagcagtgccacatcttctaagctctctctcacctgtccttccactgtcccacctcctgtcttctgactttggtcctcctacctcccctcttttcaggacctttgtgattacacgaggtgcacctggataatccagactaatctccccatctcaagatcctcctcaatcatgtttgcaaagttccttttgccatgtaagataccattcacaggttctgaggattggggtgtgaatattgttggggggccattgttcagactactgtagttataattttaatattaaatttgttatattctttggcaatccagcttaataaatgccttctgttatctcttctgatagcagtgtttggtttttgtgcccttcctgcttccttaactggttctaatataaaactttaatttgttttatcaccattaacaatttctgttggacactgacattaattggcaaaagttctgcatctttgttataatactaacacttgggcaataggaacgtattttgggctatgaatgagctttttattaaagctgtaaaggaagatttcttttcctcttcatcaatttgtattcccagctacctcaaaggaggcccaatcaacgtctattaaaattcctgaacttcaaactttagattaaaggagcattggaaagagattagatgagagtagggtatggacattcctccctcattttccctgatttcacctgctgattagagaatctgagattcagtctgtagggtgtgtataaaatgggagtctgagccagatgcagtggttcatgcttataatcccagcactttgggaggcagaggacagaggattgcttgagcccatgaatttgagatcaaccttggtaacggcgaaaccctatctctacagaaaacaaaaaattagccaggcatggtgatatgtggctgtagtcctagctacttgggacgttgaggtgggaggatcccttgagcccatggcagtgagccatgattgtgccactctgctcctgcctgggtgacagagcaagaccctgtctcaaaacaaataaaggggagaatctgttttctagcagttcattgatgttagcagtttaccatccagtcaagaacctttattgagcacctaccgatgtgagccttggagggattttaatagctaatggtggggtggagccgtttgaacctataaagaagtctgagaagccagagagggagaaggcaggccagggaaatattgaggaggagggtgaggctagtaattctggatgctgcttagagggcaggacgaggagatctgagaaatgggccttggtcttcaatgatgtgaggtcactggtctccatggaggtgacaaatcccatgtggaccatatcttcagatgacttcattctctggatgcagtggtttgaatcttatgtaagaagtaagttccatgaagcggcataggcctttgtcttggagcttttgtgaattcccaaatttgtgaatactcccatagcatataacttaacctataaaatggaataatgtagactttgaagattttgaattggtccatatgtctgctttctaaagaaccctcatttcttagtccttttgcctttgtctccatttccggcaccagcacaaggctgttagtaactggtgctgtcagtggttcttcaccgcacggtcctgactcactcttgtgtcatgaacaatggtgaggcgtgttggagtcatttgcttctaattactggctaaggctctaaactttttggatgacttactagaaaaaggcagcaaggcaactattgtattactgtttttcccatgtatgtattccaaagtgctttactgagtgcggcaggaggggtagaagcagagccagctgctgctagggtgcatatggtgttggatgctgacaaaggcatgtggggttgtgcagcattgcctgtcatctgcagtgttggtgcatgtgtatgtttgggggttggttgagagccactgggccttactgatgaactaaaagtacaaagaaccactatgctttaacaaaattacagttattatgtatcataaccatggagttaccaggcaaatgcccagtgtcagctatccaggtcaagttctgggcaagagagagaataccaggcttggggatatcaggggtcagggaggccttactggcagaattgatctttaagatagaactggagctgttgaaatgcccaggctgcagcacctgcaggtgtgacccagctgactccaggccttcagagcagtcgttcttatccctgccagtggataggaatcacctgtggctttacagtgacctccacctccacctttggaggtcttgaatctgtattagcaaataacaactccctttctcctgcccccaagcaactctaatgtatatgctatatacgttagagtttatctcatgatacttttatgctggtggaggaataagaggtatcacagtgtcatcattggaactctttagaaacaaacagtgactcacatgcataatacactggtgcacacacacacccttaagtagcatttgtttgaatataatcaggccttacatagtgtataagtaaacataaatgtagctgtttgagaagtaaaatgctgaaactattaatgtgatgttccaataaaaagtcagtcaagcgtcttattcagctatacaaattacagatgtcagtattagatttttttttttttgagggtgggtgttgggggagacagggtcttgctctgtcaccgaggatggagtgcaatggcctgatcacagttcactgcaccctcgacttcctgggctcaaagaatcctttcacctcagcctcccaagtatctggaactacaggcacatgccaccactcacagctaatttttaaatttctagtagagatgagggctcactgtgttgcctaggctgatcttgaactcctgggctcaagggatcctcccaaagtgctgggattacaggcatgagccatcgcctactggccctttcttgatattcttgatactgagctctgtagtcttttttttttgtataaatttatttttatttttatttttttgagacagagtctcactgtcgcccgggctggagtgcagtggctcgatctccactcactgcaagctccgcctcccgggttcacgtcattctcctggctcagcctctagagtagctgagactacaggcgcccgccaccacgccccgctaattttttggtagagacagggtttcaccgtgttagccaggatggtctggatctcctgacctcgtcatccgcccgtctccccaaagtgctgggatcacaggtgcgagccaccgcgcccggcttaagctctgtagtcttaaactcctaataagcatctggaatcttctgagcgcttaactcccattttagcagagcttgggtcttctttttgtattttaattccttgtaattggtatgcctctgtcctactgcctgtggtattcagatcactagactaccttagattcctttacctgctggaaaaccagctggagtctagaagagtgcttacttaaatcacagaaggaacattagctagtgagtcagacgacttgggttctagtcatggttctactgttgacttttttgtgactttggatgatccgttttacatctctggacttcagttttcttatataaaaaaatgaatggaactttacctgatcgctgtgattttaaacatttttttgtattctaagacacatctgtgatttttaccgttgggtctaatactttcaaatcaaacaatgtattcagtatctctacaagggctggactgggggctgtagggtattcaaagacatgtaagttgtgcttctagctcaaatgaatattctacttaagataatatgtaaatacacacagagctaaagaacacaagattaaataaccattcaaaccggacaaggcataattagttgttagatgaatggaatagatcagcatttcccaaactctaacgtggatcatcagttctgcaagaagttaatagggcttcctgaacaaatgggtttttaggtcagtggagtttagaaaatgttgggtcaaacaaaatcaaacagtttatttgttaaaggcttcttggggcctttaataaattaatctccataatgaacgcatagctgcataatctttggtttcccagactttgttcaagaagcctatatttatttatttatttgtttatttatttatttaattaggaactattcactacttgaatgaatgcaacttgggaagctggtattagtgctaagtgtgttaggagtttaaggtgagagaggtagtttcgacctggatggccaaggaaagttttacgaggtagtgggtccagaacgtcggggtgggttgcacagtgggagaggctgggaggagcacttggaaacagcatgtggctgagctgtgagacaagtgaatggaatggagtggtggatgcttcacacttcaaaatctctgaggctcagtctttctcctggaagtgctccttggacagagttaactttacttttttttttttttttttgagatggagtctcgctctgtcgcccaggctggagtgcaatggcgcgatcttgctcactgcaagctccgcctcctgggttcacgccattctcctgcctcagcctcctgagtagctgggactgtgggcacccgccaccacgcccggctaattttttgtatttttagtagagacagggtttcactgagttagccaggatggtctcgatctcctgaccccgtgatctgcccgccttggcctcccaaagtgctaggattagcccggcccagagttaacttttctccagagttccatatccccagaggctatgaagggtgctcggccccgccccactcactcttgtgcatttctggttttgttcctgctatgtcccattacaagccaattcgtaggcttgctcagtctgacaggctacaaatgaggtgctcgtgacaccagaatagaacttggctattcctcactgtgagtgggccaggactgagcttccaaaggctggccaagggctggctgccactgatgcagaatcctcccaggaggagcccaggaatctgtatttccaacaggccccaacgccttggatttaggagacgaacttggagcagaagcagcatggctctgactgggcccagggagcctgcatagtgcctccttacattagatttcactggatcctctcagttgtcctggggaaggcttgggtgatctatgtgctatccgctgcagtccacagcactgaggagtgacaggattcccagtcagggcctaattccgtatagctgctcttgaacaagtacatcccaatgctttacagagttaggtagcagttattgagtcactcatttgcaaatgtagttatagaaatgcatgatcatattagaaggatccagggaggaaagagttaggcttgtactgggcaggctgaatgagcttcacttctggattcggtttattctgttgtgtgtttgctcctcctccagtaccctctctgtcatgtgctgcttttctaaaacctgtgtggaattatttattacagagagataccgggtttattatttgtaagggcgagaacacttgacatgcagggggagggaaagacattgacgttgtaatcctgtggtgtagcttatttttaatcacagagagaaatgctgaggtttgttttaactgagatacaaaatgttagaaataagctttggttgttaggaatagtaattcacagagcggtctctagattcactatgttagcccaaatctgaggcaagcaagttcttttaaagcccaacatcagaactcatgtactgacctagtttaaaatgttaaaagtgcagctcatcccatcaggaggaaactactatagagcgtgctcttcgagtttcttctttatttgtctagggggcttcttttttcctcagagagagggcattagttgcataattttgcagggcaactggcttcttattccttttgcactccttagtggtgtctcagctttgcagttttagggggaaatgagctttgatgtgtagtaaaaatgataactgattttaatataaaatagtgaatgctgggtattaaactcttgggcagcaggagacataacgtgtcagagagcattagttttcaaaacctgaaatgaagtggcttaactcgtcaacagaagccctggcgatgcagcaagtcttaagaggaggggacccaaatggattggtgagtggtatggggaggggtgtctggggctataattcctccatgcgtaggtcttgaaaagtcttctgcatgacccagatcttttgtttctaggggagggtctttgtcagagtttggtcctgatgctgaagagctttcttcctgttcctctctcctctgctaagatccttggggctgcagtagttgcttcatagcccagtagatgagctagctggcagagggcaggaaagtttacacattcctgtgcagcaccttttgcatcaggactgctctagtgttgagaatcactgtcctccgagtgccaaattctcctttaaaaacaggctgggtatggtggctcaccttgtaatcccagcactttgggaggccgagacaggagggttgcttgagcccaggagttaaaaaaataaaaataaaaattgctggacatggcctgtagtcccagcgacttgggaggctgaagtgggaggactgcttgagcccaaggagattgaggctgcagtgagctatgatcaagccactccatcccagtttgggtgacagagccaaaccctgtctgagaaaacaacaacaaaaccttggccaaagctatgcagagaaaggacaagagaaagttggcaggtagccatatttccaggcttagcattcacaatgaaaagtgcatggttccatgattttctgtctttattttctgaaatcatgactactcccttgcttccttcttgctgtttcttgtctgtcctggttgtaaaagaatttgggctcctggtggaattctgccactgtcactctcttcctcacaaaccttcagtagctctcagttgcccccgtacctggaccccaacttactttcctaatgttttctgccgtctcctgcagaatctctcctctggcttccaggctctctcagcttccaggccggcctctcagtgtgtgtctcagtagagtcttcaccttgtggcttttactcatactccttgcctgaaacgttcttctcccaccaaccactagatcctacccttggatggagcatgagcggggaattgctgttgcttgtgcactggagtgtgatacctgaagccgagccaggaggcaaatccagaagctgatggtgtatccgagtcaccgtgtttgtagaaagcttatcctttagttaactcgggcacgagtttaacttgtatgtaaatacatattcaacatagatagtcgcctgtaggagatacagttggggattcagcttttttttaacctaccatctgtgagtatagccctacatcattaagtggcccccatcgtgtatgtatgtatgtatgtatgtatgtatgtatgtatgtgtgtgtgtgtgtgtgtgtgtgtgtctgtgtgtgtgtgtgtttgagacagggtctgactttgacatctgggctggagtgcggtggcatgaacgctgatcactgcaactttcacctcttgggctcaagatatcctcctgccttagcctcctgagtagctgagtactagctcctgtgtgctactatgcctagctagctaattttttagagatgagatcttgcaatattgcccaggctggtctcgaactcctgggctcaagctgtccttctacctcagcctcctaaagtgttgggattataggcatgagctaccatgcctggtccatatatctatatatatatttagctcaaatgttgtttctccgtttttgttcttttaatgtatggtctgaggatccctgcctttacagttgcctggagttctctctctttttttttttttggtagagatgaggtcttgctatgttgcccaggctggtcttgaactcctggcctcaagtgattgtcctaccttggcctctgagagtgctttagtggattataggtgtgagccactgtgcctgacctgcctggttcttgctaaatttgaagattcctgggcactactgcagacccagagcagagtccaggagggaccagggcacactgatgtgattctaagggccgtgtgcaccacagccccactgctagccccatgtgtctgcagactgccccatgtgtctagggcgtggtgtgaggggctagttgtggcagtctcgccaggtcagggttgggtgggcaagtaagggctgctgaggagaatctggattcttaagaggggttggctgggctgggcacagtggctcacacttgtaatcccagcactttgggaggccgaggcgggtgaatcacaaggtcaggagatctagaccatcctggctaacatgggtgaaaccccgtctctactaaaaatacaaaaaattagctaggcatggtggtgcgtgcctgtagtcccagttactcaggaggcggaggcaggaggaacgcttaaacccagaggcggaggttgcagtgagccgagattgtgccattgcgatccagcctgggcgacagagtgagactccgtctcaaaaaaagaaaagaggaattggctccacaaccctgattacctggccagggatagaccagaactgtggtgagggagcctttgctgctgtcctcaagtagcttttgggccttgcagaggtccatgggcttcacgaatgctttctgcctttgactctgttttctcttttgatggtacatatcaagccgctagagtgccccaagtcttgttttgtgtcaaacaccctccaaggcagacgacctgcagttttagatcgtatatttatgtgacctgatgcctgctttggggtctccagagtcaaaaggggtgtgtgtgtgtgtacgtgttgatattcttgggcaaagggtgattgtaactgcagagaccatgcatcctccagccccgaggctttcctgtcgcctgtggagacaagcttcattgcctgtggggttctggtcctggatcatttcttagagctgagcatggggtgatgccaaggcccttgggacgcaccaagggtgaaagaacagtggggttgtgagggtgcttctgcagggagccctgaggcctagacagacaggagccaggagggcttgcgaaaagtccgtcctagctgcaaacctgctcctccctccgccctggctttccttgcatttcatttgtatcctgctgatttgatttccttttgcattgtgtaaggttcttagtagatacctattccgtgaagttagagatgaattagacacaagagagagaaagacctggctaaactggaaatgagaaggacgtcgacagtttaaaaacacattatggtaaaaataaacataacacgaaatttactactttaaccatttgtaagtgtatagttgagtggcatgaagtacattcacattgctgggcagcatcaccaccatccatctccagaactctttcatcttgtaaaactgaaactgcccattactgcttatcctccttccctccagcccttggcaaccaccagtctactttgtctttgtgatttttgactactctaggtacctcaatcagtggaatcataccgcatttgttttctaagttcacatttttctgtgtcgatactttaagtccaataagttaagaggagaagggacttaacttgcctctcctttggagacagtcctcctgctcccttctgcctgtccttgttgcccagagtggcggggccagtgtactgctttacctaatcctctgtgtagaatggactggcagctgggggctctcgaagtttgcttccagctgttcttgggatttagtgttttccctggaatgaagatgaagcagggttgccagataaaatgcaggctgcccaggtgaattaaatctcagataaacagtctatcatttatagtataagtatcttccaaagactgcatgggaaatacttatactgcagaattatctgtggtttacctgaaattcaagtttaactagatttgctgcatttttgctgctaaatttgggtgatccagtggtgaacacacaataaagcagctcattggtaaaagggcatgcggttggctagaaagattttgggagatgggcagatttgatggtgcagagagagaggccatttggcattgtcaacctattttttttttttttttggtagaatattaacttggatcctaaaagtaggattggaaagtagctgcatagactcctgtcatttgttcttcagagaaacaagcagctagtactggctaatgagaatatgatctgcacatggcaggtgccaaaagtgtgctctaatacaaggccctttcttcctttgcaggtgctgggctacctgactgctagcagggactgagggagggcatttcttgaagagttacccagatccagctgcttatctgcccctggccatggtttatgttgttgactgattgcaccagctgctgagaggtggttttatgtagtgtgagtaattgaaacttggttctaagtttccctcttgtcccttcctgtttaatgcagtcagctgtcctcgaatttattttttggtggtactttgaatcagccccctgtgtgagaattcaacaaaaacgcaactgatacaaagcatctgcactgagtaagtccgggcagcattgaatccctctctctgtgttttctgtgtggctgtttttcacttaccttctcccctttgggtctaggttcctgtggctggtttgctttctcctcagtgttttggaggacataaaatgatagttctcagggtttgcaaacagtgtgagcccttcctgcagctgccggtgggtaggtggataaaatcagttttgctgctattgtccacgggccaggcccacccccaggtgccagtggctgacccctggccacctgtgcgggagtgtgagtggctgcctgctgcaagggcccctgtggctcagaggagacgggcacacgctatgctcccttcagagcagtggtagacatgctttattttggggttttgaagccctagcatttagtggctcattttggcctttttcttcccctaagggattctgtgatgtttaatgactcaactctgattgtactccggatgtttcttttccactgatgtcagtttatagagcagtcctccagcaaatgtttgtgtgggcaggaggcagaaagggaaggaagaggtgagggggcacttcgggaccccaagaataggcttcaactgctgccccacacaccagggaggccaggccctgacattttaatgcccagtgcttttgcttccagacccattggaggggtctggttggggcttggatgaatgggacctgagagccgtctcctgcagggctgctggttctctgtgagaactttgggatgccaggtggggcaccgtcatggggtatgggattatttgtaggtctggtcattaggggtgggatgtctggcagatgccttagagcaagtgtatcaagaagtggggtacagcacaggaccctgtgccccatccttccgtgagtccccttctggcttgtctccataggacttcagcttaacacagggagtgagggagagggcaagagcatgggcaagagggagggtttagttttgagcagatagatccagctcctagtttgccttagaccctggaacactggcttctttcattcggccctttagaggagtggcccagagtagcctagcagggactgaactctttcggatggcttccagagcattgttcccaagaccctcccttctgctgaccctgtgacatcggggcaggtggggagagaagaggtagacactatcattcccccagtcccaggtccctccacacagcttattcctcacttttcctccccccggggggctgacagaatcaaacttgtgaaatactgaacactggggttttgtggtgggcagttatgtctgttactaagcacaaggaatttgagcaaaggagggagaaaaataaataactatttttaaagggaaccattgtattcaatggactcctcctttttgagggtctgtcgtgggcaaaagattgtggtgcctcctgagagtgatacagaggcagtgagtccccgactcttcctgcaggagtgtgtaggtcagcaatattgcagtttccagg

SEQ ID NO: 474 - DNA, 40001 bp, Homo sapiens
gatggggggcggacggggaaggggaaggggagtgtctgcctctttgggtagcctgaacttacattagccaaatgtcattgaacctccatgacttgaggctagttacgtgatggctgagtcaatgccaggtctaagatcattctttcctttattctatttatggaactaatatcaagagagcatttactttttggcaggcattgttctagacgcggggaaaacaattttgaataagactcataaagatctggcccgaatggagcctatattctgggagtacaagtttcctgttaatttttctctcatgtctttctttaaaagcccagcacaaatctaggaaactgtgatatctccaggaagaagggacctctctgtcctctgaaatcatttgtgtgttgcaggttccaagagtgtggcagtggttatagcacattatctagtggctgctggtatgagggtttaggctaccctctgggaaactggactgggtcagaccttttttgggtgtgatgaggggcagagagtgaggagactctgctatggtgccttccaaacaggaaatgttcagcaaatatttattgagcaaatgcatatctgcatgaggtagtcacatgggtggtattacaaacaccagactggattccagctcttcagattaacatttggaattcctaggaactgtgctgaacctggcaaagatgagagccctcctgccaggagatcctttagtttgtttctggagcattcccaacatgaaagctctcccatggaggttgggggagttttaaattgccagtgtgtttgaaacaagcaacattgtcttctgacctttccctagggtcttgcatactttgatatggcagaagcaggcgttgctctgaagttataaataactaagcaacttgagagttacactctagggccccaagttaaaacagctgattccactcttgttgtagagcaggaaactatcttttcaaaatcatgtgtgagcagcatggcattcaaacgggatattaatcttcctagaaattttaccaggaaagcagaatgcttccttttcctccacccttatttttattttttatttttgcttatgtgtatctgtcatttcagcatatgtgaagtgaatgacaagatatttgttgtttttactggtgacagatgataaatatcttcatttctttttagcttaaaaacacttgctgaactttggtcagctgatataaggattagaaataattttaagattatttaatctcgttttcccccaaagaattgatccagaaattggtataaagtcagaaggagaaaaagaaggatgagtttctaagataaatgtgctcagataattgctttttattaaaagatactgttctttttacttcttaggtgttgaaatgtctgtttttaatgagatcgtgcttcgaggttggtttctcaagacgaagttatcagtcagcacaatttgggaaaggtgggggtattctgctatggaataccaaagtctggtaactggtcatctcattgagacccccgtgtgatgcttgagttgcccacctcccgcaaccgagtccccatcaagtagggatgtttatacagtgagtcccttgccctaaggctggtccttctttgggcagctttgactgagtttggagaataattgctattctgtggaaatttcataatcataacccaggcaagtgcctgggaggcagagcacaggtgggtgggggtaaaatgcagagtgggctttggatatcaactctgtgatttctgtggccaaagcagaaatgcccatgagcttgagttagtgcagtgagttaattgcatggtaattaaatgctaacatgattgatcagaggaactgtgtaattgaagcatagtaaaatgtggcatgcttagtaagcaattgagttgtcttcccaaggatgtaggcagtactgggcagaagcacagatgtcttgaacaagctgtgcagtgcacagttttgcccttttgtcttctgaggaagatgtatgggactctaaggagtgaaatcccacattccgtacctgagaacgagattcataactgtatgtgagatattctttattttgtagtactttgcatactttttggtatatagaatatttacttgttatcattggtgaaatttcaaggtttttttttgtttatgggtttttgggcttttctgtatgtattctggaatcaccaagaggcttccatattgaattttctacagtagctctctgaataagccttaattgatatatttggtagagatgaatgaagataccatttaatcgtggtggtaaatttaaatatatgatgtttccttctggatgagtgactatttaagccctatagatgattttttaaaattattttatttatttatttatttaaagacagagtttctctcttgtcacccaggctggagtgcagtggtgtgatcttgactcactgcaaccttcgcctcccgggttcaagcgattctcctgcctcagcctcccgggtagctgggactacaggcgcgtgccaccacacccagctaatttttgtatttttagtagagacggggtttcaccatcttggccaggctggtctcgaactcctgaccttgtgatccacccgcctcggcctcccaaagtgctgggattacaggcgtgagccactgcacccggccaaagccctatagatgatttttgaaacaaatttttcatttcgaaaagatctggacagtttgaaataaaaatgaccaaattttctatcaagttgaaaagaaatttagagaaatacgatttatcaaataaaaaaggtaataccttggaatgaatgaaaaaattaggtaaatttttcataacttaggtagctgtcttaaattatcctggaaaatatgggccaaactttgagttgaatttttagtacagcatttagattcatgtttctctatttacgtttttgtgtgtgtgtgtaatgttacttttagagcagtggaggtctctactatccattgtttaatctcttccttttgtgaatagaataataatcaattactcctaatcagtattcttggtatttttgtatatacatgtgatagtaagagttacatttatgtggatgaatttactataagccagcctgtaatcttagtgttttacttatttagcttcctaacattcctatgaggtaggtcctgtttttatctccattttacagataaagaaactaaactatagaaagcttaagtaaggtgcttaggatcccataagccaggggttggaccaagatggtctggctctaggatctgtgatcttaaccattaccctatgcttcctgtctgcgtgtactggacattctgactatgatggctttggagtggttcaggatcttggactagctacttcataaaaatggattggcttattttccgtaaaatgtcttgtgtttgttttgttttttttgagaaatgacctttgtatgttaatactttagtttgctagtagagcctatttgtttagtcatggctaacagcatttgttgcgagtgattccattgattgagctctatttctgttactttctaagtgtttatcgtgtgataataaaaacatacccagctggcatctcaaatctgacttagcaaactttcaaggtgtcttctagcagaatctagattccaaatagcagcccagccttgagattgaacttctgacacagcagtgtgggtgcgagggtcatcctctctcctatcttcggcataacttgcctggaatgcacatgtgctgctgagaacggcccctcctggtcctctggtcccctccttgtaacgtctcactgatcacacagaaccagggaggagaggggctttcgggggcttgtcaggtcatggccatccgtgcgcctcctttacagacaggaccactgaagccaggggaggctgttgggcttgcctgagccacctcccacttccctgcctggaactccctccctccgctctgcctcctaatgcctgggctccgttgaggtggagagaatccggtggctttggattccgtgtccacacccagttgtttcccagtcagaaaaagaaatatttagtttggggtttggataaggatattagtttcaaattaatcctgtacttaaaacattttatttctgtaagtcatgtgaaaaaaaaatgtttttagcgaatagggaaagtttttaagacaattgggatcttcccagtagtctgtattctcttcattctttgtggggtttgttactggcagccttagtaaagcatcttgcaaaacgggggctggtaagatgtggtcccagtaccccaaatggctcgtgttcagcttcccttctcatgacaggtgctgccagcccctttgggtcagcactgggcacccaccagagcatgccattttcctcaggggccctggagaagggttctgaagtggtggctcttgagtggtgaaccagagggtggggccctgggctttgggatcagctaggcttgggtgtcgcttagtagctttgtgcaaatcatttcatcattctgagcttcagttccttaagctgtaaaatggtgcttaccttatgcagtagttgagataatttagatgatgagatggcatagaaataggtatatgatgataatatatgtatcatatttaaatcttgcccaacacatagtaaaacatactactttgagctgggcctatggcttagcatgtcatttaatgtgtaagttatgggtattgtaatttgggagcccctatggagcctctgttcttttatccccactaattcatgcatggtgatgttttgcctgctccagggcgatgctgtggcaggtgactgagggtttgctgaccttgcaggagagacagtgagtgcctgggcaccaagcagtgccctttctctgccctgcctgcccccagtgcctccaggtccttggaatgactctctgagaattaatagaatgtgtttttatgtatgtgaaagaagacaacccccagagaatccagttacgtgctatagagtgataccacatgctcttcctaagtctaggaaaagaattgtatctggaatgaagtgtaaaagttaagacacaaagattgtcctttggccccaagtacaattcgaaagcattttgacaagaacgtcttacaatattagtggcttgattatttattttgtgctgttcatatctcacccaatgctaggctctacagctaagtcgtctttctgtcttcactatggagtgacctccagacattgacccctcctgtggttgtactgtttcaagctgttttgataaggctgaactaggatgatcagggcatggcaaaacagctattagcagcacttgttattaatgacatatgaacgtggtaaaatatacgggcttccgatgagtctattagtgtgtttttttatgtttaggaatgtttctaagttgaagagctgaggagtatataagaatgactccatacttttccatgaaaattcaacacctgtcctcaaaacagctgggtctagctccaaattgcccactgtagtcttgtgaaaatttctttgaattctccctttttttctcaaaaatacttggatttcacattctatcccatagtgcattttatttgtttttatgttaaaatgctacttttcttcgcaaatgttagaggagggttgacttgcctggaagaggtgccatgttcatcttgcagctcccctacctgctgtaggccctgggggagtctccctccccaccccacccccagcgtgagaagcggagtcctttctgccactgacagagggatgtttctgggagtaagcggtatgcttcatggagttcacccctgaattttgaggattgaccccaatttccttagttattttgaaatttctagagattggtatatctaactcaggatgagatcatttatgtttaaaccattcttttgagctagagtggaatgagtgaccccatttttctgaatttcttgcctttagttaaaacaaaaatcggtgtttaacttgccttcagatgatctcttctgggtgtttttctgagaagacactctcaaaacccagcagtaaccctggtcgattttgcacctgtgcctgaaatgctcccttgccgtgccctggtgtctagtcctggtcagtgcactcaggaggcttgcaaaactcaactctagtcctaaatactcctcttccagcacttacttcttcagtcacaaagttgctttgcccacccagctgctgtcctgggtcacagctggaagcagaaaagtctaagcttagtatactttggatgatgttttttacacttttgccacatgacagactctagagcccctcagcatctttttgtgtggtttggatctgccacaggaatggggaatgttagtcttttaatggtgaaattactacatcatttcttgggccctctgactgagtcggttgtctattctcagaagaggctcacttctggacctctcggttcagaaatctgctctctcttagtggaaaattatttcccttcctttctttgtttaacctttcccccattctggataacatattgatcctaagtagcatagtaactctaagaagtcacccaaagtcccacagaaacttaaattgctgtagaggctactcataactaaatagaccactctgtcttgccctttaagatacttatagtagacttaaaaaatttagatggtaattgctgagagacatgatgtgctctttccgagtgtacattttctttcttctcatggatggtatttgaggttctgtaatgacattagtttgacagacatagagccaaccataaaaaaattcatgggttacccttgcattgaagtaagtcagtgaaatgagtggctgtttgtccagatgttatttgtccacagtgtgttccagtttcttggaaggagaaccatcctacacaaatcctccatgctgctctgctggtttgggtcaggatgttttgggcatcttcaagacttccctctcctgtttggattggtaacagtatctgtttcccattcatctggcttgcaaaactgaactctagtcttaaatcctcctcttccagcacttatttcttcagtcacaaaattgcttcaagcctgctttcctgacctcctgattcaaggattctaatttcttctagttagctttgattggtgccctgacctctaatctctcaatatccccctttcatgcatccaagtggcagctgctacataggcattcccaagttctccactttgctccagctgtccttcctgccttaggagcctctggtcatgctgagtccttctcacaatgatgacctagatcctccatctctcccgacatggtccagccacagccccctccttactgctttgcaggccctttgctgtgcttttcctttgcttgctgtgcctgtctacctgttgccagatgttgagggccaccttgtttcccaaagccagctccagtgatccctcttttgtggtccctcccaacacctgcctgccaggtgggaagtgatagctttcctgctcagcatctgtgatgcgttgtctcttcctagtgctggtgtcctttgctttgtgttagaactttctgctctgttgtaaatgttggatttccttcctgtttcgacagggaaatgtcttatagcctggggtcagctggaacagtggagggagtgtatcccataaccttgtagacctttaccttttgctaagggcaagtcacttaacctccagttacccatttgtgaaatggcccatcattcttcccctgcagggtgatagtgatgatgaaaaatgaggtgtaacagatactaaagggtctagcagagtgtctggcatatggacaactcagtaaatgccagatccttctctaggtttcaatccagatagggtctagaagaagttctacacaaaattggtgctaaataaatattgatggaattgcaaaccctttcagaacctgtttggcattttgtagctgcagattaaatggtgtaaaagcctgtagccttgtgtgttggagctgtgactctggctctgttacactgatttctgtctttagtctagggcggagaatattccagatctcttacaagttaacccctccgccctctactaaccaaagcaaaagaaattcttgtcaaggagttggcagaaacctcaacattagctttgctataacttgaaagacacaactttctagtttttgcataatatatgcgcacagcacacactgtacctagctgctttactttggtcaccagttgcttgttggctactagcctagtatgcgaacacctccagcttttttagttcttgttggtaattaatttcctagaggctcttattacttgtgaacaaaacttttgaatacattatgaatgaggttttacctgatgtcattatgtcagtagtgttatgaaaaaaataaccataaaactttcttcattgtggcagtgaagtataattctgttaaaaagatcaaatgtctaatgctcttaagaaaaatcctgagtctccctttacaagtacgtatggcatgttgggaacaaagttttaatacggtgcttttttcccctctcaaaggtcttttataacctgttttaggcagatgagcttgtttgattaagagtggtaattaattcacagtggtcattagcatgtaaatataatgtgaccttcacatactgtaagaagagattttattttagcagttcatgggcattgacttttgacagagggaaagaaagggaaattgtatcagttagtttggtgtattatttcaaaacatggaaattaattttgtgtcaggttgtaattgtaattgaagtgttaaagacttcgagagtggtaaattgcatttaatctctcagtagtccttaagtgagtattcaacagttatcttcctaaataattggcattgctaatgagaagagttaaatcagtttctatctttaccctgttggagtgtggaattaacaaactgggaaaatgaaaactttcaactttcccagaagagagtaaatatgcaaaatgccatttaaaaaaatataactcacttacaccaaggagagcggaaatgtaagtctggaacattttgtggagaggagcaggtatgaggcaaaggtacagacctaggaattaagagcacgtgaaccttggaactccctacacactctgtttccttctctgtcaaatgaagctgcttagctagagaagatctaaggcccattttaatgctaagatttttattatttctgtttctctgatttttttcatcttctatttaaatctgtgtggtagatggctatcttcagtcatactcccaatataattttaatccccccaaaagtatatttatcatatcagttagctcttgctattagctcagcactgtgttggtgagattgatccatgttgttgtttgcatgactggtttgttcatttttattgctgcatagtaatccattgtgtgaatatactataatttatccattttactgtcactggaaatttgcatagtttccagactttggctactccaaagagccagcaagttgtggtcttgttttctggcatacctgtgtgcaggaatttaaaactttctctttctccttttctttgaaatataactataacagatcctattatgtgttgggtttagtaaactttgtgatgagtgttctccctgaaggagagggcatttcttacttagatacaagaaattatccttaggcttatctgtgtagacatactaccagtgactaaaggatcactgaaaacatgcatacagtttctagtttttaatttgatcttcattttaagtgccttctgtgcatgttggggtttttggtgtttttcacacatctgattttttttcagacgtgtgtttttatatcagactccagtgaattcttttggtagtggacaggtcgtaaagtataaataaatccagcagaacatacttgccattcctcttgtaggcaccctctgcctgtcctttatgtgtgctgggcttgccccatagcagctgtggttgctggcatgtcccgctgtgcagtagctcgctgctgctgaaccccctatgcaacaagatcctgggtggggaagggcagctcaggtatgatgtggccaggactcgaagggagccaatcaagtgtgaatttcaaaactgaagacatttgattagtgtgactctactttgtggatcatccaatgcaaccatctctttttacaggtggagacctgggtttagagaggtcaagtgacttgtgcaagtagagaccatgtcttttgctgccgtttccgttgcagcttatatgaaattattatttatagttgagagggtaaggcagtatgaaaagaagacagtgtgctcacaatttattatagtttttggcaataagagcttctaaattaggtccagaacaacatgtgagtttgccttctcctttttgcaaatgacatacagcatcctttcctctttggattatgttttcagtgtttttatatgggtcataggtttattttggtcctaatcacattatgcagttaggagttttgctgctctgcctgaagaattctacattttactctatttgttttgactacaaataagacaaaatgtgtctgtcaggtgaaggaacatattcactctatggtgttggtagtgacctataattatctcaaatcttttgatttcaactttgggtgcatgcttgcttctggacagctgttgcagccttgatccgcctcttgtctcttttcttcccatggctgaaggcctggtggtgtccttctgcctttggtaccatcagtctctgcccacccagcttaattggacagaagctctagggggcaggtgatcaatcataccacgactcatttgcctgtgcagtcattcttagtagctttgcctcgtatcattttgagagcagaaagtttttttggggctgcttatttaagattttaggtaggaggtgaggtaattgcatgaggcagaattaggtattgataaacttggtcctgagttttattggaaaggtgtaggttgactggagtggagggagatgtgggtttcactggaactatccagtgatgggattgttctgactatgatgctgtagattgaagatattgctgctccgtcaccatgtggcacctcctcactgttactatttcattgaagatcagtggatacggatgaaagagctaataatatttcagtggctggtggatgttctgaagccaaggatggcgagaggttgctgctaattcagagattaccaaaccttcgccgttcctcccactttgtgccttggagtccccactttctgcacctgtgcctttcatcctttagcctctttgtccagtctttactactccttaggctcacccttgtccctttgtcctcttccttttccttcataccctgaactgctgttagtagaaaatcacagtaaaggttcacacatttgttgtacttggaataaaatgggatgtttcatgtttttgcttgaaaaataactgagttaaatccttatagatacaaacataaagatatcccaaacaaaattgtttctacttttaagtttgcttgggggccatggtggtttacccccactgcatttgccgagcagtggagaaaaatgaggtggtgattgctgttttgcaatgaacctgaataattattccacacccccaatattttaattttgtaccccttttgtaaacaaaaaaatgacattggccaggagaatgaggactctacttacattctaatttgttttttaaaagtcaaacacaccgctaatgttataagagaattggtgctttgtggcttaccacattacccacttggaaaaacaaacatgttaattctaaggaacatactgatttgatggtacaaaagtttcccagacctgttgggtaagtctgtttgtctctttctttttttaaatgaaataattatgggagactctgtagccatgtcccagctctgccacttacttaaatatccctggacatattacttgaactatttaagcctgaattttctcataagaaaaatggggttaatgattttacttagccataagattgttgtgtggaacgagagtaaagcactgacgtcagactgagcacatagtaaatgctcattaaatattagctagcagcagtttttttttttttgagattgagtctcactctgtcgccaggctagagtacagtggcatgatttcggctcactgcaacctccgcctcctgggttcaagcgattctcctgtctcagcctcctgagtagttgggactacaggcatgcgtcaccacgtcccgctagtttttgtatttttagtagagtcggggtttcaccatgttggtcaggccggtgttgaactcctgaccttgtgatctgcctgcttcggcctcccaaagtgctgggattataggcgtgagccaccaccagcacatttctttatagttatttgtgtcggaggcaggaaggagccacacagcttggagaagtaggaggagcgtaggttttgaagacaaatagacatgggttcagatttcagctcactagcaagtttggtatgactttaaacttgtctgagcctcaggtttctcaactgaaaattaaatttctatctactttatcagtgttttgaggactaaatgggctagaacatgcaaaatatggtgaacggtggagagccgtgacctgcaatgttttttttgtttgtttttttgagatggaatttttgctctgtcacccaggctggagtgcagtggcgcgatcttggctctctgcaacctctgcctcccagcttcaagcaattctcctacctcagccttcccagtagctgggattacaggtgcccgccatcacacccggctaatttttgtatttttagtaaagacagagtttcaccgtgttggcctggctggtctcgaactcttgaccttaagtgatccaccagcctcagcctcccaaagtgcagggattataggagtgagccatggcgtccggcttgcaatgtcttttttagtgtggattagtggtataatgatttaagatttattgggcactttacatgtgccacacacagttctaagcaggattagaaatattaacttgtttaaacttcacagcaattctaagaggtagctactactattgttcttattttatggataaagaaactgaagtttaagtggttaagcaacttgcccagggtcatagacctctatgttatagagctggatgaacttgatatgaaggtggagtccacagtattgaccacagatctggggcttttaggtgagacaaaccctttcctcctgagtgtgctttttatataaaaggtagacatttccccagcaattgaagttggccgtctcagtacctttgggtgggggtagttaagtacctctcacttacattggtaaataactcataaatattaatgacagcccaagtcaactcttggcctggaccatgttgatttttctgttagtgttcacacctttattttaagcttatccctggtggctcataaatgagacactgagggaatttgtttcctgtgccttttcaatgtaaattattggctggtgatgatgatagcatattaaataagcttaaccttggaagcttagcctctttgcagaatagagaactgtaaattgaagactccagtgttctcttacttttacaggctgatacagggtatgccagctgctaggattaggctaggaagcaaaagtgattggtaaaggagagtgggtcttgtcagtggtgtatgcagaaggaagagtataatgtgtagcagcaaatttctgtttgatggttgaggactataaaattggctacacagttttcagtgaaagacattttctagaaaggagtgtgttacgtgcatatgaaattgaagttgtatttctaggaaaatattcctgaaactttaaaaaagttttttagttagtgtttgtattactccgttttcatgctgctgataaagacatacttgagactgggtaatttacaaagaaaaagaggtttagtggactcacagttccatgtagctggagaggcctcacaatcatggtggaaggcgaaaggcacgtcttacgtggcagcagacaagagacagtgaggaccaggtgaaaggggtttccccttataaaaccatcagatcttgtgagacttattcactaccatgagaacagtattggggaaaccaccaccatgattcagttttctgccaccaggtccctccaacaatatgtgggagttatgggtgctacaattcatgatgagatttgttagggacacagccaaaccatatcagtgtctaaaatcaagttttgaactaagagctacggaatgtatgccatttctctctggggatctgaagtcttcattgttgtacagttgtatgcctcccaaagttgtgtttattaattgtcacttctgatggaaaatggcacatttccatctccatgcttcttagaagagcctgcaatttacccctgaagtttgttgaaggcacagagctgagtaatgtctacatgtgtgtaagtgtacatatatgcacaggcatacagcctttctctaaggggttagaaaagataaccttgatagctttcatgttgaatgtgtgaggaatacagaattgtgaataggttttgttatatctacccctctgttggcaacgggacactaagtcaaccttttcttatttcttctaaacgggaaacataactacagcatagagaccaaggaggtggttggaaagataaccgtatatgttgctaagcggaaaaagtagcatcatattgcagatttaggaggtccagtattacttacttaatagttgtttatttttttaaagtgtatatctgttttagaagttctatctcttaagggagatagagcgatttaaaaaataatctctgagggctatctgttcttactcagatattttttaaggaccttttaatttttatgtacttgttaaatttttgaaaggagtgtgtgtttaactccttacatacttagtccttgccagggtgaatggttaaattagacgtgcaaaaagctccacatcattgcctgctgttggcttgggtggaagtaaggagagtatactactttaagttttcactttctttttgtcttcttacagtgtcattcctttgtccctcccatagattgacaggggagtgtgtctggtcccttgacttctgggccaaacatgcttaaactgcaaatctgaagcttgaagggaaagaggatcataagaatagttttgtggtgaattgtagatcacatcccacccttctctttctcctttatggctgaatttttgacatctgtgcagtgctgttgagagcaaagaatggctggggctgggtgccgtgagggtggggggtacaggggaaagccctggaatagggttagggtgttgttaaccaaaaaacctaactctgtaaaatatttaaagaggtttattctgaactgatatgagtgaccatggcctgggaaacagtctcaagaggtcctgagaaagtgtgcctgaggcagtggagtttagggagacagttggggggcaagttacaggtcataagtggattcaaagattttctaattggcagttggttgaaagagttaagctttgtctaaagacttaagtagaaagaaatgcttgagttaagatgaggggggttgtgagggtcaaggttcttgttttgttatgcaggtgaagcctccagttaagcagccttcagagagagatggtaaagatctcttttctgatcttaaaaggtgtcagactcagttaatctctcctagatcctagaaaggcctggctgcattaatggagattcccccatgcaaacggacattttccgcatgcaaatttctcccatgaaagatggttttgcagggccatttcaatatatgtcaaggaaatatattttggggtaaaatatttccatttcctcagtgtctgctctctgccgtgtgacgctataccacagtcaggttggaatttggtatcttattgccgcaaagagtctgttttgtcagtctttgatctctattttagtgttaatactggtcgttttgcctaaactccaaaagggagctggtataaagaggcgtgtccaacttcccttcccatcatggccagaaattcagttttttcagacttctctggcgtcctcttggccagcaggaagactgttcagttggtggaggggcttagggctttgtctttggttcacagtgtggatgcacgactcaaggggttgacgcttagctctttgacatgtggtgagaccctcaaggatcgaagaaagcaggatgtgtccacagcttgaaataatccctcttctattttagagggaagataccaagaaataaaaaaagagaatctgtgtcagtaaatcctttaaaaaacactgggggtggtttgacaaactgtacagttcgttggtttctacacttcatccaggattggtttctgaataaagttttggctgtggtggtccattctcgtggatgaaatacgggtcagcttgctgaagcattggcacaactggcatatggataggtctgtgctgaatcctggctgctagaacaagtacgctgtgagctttttgcagttacctgtttctgatgaatttgtagctgaaaatcttgtcacagaagttgcttttcaatagaggtgggtatttccttgttgttgtttttttaaaaagcaaatttctgacttgttaacccccgaggctttctaagaatgttcttctgtttggcaggttttcttgctggtttattctgccttttcttgttgtatttttttctgccctgcagctgacattttgaggacaggacgactcccaggcgtcaatttcagagttcaaaaaccagagaagaaaattgcatcttctctctctcatgtgcagttaactttgactttgacaaagattcactcacccactgggatgtgagagaatgttacagaggatttggaagctgctaatgaaatgagtggtctgccctgaatgtggcttacacacacacacacacacacacacacacacacacacactctctcactcacactcattcacttccctcttcccacccccgacaattctatggatcctagggctgggataagtcctcaaaggttatctatagtttagatacaactcttgcctgccttaaatatgcttaaatatgccaaatatttctcaggaccagaagtttatataaagtacatcatggcacagctgttcttacagagccccgaagccagcaacaaggggagataaattccagagagaatgagttaaactgggcaattaagttggggaagataaaatgtttagctgacatatgacttaagattctcagtgaggtatggacatggtggtgttctcctgcacttctctaaccataaagttctggaataaatactttgtacaaacctgccttcccttctgccccatactgctttctgattaagagaagggggtcagagggctttaattctatgctagtgaatagctgtatgtccttagacaagtccaggactattttattagcagctggcagcttcagagctgaacactatgctaactatgttatatgtgctttatataaggatatatatagagagaagaagttggctgaatcttggagggaaaagttcacaaatccattggcgtaagtgggagaatttatcccagtaattgatatatcaaatgggcagaaaaataaataatagagaataactagcttgatctagtggacacacatagaacacagctttcacaacttggaaagtacatatttttaaaacgtggtacatttatgaaaagtgacagtgtacacacctcaataaatgttaaagaggcagtgttgtgtgggccacttaagtcaaaaccaattaagttagaaattaaagacaaaaggcaactaaattgcacagtgctgtatgaatgcgagatatgctttattcctttcctgtattgaacataccgatcccagctgggaagagctcagtcttggggagctaacccagaacagagcaatctgagcaaagcaaatttatccaggttactagtattagatgctgctcctatgtccttttgagggacctggggtgaaaggtggtttgtgggaaccactatctgcttcccagttaggcattttgtaaacataaatcccaatccttccattttcttaggaggagagccctgaaaaccacctggaattctttgtgtgtgggaattctgggctattccagcattcctgtgccctgataacatagccttttcaatgctgggaaataaaactgtcttactgttcatgtttagtttagttcataaactaaaatcatcagctttcacaaagctgtgagtagaagctttgtcaatggcagattttatactctgagtttttctgttaacaatttaacaattctcattttagagggtcttgcaggtgtgtgcttgtgtgtgtaggaagcaatttaggcatggacctgcctcatcggggtgctgagacagcgtgctgtagagagaagacgctgggctcagaagcaagcgagactgtgtcccctggaacaaaagccagtcgtttctcctttctgaaccttggataggacttcagatccctaccttgaagtagcctccctaccttgaagtagcctcagaaggagtagatgaaaccaccatgaactttaaacagccctgttttggcatatagtaaatgtcagtaaatgatacctattgagattgtcatctgcagcttcattcattcaaattcacagctttagaattcagaatcagttgggctgcctcatacatgcattatatgcttgcttttattcattcctacagatgtttgagaaacagtggtaggatctggaagttcatgttggtatcctttgtccatggtgagttcccccaacaaatgaatagaagaagaaatttgattgaaaggattttgaagttggaaacgattttccttctttcattttgcactcaaggggaaaaaggtccataaagttagaatgatttaccttgagtcatagttagctaaataggacaagagcaacatggtggagctcatcctcatagtcatcgtgatagcatctctgcatgtgaattcatttcacaacctccttttgtgaacactattgcagtccaattttacatggtgactgtaaggcacttgcccaaggtcacacgattccttccctgagctgtgtagctgcagatcttacccttctactcagagccctgtgtgcattgtctctcacatgtgtttaatcagtttattaaagttgatttgctaaggccatccacgtgtcctcaggcaagctgtcattttcaacaaaatgagggtgatgtgtaaaatgttctcagatctccctgaaatgtataccaatctctttgagatgatttaaaaccagcatgggattaacttgcatatacagatttatgcaacttggttcttctgaaatttattgaatacatcctgctgttcacttcctaaatggggtcattcactcctcccctggggacaaccataccccaccttctctaatcatattttctctggccattggcagaacaatgtgtgaggttagtacaatgtcttttctgtggtaatgttgcaatttagtttgatctttttcttgggtatcagaaattggtgaaaacataactgcagtcacccttttcttgtcaatgttggtttcctccactttgttcccttttattactccttcagtaacagggttctggataccttatagaaaataggacatttgcttagacttgtgggtcattctgtctgtaaggtccctttaggtagtgaaagggcagctggatgctgccctcacctgttccccccagcccacacggcacccctgcttctagctcaggcctccttagtcagtgtgcccctcatgcgtcttgctgaggaattctggcagtctgtcagagctcttggcagtgtgctgtgggatctataactctgccaccagtgagaactgctgcaagggaagctggaagaagggtagattaaagacttcagttttgcattaatggtgcaggtggggcaggaagggtggcttggagtaggcaatgatgtggttggtcatgtagattatatatttattattttttcttatatgttacatactcaattaacaaactcaataagcaaaagatttaagggaaaaataattatttcctttttatttgagacggaggctctctctgtcacccaggctggagtgaagtggcgcaatctcggctcactgcaagttctgcctcccaggttcaagcgattctcctgcctcagcctcctgagtagctgggattataggcatgtgccaccatgcctggctaagttttgtatttttagtagagatgggttttcaccatgttggccaggctggtcattatttcctttctaatggtaattaaaacattggtacacttcctctgaatgaaaccatatgaacacatacagccatcattcttgtgcactctgactcaatgatatgcgtcgctggaacttcgcttccgcatctcctcacagtcccttctgagccccagtgaagccagcactgtgagccaatccaggcccctggtttggaatgcctggttagttacagtcatctcaggggcccttccctcagcaggtcaagagacattctctgctgggcaggacccctcagaaatcttaaaggtgctctactttcaaacagaagcaaacattttaaatctcatgttttctctatcagcttaagatgctggcccaaaaggatctcccttagaccctatcccaagtaatctttatttccatttggaagttgggaaatattctttatttccatgtgagaggtaatgtaggggttatagatgccagcccctgttctcagggtccttatcctatgtgcctacagacaagccatgaatacttggaaagtgaagtactagcattcacaaaagtgaggtgtatgttttgatattgtagcatgtgtgcacatgtaccaatctacagtctatagttagagtctgtatgtatagatgtatatttacaatatacatacatgcacctgtagacaggcacgtgttgtaccaaagagacatgacgtcgagcttccttttgatgcttgggaaggcctccaagggttaaattgttgagacaagtgccttcagggatgggttggattttgagattgtaggtgaggagtgcataccatagccagtgggattggagacacggtgtcgggtgtttggtgtcaaaatccgaagtcttctttggactcctcagggatcattttaggtggtgatgatgatgagcgagatttggcctctatgaaatatatgctgggttcccttgtgggtttcttggctggttgagctgggacctttatccttgtattgctgaggctggggataaaattcccagtgcctctgcatcaggaaaccgttagctgtattatgctaaagcaaaccctgtctaaggaaaagcccacctggtttatcacccgctgttgggtggaggtgtttgagcaagacaggagggtccctggcctctcacgttggtgacagcaatatgtcacaggcaaaaatgatgacctcatagccttagaaatagtggtaagtcattcccaaagatggacatgcctcagaaattttacagaaaatgtctttcatgtcattcctgcagcaaaacaagtagaccctgtttgacagattttacttcaactgggaatgcatgcacaattatgtctgtacacagtatggctttaactttcaattccagggctgggcttttagctggtgggtcttatccactgccagcctctttgtctcaaggggaaaaatgcttttgtgatgataaaagtacaagatgaccattactgaaagtactataaaagtggaggaataaagtagttactctgaatcctatagccactaaccattatgatagatttcctcctagtctttttctctgtgtatatttaaaagtttatgacttttccagattataaaaatacatgtggaaaatataaaaaatactttaaaaaatcacatgaatatatgacttaccctggagataaccactgttaacattttagtgagttttcttagttttaaaaatagatggatatgtgcatatacttttgttcattaaaattagtttatttttatatagtttacattccattaaattttatatttttcaaatattgagaaagcttatgaggttactgaagccaaaatataatttaaattgataatttgttaaatggatatgtcaaaacatatgtaatcatttcctgtatttgtcatagtgggaaattatcttaatgctatggtagcctccaaggacactatcccagaagtcactaacagaaaggcttacagatcagattaaggtgattgagtcattcgattgattaagtgaatttaagcatacaaggagaagcaagaggaaggagacggagtaggttaacaaacttaggtccatcagggtagatggaccacactgcttgtatcctggcttgggcatgtccagactctatgtctgcgacactctgttccacaccagtggcatggtcctgagggccagatctgagaatgagcaagggtactcaagagacagaaggtgccaggagcccacatacttcctctgttagagaaatgcaggggctatgtctggcaaaggtatcacttattgacagcccttcttgagtgtatccagagcttgcttttttttttttttttttttggcatgtctcaggcaaacaagtcgggtcagaatgtcaccactgggtggctgatcttggatatcgatgaagactgagccaccacttggtttttctatcccttccaatctgtgttcagactgcatacgctcttctgtcttcatctatggctgatgtctctcagctgtgtgcttgtttactttctgtacttcacacaccttaggcgtttcatctgtcccatttggttttgttgtcttgttctctacagcatagctgaacatccttaaaacacacattgcactggttatttcaactttttactcataagtaatactttaatggagtctcttcatataaagctttattagtatttggggatggattatcagaagtggaattactgaggctaaagtaacatttacagggctttttttttttgtgtgtgtgtgacagctttgctctgttgcccaggctggagtgtggtggcatgatcatgactccctgcagcctcgacttcctgggctcagttgaccctcttacgtcagcatcctgagtagctgggactacaggtgtgcaccaccatgcccagctaattaaaaaaaattttttttgtagagaccgggtctgtgttgccagggctggtctcgaactcctggactcaggcaatcttcccaccttggccttgtgttggtattacacgtgtgagccactgcgcccagcctttttagggcttttatcgtctactgtaaagtaactattgaagagagaaataggagagaactcgtattgcaactttacactcaggtggtctctcgtgccccatcctgtctccaatccctgcccctcccttgcctctcttgttttttttattttttttctcttacttaaaagcttaaaaaaaaaaaaaaaaaggacagtacatccacagagggtggataagtagggaaaataattatgactcctacctctgtctctcaggtaccagtttccttcctcacagggaaccttccctcatggtttatgtgtgtatttttaagcacaagtgatagtataccacatttacttttcagtattttgctttatattttggaaatctttgcacataagtaaatataggacttctggttcaggagatttaaaaaatggctgcatagtattctatcatatggatgcactgtaacttattcgcccagttccctgttgatggacatactttggtctctgatattttgttattcttaggccaggcaccaatggctcatgcctgtaatcccggcactttgggaggctaaggggggcggatcacctgaggtcaggagttcgagaccagcctgaccaactggtgaaaccccttctctactaaaaatacaaaaattagccgggccttgtggcttgcgcctgtagtcccagctacttgggaggctgaggcaggagaattgcttgaacccgagaggcgcaggttgcagtgagctgagatggcatcactgcactccagcctgggtgacagagcgagactctgtctcaaaagataaataaatattttgttattcttaatattgatgaacaaataacattttgcatatttgtgaatttatatttaggagaaattcctaaaagtagaatttttgggtcaaaggaatataaatgtatttgtttgtttgtttatttatttatttattcatgtattcattcattcattcattcattcaagatggagtctcgctctgttgcccagcctggagtgcagtggcacaatctcagctcaccacaacctccgccttaggggttcaagtgattttcctgccccagcctccaagtagttgggattacaggcacgcgccaccatgcccggctaatttttgtatttttagtagagacagggtttcactatgttggccaggctggtctcgaactccggagctcatgatctgcctgccttggcctcccaaagtgctgggattacaggcgtgagccaccatgcccggccctagaaatacaaatttaaaaaatggataggcattgcctaatttttcttcttggggaaaagatgtaagagaagttctgttcccaggacttctgttacctacactgttgtactttctgatcttcgtctttctgacacatgaaaaatagtatcttttttaattttgcatttctctaagtggagttgaacgttttttgacttgcttgttgaagaactgtcctattttcttttctaacaattattcatacttctgtgccttttttccctattaggtggtgttggggtctattattcatttgttagagctcttaattaagttagtctattgttttagtcgtgaataatttttcctatatcatttgtctttatagtatgtattgccattcagattttttattagatttagacccagtattcccacttttgagtgtttacccaaaagatttgaagtcagtttatggagatctctactctcatgctcattgcagagctattcacaatagcaaagttctagaatcaacttaagtcccatcaacagatgaatagataaagaaaatatggtgtatattcacagtggaatactattcagccttaaaaaagaaatttgtcatttgcagcaacttgggtagaattggagaacattatgttaactgaaataaaccaggtacagaaaaacaagtaccatgtgttctcacgtgtggaatccttgatctcatagaagcagaaagtagaatggtggttaccaggggttgggctggttggggagatgatggtcaaagggtacgaaggctcaattagaggaatgtcttttttttcatatgctttgggtatattgcacagtgtggtgaagtgaatatagtaaataagaatgtattggatgtttcaaaatttcaaagtaaatttcagatattctcaccataaaaataaatatttgaggtattgaatatgttagcctgatttaattattccacattgtgttcatgacatcacatataccccataaatatagttgtaatttgtcaatttagaatttaaaataaaacattttaagtttaattcagtcgaaggtatccatcttgtcttatgtggcttctagtttttgtattatacgtgggccttccccactgaacctgaaaacatggtagatttttttccccctaatactactatggatttgatgttcatccccaaatcattatctctgagaggaatgggctagaagcctgtttttagagcctcgggtgagcctcctgaagccgtctgtttgggaatcattgtcttgttgttacgtgtgggtgtcccccaagtggtgtgatccatcatggaaagaagagtctgaactgcttcaaatatcgcacactgggaataattattttttttacttttttctttttctcttttcttttttttttttgtgagacaggtactcactttgtcacccaggctggggtgcaaaggggcaaacaaggttcactatagccttgacttcccaggctcaggcaatcctcccgtcttggccccctgagtggctgggaccacaaacacttgccaccatgcctaatgtcgtgggttgtttgtttgttttagggtttcttggtttttttgtttgttctgtttgtttttttagtagagacaatgtcttgctatgttgcccaggctagtctcgaactcctggcttcaagcaatctgcccaccttagcctcccaaagtgctgggattacaggtgtgagccactgcatccagcattactgggaataatttgaatttactgaaagttcatgaactttcatcaggccagtggattgttatgtggttcccagacccagccagcagtgaactgctctccagagccctttacgacatgctgcccactgtccctgttggcagccacagtcctgtcctggaaatgggacccagaacagtccctgcaatacccttgcaagagagaccagaccttaacctttttttagaaaagcattgctcttgcttcacgtgacaaatggtgatttagcaacaaaaccatgcctctctgtttgtttggtttttgtgaatttgcttccatggtctgttgaaagggcctcagctatagtgttttagccacaatcatttacctgctgtgtgaccttgggtaagaattccacttccccagtcagttcttcctcagaacagtgggaaacgagatgccccacaattatgaagattaagtactgagtctgataattttcatgtaactgtgtatctagatcagatggcagttagcttcaaatttttatgtgtgcaggaattcatggggaaggggttgttaaacatgtggattctaggctgggcgcgatggctcacacctgttatcccagcactttgggaggccgaggcaggcgcatcgcttgaggtcaggagtttgagaccagcctggccaaagtggtgaaaccctgtctctatgaaaaatacaaaaaatagccaggtgtggtggtgggcacctgtaattccagctacttgggaggctgaagcaggagaatcgcttgaacccgggaggcagaggttacagtgagccgagattgtaccattgcactccagcctcggtgacagagtgagactctgtctcaaaaaaaaaaaaaaaaaaaaaaaagtggattcttgggcccaggaatgggatcatcttcagtgattctaaggcaggtagcccatgttccacactttgagagccttaagttagattcagggaaagctggtcagggggatgttttccatgatggctcccccatcccctaacccctccctcaacagtgatctgtctgtttgtagcttatgtttagttgtaagagccctaattcaggtttttagactccaaggatcattataaatatatataataatagataagcacatctatatagaaggagagggaagcagacagacactaagaggattagctgctttttgttctgagagtaattgtatttttctttctcatctcatgggttacttaaagaagtgaaatttaccccccataaaaaatgccaggagggtttgaattatgatggcaggtatttagatgtctttcttggtgttagcagatgctaggaccagggctgtaggcttccctggtgctttggctaaggagagaagttggtctttctgtccagcaacctgtgggcagctgtgtagaagggccccatgcagcaagccctgtggattactctgagtctgtggtgtaacatgcatcccatctggtagcttttaggctcaggtgattggctgctgtttgcttatggtgtgagccacagatggttgcccattgtcttaattaacaagaagcagtcacttggctctgggatggggttactccggtgcttccaaatgttagtgtgaatatcagtcaccaggggttacaatgtggattctgattcagcagatccagtaggagcctgaggatctgcatttccaacagactcccaggtctagtgtgtagggatttctccccacagtgtgtagggatttctccccacatactcaccaagcaattctccaggggattgattctcctgcagacaccagctgggtatcctctaattcaattctattttgacactacctaaagatagtgtcaggtcctacaggttgatggctgagtcccacaagactactctccacttgagatgccagtggccagcacagattgtggcctgagctgctgactgacaggctatatgctgggggttcccatgacacccttttcggactcaatttaatttgctagaacagctcacagaactcagggaaacatcatggaaaatatgcatagggtgaagtatgggagaaggagcttggagcgtccatgcccactccgggtggatgcaccaccctccaagaacctgcatgtgttcaactatctggaagctcccagaacccagtccatgtgagtttttatggaagcatcgttgtgtaggagtgattggttaaatcatttgccattgatgatcaagtcagacttcagccccgctcccctcctctgaggttgggagtgggcctgaaatcagtcccaaccttctcatcaggttttgtgaccagcccttatcctgaagctggctaggggcccctagtcatcagtcatcttactagcacacaaaggcactcttaccactctggagatccccagcacttcaggagctatctgtcaggaaactaggaacaagaccaaatatatatttcacagtactgtgaggcagttgcctctgttctttctgcttctctacacagaattaggagatggtgggttctgatcctggctctgcccctaagtggcatgcgacttccgggaagtcctgcagctctgggcctttgctctgcctaagctctgtgagggcacagggtttgtctgccttatttgctgctaggtatggtatcattttggaaacttgagtagattttagtgaacttccctgtgtgagtagaaagtagggtagatgtgattttactgtttgggagccacattcctttgtgttagctgtgtgttaagaacacttgctgttattcttcctactgttctacaggaaattagacgtggctgcccatgggagtcatctggcactcaagtgccactggggcacttccaaaactcagaaacctccccagcactcccagattctgatgtaattgatttggggtacagcctatgcgtcaggatttttaaaacctccctaggtgatctatggcagtggtgtggtcctggctacttgggaggcagaggcaggaggattgcttgagcccaggaatttgagaccagccaggacagcatagtgagaccctgtctgtgtgtacacacacacacacacacacacacccctctctctccaggtaattctggtatttagccaagattgagtagtattgggttagataacttgattttttttttttttttggagacagtgtctggttctgttgccccggccagagtgcagtggcacaattgcagctcactgcaacctctgcctcccaggttcaagcaattctcctgcctcagccactggagtagatgggattatgggtgcctgccgccacgcccggctaatttttgtaatttagtagagacggggtttcactatgttggtcaggctggtctcgaactcctgacctcatgatctgcccgcctcagcctcccaaagtgctgggattacaggcgtgagccaccgtacctggccagtatgttttaaagttattttaaattttcatacaataactcttatgtgtgtgtatgaaccgttctcacttttgacaaatgcgcaaagtcttgtgactgctaccgctctcaacatttctagcatccagttttcacaaatgtacttttggagttttgctccttggaataaacattcggccttcctttgacatttattattattgttactattattgctgttacttctgaaatccagtatcttaaatattgtttaaatttcaaaactgtttcctagcccttctttgccatgtagtttggagaccctcataatcactggtttagtggtttacagtgtttgctgcacagtagaatcaccgggggatcttttacagctacaacaaatgctcaggcctgggcttttttaaagctgctcaggtgttgctaatgggcagccaggcctgagaaggattctctaggattctcccaaggcactcacttccaggttagaggtcacaggtcacaggtcttgtcaattccctcttcccttctctcatccgtaggggcttctgatatcttgttttttcttctgtggcaccaatttgggtgcatttttgaaaagaaggaatccaagaacaggactaattagtacatattgattattggagatggttaaatgctgttaataaatttttgtatttttgcctacctgcagtggaatcctgccgatcttgacagcacgtgtgttttgtctgtcctccctagggtgtctgaacagcgctgtaatagtgtagatggtagatgtgccatctgtgcgatgtgatatcatctgtgggcatgaaggaagagatggatgccctctccttgggccttgtaaagtcagcaggatgctttcctgaccgagctattcgcaagaataggtgctctaatggtaatttttaaagaactgttttaaaagttttagtagacatggaataattgtacatgtttataggatacagagtcatattttgatatgtgtcattatcaagtcagggtaattagcatattcatcacctcaaacatttatcatttctttgtgttgggaacattcaaaatctactcttctagctgcttgagaatgtacaataagttctggttaaccacattcaccccacagtgctgctgaacactagaactcactctgtcattgtagtgtttttttttttttggacggagtcttgctctgtcgcccaggctggagtgcagtggcttgatctcagctcactgcaagctccgcctcctgggttcatgccattcccctgcctcagcctcccgagtagctgggactacaggcacctgccaccacgcccggctaatattttatatttttagtacagatggggtttcgccgtgttagccaggatgatctcgatctgacctcgtgatccgcccacctctgcctcccaaagtgctgggattacaggcatgagccaccgcgcccggcctgtcattgtagtttttaaaaggcgttttctaaacaggtggtgttcaaggaaaaccttcacctctaggactgacaagctccttgatatttgggggttggggtctaatcttcagtagtacttagtccagaagccaaaccagtttacctggaggtctcagctcctagaaagtggagtaatgccataaagtatctaaaacactgtaaaaaagatgatcttatttgatatttatataacaaatctattttatggatgaagaaactgagcctcagggaaggaagtgatttacttgcttagtccctcagctgagcttttctcttttctctgcccacagtcttgattgctcagccagtgtaagttagggttatctgagaggtggaatgatggatgagaatgttaaaggattgtttgaagagtgggttgggaggtgcagttctagcaacttcaaacctgattgacttctctgctcctgtgctctggggagtttctggtctcaatagcccagttcaagcatctaaacagggcatcctttccttttgatagtgttgaggaggctcctcagtgtcttgcccattccctcattctgccacagtgctccacctcccacactgttaagagcagcagccttggctggtcgtggtggctcacgtctgtaatcgcagcactttaggaggctgaggcgggtggattgcttgaggtcaggagttcgagaccagcttggccaatgtggtgaaaccccatctctactaaaaatacaaaaattagctgggcatggtgatgggcgcctgtaactccagctactcagaggctgaggtgggagaattgtttgaacccaggaggcagaggttgcagtgagctgagattgcgccactgcactccagagcctgggcaacagagtgagactttgtcatacacacacacacacacacaaaaacaccagccttttctttgtttttaccaatctaatatcctctccattcttccatcaagagctcaagagtaatatagtaatggcccttggatattaagcacctacacttctggcctattagccctaattcttataggaccacttcaaactattgtcatcaatactttgcattgaatgcaatataattacccaagccctcagagcctaaagcattagattggaactcagctgtgtcagatgaataaattattttcaggttgtatagcagaaagttcctttctgggacataggtacatatagcaacaaattctgtccctgttgtgtaggctctaggacccctttcaaacatccttcctccttggttttagatttggggttttagtttgatttctgaatctacaggatttaatgtgcagtttctaggaggcaaaaagaagttagttgtacctgtaaattagaatgttaaattctcccctctaacctctttctatgtaaggaagtatatatccacttgatagactcaggccatttgtgaatcaataaacctaggactgtcattctgaaaaattgttacaatttctaagaacaaatggaatgctttaaaaaaatgtaggggtaagtatatcccatttgatctactttggagagagggtaagtgctttattacctgctgattaccataataaaacatctctgttcttcagagaaacataaaatgtaaaagatcttaaagtatagtagcttacttctggtaggggatttaggagattcagttgtgatttgcaaagggagaatacccatggagtctaaatttcagggccaaccacagcaaaaaccatagcttacctgccggcaaagatttgatgactttctctccctgctcttcccttctccacccttagccaaattagaagcagacattttagggagcttaagcaatgaaaatctgaggcagtgctgatagaattgaggcgtgctttcttggaagcattttcatttttatacaggtaagatgttgggagtgggagaaggttgtcctgttacagtaaatcatgtgtgtgccaagattgagtggtgggtggggttgaaaccttggctcgctgtgctgtgaatagtccttaaggtggtgatggtggcattctcaacaaatctgtcacctagtgggcccatgtccagaaaaggacagcatatatgattgaagtgatagtgcaccttcactgggaggggctgttccagagattagaggtctataggcagactaagacaagggcctgaaggaggatgtgattaaagtcagcatcactctgaaagggcatcagcagagggagtgcagtttgtctaccaaatacctgagcactggaattagtgggcatcttggaaactagaagaaggtagttccagtgcctggtggggccgggtgggtaacccgaggggctcattatctcaggtgaaccactcggacattgagcatctacctggcatgaagcactcattgggagagatttctaatgtttaaggagtgcttcttgctgtctatctggccatcatctacccttttgtttgcttcttttatttattaaacactaactgaagacataccatgtgccagaagaccattaactgatgacatccaggccccttttaggcacaggagaccaaaaaaaaaaaaaaagactaaaagtcaattttgacttaactactaaacctccaactgctcattttgcagatgcatgtaaatacttacactacaataaataaattcaaacgaactcatcactgtgccccaggggtccattaaatataaaaaataaaacaggctgggtacagtggctcacacctgtaatcccagcactttgggaggccgaggtgggtggatcacctgaggtcaggagttcgagaccagcctggccaacatggtgaaaccccgtctctactaaaaatacaaaaaattagctgggcatggtgatgggtcctgtaatcccagctacttgggaggctgaggcaggagaatcgcttgaacccggaaggcagaggttgcagtgagccaagatcgcaccactgcactccagcctgggtgacggagtgagacgccatcttaaaataaataaataaacttttttttttttttttttacatgagtaagcgtcttggccttcaaagagtgctctgtaaaactgggagtgacctaagaaccaattacataaaatgaggtatgcaggtagagagaggtgcagggcgttatgagaatatggacaagcagccctttctctgaaggaggggaggaaagaagtgttaaccataatctggccattttgggactgtgatgggtggtggtgaagaaggcaggaggtgagaaaatgcttgcagaagccaggacctggactttggaactctgagaagtccagcatagtgggagttttaggagtggtgagggacttgagagataagcatgtgccagaatgcaatgggcctttctgcctagggcggcatttggatttgatctcgaagggccttagtcaggggattcactgggtcaggatgcatgatccgggtggaaaggcagaattaatatactcatggggaagatcaccagggagttcagacagtaacagagccaagatatgctcatatgtccctaatgcttcatcggggcacattgggatctggaggtatttccccagtccaactcagctctgttattccactgaggtttgctctggtccctgctcatgacagatcaagaggatgactacccaggtcaggtgagagtcatgtgctttaggaactaggctgtgaacttctaaagtcaaaataagaaactgacttaaattttcgcacggggctggggatgatgggcagtggtgaaaagtgggtaggtaatcaagagtcaccccgagtagatgatttttatacctgtgttaggggtatgaggtttcactgaactattctctctacttttgtatatgtttaaaaggttccataacaacattaaaaataggaagaataatagcgtcatggattttcatgagaattaaatgaggtaacacaagtaaatatcttgtattgactattgctattattggccactgtcttggctgaatttcaccttccttcctcattctgttatttcttgctctcgactttcttggcctattctgtttccggcctggaatttgccttgtggattttggacagtttagcttttctggttttgaccctggatggtgctcccaaggacactgcctgtgtatcttctctggtccatcctgctcagggaaccaccccttccagctccccaatcgtattgcctacctggggtcagccccactggattgaaccttgtttgctcaggggtgtgtgtgtgtgtgttggaggggagaggaggggattgagatggaaagagaatgagccatagacggcacacctgacaatatccccctttatacagtgggtagcttcctgaaatgttttgtgacaattcagttttcattgcattatatttttatatataggtgtgtatatatacaacagtaaagtatgtgaatctgtgagcccatagacattattacatggatatttattgtaacttcaagatgtttgttttcattttggatgggccctcgactatcagtgactgtcagcctttttatgtatttatttttggctactccagctgctttgctatattgtggattatttgtgaacaaatattttaatatactagataaaaagactatttaaaggaacccttggcgaatactttcataagatgcaaagagtgtttatttaggactcgttaagtgccagacattatgctgggccctttcttgtccctcactgatctgtaagataatccttttgaagtaagtgttatcttcatttttactttttcaaaatcacatgcttaattcagttgtcttcccttatttgagggggttacgttccatttagtattttctttttttttgagagagagtctcgctctttcgcccaggctggagtgcagtggcaggatctcggctcactgcaagctgcacctcccgggttcacgccattctcctgcctcagcctccagagtagctgggactacaggcgcctgccaccgtacctggctgattttgtattttttagtagagacggggtttcaccatgttagccaggatggtctcgatctcctgacctcttgatccacctgccttggcctcccaaagtgctgggattacaggtgtgaggcatcgcgcccggccccatttagtattttcagaccacaattgactgcaggcaactgaaactgcagataacgggaaaatactgtatatactaggatccttttggttgcaagtaaaagaagacctaccccagactgattcaaataacaaagataatttactggtttttgtgactgagaagtccaaccatggggtgtgtttcaggtatggttcaatccagggattcgtgttggtattagggatctgatcccttgtcctaggactgtcttggctctgccttcctatgtatgtgggcctcaccatcatgctgtcttcaactcatggtgacaaaaacagcctcagaagattcaggccttacgaatgaacgccacatcaaccatagaagagccagcaactttgacccaggattacaagcagaagtcatgaaattcactaagactagattgactcaagtcatgtgtttgccttaaaccagtcattgtggccagagaaatggactggctacagtgacttggcttgacctaggatatgtgacctaggacatatgtcagcttcagaaatataatcaaggagagattgtttgctaggaggaaatgagtgctggagaggccatccacagatggccactacagggacagggctaggatgggcatgtattgctctctgtctggctccagagccttttaattttccccatagcagtgtttaatagcttctctgttggtgccattcctcaggaagcctttggtcttaagtcactccctagtggttgcccacatcatcaaattgttcagaaactctatattctcaactctaaaacaaggaggttggacttcattaattcagcatatatttgctgagtacctactatgccaagctctaggacaggggccggagatataattatgtgcaatgtggacatgtcctctgtccttttagggcttattgactagtagaagagacaggaatgaaaaatgatgagacagatgtaagatggagctctaggccagacgcgctggctcacgcctataatcccagcactttgggaggctgaggtgggtggatcacaaggtcaagagattgagaccatcctggccaacatggtaaatctcgtctctactaaaaatacaaaaattagttgggcgtggtggtgtgcgcctgtagtcccagctactggggaggctgaggcagaagagttgcttgaacccaggaggcggaggttgcagtgagccaagatcgtgccactgcactccagcctggtgacagagcaagattctgtctcaaaaaaaaaaaaaaaagatggagctctaatacacgcctggctcttatccttatcaaatagttaatgaatgaaataatcacacaaatatataatattaaactgtgttaaactgtgttcaggctacaatggggagctgtgagagcatctccagggaggactgtaatagtaagctgaaaacccaggatagggccttgggctattcaggggctggggctggcgtggagggtagtagggcccatgaggtcctttctggccttgacagactctgatgtcgtcagaattaatgaggcctcggtcctgatctctgagagagctgtaagataagttagctatcacgctttgtataataatcatttgtgttcttagagtggcgaatctccatttgagcctgctcttcatgttcatccaaatttcagattccttaaaaatgatatttcttgtttctccagaccttttaaaaaatattgtggaaggttcttccctgtaataggtgagtcctggttggtccaagcccagttcagtgcctcttccctagtctcccccagcctcccaaactcatagcgcctcttcctctgggttcgccaacactcgtggtctctgcctcctgtggggcatctgcttccttagccatctttctgtgggacttttccaaaaggttataagtggtgattactggaaaaggaggtgtgggttgctcatggattcctagaatggcttgtttccacagacacctggaagaaaaaccaacactgtgtgtacaaggaaggatcatgctttcctgaaaaaacagacagattccatagtcttttaaaggttctaaattgaggcgtgctttggaatagttttcatttcctggagaccgcttctggcttatctgccactgcgccatcctacattttttccatcaactctgtcatcatcatctacccttttaagagaaaaatcttttaaaagcaagtgggagtagaaaagcttttttttttttttcttccccccctctaatcacagcctgaagtttccttccattcctagaatggcaggttctaatggaagtaagagatggtgtcaggattagctaactttattcttagtttttttttccttatcaatgctagtggcaacacattgattgtgttaataaccccagacttgtgctaagtggagatttggggatgacctcacttttttttttttgagacggagtctcgctctgtcgcccaagctggagtgcagtgttgcgatctcggctcactgcaagctccacctcctgggctcacaccattctcctgcctcagcctcccaagtagctgagactacaggcacctgccaccacacccagctgatttttttttttttttgtatttttagtagagacggggtttcactgtgttagccaggatggtctcaatctcctgacctcatgatctgcccacctcggccttccggagtgctgggattacaggcgtgagccaccgcacccggctgttatgctttttcttttattgactgatgtgtacagaaaaattggggggtgaagaacagtacatttcttaactcttccaaaaattgcttgttgcaataacaaggcactgaaacaacacaaaaagtccacatttgtctgttgaagaggaaagagggaaagagaaaaaggatggaggaaaaggtgggttatcaggctaggcaacatttccagtgaggcagcatctttttaaccttgcatttgcatagtgtctcttgaatccaactctctttctttctctttgtgtgtgtgtgtgtgtgtgtgtgtgtgtgtcactgtgtctcaatgtgttctttcctgggttttgtggcagggttccagggacagcagagctgcaaatctcctgcaaatttgcatatcctttttatgctcaagtgaatcaatagtgaacaattgttccctgttcttggacagcagcctgaaatccatattgctctgtgtgcattggtgaaatttggtaatctcagaactcagaactcgagcccatcctggctgaggtgtagtggcagggccttattctgattgggcactcaataaatatttgtcaaatggat

SEQ ID NO: 475 - DNA, 20001 bp, Homo sapiens
tgctgggattgcaggtgtgagccacctcgcccggcataggggctcaggtttcctatcccattccacaacttcagtatgaagctcacaccctttagttcccacaacaaacagtcatgcacagtgagcttttgtcagttggtagacttgaccgagggacactggcttcctccctccttttcctctccgaccactgctcctcgcacctctttccagacccttcttcctcttttgagcagagcagctttgccaggctccaaagccctgtttctgcagatccccaaccaccaggggcctcatcttcaacccccagttcttattaaagcatttcgttcacaagaacagctctttcactgagaattctagtacattctccactactttgcacatatgtgatatatgtatgtgtgtaattgtttatgactacaggtgtgcctgtaccctagtgtgtgtgatgggcagtgggagaggggtagatggaaaataattctgagacattatccaataccttatgtttgtaccttactgcatatgtgatgtgggcagtgggaaaggaagcccccatggggggaattagtccatttgtttgtgtctccgtgtctctttttccaaatacagagttaactcccaagagcatgtacccaatcaccagctttgtgcaaattctagaaatatctattcgtagcaagactcagcccaggtaccacctactctggtaacccttcctcctagtcttgggctgaactaattgtcccttttctgtcttgcacagtccctgtatacccctccagcaaagcgtttgtcacactttactgacattgttcttttgcctgccccatctctatggtgaagctcctagaagacagggaccatggctcaccttctctcagcatcccagcacccagaatgttcagaatctgtgtatggactgggctggcctggcttcacacactcccagtaagatatttcactctcaatggctacacacccctatgcccaccaccctctctggaatgtggggtaaaccaacttacacaccaaggggcttttctcttggggtcatcacccaaggaccttcctctggccaggagaagcttgctctaaccctgaagatggaggcagcctgggatacagggtgtgggcagccccctggctgacccccactgtaccctccaccgcagggacgtccctcctcttttccgtactttctggccctggcgcgaaccttgttggcgccaatgggcttttaatattttccattcctggctgggatacaacatttcacctcaaaaatgcttcctccccctcaccaaagggcgtgtctttccagtgagaggaaccggaagctggatgtggaggttctggacccacccgtattctggggcttggaggagccacagtccaaccctggagaaagaggtggcagaaatgtcttcccagccaatgaagtgagttcccaggcctgcctgaggcctcctggacccacaggaagcctggatcctcagtgacaaagcaaggggccacctgcttgcttccatctgagactcagcccctgccctccacttgccctctgaccttggccaagtggcttcacctctctgagcccccatggcccatgtgaacagtggggataatgacagtatctagctttcaaggtccttgtggagttctaatgctgcacattcaggttatctgaggagcattaaaaaacacccatgccccactcagagattctgatttaattgctctgggatagggcttggatgttggcatatttcaaaaaccctccaggtgattttcactcacagccacagttgacaattagtctttgatgggaaagcactttttttttttttttttttttttttttggagatggagtctcactctgttgcccaggctggagtacagtggcacaatcttggctccctacaacttccacctcccaggttcaagtgattctcctgcctcagcctcccgagtagctgggtttacaggtatgcaccaccacgcccagctaatttttgtatttttagtaaagacgggggtttcaccatgttggcccagctggtctcaaactcctgacctcaggtgatgtgcccgccttggcctcccaaagagctgggattacaggcatgagccactgtgcccggcctgggaaagcactttctaaggtgacctgtacaggtgccagctgctgctttgatgatcaagggtgtcacaccactcattttcccaaaaatatgaccccagggatgcctgaaatcccactgaaatgtggtggagggaaagcactttgaagggaagtaaggggtcctccagatgagttctgtgacttcaggattcccacctgcacacaagcaggtgccttagagccaccagccctgtcccaggccaggacccgacacacctaccctgctgaccccttctgctgggcaggctaggtcctctccagagagcatctgggcttgtagctgaccaacagcctgctctccccaaccactctccccagatcctggagagtgggttgtggggtcatgtaggggtgggttgcccctccacacctgtgggtgtttctcgtaaggtggaacgagagacttaggaaagaaaaagacacagagacaaagtatagagaaagaaataaggggacccggggaaccagcgttcagcatatggaggatcccgccagcctctgcgttcccttagtatttattgatcattcgtgggtgtttctccgagagggggatgtgtcagggtcacaagacaatagtggggagagggtcagcagacaaacacgtgaacaaaggtctttgcatcatagacaatgtaaaggattaagtgctgtgcttttagatatgcatacacataaacatctcaatgctttacaaagcagtattgctgcccgcaggtcccacctccagccctaaggcggtttttccctatctcagtagatggaacatacaattgggttttataccgagacattccattgcccagggacgggcaggagacagatgccttcctcttgtctcaactgcaagaggcattccttcctcttatactaatcctcctcagcacagaccctttacgggtgtcgggctgggggacggccaggtctttctcttcccacgaggccatatttcagactatcacatggggagaaaccttggacaatacctggctttcctaggcagaggtccctgcggccttccgcagtttttgtgtccctgggtacttgagattagggagtggtgatgactcttaaggagcatgctgccttcaagcatctgtttaacaaagcacatcttgcaccgcccttaatccattcaactctgagttgacacagcaaatgtttcagagagcacggggttgggggtaaggttatagattaacagaatctcaaggcagaagaatttttcttagtacagaacaaaatggagtctcctatgtctacttctttctacacagacacagtaacaatctgatctctcttgcttttccccacagggtcaaggtcaccttgttccctttttatctccttcactgcacttggaggtaaagggcagcagttgctaaagaatttaacatgggccgggcgtggtggctcatgcctgtaatcccagcactttgggaggccgaggtgggtggatcacctgagatcaggagttcgagatcagcctggccaaaatggtgaaaccccatctctactaaaaatacaaaaaattagccaggcatggtggtgggcgcctgcaatcctagctacttgggaggctgaggcaggagaattgcttgaaccgggacctgggatgtggaggttgcagtgagtcgagatcgcaccactgcactccagcctgggctacagagcgagactccgtctcaaaaaaaaaaaaaaaaaaaaggagttaaatgtggagagaaccagttgtctgtgctaggggaggagagggtgtttgggtgcttcgtggagagagccaacatctcctttcctcctcttgagaagagaggatctgcaaacaattctacagcccagagggaggaaaacggctgagagccaggcgccttgggaaaaggcagcagagagccccactggctgaagatgctcagtctctcaccatgaccagtgtgtccacctgccccggtgccatatcccagagttaccatgttcttacacagaggaaagaacagcctctgtccaggggaggcacagcccctgtctcggggagcttcacccaaaggccaggcccccaggagagggccagaacccttggtgtcccaggcccgaggttcttcaataaggttatttaacagatctggtggctagagactcccgtgggagacttcagccccatgaggaagcgctgttttcctcaggcaaactatggttgagaaacaggagctttctggagacattattcttcaaagggtttctcacagccctgtgtcccaggctcctggccagaggtggaaaggagagggagtgagtgatggggagcatggtgtagggcaccacacagaaggcaggaaggagaggagggtcagcagtgccaccagactgagccccaaatgagggggagtccaggagaggaggcttgcacaacccaccaccttggggtagttacagtgccacccaggtttatttttccaactgagggcacactgaaaggagggtacattgaaaagtatgggcataggggaactcaagtcccctgggctgggctgtggcctctttagaagcacctacagcctcagcaaggccgggaacagggaactactgaggctgaaaaaaacttcagtctcaataagtctgcccccagtccctggtaacgctcaggctttgcagccaaatgcagattaaagctgcctctaccacatgtaagctgcattcactgattcattctacaattaaaaaaatctttttgtttttgagaaagggtctggctctgtcatccaggcggaagtgcagtggtgtgatcatggttcactgcggcctcaacctcctgggcccaagcagtcctcccaccttagcctccagagtagctgggaccacaaacacaccaccgtgcctggctaattttttattattattattttttgtagagacagggtcttgctacttcacctaagctggtctcaaactcctgggctcaagcaatccctggtctcagcctttcaaagtgctgggattacaagcatgagccactgcacccagccccctacaaatttgttttgttttgtttttctttttccatcatcttctttgtgatagtaaacaaatatttttagcttctgctatgtgccaggccctgagctaggtgctgggggtacagaaaacaacaaagtaggccgggcgcggtggttcatgcctgtaatcccagcactttgggaggccgaggcgggcggatcacctgagattgggagttcaagaccaacctgaccaacatggagaaatcccgtctctactaaaaatagaaaattagtcaggtgtggtggtgcatgcctgtaatcccagctactcgggaggctgaggcaggagaatcgcttgaacccgggaggcagaggctgcggtgagccgagatcttgccattgcactccagcctgggcaacaagaggaaaactctgtctcaaaaaaaataaaaaataaaagaacagagtacctttgaggaacttaccccatcgtcggggagatggaatggtcactatagaacactaaggtaaatgtaggtagggacaataacatgcatgggttagtgtggagcacctgttctgggccccctctggagcatcattctgaggatggctctcagggaagccttcctggaagaggtataatcatttgaatttaaaaaaacgaatggcagtgatcacttcggtagcacatatactaaaactggaatgatacagagaagattagcatggcctctgcacaaggatgacatacaaatttgtgaaggattccatattttaataagaaaaacaggccaggcatggtggctcacgcctgtaatctcagcactttgggaggccaaggcgggcggatcacctgaggttgggagttctataccagcctggccaacatggcaaaagcccatctctactaaaaatacacaaaattagccgggcatggtggctcgtgcctataatcccagttactcaggatgctgaggcaagagaatcacttgaactcaggaggcagaagttgcagtgagctgagatcaaaccactgcactccagtctgggtgacagagtgagactctgtatcaaaaaaaaaaaaaaaaaaaaaaaagaaatggtcccgggagaaaccagtaggaaataggggaagcaggatagggaagaggaacagtacaaagcagctagattttgttttttggagcggagtcttgctctgttgcccaggctggagtgcagtggcatgacccagttcactgcagcctcaaaaatcccaggctcaagtgatcctcccaccttagactcccaagtagctaatttaaaaaataataaaatatatatatatatatatatcagtaattactaaaaattagtagtaattatactactttaatagtgtgctaacatcttccactgtgttgtgaatttacctatttttattttactttccttaccttttttttgctttatatatatttaagttgtgttattaggtgggtataaatgtaggattgttctttctgatgatttggaccttttgtcattatgaagtgacccttttatctctcataatgcttttgccttaaagtctatgtggactaaaattaatacagacatatcaaccttctttggttagtatttgacagattcttttcatcctcttactttcaacctttctgtattcttatgttttatttagatatgccctttttttttttttttttttttttttgatggatggagtcttgctctgtcacctgggctggagtgcagtggtgcgatctcagctcactgcaacctccgcctcccagggtcaagtgattctcctgcctcagcctccggagtaactggaattacaggcacctgccatcatgcctggctagtttttacatttttgtagagatggggtttcaccatgttggccaggccagtctcgaactcctgacatcaggtgatctccctgcctcagcctcccaaactgctgggattacaggcgtgagccaccatgcccggcctagatatgcctcttgtgaacagcttataactgggttcatttgctttgtctagtctagcaatctttgtcttttaactgaggcattgagtccatttacatttattaatatactgatatgtgcatgtgtgcgcacacacgttatttatttacgtatatcctattgtttggtattttccccaccttttctaaggtttccttttctattctttttggctttcttaattattctttatttcatttttctccttacatagtttgcaaattataccttttttttttttttgagagtttcgctctgagtcacccaggctaaagtgcagggtcacgatcttggctcactgcaacttctgcctccccagttcaagagattcttgtgcctcgccctccagagtagctgggactacaggcgcaccaccactcccagctaatacttgtatttttagtagagacggagtttcaccacgttggccaggctggtctcaaactcctgacctcaagtgatctgcccatctcggcctcccaaagtgctgcaattacgggtgtgagccgccatgcttggcctgtgtttttaagcccataagacattgttattaatgttaatacaacatttgtttagacttacccacacatgtaccattttctttgttccatattccttcttgtctctcattttttccatctaggatcactttttatttctgcctgctggtggcaaatacagtttttgtttgtatcatgtcattgttttttcttacttttaagatatcttttcactgattttataattctttttaaaaatttttagtgccaatgaattcttgcttattgtttgtacctacagttgtgtcctccagctgctgtgccagtttagactacaccgtcacctacctcctaaagcacatagcaaaagagggcaagggggatgggcatggtggctcaacactggtaatcccagcactttgggagtggtatttttctcttaagaatagggaaattaagataggcatttttcttttcagtctgttgggaggtagtggtgtttatatctagctcacacattcactgaagtcccaattttaggttttttagacttcccaccttaaaggagccctgagtttctctcagtagtgtgtattggagtttgctcctatcagctcacaagaaccaaatatttttcgtgtcagttcttagtaccactgacggcttgaaatctatggtgggaacatttacctaatggaaatcaacaaaaactgaaacactaaaaaatgtgtgtacaacattgtgcttatagttaatactgaactgtacacaaaacagtgctttgttttgttggagagccagttactagcacaccactggttctctctaatcactcactcccatgagaccatgaaaattcaagttcaagtttactgagttaaaaattactcaccggaccaggctcagtggctcacacctataatccctacacttagggaggcagaggcagaaggttagcttgagcccaagagttcaagaactgcctggacaacatagcaagaccccattctccacaaaaagaaaaaacaaataaataaataaaaaatgggctgggtgcagtgggtcacacctgtaattacagcactttggaaggctgaggagggaggatcgcgtgagaaccacaagttcaagaccaccctagccaacatagtgagagccccatctctacaaaaaacaaaacaaaacaaaacaaacaaaaaaaacagttgagcatggtggtgccactgcactccagcctgggcaacagagcaaaaccttgtctcaaaaaataaaaaattaaaaagtttaaaattttaaaaaattaaaatgatgtcgtttcagtcacgcaagatgaataagttctagagagttgctgtacagtattgtgcttatagttaatactgaactgtacacttaaaaacctgttgaccaggtgcggtggctcacgcctgtattcccagcactttgggaggccgaggtgggcggatcaccaggtcaggagattgagaccatcctggctaacatggtgaaaccccgtctctactaaaaatacaaaaaaattagccgggcgcctgtagtcccagctgctagggaggctgaggcaggagaatggtgtcaacccaggaggcggagcttgcagtgagccaagatcgcgccactgctctccagcctgggtgacagatcgagactccgtctcaaaaaaaacaaaaccaaaacaaacaaacaaaaacaaaaaataacttgttaagagaagccgggcacggtggctcatgcctgtaatcccagtactttgggaggccagggcaggcagatcacttgaggccagttcgagaccaacctggccaacatggaaaaaacccatctctactaaaaatacaaaaattagtgggacaggctggcatgcgcctgtagtcccagctactcaggtggctgaggcacgagaatcccttgagccttggaggtggaggttgcagtgagccgggactatgccactgcactccagcctgggtgacagagcaagactatatcacaaaaattaaaaaaaaaaaaaaaaatttaaattgcaaataggttagacaataaaaaataaaaataaaataaaaatgtccaaaaggcaaaagtcagtttcgttgcgcaacttgcctttgaattcgtgacttttttggcctgagtattccttactttcttgccaactcatcagtgcagtaaaaaaattttttttcttttatccataattgttttcagaagtttattcagggtacttagtccactttagtaccataaaatatcttagtatcttaacgtagatattgagatagttggactagatcagtagttcttaacattttttggacacagactcgagaatctgataacagagcttggataacttctcctcgggaaaatgcacatacacacagataaaatgtatgtttttactcccctgaaactatccatgggcccaagaataagaatgttgcccaggttggtcttgaactcctggccttaagagatcctcccatgtctgcctccaaagcactgagattacctgtaggtgtgagccactgcatcaggctcagagctaacttttgacagcctctccatgtttcctgtcctgagctgagagtttccgggattctctccttgggtgagcttgagtttctgaactggggcttccagaatctccaagacctcttgggggagaagctgagagttgtcagttaaacctttcacaaagctgaaacacacgcaatgttcattcaaccagacctatccacatttattcattcggtgtttattggctcctgttccagctgtctactgctgcataacatatcatatgtaaacttagtggcttatatagtaataacaatcaattacatagttctctcatgattctgggagtaactgggctcagctaggtagctcttgctctgggtctctcatgtggttgcagtcatccacaagtgctggaatcatctcagcctcttcagtacatgtttggcagttgatgctggttgcaggtttggttttcagtggggcttctggctgtaaaacctacatgtggcctcactctctctatgtggcctgggtgtcctcacagcatggcaggtgggtcctgaaagggagcatccaaaaagagatttaaaaaaatttaaaaaggggccgggcacagtggctcacgcctgtaatcccagcactttgggaggctgaggcgggtggatcatgaggtcaggagatcaagaccatcctggctaatatggtgaaaccccgtctctactaaaaatacaaaaaaaaggggtgggggagagggatagcattaagagatatacttcatgtaaatgaccagttaatgggtgcagcacaccaacatggcacatgtatacatatgtaacaaaactgcacgttgtgcaaacgtaccctagaacttaaagtatatttaaaaaaaaaaattagccgggcgtagtggtgggcgcctgtagtcccagctacttgggaggctgaggcaggagaatggcatgaacctgggaggcggagcttgcagtgagccgagatcgcgccactgcacttcagcctgggcgacagaaagagactccgtcccccccaaaaaaaattaataaaaaataaaataaaataaaaattaaaagagaatgagtcaggaggaagccacattaccttttagaacctagccacggatgtcacacagcatttctgtcacattctgttaattagatacaagtcattagaccagcccatatttaaaggaaggtcaattagattctacctcttgatggaaaggatgtcaaaaaatttgccggccaggcatggtggctcatatctgtaatcccagcactttgggaggatgaggtgggcagtttgtttgagcccagggttcaacaccagcccaggcaatatggtaaaaccctatctctacaaaaaaaaaaaaaaaaaaaattagccgggcatggtggtacatgcctgtagtcccagctactcaggaggctgaggtgggaggatcgcctgagcctggagtcgagggggcagtgagctgtttaatcgctcaacttacctttgattcataatggcgtcactatactccagcctgggcgacagagtgagaccctgtcttaaaaaaaaaaaaaaattgcagatatggtttttttttttttttttttgagactgagtctctctctgttgcccaggctggagtgcagtggcacgatctcactgcaacctccgcctctcaggttcaagcgattcttctgcctcagcctcccaagtagctgggattacaggcatgtgccaccatgcccagctatttttttgtatttttagtagagacagggtttcatcatgttggccaagctggtctcaaactcctgacctcaggtgattcacccacctcggccacccaaagtgctgggattacaggcgtgagccactgtgcccagccctgcagacatgttttaaacccaccacatctcctttctgtttgtcaagcactggacaaggcacttagaatagaacggtgaatactacaaaccctgtggtgcttacagtctagtggtagagccaaacattaataaaataacattacaaatatgtacacaattatgaactttgatggtcctatggaagatgattccagggagccatgagaatttatatgacacatttttatgacctggaccagggaaccaagagagaattctctgcagaagagacatttggattgagatctggaacaccattggatgctaactcaatgaagtgggttgaacaagagccttccaggctgaggggataccaggccaaggccctagagtaggagaaacagcagcctgagaggcagctagtatgtcttgagacagctagcagggacaggaagtatgaaacaagaccgcagtggtgggctagggccaggcccctgggcactgtaggctgggtaatggtattggacttccgcataaaagttgtgggaagctggctgggcacggtggcttatgcctgtaatcccagcactctgagaggccgaggtgggcggatcacgaggtcaagagatcgagaccatcctggccaacatggtgaaaccccatctctactaaaaatacaaaaaattagctggatgtggtggcgggcacctgtagtcccagctactcgggaggctgaggcaggagaatcacttgaaccctggaggcagaggttgcagtgagccgagattgcaccactgcactctagcctgggcgacagagcaagactctgtctcaaaaaaaaaaaaaaagaaaaaaaaaagaaaaaaggtgtggaaagctgttgaagggtcacatactggagagtgatatgaacacatttacaacttaaagatcactttggctgctgtgtagatggccccagccagacgctgagtcaggcctgggagggctgggaacctcctatctgcagttcctcccctccccatgagactctcccacacaggctgaagccagctgcagccttggccctatacctccttgcctgagatttcaggctgagcaccctacacttaacctactcagtccctcctcccagacacaggaagtcctgccattttgcatcactcggtgagtcaccccttatttgtcagtcagtgggtgtaatggattaagaggtggtcccaaaagatgtgtctacatcctaattcccagaacctgtgaatgtaaccaaatttggaaaaaagggtcttcatggatgtaattaattaaggattttgagaagaggaggacatcctggattatctgggtggaccctaaattctatgtgtccttagggtcttataaggagtgaggcacagggagatttgattagaacagaagaggaggaagtagtgtgaccacagagagggagattggagtgatgtggctataagtcaaggaaggccaacagctgccagagctggaagagtcaaagaacaacatctcccctagagcctccagagggagtacagccctgccaacaccttgattttggcccagtggtctgatcttgaacttctggcctccagaactgtaagagaataaatctctggttgttctaagctgcccagtctgtggtaatttgttacagcagccacaggaaattaatgcagttgggtacttctcaagctgctccttcctgatgagctgtacaggctccctctccttcaggagacctctaaatgttggggtgccccgggctcagttctcatactacttttttctctattctctgtccctacatgatctcatccattcacttggctttaaaataccattcatttattggctggacgcagtggctcacgcctgtaatcccagcactttgggaggccgaggcaggtggatcacctgaggtccggagtttgagaccagcctggccaacatggtgaaaccctgcctctactaaaaatacaaaaaatttatcagggcatggtggggcctgtaatcccagctacttgggagactgaggcaggagaattgcttgaacccgggaggcagagtttgcagtgagctgagatcatgccactgcgctctagcctgggcaacaagagcaaaaactctgcctcaaaagaaaaaaaaacatttatttgctaatatcctcaaattttatctccatccagacccttctcctggagcccaggcatccccagaggtagatgaaaagagaactcttgttccacgctcaccaccacatctgtccctggcccaggctgccccagtcactccatgctccagttggaaatgtgatagctatcctggatttctccatttccctcatgcagtttatccaaactgctagcaagtcttgtcttgttgtttaggtcttataatctctctcaaatctgtccattccactccgcactgccatcactgcagccgcagcatctctcactcaggtgactgtgccagctgcctgatgactcccatgtcgactctcatccccctccatcccttcttacagcagccagggtgattttttaagaaacaaattagatcaggttgcagttttttgaatacctttattgaggtatagttgacatgcaattaattgcacacttcaagcttacaatttgctaagttttgacatatacccatgaaagcatcagtataataaagataacaaccatatctatgtgcagtggctcacacctgtaatccaagcaactcaggaggcagaggcaggagcactgcttaaggccatgagtttgagaccagcctaggcaacatagtgagaccctatttctacaaaaaataaaaaccaattagccaggtatgatggcatgtgcctgtagtcccagctacttgggaggctgaggcaggaggattctctgagcctgggagtttgaggctgcagtgaactgtgattgcactactgcacagcagcctgggtgacagagtgggatcccgactcaaagaaaaaaaggaaggctgggtgcggtggctcatgcctgtaatcctagcactttggaaggctgaggtgggcggatcacgaggtcaagagatcgagaccatcctggccaacatggtgaaactgcggtctctactaaaaatacaaaaattagccgggtgtggtggtgtgcgcctgtagtcccagctactcaagaggctgaggcaggagattcacttggacctgggaggcagaagttgcagtgagctgagatcccaccactgcacgctagcctggcaacagagcaagactttgcctaaaaaaaaaaaaaaaaaaaaaaaaaaaaagagagaaaagaaaaaaaaaagaaaagaaagaaaaaatgaaaaagaactatacctatgacctccaaaagttttctcgtgctcctttgaaatccaacttcccttccccacctcccattcctaggcaatgactgatatgctttctgccattaccaactagtttacatcttctgaattttatgtgatagaaaatagtatgtaattttttctttttttttttttttgaggcagagtcttgctctgtcgcccaggctggagtgtagtggcgcgatctcccctcactgcaagctccgcctcccaggttcacgccattctcctgcctcagcctcccgagtagctgggactacaggcaccttccaccacgcctggctaattttttgtatttttagtagagacagggtttcactgcgttaactaggatggtctcgatctcctgacttcatgatccgctcacctcggcctcccaaagttttcggattacaggcgtgagccaccgcgtctgacctttttttttttttttttttaaatacagggtctcactccgtcacccaggctggcgtgcaatggcgcgatcacggctcactgcaactgcagccttgacctcctgggctcaagcaatcctcccacatctgcctcccaagtagctgggactacaggcatgaaccacgacatgctcggctaatgttttttttcttttcttttttttgttttgagacagagtctcgctctgtcgcccaggctggagagcagtggctcggctcactgcaagctccacctcccgggttcacgccattctgctgcctcagcctctcaagtagcttggcgcccgccaccacgcctggctagtgtgtgtgtgtgtggtggggggggctagtgtgtgtgtgtgtgtgtgtgtgtgtgtgtgtgtgtgtgttgggattacaggcgtgagccacaacgcccggccaatttttttgtagaatggggtttcaccatgttgcccaggctggtctcaaactcctgaactcaatcaatcgcccacctcagcctctgaaagtgctgaaagtacaggcgcaagctgctgtgcctggcctatatactcttttttatatggcttaataattttgaaattcatccatgttcattgtatcagtattttttttattgctgagtaataagtattccattgtatgaatataccacaattttttacccattcacttgatgatgaacatttgggctgtccagtttttagctattatatgcaaggctgctgtaaccattcatgtataggtctttgtatgagcttctgctgtcgtttttcttgggtaaatacctaggagagaagtgactggatcatgtggtaggtgtatgtttaactttttgagaaattgcaaaactgtttctatttttattgttttgagacagagtctcactctgttgcctaggctggagtgcagtggtgcaatctcggctcactgcaacttccgcctcctgtgttcaagcaattctcgtgcctcagcctcccaagtagctgggactgcaggtgcacaccaccaaacctggataattttttgtatttttttagtagaggtggggttttgccatgttggccaggctggtcttgaactcctgacctcaagtgatctgcccccctcagcctcccaaagtattgggattacaggtatgagccatcatgcctgtccaaacttttttttttttttttgagatggagtctcactctgttgcctaggctgaagtgcagtggtggcatgatctcagctcactgcaacctctgccttccaggttcaagtgattcttctgcctcagcctcccaagtagctggggttacaggcgtgtgccaccacacccagctaatttttgtgtttttagtagagacggggtttcaccatgttggccaggctggtctcgaactcctgacctcaggtgatccgcccaccttggcctcccaaagtgctgggattacaagcatgaaccaccatgcccggccagttttctaaagtgcttatacattcctaccgctagtgtggaactggttatagttgtttcacatccttgccaacacttcatatggtcagtcttttaattttcgcttttttagtgggtgtgcagtggtatttcactatgttttagtttacatttcttataaccaaagaggatcctttcatgtgcttatttgcaatttgtgtatcttcttcagcaaagtgtccgttgaaaatttttgttcatttttttacattagttttttatattgagtgtatatatttttatgtattctagatacaaatcatttattcttcatatattctaagtatataaggaagtttttaaaaaatatattctagatacaagtcctttgttggatatatgttttgcaaatattttctcccaccgacagttgtcttttcgtttttctagtggtatcattagagagcaaaagttttaaattttaatgaagtttataaaccttttcactgattattagtgttttgcccaacctaaggttataaagattttcccctacgtcttcttctagaagttgtatagtttttgctcttgtaattagatttgtggcccacttggattaatttttgtgtatggtgtgaagtaaggatagaggttcattttgtttgccatgagatatccagttgttctagcaccatttgttgaaaatactatcttttccccaaaggtactttgtcaccttcataaaaaatcaattgataatatgtgtatatctctatttctggatggccttttctttttcagtgatctatatgtttatctttacatcaataccacactgtcttgattattgtagctctgtctgtagtcttgaaatcaggtagggccagtaatctaattgcataatactttaaaaaattgttatggctattcaaggtcctttgcatttccacatacatttagaatcagcttgtttactacaaaaaaaaaaagattgctgcaattttgacaggaattattttgaatctatatgccaatttcagaaaattgtaatcttgaaaacatcaggtcttctgatccatgaacacagtatctctcaccacttatttatatcttctttaattgcttgcacatcttttgtcagatttatccctgttttggagttctgatggtattatagattgtttttataatgtcaatttccaagtgttttttgcttatatagagaaacacaattagttttcatatattaatcttgtatcctgcaactttgctaacctcagttattcattttatttatttatttatttattttttgagatggagtcctgctcggctggccaggctggagtgcagtggcatgatcttggctcactgcaacctctgcctcccaggttcaagcgattctcctgcctcagcctcctgagtagctgggattacaggtgcctgccaccactcctggctaatttttgtatttttagtagagacagggtttcaccatgctggccaggctggtctcgaactcctgacctcaggtgatccgcccacctcagcctcccaaagtgctggaattacaggcgtgagccactgcgcctggtccctcatttactcattttaggtttcctagattacttaagattttccatatatatgtcatttataaataaagacagttttacttttttctttccaaactatatggtttatatttttcttcctatattgcattgactaggacccccagtataatcttgaatagaagtggtaagaacagatatttcttgcctcattctcaatcttagagtgaaagcattcaatctttaaccatgaagtatgattttgttgttgtttttagagagtaggtctggctctgttgcccaggctggagtgcagtggcgcaatctcagctctgcaacctccgcctccccaggctcaagtggtcctcctgcctcagcctcccaagtagctgggactacaggtatgcaccaccatacctggctaatttttgtcttttttgtagggacaaggtttcaccatgttgcccaggctggccttgaaatcctgagctcaagtgatccaccctccttgacctcccaaagtgctgggattacaggcgtgagtggccatgccttcttggaatatctctgtctggttttggtatcagggtaaggctggcctcatagaataagttgggaagtattccctccttttcaatattctggaagattttatatcaagttggtattatttcttccttaaatgtttagtagagttcactagtgaaggcatctgggcctggagggtttcattttatttttttttgtgggaaggtttttaactattatataaattccattacatatttattcttgaatatgtgtcacacttttgtgtaaaccctcagggccttcccctcactcctccctaagtccttattgtgactcccaaggccctgtctcctgtctggtaggctcctgccctcctctgcagcccttccacatgctgccttccccttaggcaagaacccccaagaagcttcttgcccacctctctgcttaagggtcttactgccttcccctcaccatgttccagt

SEQ ID NO: 476 - DNA, 40001 bp, Homo sapiens
ccctccctgtaacaatctccacctggcaaccctcgtttaactcaaaacaaagggcctcaatgtcctgcacgggccctttacgttccatgcgtcaggctgggggctcagaggtttctcgtagctaaggaatggataagggttggcccctcccattccttaggatccttggaacactaacaaacattcaggtgcatctgccatgcagggtcattctcagggtatgctcaagtcatcactgtcaggtgcgtctaccatacgggctcccaccccgcttccaggatggacatgtcacacagagctgagcaggttacttaggacagacacatcactttgcgtgggccgataagaattagtcctggaactctttgtggattgtttggcaaagaggatctttttatgccaggtcagccaacctggagctgctggaggtcatctttgttaccacactcagagagcctatctgggaatgaggccaatgctaaggaaagcagaacaaaaagatggagacacatccctgacactatcacttaggtacctagatccagctgtgcctgaaccccgatggagtgttcacttaagggagccataatatcctgaagtgagagtgggggtttctatcactagtaatgaaaggatccttactagtaagtgtgatttggagacaagcattcatgctcatggtcattgaatgataatcctcagaaactcctagttgaccctgttggattaatggttgcattttctctggagagataaaaatggaaaaccaacagaaaaacaggaagctaacataggaaaaggaaacaaacatttgagtgctcagtcctgtgctaagcagttgacttaaagtcctcccaccctttccttccttccttccttcctcttcccagcaacaaaacttacataagttttgttgtccataagttacagaggagtggcttcagactcagagtgcgttcaggtctgcttgattctaaacccacctgccccatcacctggggaaagaataatgttggttccttacagggggtctttctctcgctttgctgaaggcattgcctgggattaaactccagccccgcccttcacccactcaggagcttggctgccttgcactctatagggtagatgctgattattgctccatcttgaggaagaggaaacagaggttctgagagttaaatacctttctcaaggccatgcagtcatgaatggtccagagaagaattcaaacctgagccctccatattcaaagtgtggtccatggactagtagtctggaatcatctagaagcttgttagaaatgcagaatctcagccccctcccctccacctcctgaatccaattctgcattagaacgagagctccagtgactggcgtgcacaaagaagtttgagaagccgtggtgtagcccttgccatccggagcaccaaagtctccatgcggtgggggacctacatatgccgtgtgccctgctgcactgggatccctcacaccagctggttcatattgtcaaaagggaaaaagtcccgggtgagaagtggtgagcccttgcgccgtctccatggggctgggagagtggaggctttggctcctgaggggctgcactgaaggcctgcagaacaggaggttcatctggctgtgcagagttcaccccagcccatctcaggcctgcatcctcaccacctgggcccagctggagggccagctgccttttccacaagggattatgcccagatagcttcccacagcagctccgcggattccttgctaaccccctctgggaacaaagggcttggagaaggtccacagtcctttttggagagtgggatcaaagtaagagccacatctgtcacaagaaatgcgggaacagcctcttgccaggagagatggggaaactcttagtccctggctgggtttgatacttaatggctggagtgcttttcatggctgttgggtcagtggctgctgatggtcattgaagtcagctgaacagagagctttcctccttgtgcccatggcctcctgaagaggcgtaggtgctgttactggctacagctggaacagaccggggaacctggggttagaacacgggggagactgtcaacagctgggcagctggggggccgctgacacacccagggctttctgcctcagatgccggcttctgttctgagacactcttggatgtcacagagcagtagaacagctgagcaaaagggggcacttctctggatattgacatttttgtggatgatggggagggtcaaataattttattaaaccatttaagattcaattctaacaagctcccaggggaggctattgctgctttgcaaagtgagggccagggtggtgcacacatctaactgcatggtcctggaaagccacttacttctctctttgttttctgtcctgtcaaagcgggtgataatagcatccccaggagggatgatgcgcagccctcatacatcatcatcagtggtgctctgttgcccgggctcatattgggatcacctgggggaactttagacactactaaggactggcttcctcttccccagacactctgatttagctgttggaggtgggggaggcaggggcgtggggatgcttgtggcttctcagggggcttctatgtgcagttgagaaccactctcctgaaggcagctctggccaaagaaatgcaagaatccccatcacttttggagtgtcggagacactttacgtcggtgctcctctaagtatgttccatggaccagtgcttcctgagagctatttgttaatgggttggcaggagaagtacggagatagagtgcttaggaatttccatagcatctcgatattgccagacctctgaagatgtgatcaggggctcatctccctgaataggttgtagaccagctccagggctgccaggcccctgtggggaggtgcacagtcaggatgagctgcaaatgagtcctgtgcaggggaacacgtgtcattgtgccaaggactagatacagaaaaatccactggtctttcatctcactacttccctgttatctcctgaaatctcacagtcacctgaagtagggttttgtgttttttttttttttgagacagagtctcgctctgtcgcccaggctagagtgcagtggcgtgatatcggctcactgcaagctccacctcccgggttcacgacattctcctgcctcagcctcccgagtagctgggactacaggcacccgccagcatgcctggctaattttttgtatttttagtagagatggggtttcaccatgttagccaggatggtctcgatctcctgacctcatgatccgcccaccttggcctcccaaagtgctgagattacaagtgtgagccacgatgcctggccgaagtaggtattttcatgcttatctgcagatgaggaaactgaggcttggaaaggtcaagccacctgctcaaggctaggtgtctctaaaccaaggtagggcagggccttgtgggtatgttaccagtgtagtcacgtaggactccacactccaggtgtaatgccctatgctcaccatcttgaaattcttagtaattttatttttgagtgtgtgttttgtaagcaaagtcccatgggacaatggagcatgcagcaggcttggagcctcgactcctgcctgggcctgccgccctattttgcacctccccacttaccctgtaagggttttgcttcctcactccctcctggcaactgctgccacccccatcttcaggggccctggatcaggatgccagcctggcaggcatgccccatgcacagagccatgaggcaggccctgggcaactatgagggactgcacctgccacacaggtgaatcccatgcccgagggggcacaccattaaatagcaaataaaaataccatgacagcttgagagagagactgtagagaaaggaagaactctttccctgctttttttttgaacaaagggttttgcattttcatttcgcatcaaactctgcaagtaatgtagttggctctgcatatggccaggattttttttttttttttttttttttttgagacagagtctcactcttccccaggctggagtgcagtggcatgatctcagctcactgcaacttctgcctccccagttcaagcgattctcccgcctcagcctcccgagtagctgggattacaggcaagtgccaccacgcccagctaatttttgtacttttagtaaagatggggccaggtgagtctcaaactcctgacctctggtgatctacccacctcagcctcccaaagtgctgggattacaggcatgagccactgcgcctggcagggccagaacagccctcatgggccatgctctgttttctccctctgtacctgattgctctgttgtccaaggactgcatggcccactgctacatgaaagaggccaaatgacagtttcttctggtaggaaaagtcatggatttgaattggttttttaaagtccctgaacctggctgtgcttggtcagtgcaggtggaacttgggcctctccgcgtgctagactctaggatcttcaggagggaattgcttcgttatgccagctagtctcacatcagactctggtttgggggattagaggttcattcttttgtaaagagaacagtgcttgagaccctgtggccctgaatcaggcagacctgggttcaaatcccagctctgccacttcttttatttttcttttattttttatttttgagacggagtctcgctctgtcgcccaggttggagtgcagtggcgcgatcttggctcactgcaagctccgcctcccaggttcacgccattctcctgcctcagcctcctgagtagctgggactacaggcgcccaccaccacgcccggctaatttttttgtatttttagtagagacggggtttcactgtgttagccaggatggtttcgatctcctgacctcgtgacccgcccgccttggcctcccaatgtgctgggattacaggagtgagccaccgcgcccagccccagctctgctacttcttaaccatgtagtatgggacagatctcttaactcaagactcggttcttaaatgctgtaaaatgaatctccttcgtggggggtgtagtgagactacgaacagctagagaactgctgcttaggcctggatacttgacttgtggtttgtagcccagcagcatcagcatcacttgagaatttattagaagtgcaaattcttaggacttagcccagattttctgaaccagaatcatttaacaagattcccatatgatttgtgtgcacattaatgtctgaaaagcgctattctcagggatcttccagaagaatgaatttcaatgttggagtccatcatatagatccatatttaaagacttctggagacaaaggaattctcaggtgtcctaccttagcttaaggttggcaaactcctatttatccttcaaaacctttctcagtattttccccttggttataccttgcctgattgttgagatagtcaatcatcattctcttctcctcactacttcatcacatacaaacatctaataactgcatgtatcacattgcctgatgaacgccttgtacaggtgagtctcatctcataggctgtgaatttctgtgaatagcagcccagcagtgaggatgatgatgatggcaatagctgagatgaaatacgtcagctcacctacggggtgtgacaacaggacttgagagcagagttggcttgtggtcaccccggacccccatgtacccagatctgcttggcacaatgaggtcttcagaaaagtttgttgagctgaattgatagacaaatgtctccctcctccttgattctctcacatccatgtaggagaagtgtagggaaggtgttgacatgctttattttttctcagaagctcatgtctgggtcccagcttagctgaatatttcttcatttgctgagaggaacattcctcccccactggctttgaagtatttctgaggggcggctgccaagtttcatcacctcccctggcaatctgaggaccttcctcatcatgttctcatgtgcaatgcatcctgtccactgtcttccccacttttcctttctagaaaaccagatggtagtctgggctgctcaccccatcaagaaagccatgtatggccaggcgtggtggctcacgcctataatcccagcactttgggaggccgaggtgggcagatcaacctgaggtcaggaattcgagaccagcctggccaacatggtgaaaccctgtctctactaaaaatacaaaaattagccgggcatggtggcgggtgcctgtaatcccagctacttaggggcctgaggcaggagaattgcttgaacctgggaggcggagtggggagctgagatcaccccattgcactccagcctgggcaacaaagtgagactccgtctcaaaaaaaaaaaaagatgtcagacacagaccctcctcctctagaaaactggacgcatgcgaagcagggatctcagagtcgagctgcatccgaatcccctggagagcttgtaacacacagattccaagggcctcactctgctccgggagtctctaattcagtatgtctggggtggggctcccaggtgctgctgctggcccaggacccacttagagaaccactagtgtaaactatcccaagacaatgataagtgagttcgtctggcttagaggagaggtgtaactcaggagggagaaaccgggcctgcctgagaggtcaactgaagaagctccacgcggggagggatgcctcagtggaggcttctaacctgaccagaaattcacgggaggacagggatgaaggggtttttggcagagagaacagctacgccgtggctcagaggcagaaaaccacgtggctgttgttttgcatttagatctagctgtctaagagaggaaaccaaataaatgatttaaatgaaggctaacttctctttcgtagagaagtctaaaagcaagcaattcagggctgctatagaagcattttttttttctctctcgctctgcttttccattctaggcatatgacttctatcctcaaagtcacaagatggctgctggagttccagtcaggatgtctgtacagtaagtgtgatttggagacaagcattcatgctcatggtttcactttatccatggtttcactttccacaacttctagttaacctgcagtcaactgcagtccaaaaatattaaatggaaaattccagaaataaacaattcataagttttaaatggtgcactcttctgagtggcacgatgaaatctcatgccatcccgctccatcccaatgctgtatacactgtctgttagtcacttagtggtcttggttatcggatcaactaatgtggtattgtgcttgtggtataattcttaaaagtgcaagagtagtgatagtgacatattgttataattgttctattttttattagttattgttaatttcttactgtgcctaatttatgaattaaactttttttttttttccccagacggagtcttgctctgtcacccagactggagtgcaatggcacgatcttggctcactgtaagctctgcctcccgggttcacaccattctcctgcctcagcctcccaagtagcagggactacaggcaaccgccaccacgcctggctaattgtttgtatttttagtagagacggggtttcactgtgttagccaggatggtcttgatctcctgacctcgtgatccgcccgttttggcctcccaaagtgctaggattacaggtgttagccactgtgcctggccaggaattaaacttaaacaaacaaaaaccaacaacaatggagtcttgctctgttgcccaggctggagtgtagcgatgcaatctcagctcactgcaatctctgcctcctgggttcaagcgattctcctgcctcagcctcccaagtagctaggattacaggcgcgcgccaccatgcccagctaatgtttatatttttagtagagatggggtttcaccatgttgaccaggctggtcttgaactcctgacctcagatgatccacccacctcggcctcccaaagttccgggattagaggcgagagccactgtgcccagccttgaaattaaactatcataggtgtctaggtataggaaaaaaaaatgtatatatagggttcagttctgtcctcagtttcaggcatccattgggggtcttggaacacaactcccccttgaataaggggtctatagtatttcaggcagagtgaaggggaagggcaaggggtaatggctctttcttccagctgaatcagttcccttgaaaaagacttcgcagaaacctcaccctgggacttttgtctagattcaagagaggcagcaaaatgcagtcttttatctgagcacgttgcagccctgaatagagcccgaagtctgttaattaaggaagaagcagggagtggatattgggtagaccgttttggtgtgtttggaggaacgtcaagttcttagtcttgccagagcctgaggtgccagagggcacgcggtagggggaacgcggtgcagcacccagccactcaggaaaggggaggcacggccaagacgggggcaggatggaaagtccatggatgccgcagggtttagacccagccttaagtgtgaatccatccctggagttggagtgtcagggtatctcttttctcttttggctcctttccttcttccttcggttttttttttcctcccttcttctcccctttattcttctccttccttcccattccacttctctccttgcaggagctgcaggatttggtttccagtctgagatgaattggaaggtggggaggagccctgtccttagataaggagggcctcgagggcatgctagggagtgctgggggaagtttccatcagtaggaaaagcctgggagccaggctagagatagccactcagaagaggtagggaagaaagagacaacattggttctgggcagtaaagtaacacgataaatgcagacttaagaaaaatgagtctattggaggccgggcgcagtggctcaagcctgtaatcccagaactttggaaggccaaggcgggcggatcacaaggtcaagagatcgagaccatcccggctaacatggtgaaaccccgtctctactaaaaatacaaaaaattagccaggcatggtgacgggcacctgttgtcccagctactcgggaggctgaggcaggagaattccttgaattcgggaggcggaggttgcagtgagcggagatcgcgccactgcactccagcctggtgacagagtgagactctttctcaaaaaaaaaaaaaaaaaacaatgagactattgggaatgatgccttctctaaactgcatttacattttacactcttggctcaggaggaagaaaccttcatatgaaatctgctattgcatctttagtgaatgatgccgctgaggactttgctcctagtgtctttcattgtcctccacatgaaatcctgtaggagtcctttcttaatgtaggaacttgggaagagctgctttccttcaagagtttgtagttttcttcttcttcattaatgaaatttacacaatccatctgacttcctttgtgccatggctcccaggaaacactggggcaaatggttggactactgtggttctcttttctttggttctcattttctatttctattggtgttttaattgcctcattggatgtatttttgtgtgtgaaatatgacaggaaacacaggtatgttaactaggctggaagagattaatgtgtggcacagttgcggggtgcaggggagtcctggcagggtggagagttagcaattgttgtggcccaggtgggaggcgatgtggtcatgctgggagggaagtttagatgtgtccaagagaagttgcagagagcccgcagcatgatatctgaccatgtcagtttcacaagggggacagctgcaggtggctgacacatccagacacgtgtacaccaactggggaggaaattggctagatggttttcatttgggttttattctattccttggtgttgaacaccttgggctttcctgaaagacatactttggcaatatttcctgtctcaactcaggactagggttggggatcaaaggcacccatgctactctgttttctaaagtcttttgatttctgccactggttttatctacctacgactacattcttcaaaaacagacctacttgcattgtaaactaatctaaaaattgctgtgatgggcagatattggtcatggtgtcacccttcaggtgacatattgacctattaagagggcttggtgggggcaatgttttggttgtaaaaagtgagattttgataccattcaagtgctctgtcatggtgatggatatatgtaaaagaagggttttggttgtatgtaagtttcatggccccaggactctctcgccttgtgcccacactgtgactgattaactccccatggccaaccccagcccatctctcctgcctgactccatcctccaccgatctgctcattaacgaaccaaacaatcaatcagccatgcaatcgcttcagtgcacctctgtttcaacttttcgatttcaagctcaattgtcagtgagaaaaaaataaaaagaaaatataattttatgcctgtatgactcagatatttagttgcttctagttctgggctgtttccattcttattctgcccattcatttattctttcattcctccttataatcattcatttatatacgtttattcaacacaacttgattgagcatctcctaggtgccacactcgggtgctgatgtcagagaaaataactcatttctgttttcatgaggctcccattctagcctagagtttctcaacagacagagctgttagcatttttgtgcaaaaattatttgtggcctgggatggtccatacattacagggtatttagtaccactggttccaccctctaaatgccaacagcattccctctttccattgcaacaacaacaaaaaatgcccccacgcatttctaaactcagtggcaagcctgttgtttagataaagtgtggtggattctgtgcatcggttcttcccattttcttccccccagttactaaggctggaaacctacaaactatgtttccctttcatccagggtgtattagtttgcttggatgccataacatgataccacagactggatggcttaaacaacagatagttattgtctcacagttctggaggctggaagtcgaagatccaagtgttggcagggttgatttctcctgagggctctctccttggctcgcagatggcctcctcctcctcctcctccctgtgtctttacgtggtttttcctctttgtatatgtgcattcccagcatcttttcctcttcttataaggacaccagtcatattggctccctccgccccttatgagctcatttaacccaaattactcccttaaatgtcctgtctccaaatacagtcttattaggggttaggactatcatagagatctgaatttaggaaaaacacaattcagtccataacaaatggtgaggcatgtgacttagcttggcctagcacgtgcctctgctggagatccagatgcagaagtgagcaaggtgaggtgctgattttatgcaggtgttctgacaagcatggtggcaggggtaactggtttctagggctgctgtgggttttcagcatccagcccggtatcataggttccagtggtgggtggcagaagccatcagtgttccctgtagcaggtctgtggtgtgattgggcatttctcctggctctgttattcctgcttgcatcacatctgatctcattctctgtttctcctgacgattgcatgcactattcactaccgtttaataaaaccatctttttgcttaaattagctagcgtggattctgttgtctgcaaccaagaactctgatacagaaagaagatccccaaatatttcattgcattttaatgtggtaaattctgggtagagttgtgcataggatttcgtggaacctcagaaaagaataacccatagtcatttgcctttgtctcctaactcttggcactgcctaccacctctagagtgttgctgcttgttctgttcaaaagcttctttgctagatgggtctagtaatccatttatctaacaatgactctgtaatttagtaactagtaactaatcagctaatcaactagtaactccctttatttgtacctgagaggctgatcccattattgcgggtggagttttaggacaatgggtatccagtcttagctctgtgtccctctagctgtcttatctccagccagtcacttctgctccatcggccacatcttcttctggtaaaataagaatcaagcagtcccagaggcccctctcagcattgccatgccacacagcatagtggttcttcagtggaaaccaaaacatgtttatttgcttgtgtgaactcctgcagaatgtgccaaatggcagggatggatgtgaagtcgctgttttagaaacaggtgtctggagactgctctatcttcatggcaagggaggatggtgggaggagaagctacaaccaaaaagccttttccaaaatgtgtttatcagtgtgccaaccccacaggattcttctgcagaggcgattccatggtgtacccgctttgggaaatgctgcatactctattgctttctggacattcacagtgaacttagcaggttgaaggcttagaggaggcttccaggaaggaaacctgtttattaaacctcttctcaaatgtatttgaccactcgaccctttgttttccacataacatctactaacattcttggtaacaccacttttggggaaatactgaactaaattagtctcaaagtcttccaaagtaagcacagaccttgaaaggtcccatttgggatggtgagtcctgcctacagcttccctgacttctgactaacccagggagctctcagagttctcagcagcaggaggcaagaccaaaaatccctatgagtggaagccacatggaattgttgctgatatcagtggtgagtcacaggggtccacactggggacatgagtattagacatgagtcatgggcatatggaagccttgttcagctctaccttcctttggtccctaatcctttgtaatgccctggtttcatgatgtaacttcaagggaattaagcttggaaagcaaaaatgatgtaattaatttaatgcggcttcaattaaagccttccgctagcatgacatctgaccatgtcagtttcacagcggggacggcagcaggtggctaggcgcgtccagacatgtgggtatgccaagtcgggaggaaatgggctagatggctttcacttgggttttattccagtccttggtgttgaacactcagggcttccctgaatgacacactttgtcaacatttcctggctcagctattaactgaggaccaggatggagacattaggcaaacagactaggccgttttcttgtcttctgaatcccaccagtggttctttggttctacctagagctactgtcttcaaaaagaaacctccttttattcattaaaaactgatccaaaaaatggttttcatgggcagttatgggtgggtcattgtgtcatattttgttatgagtgccagataaacttatcaagagggcttggtgaaggcaatggtttgaccaaaaggagtgacaaaaatagtggggatttgccctctgttattgggaggtgacaccagtgtggctttaaacttgtttgtaaaaataagctctttctaggccaggcacggtggctcatgcctgtaatcccagcacttcggaaggctaaggtgggaggattggttgagcccaggagtttgagaccagcctgggcaacacagggagaccccgtctctacataaaataaaaaagttagctgggtatagtggtgcgtgcctgtagtcccagctagttgagaggctgaggtgggaggatcccttgagcccaggacttcaaagatgcagtgagctatgattatgccactgtactatagcctgggcaacagagtgaaaccctatctctaaaatacataaataagctatctctgggacttctggagtcttgtctcttttcttctccaatctacagttaaagaaacttctggaataggtgagcatctccttattccatgacatccccgagacgctgctgacactttctctctgccccactgcatccccttcctcacctgctttgccatccactcctgggccccagacttcctgctgccggcgctacggctgctcccggccctgtttccaggaggaaagcttgacggcttcggccaggccagggagcacagggcctgcgccagctctgctgaggctcacgttaaggggaggttgcccctgctcccggcttgtccctgttgcctgtggctaacacagcctaactttctgctcccggcttgtccctgttgcctgtggctaacacagcctaactttcaaccgcaagtcgcagcgcagggccctggggagcagcctggtcttctctcctgctggctgagagggttttcaggtcatgccaaggggttagtggggcattctttcctagatgtttctgcttctcattcccacccttcagcattcatcactggagccttttgttttgttttgttttgacacagtctcgctccgttgccgaggctggagtgcaatggctcaatatcagtcattgcaacctccacctcctgggttcaagcgattctcctgcctcagcctcccaagtagctgggactacaggaatgcatcaccacatccggctaatttttttttggtatttttagtagaaatggggtttcaccttgttggccaggctggcctcgaaatcctgacctcagatgatgcacccgcctcggcctcccaaagtgctaggattacaggcttgagccaccgcgcccggcccacaggaagctttttgctccttctttcataactcacaggagctgtttttgggctcactagatagagatgatattagctgtggatcattgctaacatgtattgggccgggtggcctgggctgggaagtttctgacaggcatggcctcgttttctcctcacttcagctttctgagggagaagccattatcatctccagtttaaagacgagataattgagacttcaagagtatcttaggccaagctcagtggctcacgcctgtaatcccagctacttgggaggctgagataggagaattgcttgaacctgggagtggaggttgcagtgagctgagattgtgccactgcgttccagcttgggtgacagagtgagactccatttcaaaaaaaaaaaaaaaaaaaagagtgtcttagttctcgctgctacaacaagatcctatagactggtagcttataagcaacgggaatctatttctcacagttgtggaggctgggaagtccgagaacaagcatatttagtgtctggtgaaggtcactttctggttcatagatggtgccttctcactgtgtcctcacatggtagagggaacaaggcagctctctcttgtttcttttcttggtaggtcattagccccattcatgagggatccaccctgtgatattatcaccccccaaaggccctatctcctaacaccatcactttgggggttaaggtttcaacatataaattttgaaggagacaaaaacactcggttcatagcaaagaggataaatactgtggccaaggtttctcagtgaataagcaatggaacagagtctcattcaatgagccatttatggaacacctgctctggcccgggtatggtacaagcttcagggacagaggctggaatgtgaccagacataggacttcagtggagcaatagaagtgaaccaaggactatgtgaggcaagatgggcattgcggtgggcagcccaccaacgtggctcagggagtgggtggggtgggttgtccttgacagactctagtttaaggaaggctctttgaggagtgacaattggcgtagctctggaggatgagcaggagtgaggaaggctaaagaggaaagagggccccactttgcaaagaaaaaaaaaaagttagagagccacacagcacatttgggaaaacaccatgcctgactcagggtaaatgctgaatcatctttgggcactaacagaacagatgcccagccaagcttctcaacccatttccaggctctgcggagggcgggatctttgtagggtgtaaagtggggaagggctgcacagatttggggtttgggaaagtggctgtggctggatgtggaggatggctaggagggacaggggaggtagcacaactcagttgaggtcattctttccatgattttcattattattattattattattattattatttgtttttgagatggagtcttgctttgtcacccaggctggagtgcagtggcgtgatccttggctcaacacaacctctgtctgccgggttcaagcgattttcctgcctcagcctctcaaatagctgggattacaggtgtgtgccaccacacccggctaatttttgtaattttagtagagatggggtttcaccatgttggccaggctggtcttgaactcctgacctcagataatccacccgcgtcagcctcccagagtgctgggattacaggcgtgagccactgtgcccggccaagaccatgcttttcagaagcactcttcattagaatttttaagttggaaggatatttagaaattcttttctttaagcctctttgatcaagatgaggaacttgataccaaggtggctagaggaggcaccactaacctcagatagttagtggtggccccggccaggacccaggcctactgactcccagcatatatgtttttgccacactgcaccagtgtctagagacatcattgttgtcttagtctgtttatgttgctatcaaggaatacccaaggctgggtaattaataaagaaagatgtttctttgactcacaattctactggctggaaggttcaagactgggcatctggtgagggcctcaggctgcttccatgtgtggtgaaaggcaaaggggagccaacgagtgcagacagcacacggcgagagggagcaggagagacgggagggagtgccaggctctttttacaaccagctcttaccaggaactaatgagagtgagcactcattcagccccgagtaagggcactcatctattcatgaggactctgcttccatgacccaaacccctcccattagacccttcttcaacactggggaccaaatttcaacatgagattcagaggggagaaacatccaaaaatagcagtcttggtggagtaggggtggtggtggagggtagatgactatgggcatcttgtggataaaggccagggaagctgccaaacaccctgcggctccaaccaccaggaattatccagccccaaatgtcagtgggaccaggactgtgaatccctgcccagacagtggaattttcaaaaagcccttagttgttgggaaccaacttcagaacggggggctgtggagagtaaaccaaagtcagtgggacattttacttggcctaggcctctcagagagagacaagaagcctcatgaaggtttactagtaaagttactagtaaaggttgctattcaaaaaaatcatttttcttaaaggtaagtttgttcactgtagaaataaccaagtaagaggaaagggagaaataaagtcacctgtggacccaccgcaagagatgctcatggtgcacatttcgatgtgactttctgtgttttagacacacgtgcacacaacacaggcacacatagatattttatgcacctaagtaacaaccattttttcaatggcatcaagtccgggaactggagggccccttggagctgggtgggtggatgtgggtgagcgcatttggacaagctgaagcagagccctgttgacgtatgtgagcagcaggtggaacattcggggatggggtctggggtctggcagggagatgaggaggaggagggtaggaggcacggagactggctctgtgggggtcaagggagggctgaggggaggaccgcaggtagagtcatcccagtagagggactaaggagagcgcattatgtctgaggaactttacagcaaagtatgcaatggaaagccttctctatttcctctacaagaatgtccagtgtgcttggaattcttgtagaaaacgtgtgtgtgggaggtggatttggaggggtcggggaggtctgtgctccagcgggttggggcagagtccaccctgcaatcagggactggattatagagtgatggatatatctgcatgcatgaatatgtgtgtgtatttattactaatatgagattatatccagtctgttttgtagagtgtttttcgcttgacgatatattgtggatatctttctatgacgttaaatatgccactacattgttttaaatagttacacagttgtctatcaaagggatgtactatcatttaatgaattccttaaatttgaacatttttcatttcgaagtatttattcatagggccagtctttctaggtgtatcgtttacagagggggttctcagccttggcaccattgacattttggagcagagagttctttgctgtggaggaggggctgacctgggccctgtagggtggtcggcagctcacatcctcatggccaactggggacagagctgcgattcatactcaggcaaggccaatgtgctctccagggcactttggctctcggggtgtggctgtagggcaggtgccactaatgaagtcccctgggaaccctcgcagtgcctgtgagttgcttggtctttccacctgagctggggggaggcctgaccagtgcccacctgtgctgggagtacttgagctggggcagcagcagaggctgctggtaaatccttgcttgttctgcaggcggatgcaagtgccatttgttgatttctcagcaaaatcctcatcaggtcaatatgtgcaggcggaactctgaaaaaatcactggctggccttgggctgcaattcagtctgttactttctgtgaaacaggtcttttagaatcacaatgggttggggctccctggaagcccctgtgaaatgcccactgagctggggaaggcctgggctgacctatgagctgttttattgtcttccttcctactgcacgttgtggctcagtaagtatatacgtggaaagatctgcctgaacttggctgaccccagggcctcggcagaagagaggattgccccttggccccaaggccttagccctgaggtcacaggacgggggctacgagacagaggtggccctagtgatttctagttttgggtttgtagccgtgaacattttccacactctgcagcttctttcagtttctttctgacagcctgggaaaggaactgtcagacttagagatctgctatgaaagggctagagagaaaattctaaggaaccagaagtggtttttcaattttgaaataaaaatgtcaactaataagagtgagaactcatatatccccaaggaagggcagtaatgtaggcaaaaaaaaaaaaaaaaggaagaaatgctgtcaatatctcaccctcaccctttagtgagagaggggtgatgtgttctggagtgtccgttaggttgtttttaaaagaaaacccctgagaggcaatctctgtgtgagtggagcttcccgaacagctacaagcttcttgaaatctcatcacatcacaggggtttgaatttaggagtttatccaactgggcccatggagaagtttgtggaggatcgtggagaaagtagcaggtagggaagagagtctaagagtcttcaggtgacgggcaccaacctggcccttgcgctgctgctgtttgattaaatgttactccggcagcaggcagcggggttggaatgaagcagggaatttggagtcagggcatctgggttccccctccccacagtttctaattgtgcggtgagggcaaggccctcagtttctctgagtttgtttctcatctataaaatgagtaccgccacacagatatgaaaaagaaattaaataatgctcctcaagcttctggctgtgttatgcaggaggaaggttatgctcagagtggttggaaacttggacccactttcaagataagtgatagaagaatctggatgaatcaagaccaggaggagggttggggccctgtgtggggaattgctaaggtagccaggcttggaggcccagggtccactgctagccttgtatgccgcttattcattcgtttatttattatttgagacaggatttcactgtgctgcccaggctggagtgcagaggtgcgatcactgcacactgaagctttgacttcccaggctcagtggatcctcccacctcagcctcctgagtagctgggactacagtcgttcaccactgtgcctggctaatttgtatattttttaaaatattttttaaaatttttatttattttatgtattttttttttttgagatggagtcttgctctgtcacctaggctggagtgcagtggcacgatgtcagctcactgcaagctctgcctcccgggttcacgccattctcctgcctcagcctcctgagcagctgggactacaggcacccgccaccatgtctggctaatttttttttgtattttttagtagagatggggtttcaccgtgttagccaggatggtctcgatctcctgaccttatgatccacccgccttggcttcccaaagtgctgggattacaggcgtgagccactgcacccggccaatttttatatattttttgtagagatggggtcttgctctgtggcctaggctggtctcgaactcctggtctcaagtgatcctcctgctttggcctcccaaagtgccgggactactggtgtgagccactacacccagcctgtatgccccttactaatgtgatcattcacttattattgattactgacctatgtacaaagaaataataattggaggtggctaacaataaaaggaagaaagacagtaaaatgataaagaagcaaagataagagaacaagaaccaaatggtagtaaggacaactatcacagttcttaactaaggacagcagaagcaacttagcaaaaatatcaaactctgaactctcaggagtcaagacaaaagggatatgtagcacgtcacttctgctcggggatttttgtggtatttttggccacccaacatctggagcctttttctctgggaattttcctccctccgtagaagcagaaatggctgatacttgttcttggcctcccttgcatccagggagcagaaaaacagcagatattccatccacagacaagtgggattggggatggcctatgggaaatgctctctggtgtatggctgtgataattgcatagttatgggggtgctggtggtggcaagaggtggcccatgctggtggggctggtgatagaagccgtctgcactggctgctatggtgtgctgtcccctgcactgctgtgtgtcaggactggggtgttaatctattcaatccatatacataagaatttttttctaacaagttttaatttttgaataatttaaaatttacaatgaaatgaaaagaatagcacaatgaacatcatatttgcctttatccagatttaatgatttgttaacatttttccatgcttgcagtcacaagccctgtctccacacacacgcgtatgcacacacacacatatttgctgaactatttgaaactgagatgcccacatcatgatcctttacctctgaatccttcagcatgatctcctaagaatgaaaacgttctccatcttcgtaattccattgtcaccttaggaaaatgaacaattttataatacgtaatatccagtccttattcaaatttgtacactttccaaaaatgcctcatgtcttttagtctcttgaaatctagaacagtccctctcccttcccagtcattgtctgtatttgacacacttttcaaatgcttttaatttcagatactttaaataaatttattttctgctcaaatcaactctagtctcttctgtcacttacaaatctggcctcgtgcacacagctcctcttaccgaaggagcatttccactacagtcataggaagattaactttcccttgctcaaaaaggagtagcagttccaacaatgggctctgcagtcagaccgcctggcttggaattgaatccccctgctaaccagctgggggagggcaagctacttaaccatgatgaggatcagcttccagaattgtgaagctgcataataataatggtctctattgcgtagagttgttgagaggcttaaacgaattcacaggtgtaaagggcttagacccgtcacccagatgcactgtaagtgtggtgtaagggtttactgtaatgatgcaacctcttcctggtacattctcccaattctttgcttcctaggcaacttgttttcttggaaaatagacccagcggaagaccctactcaatgatctgttttccactgtagggtgatagtaccagctgtcttctttgtaaatggtgctttagagttttcattaacaaggagaggccgggtgtggcgactcatgcctgtaatcccaatgctttgggaggctgaggcgagaggatcccttgaggtcaggagtttgagaccagcctgggcaccaaagtgagactctgtctctacaaaaaattaaaaaattagctgggtatggtggtgcacacctgtggtccctgctgctcaggaggctgaggtgggaggatcacttcagcccaggagtttgaggctgcagtgggctatgattgcaccactgtacttcagcctgggtgacagagggagatcctgtctccaaaaaaaaaaaaaaaaaaaaaaaattagtaataataataataataaggagaagcaagtacattgtacttagaaacaacttttcctgtctttaatcacatcagtagctctcatgcacttagtgcccaccttgggccagacgctgtgtacatatcatcttattcctcctcataagggctgtggggacattattattgccattctacacatgtgaaaactgaggctcagaagtaaagtcacttggtcaagttcaagcaatcactaagtaacagcaccaaagttagaacttcaatctgcctgccaagcaaagcgctttccagtaaaccgtgttgactggatccccaggtgtggtgggttctagtgtttttggcaaatcgccccccaaatcgcccattaataagcatcagtgtggaagggccttttctccgtggacaggaaaactgagacccaaccagctgtcattgcggcaatatctgctctccttttagaaagagatgggacaggctattctcaggaagacacttagctggcttcttcggctgcatcaactcaaatctgccactttggaaaatcaagttgaataggaattgggagggattgctgctgcctggggacccagagcacctcacacataaactcgggtttgcagggagatggctgaataaagaagagaggcgagattttaaccttttgtgcagccagatcttttttttttttttgagatggagacttgcccaggctggagtgctgtggcgggatctcggctcactgcaagccctgcctcccggattcacgccattctcctgcctcaacctgccgagtagctgggactgcaggtgcccgccaccacgactggctaattttttttttttgtatttttagtagagacggggtttcaccgtgttagccaggatggtctcgatctcctgacctcgtgatctgcccgccttagcctcccaaagtgctgggatgacaggcgtgagccaccgcacctggccttgtgcagccagatctttaggccatgcatgtggcctgattcagcgagaaacgggatgacatgaactgaggatgagggcggctgagcgagccagttcttcatagtcacattcggtttagcagctgatcatgacttgcaggtttcatatctgaagatgattttcactttacccagtattttccacaggaaaaattaggggaacaaaacccaaaagcttttactacagaatatttttgtttctttttaaaaatgggatctaatgagtaatacgtgatctcgtgatgttattagaaggtaggtaactggaagtagtagaggcattcacagtcaacctttcggagtattgcaagcttattttttacaagcaaaattattttctgcaaaatccatttcatgtgaatacttaaaatagaagccaataatagttgggatcccctggatccccaccctggatctcacatcgcatttagatgtcacgtctcctcagcctcctcttggctctgggtaatctgagcaccgaggctggagccctgctcactgcctgcttcctcccgaagcctctaactttcttcttggaacctcacagctttgtggaacactgttcgagagcccctgatatactccaacacctatttactaaaaatgcagatgtgaaacgagtcatttcagcttacatttagaaaacagtctctttcaggttggcgcagtggctcacacctgtaatcccagcactttgggaggccgaggcaggcggatcacctgaggtccggagttagaaaccagcctgaccaacgtggagaaaccccgtctctaataaaaatacaaaatgagctgggcgtggaggtgcatgcctgtaatcccagctactcaggaggctgaggcaggagaatcgcttgaacccagaaggtggaggttgcagtgagcggagatcacgccattgcaatctgggcaacaagagcgaagctctgtctcaaaaaaaaaaaaaaaaaaaaaaagaaagaaaaaagaaaaaaaagaaaacagtctctttcaaacctcccggtgagaagaaatccaaataattcatgtcaatattccgccctcgaggaggtggagcgtaactcctctctcctttcatgtgggctgtgcatcgggacttccatccagagagtacagtgtggaaggaggaactccaaaggagtacggtggagacacctgacaaacaccacctcaatcaggtggtcaaggttaagagcaacgaaccatgctaactgtacatgccctgatacgatgggatgggaatggctcttcatctctgaggtcttcctccctaaatccctcgcccaagtctaatcaccaggaaaacatcagagcaatcccgatgaagggagagtctgcagaatgcctgatcaatacctctcacatttgaaaagccatcaaaaccaaagacactctgggaagccgtcagggccaagaggagctgaaggaggcaatgcctaaatgtgatgtggtgtccagggtggtatcctgcaagagtggagggacattggtagaaactaaggctatctgaataaagtatggatgttagttaataataacaataatacattgctattggttcattaattgtaatgaatgtaccatactaacagaagatattattagcaggggaaaattgcttgaggtttatgggtatatgggaactctctgtactattgtggcagtttttctgtaaatccaaaccattctaaaattaaaagttacttttgaaaaaaaaaaggtttattccattacctaataatttgtggtgtaggaaaagtgttttttttttttttttttttttaaattcagactagtcctttctggtcatacatggaggctaaaggggtttaaaatactctgatgggagtctagacattaacttatacaatccatatttctcacttcaccagcttggggtacagaataaggtcatatcttttaaaatacgcataatgctagactcccatttgccttaggctaactggagaacgttatttttccatgcccttggctcctggtggcatggtgctgtcctcccgagacaagtgcagtgtggcccagtgagtcctgtcaccatcgccgtcatcgtgggcctgcaagagcggagaagccagccagccctccccatggcagctgtgcagcttggcttcaggcctggtgcttgatggcctgcgatccttcagttactcacctctccaggccatgaacacagccatttctcaggggtcagggtggctaggtcaggaaatctccccagccatagccatttgaagtccttggggaattcagagtgaaaacattgttgtcctttccctcactttgaaactttcatgcgcgtcggagtgaagagaccaccaaacaggctttgtgtgagcaataaagcttttaatcacctggctgcaggcgggctgagtccaaaaacagagtcagcgaagggagataagggtggggcggttttataggatttggggagataaaggaaaattacagtcaaaggggatttgttctcaggtgggcaggagtgggggtctcaaggtgctcagtgggggagctttttgagcccggatgagccaggaaaaggactttcacaaggtaatgtcatcagttaaggcaaggaccggccattttcacgtcttttgtggtggaatgtcatcagttaaggtggggcagggcattttcacttcttctgtgattcttcagttacttcaggccatctgggcatatacgtgcaagtcacaggggatgcgatggcttgacttgggctcagaggcctgacacaaacctgttgatttcctggcccagcttgagtgatatttctcctctctccatccccaaggggacacatcacttgatttcctggctacttttgctctgttgtgggtgaagaaagccactgcgactgcatgactgtgacttagatggagaggggaggatcaatctctttttaatagacagaagagggagtgagctggagaggcaggcagcgagagggaggcagttctttcactggtagggaaaggacttgtgtcctgggcctggatcacccagctctgtgactctcagtattctatctaatcttcctgggccttagttttctcatctgcaaattggggagagggatagaaaaattggaagagacaagcctgactgtgcagtgggttttctttcctttttttttgagacggagtctcgctctatctcccaggctggagtgcagtggcgcaatctcagctcactgcaacctccatctcccaggttgaagcgattctcctgcctcagcctcccgagtagctgggattacaggcacctgccaccacacccggctaatttttgtattttttgtagggacgggatttcaccatgttggcccggctggtctggaactcctgacctcagatgatctgcctgcctcagcctcccaaagtgctgggattacaggtgtgagccactgcgcctggccgtgaagtgtgttttctgttccatctagcagtgtatccaggagccaaagctggagcctgggctctggcaccccctcacccccacccctcacccctactcccacccgaagcagtggtgctcatccccgtgccacaagctcagcctcagtcatgggtggggagagaaaagccttgctctgaccccagcttaaccctggcccccattcagacgtattgttgctattgttttctggggtttgcttcaccggaatactgccccttcatgttctaagatccttcccaaggaatacgcaagtccctcccccaccacagtgcacattcactagataggggagactttactttttttgcttgcaaaatccaagtcctttcacgtttcctctccaaagtgatgaaaaggaattcggctgccaggacaagtcacaaggaagatgaaagcagctttcctgaggttcaattcttccagaaacaatcttcctcttccctcttcccccaactcctccccaactttcaatgcacccaagtgtatattgtttttaaatgtcaaagggaaaaaaaaaagaaaaagagagtgagagaaaacccatttgctcctgaatgtcacattctgctgagggagaaaaggcagaaagaacaagtgttggaattaaagagaagcagattttttgtctcctttgccttattcaggtcttcgggccggccccctttgctctctcctcttcctcgtttccctcccctaggccgcattgaaatgtcaaacacggcagtttgcagctgaaagggggtccctggtgggaacagcctgcccttctaacctgcaggaccgagctgttccctgctcgcccttgtgtttgcttttcccctttcttcctcgccggctaacgccagcagctgttgtttgggacggaggaggcgaagggggagggaaagcctttccacctgggcgtgtgaaggaggcgcgttacaaacaacgctgggccccttctttccctcgagtttttccaacctccggttgacacagagattgtcccctggggccttttcactttccgcctgggaagagaaaggccggggaaaggagctccctgtacccagagtgcctgcctctgcctgggtctcctctctcccctttcggggattctgtccaggcacgttggaggtcaagacaaagcggtgccaacgggccgggcgtggtggctcacgcctgtaatcccgcactttgggaggccgaggcgggcggatcacgaggtcaggagatcgagaccatcctggctaacaaggtgaaaccccgtctctactaaaaaatacaaaaaattagccgggcgcggtggcgggcgcctgtagtcccagctactcgggaggccgaggcaggagaatggcgtgaacccgggaggtggagcttgcagtgagccgagatcacgccactgcactccagcctgggcgagggactctgtcaaaaaaaaaaaaaaaaaaaaaaaaaaaaaaagtgcgagcggaagtagaagcgttttccaacgcccagagttggtgaaggtctagggagaggatgtttccctatattgctggcgaagggggacattggtccagcctttccagagggcttcttggtaacatcaatcaacacccttcgaaaaagtgcaaatgctcaattcagcaattccaggtctagggattttctcctaagaaataattaggcaaagagccaagagttatgcacaaggatgtgtgcctcaggagtgtttataatacagctcaattggaaacacttttctctctgtccaggattaaaaaaatgaaggcatgttatctcatggaatagtatagggtcattgtaaatgatgatgtagatttatatttgtgtatggtaaatgtgttacaggaaagggtcccgatccgaaccccaagagagggttcttggatctcgccgagaaagaattcagggccagtctgcggtgaaaagcaaaaccaagtttatgaagagagtaaagcagtgaaagaacagctactccatagacagagtaggacgttcctgaaactaagaggaggaacgtgtccatcctaggtaaaacggttctatatgtggggagatgttctctgctacaagggttcgtgatgaaggattaattttcttaattacaatattttgcaagaatcgatattatctttaaagcaaaattaggaatgtttttgttctccagatatcaagatatctgcatgctcccaaatctgggtctgtttagtaaacattattaatttgttcccttaactgtaaacatttagaggctaggaatgcctaattttctgagtgcagcccggcaagttccagccttattttcctggctctcactcaaaatggagtggctgtggtttgaacgcctctgacaaatgcacctgttagcaataacgtaggcacacactgagaatggccttgtatggcagacacacctgaatgtgtgttctgagctagggaatccgggagtgggaaacacggagactcattttttgtctatgaggaacatctgagcctctggcccgtcccgtaaaacataggccatacagaagactgtggctccgagttttgggttgcatgaaggttgccaggaggaggctgttgggagggaaggtactaaaggaaactgctacataaactgcatgccttttgcaatcggttacagttctcctgtccagcccaccagcactggactccctcctctgcaggtaagcccccatgcctcgttttctggctctgagtcttttcttcagcctcttgaatctggtgccttccccactggagtcaataggggtttggcatgataatttgctgatgtgaaaagatgtctacaaaaaaacaagggaaatagcaagatataccatgtatagttctttctcattttttacattaaataatatatgtgaatagaagagtctggaaagataggcacccagatgttgatggctgggtggtgaaattatggttgatatttcttgtctttataattcctagtgatttctcttttttatcatttaataaggatccttattaaggatcatataataaggatccttattataatcagaaaaaaatcaacaaagttattactttcctaaagagtgtgaagtgtgtaaattaacttttgccccttaggtactgtaatgctatctttttccttatgttgtatgaataaaaatttcctaataattaaaatgttcatttttataacatgaaaccagagatttattgtttttggcatctgagaaggaaagcatctaatccctaatagatcacagaacacacaatgatgttctgtgatttctttccttctctggtcgcctgttatttaactttgatggtccttttataaagaatgattgtcatctttcctccttcacctcagctccaagctggtcctgcatcacttctctctgctctgtccccagctgcactgtcccacctactcaatgtcccccagccgcttcccccagccagtctgctgttggcttttctgccattttgttgtgtacaactaactccaaccctcacatcaggacatttcaatcgacatatttaaaaggaggctgactgtcttggacagcccaggacatgtggacattgctataaaatacacccaccttgaatattgagaggttcctgtaaggcttccagtttttccttcccaacatgacttcctaaatgcaccaaagttactatttgaattttatatgattctgcccttacagtcaaaactgggtccctttacctacatgtcccatgggaaggtgaggccttggctttggataaaacatatcatggaggtggaagttctgactctgctcttccaaatacgaaccggtgttcctaggaaacacactgcaggactgacctgcatttccaatttgtgcctaagtgggagtggctagctgaattcagggaaagacttgaagttagcacttgagatattggccgccatattggaaagttggaggcatggcttggatgagtgtggctgacttttgaagcccatgccaacctctccagttcggcagtttgaagactgtcctttcacatttggtaatggggaagagaaggaaagtaggaaaaaggcagcctttatttgtgcttgtttttagctgaggtgaatgtatctgagggttgatgatgcccttcaaatggctttgctgctactggcatgctgctttgctcaggtgcagagaatcacttgcatagaacagtgtgtgtacatgtagatatctcttggccatcttcttgctggggaaatgctcctcgagaaccatggaatggaaagatgagccaaggaaatcctcttcatctcctgcaaggatcccccagccataaccccctcagggttcaggatgactgaagatcatcctgagtgcttggtgtgtgcctagtaatgcagatacagttcagtgtggggaggacagggctggagggaaagagccaccagcctctgcttctctgccaaagaacagctttatggaaataaaagacagctgcgtaggaagcagcccggcacttccacggatgctttcatttgtgaacagaggccgtgctaagcaacaactagaaggagtcttgggcatccctcactggacagagtacagttctttgttctgcccccataaataagggacattttctctaggagtgtgatgtattccagaaatttgttgttagtgagggctttcagttgtcttttcagattctcatggttcttaggtctttataatatcacatcttgagaaaaagtataggttttgaaaatctagctctagtgattagaaaatttataagcttagtcttcaaacttcactagttttacatgggactgtagtatcagcctctgggggctgtagggcttaaaaggctggtttaatccgggcgcggtggctcactcctgtaatcccagcactttgggaggccgaggcgggcagatcacgaggtcaggaaatcgagaccatcctggctaacacggtgaaattccgtctctactgaaaaatacaaaaaattagccgggtgtggtggtgggcgcctgtagtcccagctgctggggaggctgaggcaggagaatggcgtgaacccgggaggcagagcttgcagtgagcggagttcgcgccactgcactccagtctgggcgacagagcgagactcagtctcaaaaaaaaaaagtctggtttcattgatgtggccctggctacctttctagccttatgtcatttatttcactatttcaagccaaattgatgtctttctcttccctacgtcagtaggctctttcacacctgttttagcgcttcctgtccctctgcctgaaatatcactccctgacgtgttcgcttctcaaacccggttcatccttcaaggaccaatggaagtgttgcctcctctgtgatatcagctttgcccctgcgtctctgcttctgtttacctccgcgggagctcatcatacactctctgttttgggaaagtcttcatgaaaactgttcctctcccctactagactctgaacttcttgaggacatggcaaaatatctgttgctggatggatacacagataagtcaagtgctacacccctggcagctgctgttttatttttctgcctttctctaagttcccattctgaagcgtccttaatcccagatgaactagattggcttaatcacgtatgtatacaatcagtctatcaggagtaggtactctgattccctgtctgctatttttagtgagcccattagataagtgatcttcaggttgttcaggtgcaggacatttggaagtccctgcattgtttgggggagactatgaaatattgatacagttgtcttcgtcaatgaactataaataattagttacataatatatattatgtatataatatacgtttgcaaccatgggcagatataatgtgtccataaaaaacaaatgaaaacccaaatcctttctaaattcaaatttttaaatgaatcataattgtatccctccaagttttaaaatcaacattcatttgctgtttatttatttatttatttgatctgtgagtgctcacgagtaaagaagcaataagagtgataaatacttaagaaaaaaatactggagaacaacttacaactgagaacactctattcattagccattactcaattttgacagcttaattgtcttgtttagtaaagtttattgagtacttaggatgtgccagacactgctaagggctttgtatggctatcccattaatcctcattaccaccctaagatatggacatctttataattttcattatacagatgaggaaatagaggcttagtgtcaaaggttaaatgctttcacaaagtaaatgttttcaaaaagtaaaatcatgactcctcatactaacgtaaaatgaacacaagtcagagatttcattgaactcgttaatgaatgagagaaccagtaagatgttactgaaacacatctgcatttctacggacaagaacaatttgccttactataaattttctgtaatttagagaattgtaaaagagctttaagttaatgcaaggtggaagtaacccagtggacacaggagccagaacacccagttatcttgtgtgcccatttcaaagtcttccccggttcttcacagggttaggaaaagtcactggaacaagatgcaaacccaaccacccagagccagtgtccctaacacctgctctgttgctagaaagatttaagaactattaagttgatgcaaaagtaattgcggtttttgccattgaaagtaatggcaaaaaccgcaattacttttgcatcaacctaatacaaactgaaagagagattatcagctcttttttggagttgcttttcctcctattgtttgatttattgatgtaactatttttcttccatttaaaaatgctgcatcacatatgtttaggttttagagaataaaaggaactcactaaatttgagtcttgtgttaaatgcttgagggagatactagtaattcccattatgcagatgaacagataggtttatagagacactccaagttgcaaggcaagtggagtggagctgtgactgaaacccatgtccctcccatccagggcccatcatcagctaggaatgtgtaagtcactatttattctaacagaaagaatttgcattgtccccagcttctggaggctgcatcatttgccatggggttgctgagttgtgctgaggattaggggatagagcaaagaaaataggatcggaaagaagcaattttcccccctctgtgctcagtggacccatatttgtctgcatgtggtagcccaaagtgacataagtgttctggacccagcgcttgacttatgccaatgttcagatattgagtagggccttgatgttggagtggcagtgtgctttttcagctgtgcaggagctggatttctaggacacagcaattctctgaaggtgttaagactgctgtcaacgctgagtgaggtggctcatgcctgtaatcccagcactttgggaggccgaggcaggcggatcacctgaggtcaggagttcgagaccagcctggccaacatggtgaaaccctctgtctactaaaaatacaaaaattagccaggcatagtggcgggcatctgtagtcccagctactcaggaggctaaggcaagagaaccgcttgaacccaggagatggaggttgcagtgagccgagattgcaccattccagcctggatgttagagcgagactctgtctcagaaaaataaagggggctctcaaaatgccacaggccactgcatttagtgcatcacattagctattagttatccatccgaagaaactaagcagtgttttccaacactcactatactgtggccataccctaggactagcatttatgaacccatatgtggaggcttccttcaggttcttcaagcctggctccatccagatgacctggatgcttggatacaatgcagttttgtcaacagccctccagaattaatcagaatttcagcaggatgagggctgaacatacctcttttcaagatccaaatatacttgggcttcccaggtataaacgctgtgtgctggattcaggcaggccggaatgtgcatcctggcctcattgcgtgatattgggcaagctaattcagctcttgaagacctactttcctcatttgaaaaatggggataattatagttgtggggagtggacgaggtgatccacgggaagcattggcactgggcctggcaccggctatgttcccagccaatgtcagctattaacgaatttcattgattccgagatgctcttttttgcatattaacatctttgaaatcagtctgcttctaaaaattgatggcatgtcatggtctcagtggtagcattttacccccttcttagggtctctaaaacaatggtgcaccttacaatagacagtgtctagacttagtgaaatacagggtgtgtaagggtccccggggtgcagtattgatgaccacagggcctcgtggaggagtgctggaaatttggaaatgtcaggtctgcctaagctgtgtccagctccccagtgttctgcgcacacaggagtaagtcaaagggaaggtgaataaacaaggtgggtgggtctgcttctcttggataggggcttcatgattgcaggtgcccttgctcagtctccttctctcaggtgttgctcagtttttctttccaggccagggcagctgagctgggcagggtgggcggggtgagggctttgctcacctcgttcaaggtcctcctcaacaagttgatctccaagcttgcttgggccacttggcttcaacaggttctattatccttttcctttgggtgccctttcagggaatgattttgaaatggaacccagggtcccgaaggagacagcaatatccctaataccagcttgacccaagagggcagataaggaagacattacccctgctccccaccaaccacctctgcctcactcttgttccgttcagccacatgatcatgacggaactcggcagcgagacagccgtgggggaaggtgtgcttcttgtttttatttttaaggtgatcctgtaggaaggaatcggtgtaatgaatggtttgctccctttgaaaaagaaccatctgggtttagatttcatatttcctatttcaaaccctttcaattagacccttggggtttcccaggcctgcctgggggagtctttctccaagcttcctttccttcctttcccaaaccctgggacaaatgtttgtttttctcacatattcatcaaggcccaaggccttcagaaagtactgaggcgctgggctttgacatgggaagctggagcctgtctggggagcgttgagcccgagaacagtacttggcaggcttgcttcctgccccatgctgccattcactgtggacagcttgggggtggggacggtgcagtgggcgggggttgggggtgcttggcacatttgctgaatccactggaagccctcagtttggagagggaaagggactttctcatggatttccagctccaagagcatcaatcagcctcagagcaacactagtgaggaaaggaattgtttatagcaggaaaggtgattacaaaggccacccgctcactgtgtatcttttgttcctgttggcaccttgaccagaattctggggcagccctcgtgcagactttgcctgcctgggtctgtggatcctggaggtcgaggaggaagggaaaagatgcccagagaagcagggagaagcccggctctggagtctatactgtgtcccatctccctctttctttccttctttttttctctttgagacggagtctcgctctgtcgcccagactggagcgcagtggcgtgatctcggctcactgcaaactccgcctcctgggttcacgccattctcctgcctcagcctctcgagtagctgggactacaggcgcccgccaccacgcccggctaattttttgtattgtttttgtagaggcggggtttcaccatgttagccaggatggtctcgatctcctgacctcatgatcccgcctgtcttggcctcccaaagtgctgggattacaggcgtgagccactgcgcccggccctaatttttgtatttttagtagagatggggtttcaccatgttggccaggctggtcttgaactcctgacctaaagggatctgcccacctcagcctcccaaagtcctgggattacaggcgtgagccaccgcaccaggcatgtgaaacttaaatcaggtgtcaaggtctgctgggcacttggttggcaattcatactattactcctgacctgcctttcccccttcgctcttgcctcagagggtaagatccataccttacattacttaaacatgatttttgaaagggtagttaaagtagaggaatgagaatgaggaaaatgagaaggaaaagatgtcatttccctgcacatttactccctcccaccgcaccttcaaacccgtttacatttcacaaacgttactagccagaagatgcacatctgtgcctggaggctgcatttcctctcctgaagctagcctctgatggaagtctccgctctgccggttggtggttttgctcggctgagctgtgggctgtggggttaaagtacccttgccaaagtgaagagttttatctgccttcctgacagctgtgagaaattctgattgacaagagggcagattctacacagggggttgggggagacaggtccccacgtgtcagttttgagaggcactactggtgtcagatagatttcatttctgtattggaaagtgcttctttaatatagaattgaaaatattcaagcctgtagcaagggacagttgctccagggcagaaaatggtctgtataaaaatgccctcccagctgcagggtggaatgcatggacttgaccctaatatggaataattgaatttataggaagaacattgccctgtgaatagctcttggaagctgctgggcagagatgcacagggtttctaacatgcaaatgcggctgagtacgaagccccagaataaaaatcccatccatccatcatgttattaacaggcgggttcctagactgattttgaaatttgtcagtaggcaaattaattacgctcttaaaaggtgatcagaagcatccataggtgtctttgacctttgacaaggaacacactgctatgggtctaattgtcagaataattgttttctcccctgcgaatgactggcggcaggtgcagctctgtgcattggtctgcatttaattatctacaggatctgaggatgggggttttgtgggatatgcttttataaaataagcttttatagtgtaaaaataccaataactcttcctggctggatacatttattttaaacaaattacggtggctgcatataggcatagagcttaggtgctccaagagggatatttaccttcatgatgtgtgggttttgtctttatttgtctgagtgatattaacaacaatacacagcctttctccaacggcacttgctgcttgtaggcagggtttttgtgggcattgttgtaataatcgggtaagacatttcaaaatataggctaaaggccaaaacagagcaattgaagaaaataaatccatgtgtggaaatgaaatccatttgggctaaaaatgaagggtgtgtgttacagtgaaaacaagacaggtatcaaaatcagaatcacttgaatttatccagcacttctaccattcatttggtaaattattggtggcaacgaacatgtgctaagctaggggctggggatatatggtaaactgctgtcccggaaacagcgatataattgtacagatggctgtgaaactgaagggcagggtgcaaagaaagggtgatacagatggctggaggtggtcagaaaaggggtcctctgatgagtaggaattaactagatgaagtgtgtttgtgtgtgtacgtggtgccggtgcaggggatgataaagtgaggatggtgtacttgaggttctgaggcggaaaggtgattggtgtatgtgttagtctgttaaggctgccataaggaagtaccacagactgggttgcttcaaccgcagaaatggactgtttcacagttctggaggctgcaagttgacatcatgatgtcatcagggttgattacttctgaggcctctctttttggtgtgcaggtggccatgttttcctcctgtgttcacatggtgttccctgtgtatgtgtctgtgtccaaatttcctcttcttgtaagaacatcggtcatattaaatttggacccaccttaagctcttcattttaactcggttacttctttaaaggccctctgtccaaattcagtcccattctagggtactaatgggttagggcttctacatatgaatcttgaggggacaagattcaatccataaccctctataaggaaaccgaatgcagattttcaagattcaaaattgtgtgctaattataaacataattcttgacggaggttatagagtttaaagaaatttaattctatccactggaaatttttatgaatgggttgcaaacctcaactctactagagaaatgctggaaagaaaaagagcctgatgaagtcctcatcttactcag

SEQ ID NO: 477 - DNA, 40001 bp, Homo sapiens
agatcagatctttcatatctaataatttttcgtcatattatttgatacttctaatcacagatatattaaatgtttctagtttctgtggacataattttggtgaattccttttcttttgtatttaaaaattcttaaaattgtacatatttttggggcacatttggtgttttgatccatgtatacaatgtgtaatgatctcatcagagtaattgagatatccatcacctcaaacatttatcttttccatgtgctggacacattacaagtcttgtcttccagctattttgaaatatacagtaaattacatttaactaacagttatagctgatgaaaattataatgataaatttaaaagaaaaaaattcattgttatttaatcaggtatggaaataaaccccagagctatcatactgttcaaggattgctaatctttaatatctaaaacaaactaagagtctgtattcttttttttcctctttatttgagacagggtctgactctgtcacccgggctggagtgcattagtgcgatcctggctcgctgcagcctcgaccccctgggctcaagcaatcgtctcatctcagcctcccaagtacccagaaccacaggtgtctgcccccatagccagctcatttttaaaatttttgtagagatggagtctcactgtgttgcctaggctgatcttaaattcctgggctcaagtgattgtcctgtcttggcctcccaaagtgctgggattatgggcatgagccaccatgcctgacctaagattctgtattcttaatccttttgctacacccactcctggttctgaacttattttgttggtcacttaaccaccttgggcctcagtttactcagcagagcaatgagatttcagacaaaaaaccttcctagttgttcacaacaccaagattctatgttcttgtaaagaatggttaagtgtgtatgtgtacctgagttacgggggagaccttttgagtaggggttactatccagggtcttgctgagacaggaatgtactgggtacttatgcctctaggaattacatgtctggagttcgaggggacctcaaggccactaagtcctctttttgcttctcctaaacatccgtcttccccaggactttctcttttcctttgttctcctggtgtgtgttgattgggggctgttggcctgagggctatgcttcctgagactctgcccaggcaggctgtgaggggcctgggcccgatcttgaccccagggatccttatgctaggagctggggtagctttggaggctttggctgtcagcagagatgactcctgacctagacccttgaatgagcttgttcccctgtgaaggatggagataagtggagttggagttcctcaggggtgcctaataacctacctaggataactcagagaagagagctatggtggagtgttgaaatactagcccttgtgaactgtacctactggtatgcatgcccttacttatgtagtttcctttcacattgctctaggcttggccaaataacttgctttggtcaattggacattagtaaacatgatacaggctgaagtttgataaactcttgagtttaggccttgccctcttggaattctaaaacgatgcaaagagaaacccaggaaacagcatcaacagccaggcaggtgagcctggtcatactagaccatcccatgccagctgagctatcagatgactgtggacatgaatgtccctagccaagacagcaaaagaacagctcagctgagcccagccccaaatggctgacccacaaaacatggctcctgttatgggagccacaataaatgccttgggtggtttgctgtaacgaaattggtaactgatatgagctgactgctatttagccatttgcttatgagatctgaatgactgagaaaatcagctcagccctgtcaccctccccctggcagtgcctcttgtttgctgtctttatatcttctcttctgtgctctcagaatgccctgtgcccattgctcattatactgcatcaatttgttcattcatttctttttcttttttttttcttttttgagacagagtctccctctgttgcccaggctggagtgcagcagtaagatcttggctcactgcaacctctgcctcccagattcaagtgattctcctgcctcggcctcctgagtagctgggattgcaggctggtgccacgacacccggttaatttttgtatttttagtagagacagggtttaccatgttggtcaggctggtctcgaactcctgacctcgtgatccgcccgcctcggcatccccaagtgctgagattacaggtgtgagccaccgcgcccggcctgttaattcatttctctctgacctgagcaccttttctttcagtttagtacctccagggctcaggacagagacttgtaaaatgttggtgcccaatggacacatggagaaagaaggtatgaagcccggccattcgttcgtattatagaaaacgctgaaggcttcccaaggcaccagcttgctatgtagctgacgggccaccaaggcaaggtgtgggagtattctgcagctagtcatggcagccagtcaggaccctcttaactctgctcctcacgcaacttccatcctgctgcagtgtccaccagctcttgaatttaaagtctttgaaatgtacatcctgagctggggctcctggctcaggtcatggtcctttctgatgacccgccatttggcttctcacttgggacctttctgcagcaaagccctggctccatcctctgtccctaccccatcctattccccgtccctctctctcctggcctctgagattcggtgagggattgtttaggtacaaagtccattggaagccacattaagtgacttaattatcagaagaggagcgatgtggaatgagggacaaggtgacagctactgtgtgcacaaagactcagtcctttttcgtttgtcttttttgcttttttcttctgtgccatgacaaaaagcttactcttgttaagttgctttatttgaatatgagcctaaaataatatcactaaaaaaaaatatcactttggaaatagattccgaagaaaggttcaaactcataaatggtcatagaattgttctaatgttttatatcggaactccacattttggcatttgtctctgaaggaggcaattgttttacattcagccaggctgaaaatgtctgcaagctgatggaatccttctggaacatcaaaggatgggaatctggcttcatttgtactaacatcatttattatcttttcttcagattttaagttataaaaatctcatgaattaatgatctctctgagggtatgagaaatttgcatggacaattcagctgaagaaggcagtaatttacacacatgcacacatgaataatcccaacaaagtaagcgaagccaaacaaacgtgttttgtttcataccttgaagttctttgatttgaggttcgtagaactaaaaggaagacagtgttttaaatgtgtttttcaaagaagagtcttctcttttaaaccaattctaattcaattctgttagaattttaattgttccttgaatctttaaggagactgggtttaccattattcatttgaaccagggttcaaaagggttctgttgattaaaataacaattttcgtcacataaattagaccatttactagccagagctatcatttatcaaacattactgtaagctctgtaagctcagcacaggctaagcacttcaaatacatggtttcatttaataatcccaataatttgacttaagtacatattaatatcctcttctcagagataaggaatcaggatgagaggttcagcaatttgcccagggtcatttagaaagcaggagcagagctaggatttataaccagcttgcgtgaactcaaagttcattcttttaactcctgttgcctttgaacattaccgttgacaatatttggaaaatgtgtcatctcctgttgcaagggacaaatatgcagtttaaggaataggcatcaggcttttagaataactgactttacattttagacttgtccttctctgtccttgggtgggacccatgaagtaatgctgctttgacatctgcggcggagaaagccactgtccactcaaaattcatgggcccttccatggtacaggatgcttcctgagaagcagctgcttagccagggatgttacttagtttcacctatgaatggaaatgatgttggcggcacccaggcagaggtggctaagcagtgcatgtgtcttccttacctgcccttggggagtgacaccccaggagagctggacactgcctgtgggaaaagggtagagcctactcctgtccagacctccctccaggccttcctcctccactccaaccagagcgaacacactgaagtgttaagtgagtgagagctacatttttattgttaagccgttggagttgtggggtttctttgttaatacagcagttagcattaccctaaccaaaaatagagcttcctttaacttccctttaggggaagtgagtggattgaacagctgaaaagagggtagtgggcctcttcaccagagtggatttcccagttaggcagttactacatcctatgctgatggtcacatgtttagaatatgggcctggggggatgagagaagagggcaggtgggtgctcaaggtgaggcttgggggagaaactgaggttgagaatggtctctctttagcccaggtggtacattttcaattataggaaactttaaggagacggtggtagataacttaagagaaagaaaaatgcgaaccgacatggatgtgtttaaaatgagtgagcaggctgaggtgggtggatcacctgaggttgggagttcaagaccagcctgaccaacatggagaaacctgtctctactaaaaatacaaaattagccgggcatggtggcacatgcctgtaatcccagctattcgggaggctgaggcaggagaatcacatgaacctgggaggcagaggttgcggtgggccgaaatcgcgccattgcactccagcctggaaaaaaaaaaatccatctcaagaaaaaaaaaaaaaaaaatgagtgagcagaagttccccgaatgagcacctttctgaggagatttaacttgatgtctgatcagtttaacacaaggcacatttgtctttgtgtcttcaaaaatcttgggtcgtcttctgcaaagaaaaagattaaagcacatctttttttttccctcttctataaagtctcatgttacgtccctatttgtagcttttcaaggcactaagattattgaatattgatttggttaaaaatggagaacagctctttctgtttataccctgcagttcatcctcctgctgttccccacatcacttctatgcactttctgaaaatcagtttaattaaaaatgtcatgcatggtttattgaatttcatctgaagaataagcgataacaaaaattgtttggtcttataaccaagtaaatagatatttggatactaggtatggggagaaataaaactaattgtttaaacctcagttaatgagaacatactgttttgccagtgcagtgttgggaaagaaagcatctttatttgataatggaaaatattaataattacttaaagcactttgttgaagtaactgtatgagagctacatgtttcttgtgggtagccatcactctttgtaacaattgttttaataccagagctctttcagagagtaataacagaagtataccttttactattgttaccagaaaggggtcccgatcaagacaccaaaagaaggttcttggacctcgtgcaagaaagaatttggggcaagtccataaagtgaaagcaagtttattaagaaagcaaaagaaaggggctgggcgcagtggctcacgcctataatcccagcactttgggaggccgcggtgggtagaacacgaggtcaggagtttaagaccagcctgagcaagatggtgaaaccccgtctctactaaagattaaaaaaaaaaaaaattagctgggtggcaggcgtctgtaatcccagctactcgggaggctgaggcagacaattgcttgaacctgggtggcggaggttgcagtgagccgagatcatgcctttccactccagcctgggtgacagagcgagactctatctcaaaaaaaaaaaaaaaaaaaaggtaaaagaataaaagaatgcctactccataggcagagcagcagcatgggctgcttgactgagagtaaacttatatcttgattatatactaaacaaagggtgaattattcatgaattttctgggaaaggggtgggcaattccctgaactgagggttcctcctctttttagaccatgtagggtaaactgtcatgatactggtgggagtgtcttttagcatgctaatgcattataatcagtgtataatgagcactgagaacaatcagagatcactttcattgccattttggttttggtgggttttggccggtttctttaccgaatcctgttttctcatcaaggtcgttgtgacctgtatcttctgctgtccccctatctcatcctgtgactaagaatgcctaacctcctgggaatgcagcccattaggtctcagcctcattttacccagcacctattcaagatggagtcactctggttcaaacacctctgacactatgcagttcatacaaacagtttagtttaatgcaaacagtacgtgtctgctgatcacagaaataagtccctgaaatttgaatcagtctaggggagaaaattcttctttggatttaagagagtccagtcttttcccagtagacaagaacaaggaagatagctacaggcagccatctctctatcaggaggaaaatcaaccttaaaagaaaggcaataatagaatgtggtacatatactgaagaaggaatttatgaattttacaagtacaatcaaagacaaccaagaaatttttactttttccttcaaaagctaagtgtagtgtacccacccccaaccccgtagtctaagttagagaagaatactgcctgcctgtttttccttccgtgctcagtgagccttacccatactccccagtttcacattccttgaggctcagtgagttcctgcgtcacctgcctagcacagctgtaaagttacaaggttgatacagaaacatggcttcctaaggatgtagaacatatagtatagataaatgtaaaagactgatcaccgggtgcggtggctcacgcctgtaatcccagcactttgggaggctgaagtgggcggatcacgaggtcaggaaatcgagaccatcctggctaacacggcgaaaccccgtctgtactaaaaatacaaaaaattagccagacatggtggcgggtgcctgtagtcccagctactcgggaggctgagacaggagaatggcatgaacccaggaggtggagcttgcagtgagctgagaccgcgctactgcactccagcctgggcaacagagcgagactccgtctcaaaaaaaagactgatcaactgcctttgttctcgcttctgtaagtatgcttcctgcatcaccactgactgcttaaaaggtggctgctttctttgtccggggctcagactttcctggatgctagtcctactaagccaggtgatcaccttttaataaagacctttcctgaactcactctcttcagtctctcctatctctgattatcccgccacagtacaccatggcatactatacagtcacaaaaaagaatgagatcatgtcctttgcaggaatatggatggagctagaggccattatccttagcaaactaacacaggaaaagaaaacctaatactgcattttctcacttataagtgggagctaaatgatgagaacacatggacacagagaggaacacacactagggcctatcagaggatggagggtggggagagggaaagagagagagagagagaaaaaaaaaggaagccagtagggtttatagcagagaggagaatttgctttatcagaccttgtcgactgttgacattttgggccaggtaattctttgtgatgggtctgtctggtgcattgtaagatgttcagcagcatccctgccctctttccaatatatgctagtagcacgccccccaacctcagtcatgacaatcaaaaatgtctctagacaggcagggcacggtggctcacgcctgtaatcccagcactttgggaggccaaggcgggcagatcacaaggtcaggagatcgagaccatcctggctaacacggtgaaaccccgtctctactaaaaatacaaaaaaaattagccaggtgtggtggcgggcgcctgtagtcccagctactcggaaggctgaggcaggagaatggtgtgaacccgagaggcagagcttgcagtgagccgagattgcgccactgcactccagcctgggcgacagagcgagactctctctctcaaaaaaaaaaaaaaaaaaaaacaatctccagacattgacaaatgtcttctgcagggccaagctgttctaaagcagtgctgtagtaataaaacatcagccacatctgtaattaaaatttttttgtagccacataaaattaaaaaaggtgaaattcaagcaatttcttttatttaatatttaaaatgataatttcagctacaattattgaggtattttacattcacttttgcgtacaaagtctctgaaatctagtcagtattgcatacttcaagcatatctgaactctcactagccgtgtttcaagtgttcaatagccacatgtggttaaagcaaccacattagacagaaaagctctaaagccagcaacacagggacttaccatgccttttatcttacagttgagtccataaacgtccttttttttttttttttttttttttaaggacgattttggtgtgatcgtctgttcctgttccttgtggctgaaagtatcctaatacaagcctacacgggtgtttctgataattaaggtattaaaaacctctagtggacatctttgctagcatttcttattatacaagcatcattgtctaatagtggctgtagcattccttgtatggctctaaggagttgcttctgtttagacagcagggatacctgcttgcatgcccagtgcttgcagacatggctttttcatgaaggcttttcttgtccatgagccatgcttgattctcattgcattttcttgagtcctttggtcatgaactttattgtctgactgctaagccctggcctccctcttccccatatgcagtagctctttgcttgtgtgcaagtaccttgggctaagcatgtttcagggtggcaggaatagcagaggtaaaggagagatgggctctgtcatcaaggtgagtgagcagaagaatcaaggcacctttcttgactacagctgggaattgcagtaaaaccaaaggaggacattcttgcagaattgtcaaaatcagaaacagaaatttacaaggaagttgtttcaggagattttttttgtttccagatgcagcaggcttgctgattgaaaacatttgggtcttgaaacccaggtttttactctgagaacgagaaatgtcagaaaatcccatagtatgatcctctttcccactttatagatgagaaaactaaattatagagaggctagaaaacgagcccaagtctatgcagtgttagtaacacatggaggaacataacctgttctcctggctaaccaaatatttccacctcaaagtgctgcctcctatatattttggtttgttttgagatagtctcactctgttgcccaggctggagtgcagtggtgctatctcagctcactgcagcctccatctcccgggttcaagcaattctccctgcctcagcctctcaagtagctggggttgcaggtgtgtgctaccatgcctggctaatttttgtatttttagtagagatggggtttcaccatgttggccaggctggtctcgaactcctgatctcaggtgatccacctgcctcggcctcacaaagtgctgggattacaggcatgagccaccacactcggccacctgcctcctatatttatttagagtttattcaaataaattctacaacaccccttacccaagtgtttttatctttagttacttaaagattttcttttgaaatatatttggatatacatgaaagttgcaaaaatagtgcagagaacctccatgtaccctgcacccagcttccccagtgataagatattgcatagtcctggctgggcgcggtggctcacgcctgtaatcccagcattttgggaggccgaggtgggcagataatgaggtcaggagatcgaggccatcctggtaacacagtgaaaccccgtctctactaaaaatacaaaaaaaatttgctggacgtggtggcaggcacctgtagtcccagctactcgggaggctgaggcaggagaatttgttgaacctgggaggtggaggttgcagtgagccaggatcgcgccattgcactctagcctgggcgacagagtgagtctctgtctcaaaaaaacaaaaaccgacaaaaaaaccaccccttcgggcttcaggcagaatcgagaagcatgagaaagctgcccttgttggctggctcctgctttttggtgctccccttgtcccctgaccccacatagggattcctttgtgccttctcttcttccttccttctttgcctctcctctcccgggtttcaaggcttcaatcacacatgctgttttctgtgcaagtcattcagaccctttcctttgccaggtgaggctggattaatgagacaagtgaatccctcaattttgaaataaatttggcagattatccccaagacatgctgtgactgtcacctactccttacttttctttaggaatgaagtcattacagcctgacagtgaatggtgggtatttctgggatgctgtgggaggcatatggatgatattcttttcatttgaattatgtaaaatacctctcattattaatggatgccaactgatcaggtttctcctgctgatggttctgttggatgtctaggatgtgtgtgtgtgtgcgtctaggatgtgtgtgtgtgtgcatgtgtgagtgtgtttgtgcgtgtgtttactgggtggtcctgggtggtggcgaggcaactagatgcttcatgagaaatataatgagactgtttatctttagtttccatgttcagggaagttgtctgtttcaagttaaaggataaatgctcaggtcaagctaatcccaatcattttcttttttttttttttctggggcattctatttcagttcaatcatcattccttttgaattcattctgttttactaaaaagaaaatgctcacaactcttcagtccttattggggaaggttttcctccaggcatgaaggggggctaatggtaaggtggttgaagtcgaaagatcagcaccatctcacagtccagaagcacagagggacaaggaatggcctccctggctttatcctaactcctgaataaacttttcttagggtctttgtgtgtttgtgtgaactggaattccagctctgccatagcccctgcccccagagcacagggagaatggaaaggcagtgaatgatagagctgcttcttagggcagattctgatttctttctgtgaaggctgccctgaaattcaaagaagcattattatttcatccaatttaaaaccctgcctgatgctgaatgggcaagaacctaatttcacctttggaggcaaatgggaagctttttgtgctgaaagaaagaagaaaagaggattctggaggataattgaatgaaaatccctttaaggtgccagaaaacttcgcccttccaaaagggatgaaacgaggtcaaaatatatttgttaaaagtgtggggcttgaaagccttaattatttctttggaaagtcgtgtcttttaaagacttaaacaaaagcttcaagaaggcaggagctgggagaaattgccgatggctttagagaaggtgaagcccaaaggaaagcaattactggtgaacaatggtatattaacaacgattattcttccagattgggggaccctacattggggttgggatgtgatttaggaagattgcctggtggtcctgcccaggtctttgcccaagaagatgcgggatggaggagtgacacggtcagacgtgactgaacaggctggaagggaagctaggttggctgattaaggaagggaagaaatcatccttatttcatatattctacagaaaatattatttctcttggggcagaatggtgggctgctgtagtgaatgctgtctggatttagacagatgggtattcttaatctccaatccctcacttactagcctcaacaccttaggcacagtcctttatcctcctcttcctcatctgtaaaatggggaaaaaattccctgccacagatggtgaaaactaaatcaggctatcctgggcctgatacacagcagatgctccataggtgtgggttctctggatctcttgttcctcctctgcttggtttgatttctggacaagttccctgtggcattttaggtgcttgcttttgaattttctgtgtcacagtgaagttcactcccagtgctccgtttggccatctgctgttgattgccaggggcagtcacactctcttcatctgttccttcagacccagggctacctctgcaccagctctccttgggggagtttctaactagcagaggatccagaatcattcctaagattaacaaaatagctgggcacagtggctcatgcctttaatccaaggaggaggccaaggcgggcagatcacaaggtcaagagattgagaccatcctggccaacatggtgaaaccctgtctctactaaaaatacaaaaaattagctgggtgtggtggtgcacacctgtagtcccagctactcaggaggctgaggcaggagaatcaagaggtgtaggttgcagtgagccgctatcgtgctactgcactccaggctggcgacagagcaagactacatctcaaaaaaaaaaaaaaaaaaaaagattaacaaaatattggaaagagcttgcattcctgcttccttcatgttcgctgagttgcaggcagtatttccctctgccctgcagaggaggtgcaggtgaattggttaaaacaatccattttgcccctttggattgttttgtgtcatgcaaacttccccttgactgtttcagtttgcatatttattctgttctgagattcaaccaagagctcttcctggttcccaatcaattgcttttcctagcaggaactgacaatccagcagaaaccgcccctcagttcctcccccacctcctgtcttgattgacataaccctctcagaccccaaaccagtgaagtgtgtggggtctcctggccaacctaactgtagattaataatggacagtcaggtctgtgggtggtgaggagttggggagtcccttctcaaggagcccagagacctctttggaaagattaccaaaccttgttaaaaacagacatccttggggccagacacggtggctcacgcctgtaatcccagcactttgggaggctgaggcaggtggatcatgaggtcaggagatcgagaccatcctggccaacatggtgaaaccctgtctctactaaaaatacaaaaaatttagctgggcgtggtggcaagcacctgtagtcccagctacttgagaggctgaggcaggagaatggcacgaacctgggaggcggagcttgcagtgaggcgagatcgtgccactgcactccagcctgggtgacagagcaagactctgtctcaaaaaagaaaaaacacccttggggttgtcaaattagtgaatgtaaagatttcccaagggtttcaaagagtggcctgccagccagcttttgaggaaactgttaattcagaggcaggagcctctatctggtttgctggttgggaaaaagtttctatagcacttgtaggctttgcaggcattggtcctctttgtctccccttaggaagtcaaatagagtctttctggcaagaattgggcaagaaatagcaaccgtttcctactttctcaattggtccagtaaagggggcttcctgggtgatgtgatttttagctcatttggggacgctatgcacgttatcagaaatatgaacacagaacttgtcctagtggatacgctagatttcatagtaattaggtgttgggcattttgacagagagaagaaagggtgttagaatagtggcaacagcagcttgaatttctaattatgtttccccttttggggcccaggggatacacgtcttcaatttcttgccttatcctttttttcctaaattggtagaactcagttcctgaggcagatgggagcactttttaagaagatggaattttctaacaaccagagctatctcaaaagtcataagcttcctgcccctggaaatgtgcaagccatgtctgtctgcagagctgaaattcttgtgttctcaggaggctgggcaaatgctaagatggaggttctgaaatctgattactgcaccaatcaccatgggagagagttagtgatatatctactcccagacccggaactacacagaatcaagatctattaaggtggggcccgagaatttacattgtttaaccctctccaggtgaatcgcccgtacatattgctctaaattcccttttaatctgagatcctaataataccaaatttggactgaaactaaagcttgggctaaagctttctaggaatgctcatcacctgcgatgctggaactgctctctaggtgagctctggggtttcccttgagtgtgcaaggcccttctccttgctcccagccttctcctcttttctttgtctcctcttccctttctgcactttcttttccttgtctctcctcccttttgtctctctagggtcagtttttctgcgtgttttcctgactaggtccccactgcattagtgacatcaaccacccctgaccctacacatctgtaggtgtgaaaccttgtgtgcagaatttccacgcagctctcatcggcctgaccccacccaagatagctgggtagccccttgggtggagacaaaaaccagcccagtgggaaaggctgctggggtgggctggcatgcatctgaggtttcctttaaagctagagagaaaagggctagcttctttttagaagttctcttgagctctagttgctgtgtaaatcagcgtaaaacactctagaatcagaaaggccgtgtgtgttattttctccgagagctttaaatacaggatggtttggccacagacttagtcataaaatgaaggctccacagaggctgacacaggtgaacttgagtgctgatctggggcaggaaatcaagatgctttgttgttagaaacaaatccactaatgttatttccattaactaatcaattacttgattaactcatgtgttcatcatacacttattgagtgcctactaaatgccaagtaccagctgaggactaggaggagagagaaaacatctgctctcaaagatgcaagccttgcaaaggggaaaaaaaaacagatgagcagacaattccgaggtgcagagaatgtggagattgtatcactgaattcaaaaagcacagaccctgaccagtctgggggttgtggtggtgaggacagttgtctgtcttaaagccaatcctcagggcttggtcatgcacggcactgtctgtggcccttgcctgaatgaaccatacatgacacagcaaggtccctactcaaacaacagcagcagcaacttagcaattatatgaatatgttgcctccaaaatgatagatttttcttttcttttttttttttttgagacagagtctcgctctgtcacccaggctggagtgcagtggcgtgatcttggctcactgcaagctccgcctcctgggttcacgccattctcctgcctcagcctcccgagtagctgggactacaggtgcccgccaccacacccggctaatttttttgtattttttagtagagatggggtttcagcttgttagctgggatggtctcgatctcctgaccttgtgatccacccgcctcggcctcccaaagtcctgggattataggcgtgagccactgcacccggccccaaatgatggatttttctaaaacaacactgagtagctgtgtggtattgtaaaaggaccagagaatttgaagttagacctatttgacctttgcaaactgaggggtcttaggaaattcactttatcttcctgttgtcaattgtcctacctgagaaacaaggattcctcagggttgaaagtctaaataaaggaaaggaaaggaaattgcctggcgtgggtggtacatatgagacactcaagaaaggatgtttacatttttggccgggcgtggtggctcacgcctgtaatcccagcactttgggaggtggaggcgggcggatcacgagctcgggagatccagaccatcctggctaacagggcaaaacccagtctctactaaaaaatacaaaaaaattagccaggcgtggtggcgggcgcctgtagttccagctgctcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaaggatatttacatttttaaatagtaaaaaatagatatcactaaatatcacaggccgggcacggtggctcatgtctgtaatcccagcactttgggaggtcgaggcgggcgggtcacaaggtcaggagatcgagaccatcctggctaacaaggtgaaaccccgtctctactaaaaatacaaaaaaattagccgggcgtggtggcgggcgcctgtagtcccagctactgcggaggctgaggcaggagaatggcgtgaacccgggaagtggagcttgcagtgagccgagattgcgccactgcactccagcctgggcgacagagcgagactccgtctcaaaaggaaaacgaaaaatagataccacaactcaaaattctagattgcataagcagaactggctttgccaaaaattgaaatgggaaataaattggcacaggctatcaataattcaacaagtaaattaaatttaaaatctgcatttcctggaccgggcgcggtggctcacgcctataatcgcagcactttgggaggccgaggcgggcggatcacgaggtcaggagatcaagaccatcctggctaacgctgtgaaaccccgcctctactaaaaatacaaaaaaattagcagggcatggtggcgggcgcctactgtagtcccagctgctcgggaggctgaggcaggagaatggcgtgaacccgggaggtggagcttgcagtgagccgagatcgcgccacagcactccagcctgggagacagaaggaaactccatctcaaaacaaacaaacaaaaaaaacaaaaaaactgcatttcctggataacatggacaacagaacaaatagttttggtgacttctggaacaatcaacatccagtgcagtctcagaggcctctggagtgctggaaccatcgagggcagctatgaacaatgtgctatcacttctctcatcctctcatgacaaggtacatgtgaaaacaagtcttggcatcagtaaggtcccgtaaacttagagtgttattggttaccatcagcagaacaatggacaggaaatgcatttctttctttttctgtcattttactcaataagaatttggaagctgctcagtaaaggctcctgagcaatttagctgttggtgtggccctgctaaaaacgaaccaagctggcaaaggatagggctatacaatgttcatggcattttcatggttcttcaaggtgaagtgaatcgggatttggttgtctaggaatgacagtaatttatgttgactgttgtgtggtttctgtgtggctgggctaacagcactctctgggatgatgggacataagtgcgtaatgaattggttgccacactaaactctacagtggaatgaaaactccctggttgtctgtcacacacccaggagtgcaggagaagaagaccgggagaagagagataggcagagatgatttatcattgcaatgtcatggggagattggcataagcctttgggttcactgaactggtccacaggagagagccaactttcgaatttactcttttagcaccaactttaatgaacgggcttttaagggttagtgcctttgagggaggagtgccacaggtatctatacgaaggatgtggatgtggcaagggaattgccttgggcgtgtaggatacacacaggctcacgtggtagaacagtactcgcttccaagatggcagcttgggctctgtattaactctgatggcatgttgacaacaggtcctcattcacttcagtggggcaaaaacaaggggctcggttcctaaagttacataaaaacaagagcagtgatacggtgcagtgagtctgcattagtttgctagggctgccataacaaaataccacggaccgagtggcctaaccaacagaagtttattttctcacgattctcgaggctgggagtccaagatgggggtgcgggtgggtctgatttctcctgaggcctctctccttggtttgcagatgaccaccttctcaccgcatctgcacacggattcttctctgtgcacacacattcctggttgtctgttcctcttctataaggacacaagtcccgttggattatgagttgcacccttatgagctcatttaagcttaattgtgtctttaaagaccttgtctctaaatgcagtcactttggagattagagcttcaacatatgaatcttgcaaggacacaattcagcccataacagattctcaaaagattgtctgcacaaaggtttctccagtatgtgataagattttctgtagttcatgacaaaatgagcagaataggtacctggccctttcctcagttgagcttaactaaccctaacctctccctacacttccatttctaatgacatacttcctctaatagatttctttctgccaaaattcaaatgtcctgcacacaccaagattcaaatagtctatgtctgccaaactcttgtcatgccttcctcatccctgctctcacacagtgtaggtagggagagagcaaacacacatgcacagacacatacacatgcacacatgcatgcacatacagtatgcatgtacacatacgcacacgtacgcacatgcacacacacacactcctttctcagtaagggcagtgacttagttacctcttttggtgccaacgcgtctttctttgaatgctggtgacagtggatggcagtgtccgattgtacatgaggcttctccctaagtgcttttaatgaggcacccagaggcttcagagaaaagaggacttttttagggttcagtgaggcagagacatggggttggcatcactaccaagcttcagccatcagaaggaagccaacctacggtacctggcctgaagactctcatttggatttgcctagggtccagcaccccccaggacccatggcttggtcttccagagacaaaaggctgtgagtaaagactgatacagctgttttcgctaaaaaactcaataagctttggagcacaattgtgttgttttgatatgtttccagcagcattttgcatgaaaagaagaggggacaatttcttttacttagccaaccaggtgaaggagttcagtagagacggttccacccagtgcaattggcagtgatggctggtaggcctggtggtccccagcagggaatgcatccactatggtgatgcaggaagcactagtactgggcaggagtggttcatctgtggtcagtgggtgcagggcaagatccaagggaagtggcctggcttgcagtgttggctgcccttggacactcctgaagaggtaaggacgttgtcagccacgtgctttattaggggaggatacatgataggtttcttgggcctccctaaaacagttgggtcaagctgggagtccccagcatatcacgtttgagtaggaaaaaatagctaaatatggcctgttatttttgacatgtgcatattttatatgcagggcttgtgtggtctttggaaagtgataggtacaaaagaatcactttctctcatcatcactaatctggggttcatggaggaggtgagatttcaggaggtttttggatgatggcaaagctgtatgggctagcagaagaaaggcattcgggactccaagcgtgttctagagagtgcaacctttttcagccacacctctgcagtctcaagctctgtggtgatcctgactgcatttctctgtattgttcattttggagtcccttagagatgattcagttaaaacgaggacatcctgtgttcatccttggtctttggggatttggtgggtcaacaggtagaagttgtcactcttctatttcccagtgcttgggatagcgaatcacgaatatattcactccttccgtgccctttcctgggaagccatggagtttcacactaatagcagctgctgtctgtcatttcaccgtcacgtggacagtatctttaattgagacagctacccagttgtcttttagaatgaggttgaagtcaaagatttctgactgtttctctattaagaaccatttcattcaagattatttgcctgttggtcctgtgtttagaaacacttttgttcgctaaacacagcagttggctaagtaatcattactttcctttttatttagtaaatgatgcgcttattctctgcaaggctctggtctttgtgattttgccagtgatctcaggttgtgtcaattctgtgctggaccaaggcagagaaatgtgatgattcagccagcctgggccatcccctatgagccggtgcatgggttttattagcgtttttggaatgctgaaaggacttacgagcattgtcttccctttaaggagctctgaggccttagacccacagaatgggaaccattccttgaatgtttttgaagttgttctgctgtgtggtctgagtgagggagaggacaaagaatagagaagcatctgtgtatcccttttggggcctgccatggtggagtaccttcgtggcatactcgtggcatcgccaaaatatttgggggcttggttggcacgcctgccgatcttggccttgaacccacttacagtgcatgagggtacagtggctgctccttgtgtacagacacgggtcactctgtcccttctctaccagggacactgtgagccgggtgaggggcgaggcagatggaggagggaaagaagcaaagtcaggcgggagaggcagcaagacagggcatgtgaggagcaaagccccgagcgggtgccagggagaaagaagaaagactttcatgctgacattgttttcaaataattgcagttactgagaaagaaaccacagctgatgacagcaaattattgagccgctgagattcagaaatgcgtgtaatgagcgaagaaagctgtgtgagtccacaccagagagagggagagacagagaaaggagagaaagaagtggggagggagggaggagagaagagagggagggagcgagagagagagagagagagagagagagaattccagtgggggaggtacttgctactgaagtgttcatcttcccttgtgttagaccagagtgcttataccttttctttgcttttctcttctacttttgggaaaacaaatgttatataaacgccgggcaaagggatgattcataacccaggtgggttggagcaggacagcaagagatttcatcgcactactcagaacagcatacaatttaaaacttaggaattatttttttcctgaaatttttcagttaatatttttggattgcggttgaccgcaggtgactcaaactacagaaagtgaaaccgtgtataatgaaaagatggaggactactatatatctatagatctatatctatagctatacctatgtatctatctatctacacaattacaggacaaaatacatggcttgtgtttcatggtttacacaggtgatttattgcagctgtgacaattccagtacatgtcccgcagttgtgaaattcctgttgtttgcctccatggcggttgggaggtgggagcacgtgtcctccccagccttgttccatgccccgctcattgcttctgtttgtggaagagcagggtggcttgtcaggaacaagcagctccacttcctgggtcacatgctacacagccaatgactctcatacagcaggtgccctgatcgctcgctagagagctgctggatccccaatctactccttctctcagggcagtggctagcgcagggaatgcctggtcggaaacaaactggagagaatgcagagtggagtgaggagcccaccgatgctttcctccaggccctggagagcctggggtctgaagaagagcacagaggcccacgtgtggtaccataaaattctaggaacgctccatctgcactgcaggcctgagaatacccagtgtgacagcgctgaaaacattcctggtttacgcttcttaataccagtctgtaaaaataacagtccaactgcatgagatcatggggagtttgtgtggggccgtatgctgtgggccgagtctgtgctgactgacatttggaggcttgcactctggggcttgttggtttgggaaggggaaggaatcagagggtaggagtggaactagggagtaggagtagaagaaagagaatgagaaaaaggatgaataagcctatcttagcaggagatgtccatcagttaaggagtaacagggaagggtggataacattaccatttattgggcatctaccatgtagcagataatgtttatattttttcttattttatcctctctacaattaactagcattttaagcccggtttttctccagtagagaaaaccatgtcatagatatagtaagtaatttgactgaaggctgttaaggaggtagagacaatattcagcctgaggtttttcccaccccagagccttggtgattgtcattatgctgcaggattttcacgttaggaagaagtcagtttcatcacgagtgcacatctccagctggaatttatgttgctgtgcggagctgctttagctgattttatttgactgaactcagcggttgttttaggagccctgggatgaagctttgctctctcctttccaggcacgagtgatttgggatgagccatatgcacaaacgtgatggctgttgggtcaggttgttagggatgagtgaccagtgaccagtggtcaatttcttagaaaacactctcagcctcttagaaaacacccctgaggagggggtaatccagattcaactctgagggacagaaatgtccccaccattccccaggttcaccataggaagaaggaccactagtatcatttgtgggggcaccccttcacttgggcaaaattcaaagtaatttaaaaacttgattcagttgcacctctgcttttcaataagaatatagaagctacggactatcttctatttctcagatgtttgagatgcgtggtatattttaattttcacaaccccactgggaaggtggaattaactctgttttatggaggaagaaacagaggctcagagaggatattagctgcccagaacaaaactatgattcagttgttgttttgaggtttagactcattcattcagtctgattttagagcttttttttcccactaatgtctagcgcatttccagagggaccagggaggctcctgtctcattaggcacactgggtatgctctggttaaaacaggacccaaggtggtatttattaccaacttaataaattatgttgagaatttatttaaaagccctgtataatccagctgttgaatgatactgttccttaaatggaaaacaaagatcttttctctctccatagaaagtggctcacatttttgcaaacaaaattacatgttttataacagctttcttgagagaattcacacaccattcaatttacccattgaaagtgtaaaattcaatgttttttaccgcattcataagggtgtgcaaccctcaccaccgctaatgaatattttcatttctgcaacaaaattacatttttaatcagttaaaataaattaacattacataaaaccgagaaaaagaggaggatctttcccgattctactggctccatttaacgtttatcattattgccgcactttccagtctttatttaccagagatgcagtcagctagttccaatcatctgtgcgtattgttttatgtctgcttttttaagttgacattttccatattgttactttgcatttttaatggcccataatattctctcacattgatgtgcgataatttacgaacccaccaccttttgctcaaccattagggttttttctctatcataaataatgttgcagtgaacatctttgcacacgaagcttatttcccctgttgaatatatttcactgggctgtagtcccaagagtcggcttgctgggttaaagggtatgaatgttttatatcctcctctcccctcccccatgtttatttccagagaggtgatacaatttcaaaaaaaaaagatatagcatacatatatatattatatataaaaagtcatttaatgttaccaaggttttgggttcattatgtaaatcagagacaggcaaaatctgtgaggtcaaacgtcacgcatttcttgagagccaggaacgattgtcctttatgtgtcccacctggtgacttaaataagtttaccattttccttagaaaattattcccatggaaaatgattccctcaacctcctgaccttttgttggttgctgtcagcctggggcaacactttgtttccagctgttcttaaaagccacttctttagcatttaaccctttgaaggcccacagggggtgaagagggggtgggtggttaggagggtgaacggggcagagagggctaggaggagggagggggagaatccttgtacatttgcaccactatgccccctggttagagtgtgctgtggcatcctgctacaaaagccaaacttgccaggagatacacgtggtggctggaaaaacgagaatatcctcaacttgctctgttgcaaacagcaacaattcaggaagctctgatgacgttatgtgcacctgagagcagctgttagtagccagagtgatgctgaacgactgagagagacagaggctttttagggctcaggtgtattcaccccatgcctcaccttcccagaaacatgttgtgaacttcaggatttgtggtgtgcttagacgtcaccaaaatccctactggattcataaaattctgtatcagttaagatgcttttggctagaagctgtagaaaatccaaatcaaactggcttaaaagataacaagagttttcatgttgttgaaaagtccagaggcagggttgacacttagcaaagcttgatccggaagctcaggatgacgatgaatagttttctttctttcccctccgctttccgtcgtgtcagctacatccaaggctggctccccatgtcgtcacaagacagttgccagttgggggggaatgtgtgctttctccttcatgtccagcaggagacaggggtttttctttctctcagccatggagcgtaagtgctagaattcactgcacctggacaaacttaggtcaaatgcctgtttctgaacgaattttttttttgtgtgtgatgatgatctttcttacacattttttaaataccagaagtaattaaatatgttcatataagtaatttagaaagtaaatcgtgtttatatttatttgagatagatgtgatatttgtatttatttgagatagatgtgattattttatatatgcatacacacagtgaaccaatttttttttttttttttttttgagatggagtcttgctctgtcacccaggctggagtgcaatggcgcgatctcagtttactgcaagctctgcctcctgggttcctgccattctcctgcctcggcctccgtagtagctgggacgacaggtgcccgccaccatgcctggctaattttttgtatttttagtagagacagtgtttcatcatgttagccaggatggtcttgctctcctgacctcacgattcacctgcctcggcctcccaaagtgctgggattacaggtgtgagccatcgtgcccggcccactgaaccaatttttgtgttgagagggtgaggctactgataggtgaatcatgatttagaccaaacagggcccactcctggagctggggctgggatcagtcccattcaaactgtgaggcttcaccattgggaaggcagctaacagcacctcctataattcctgtggcaacctcccggagaaggaatcaccccatctttccttgaactgcttaagtgacaaatttacgtgataaatcattctttttccccagaatacagtcagccctccctatctgtgggttccgcatccacagattcaaacaacaataaaaataataaaaatacagtataacaacaatttacatagcatttgtattctgtaaggtattataagtaatacagaccgggcacggtggctcacgcctgtaatcccagcactttgggaggccgaggtgggcggatcacgaggtcaggagtttgagaccagcctggccaatatggtgaaaccccgtctctactaaaaatacaaaaattagctgggcgttgtggcgggcgcctgtagtcccagctactcaggaggctgaggctgaagaatcgcttgaacccagaaggtggaggttgcagtgagccaagattgtgccactgcactccagccacagagacagagcaagactccgtctcgaaaaaaaaagtaatctagagataattttaagtatatgggaggatgtgcataggtcatatgcaaatactacaccattttacataagaaacttgaatattataaattttggtatgagggggaccatcctggaacaaaccccctgcggataccaagggacgactgtatgtgtatatttggagcatgtgcgcctgattcctgaaagatacataaggaaaaatggattctacagacgcaaatttttctaatgagacagaattgattgatcaacaaatatggctgagaaacatgaagaggattattgggatattgaatgacaagcatgaactgatgggcttcccagtagcttgtgaaaactagaagcctggctttcagggtgactgctgtgtgtgtgtctcccattgggttagccggcccttcatgccctctccagagccactgtgagggagttggaggagcaggagacgggagtaggtgacactgggttccagaagcctccaaaggagctgttctgcagaaaggacctggttcagggcctgccccaagaacgtccatcactcccttgttttctagactttcttccactgtcagaggcctttgaaccagagcaatgccatcttgaataggagctgggtaaaataaggctgagacctactgggttgcattcccagatgggtaaggcattctaagttacaggatgagatagaaggtcagcacaaaatacaggtcataaagaccttgctgatgaaacagcttgcagtaaagaagccagccaaaacctgccaaaaccaagatggcaacgggagtgacctctggtcatcctcaccgctacactcctatcagcgcaaggacagtttacaaatgccagggcaagtcaggaagttaccctatatggtctaaaaaggggaggcatgaatatgaataatccacccttgtttagcatataatcaagaaataaccgtaaaaaacgggctgctccgtctgccaagtagccattcttttacttctttactttcctaataaacttgtttcacttcattgtatggacttgccctaaattctttcttgcacaagattcaagaaccctctctgggggtctggatcaggaccccttttcctgtaacactaccacccgattaggcatgtcctgggtgctacatgaggtgcgtttgtcacaatagctgttcaattctcttctggactaaaaaggacatttgaagttgggccggagcagaagtgctcaggcttgaccaggtgtggactgcatatggcaggcacagggacagctgaaaggcagtgtccaggggaagccaggatggggagcccaggagacagctgggagtggggatcagctgaagggctggatatggaggtggcagttgggtggatgaacctggagatacagtagtaagtggacttgaggaaagttctagaacaactcccagagctgcaggggcactgtgcagggtgtctgcagcctgaacatggagtccttctgaatggaagctgccctttgctgctctgggagcctttgattatgcccagaagaacaggaggctttggaagcctgcagagtaggaaactggcttccctacccaccctcttgccagtaggctgcatgatcctgggaagacgcttcccctttccaatcccaattttgttcatttgttgggatccattaactgagtgagagagtcggtggttgatttctgaggtctgcttgaaaattctgcaagctggaggcttctcctaaggagttaattgttaattcaagtgtaaactgaggatggcgttaagtgtgacctcctcctgggttatttgcattttataatgcactcctaggagaccaaaattcctagaagatcctaaaagaatagtggtttgggtgtgtgggggtgggggggagaaagagaggagtgaaagggagagagagagagcacgagttctttgtttaacacactttaaatcgacagagcaagactctgtttcaaaaaaaaaacccaaaaaacccactttaaatctgaaatctatccctactatatggaaaggtgaagattttctgaatcatctgggatgctcagaccctagtaatactcatggtgggatgtgcaggaactattttgagtattttatttagctacagtagttctgtatgaactaactgaaatgccagacgtcgagtcagtgtgatttttcacttgatatttgtttggaattctgggggtggaaagcaatagatggtgcaatagattaggtaacactaggctctttagtaataagaggtcacctctctggctagatttggctttggttctctcatttcccatctattatccttgcaacagggtccaaccagtgctctccagaacatacgctccttggggctgagacttgtctggagctgtcatctagagcctggaagataagaggtgctcaataattgtggctgaagtttgccattatcagctctgtcttgtagataagacaactgggactctgagaagttcacctggctggacagtggccagttcaggtggctcctgggagtgttggtcagaaagctcaggtttctctctggcctcccaggcaggtggtctcgtagtctcaggacaggctgagtttgcccttggctgcagagttaggggcctgaataggggcgttacttttccttcagctctcaggctgcagtctggctgcctggctgtccagtattctggtcagagtctgctggaattggtagccttttaggagaaagtttgtgagactgaaagcaaactacctgcctctcatcccagcacctcccaccctgctttctcagaagtgaataaattgagcttggcacttcaaagaaaaccaccgacagtatgtgttggcaatgataacattcaagctttaaagcaaaaattaggattttgggaaacatattcattatcatgagcttgacaggttcccagcacttaaagacatttctgatgagattggtagtgataccaacaaatgtgatttttttgatattgtataatgaaatatgttaacatttgggtgacttgtgtaactgtgaactaatatttcccaaatgactaatgaatgattctacaaaatcatgcatgggtaaaagatctattcaaactggatggtggatttttagggaacagtgaaaagctcttcaatataattttggattccacattgcaaataacctttaaaaattaccacttactgagttttggtgtagtagcaaagaatatatcaaattatctgcaattattaaataactcttccatctcccaactaagtatcttcatttacttcaaccaaaataatatatttcaacagaacacagaagcagatgcaagaattcaactgtcttaagccaaacattcaaaagagttgaaaaactgaaaaatattgcttctttctcattaagtttttggaaattataatttttttataaaaaatgttatttgtgttaacatgtaacgagtttaaaattgttacctttaggctgggggcgcggtggctcacgcctgtaatcccagcactttgggaggccgaggcaggtgaatcatgaggtcaggagatcaagagcatcctggctaacacagtgaaaccccatctctactaaaaatacaaaaaaattaggtgggtgtggtggcgggcacctgtagtcccagctactcaggaggctgaggcaggagaatggtgtgaacccaggaggcagagcttgcagtgagccgagatggcgccactgccctctagcctgggcgacagagtgagactccgtctcaaaacaaaacaaaacaaacaaaaactttctcagttttgttttctaacatggaaaatattggatataataaatgtaagcaaaagctctttaggattctaagttatttttaagagtataaacagtgccccaccccctgccaaaaacttttgaattgctgatctaaaatatacaaagaactcgtacaaagcaacaagaataagacagcatcccaacagaaaaaaaaatgagcaaaggttgcaaacaggtaatttacgaaaagaataaacaggcatacaaagaaagagttgttcagattattaatcagagtgcagataaaaatgtgacacgttaccttatacctactaggctggcaaaacgtagaaagccaaataatgacaagtatggttggggtttgaggacagaaaaaccctcatgtacagttggtaggagtgagaaaagtatagtagtgattctgaaagcattctaatagtagttatttcagttaaatatgcacaggcttttttttgtttttgtttttgttttttttgagatggagttttgctcttgttgcccaggctggagtgcaatggcacaatcttggctcgctgcaacctccgcctcctgggttcaagagattctcctgcctcagcctcctgagcaggcatgcgccaccacgcccggctaattttgtatttttagtagagacggggtttctccacgttggtcaggctggtctcaaactcctgacctcaggtgatctgcccacctcggcctcccaaagtgctgggattacaggtgtgagccactgcgcccggccttgcatagttcttacgacttagcaattccatgtttgggtatatgaacaaaataaattgtcatgcacaagtcatttggtgtgtgtacagatgtttattctccctgcttgcagggacagggatctgaagcctcctgggagcccatcactagtgagtggattgggaacacgtaaatgaatgctaccagaggtacccacaccatggatatatcccaaagaaagtgctacaagaaatgaaagaaacaagcagaagcaatctacagcatgatattgtttatgtaaattaaaattacagtcatacaaagcaattcatgttttgcaagaatacaaattatagaatttacattgcattggtttcctagggctgttaggaactaccactaattgggtggcttaaaacaaaataaattattctctcatagttctggaggcctgaagtccaaaactgaggtgtcgacatggttggttccttctgggcctccgaggaagaatctgttcaatgcctgtctcgtagcttctgatggtgctggcaattcttggtcttccttggcttgtagatgcatcactcccgtctctgcttctgtcttccttctctgtgtgcccatgcctctctttgcatttacatttctgtcttcttatagggacaccagtcacattggatttaaggcctgccctactctagcgtgacttgacttcaacttgattatatctgcaaagactctatttctctgtttcacaggctctgggtagacatgaattttgggggaacacaattcagctggatacatagagcaaacatacgagaatggctggccacatgggggagggaatgggaatgtgagatgggatacacaggcataaacaaacaatggccaagcaagaggtgggcctggacagagccggcagtggtgtgtacacactaagagccacacaaggaaacttctccgtatccattttggctctagattcaggaaaacagaagcaagaaaatcaaaacaaaaaacagtaataaaaacaacaaaacctcacctggctcttttttttttttttttttttttttttggcgttgtggcacatgcctgtagtcccagctactcgggaggttgagacaggagaattgcttgaacccaggaggcagaggttgcagtgagtcgagatcacgccattgccctccaacttgggcaacagagcaagactctgtctcaaaaaaaaaaaaaaaagaaaaaaagaaaagtctcctgaggattctgacccacaatctgactttcacatgcgtttgaggatagaatttacactacccaagaattccaaaagatcccaagcaaaaactgagttaaaaggagtaatgatttggcaatgccttctgccattttgccaaagtaattacaaatcctctttgaagaaaaaataacctcttaactcaggcttcaaagaacttctacagcccaagttcctcaaaagtcaagagaggtaaaacagaacttagaacttcacacaagtagaggaagaatatggaataagacaatcaaggaaggcaaacagagaaaaagtaatataaaaaaagcaacttatagaaagcacaaagactaaaatggactcaaatatatcggcattcaaaataaatataagtgatttaaacttgccagttgagacaggttgtcagaacagatgaaaaagaaacagaacccagtaacatgctttttacttgaaacatgaggacccagaaagttttaaaacatataaatggaaaaaagtttttagcatgtagaccgtgagtgctcatttgtgaagctttattaatttcaggcaaaatatgctttagggcaaaaaagtcttaccagagtaaatgcagaatataagatggattcaaatgaaaatggattaatgctattcattaattgcattaattaaatttattgcaatatttgtagaaaagttattcaatataatttggcatttattcatgagtattcttaataaactagaagagagctttcttaatctgatgaaggcacttctcaaaataatctacaactaatctcatacttaatgataagctattagagacaatttatttttatttttatttttttgagaaagagtctggctctgttgcccaggctggagtgcggtggcacaatcttgactcactgcaacctccgcctcctgggttcaagtgattctcctgccttaggctcccgagtagctgggattacaggcacctgccaccacgcctggctaatttttgtgtttttagtaaagatgtggcttcaccgtgttggccaggctggtctcgaactcctgacctcaggtgatcctcctgcctcggcctcccaaagcgccggggataacaggcgtgagacaccacgcccagcccaagacaatttaggaacaagacaatcattcctgctctagctgcgtcttttaaactttgtacagtaatgctagataaagtagcaaattaaagtagtataaggattgtcatcatttggacatgaatatacagaaaacctcaaagatctataggcaaattttaagattaataatttatactgatataaaatgaatacacaaaacaaaattgcatttctaggccagcatttgaatatgtgatttcaaaagacataatttaaaataacaaatacaagtaaagtgctttggaaatctaaaatgttcaagacttttacagatagaacatattcaactttatttaggtctttaaaaaacttaaaagaagcacaacgtttatagatatgatgtctggatgtcataaagggattaacattctccaaactgatttatagaaattccaattggactctcctttagatgaccacagactggttctgaaatttctatggaagatcaaggggccgagtatacccagggcattcctgaagaagaaaacccaggaggatgtttgcctgatacaaagatttaacatgaagctacagttattaattaatatatcgagagtcctcttgggcaggaccttccaccaggtcttccctgaaaaagccgcttacctttccctgaccacctgcggcagcaacttgctttcaatgctctgccagcaggcagggagcatcatctacagctgctcgcccttggctgttcccaggtgggagtaagatgccaatccaatcccatggatgctgcgaccctcaaatgctgtgttaatacttttgatgttgcttcaccggctcgaggtgaagggacagacaccgcagtcccccctcctatggagatgggtgggaacctctacagccagctccgtgcctccagggaagttgatggtgaccagtccatgtgggcagaagctgcttggtggcccctggaaggagaacctaccatgtgatttaatgggggcacatggcacctactgttgtccccagcctctgggactgctgccagaaaaaactgaaatgctgagacaaaggctcacgtttaatatcctgctgcggtgatttctaaaatagggttgtgacaaatgggacccgatcagttctcacggactctgtgcccatctgttttggtttcctttgtgtgtttgctcagtcagaacaagtatttatcagctgaggtgatgaaaggcattgaagcatggaattatcggtgtgtgctgggctcctcttcacatgagggtgatttgtccctacgtcaaaagaagaggtgttggggcagagggcttaaaatctgacggacattgattggaactttggctctaagtaactctgtggtggaacccgtgttgctttccttctcggagcctcagtttcattgtaaaaggaggaggagggtgcctccaggctgggatgtgtccacagcagagggcccaggttgttgctcaatacacgatcgtcccttccctcctcaaagccttgaatagagcaagcaggtgtctgtgtaaccacatttttcttctataccttagagactccaaataaatagcatcagataataatcatgttaacaggaggcctattaccccattaaagttgtaaagcgagtttctcccatcgttttagaccatgtccgcccacacacacacattctgtggcgtgaaatcccgatgcctccaccttccccttccctgtttgtgggctgtttctcttggcagcagcctggaatccaggccttctatggctgaagtgattgctacccctttctgtgtgtgagagcaagagaagcgggtggagggaagggacaggagctcgggaagaggtgattaacacatatccccctggcgggtcatgctgctttcatgggcatcctaatcccgtttcctctcctaagcagaaggcactgggattgatttaacagattttttgttgttactgttatttagggctctcttttggtgggtatgataccataatatcttgggggtatttaagccttaagcagcacctacctgatcacccttgcttgacccccttcccagtctcagacatttctcataatcagtcaccttggttggaactcaggctggtgtctccggattcagacctttgatctcgctgtgtaagggatggagggcttggtggtggtgaggcagggagtggcaattggagtcgaaggtgtccctgagattctgatcccatttttcctttcctcttccacttaggaacatctgtccagtccctgggatggtgaggctataaccacaaaggaataagagaagacgactagttttgtaatgggtaaatgatatttatttttattttttaaattaatttttttacttcagtacgtttttggggaacaggtggtatttggttacatgaataagttatttagcagtgatgtctgagattttgatgtacccgcccatcacccaagcagtgtacacagtacccaatgtgtagtcttttatccctcaccaccccccgacccttcctttgagtccccagagtctaatgtgtcattcttactcctttgggtcctcatagattagctctgacatataagtgagaacacacgatgtttggttttccattcctggttctatcacttagaataatggtctccaattccatccaggttgctgtgaatgccattatttgaaatttgtctggtaggctgggaggtaaagtagtgtggcaaggcagagagtgaggaacaggctcgcagcatgctcctgacccagcatgttcccaaaggtggcagttgtcagttacattcccacgttggccagggttcaagggcccagagcagggtacttttaagagaggctggtattaatatttgaccagaagttgtctgtggtataaacagtgccttcatcccaacttcattcttcaattacctttttaaaaattgtattatttatttagagacgggcttataagactggctcatttttgtatttttggtagagctggggtttttccatgttgcccaggctggtctagaactcctggcctcccagagcgctgggattacaggagtgaataactgcactctgcctttaattacctttcttccacgcacagaggctttggatgaggttgtatgcatgtgtgtaaactagagaaagatttcaagcaaatacataatacaggaatgttgtaacccaacaggcgctttccattcattcattcattcattcataaagcctcatcaaacatttattatgcgttccaggatacagtggcaaaaataatgaacacatctgttacctggggcttacttgtcattattggacattaatcaaataattgcacagataaacatataatttcatagtgtgctcagtgccgtgaaggagagcacagtgacatgaaagaggatattataggggatgaggggctttcctgagaaagtgacatctgagccaggaattgaaagatgagtagaggataaggaggcagaggcaggatggggttgggggctgagactggggtaggaaaaagccagtccagatgatagaatggtagaatgaaatgttttagggcatcctagtggaggtgagtggagttttggggggcactgccgcaaaccccctgtgtatcatagatgtcaagaatatgaggataggcaggttcccctagatccagtacttccagcaaatgaccgtctaattggtagctaggcttatggaaagaaccctcctttccaattgtttttatacttctttgttctgcggacaaaagcatttttgatgttatgtgaaaatgtgggtttcaagtgtggcgatttcatgaaagtataggttgacttgctctgcctggaataatgattggaagaatggcaagtggggtcaggaaggaggttgaggagtgaagatggagggatcaggaatggaaagaagagaggatactccctaagcaaggctgggatttttgcgggaggcgggggcgttaagcaaagctaggtatgaaatctgaggcatgagccaccatcgtgattgcagtggaatgaggttgctcccgtgaccagtcaggaaggatcacatcgccccaaggctggggatgaggggaacagggagcctctccagtttggaagttaaacatcacaattcactactgtgactaagctacgcatcaatttgctggatatggcttctgcctcagattcttcaagccccacacaggctgctggtttctccagtcttccaagctgaccctgagtgttacaattcagacaactcaacatggaaagaacatacctgaggctgaggggctcggctactctcccataacggcgaaagggaattctgggaaagcactgggcttggggtcagagggcgtgcactcaccgccactactaatttattgacctcacaaaaacatttactgattataatgataaccataatgtttatagtttacataggattaaattatgaacttttacatgccaggaattgcatgaagtgtgttacctccaacagggttcaaatattcccatttcactcatgggaaagaacattactaagtgcaatgtgttgaatagtgtccccagaaagatctgtccaagtcttaaaccctagttcctgtgagtgtggctttatttggaaatagggtctttatacgtataattaagttgagaatctccagatgaagtcctcctggatttagggtgggcttttctttacagggaaggagagggaggtctgacacaaagacacgcagagaaggcagccatgtgaagacaaggcaaagattggagttccttagcaagaaaccaaggaacacccacggttggcagaagccaccaaaacccaggagagaggcgtgggagagactctcctgtagagcctccagtgggaaccaaccctgccgcaccttgacttcagacttctggtctccagaattgtgacggaataaatttctgttgttttgagccacatagattgtggtaatatgttatagtagtcctaggaagctcatacactttctcaaggacatctagacagtaaaaagtaagccaggatttaaacccagatttgcaaacttcaggtccctatcaaatatgccataggaagtctttggctcatttccttaacagaaaaatgggagggttaaattctatgacctgaggtccctttgaatgctgtgtctgtggattcaagggccaatccaaaagtgagatctgaaggtgagattcagtcttgtacctgaggaggcaggtttgaccaccactgggctccaaggacctcatgtctgagaattccctggtgatactgactcaatgtctccattcatgtgttgcaggagaccaagatgagatagaaataaaaagagagataagaataaaatctaataaaatctaatgcctgggtccaaaaaaccatttacccaaatgccaaattggaaggacccaacaatgtgatagagaacacattcaaatgagcacactgcgggatgggactgcctcgggccaggcagtgtttgcagatacaggtgctcaaagcaggggtgggagagttctctgttatattctgctcatgccacacccagtgccttggcgggtgggacgcagggtagcaaattccttaaagagggccaaggatggccaaagccctttgagatgggagaaaacacctatgagtgaaagacatggctgatgtatcaaagaaaggtcacatacattgggatcccatttcaccaacaaaccaattctacagagggaggggccacaggaagatggtctaaggaagggatttgtaatgatcagagctgtctagaagtgaaggacctatcgttggtcagtaaagcattccttattattggacatgaaccaaaaccatcttggggaccatttggtagagctgtggtagtaggttttggaacatcagatgagatgctggatgggatagttttatatttcctatcaactcggagatggcagggattctagctctggtatttcaatgccttctcccctttctggactgcctgcccctctgtagtttttgtgggatggttttggccagatccttttgaaggacctgaggttcattcagaagagtcactgagggtaatctgtgttgggat

SEQ ID NO: 478 - DNA, 20001 bp, Homo sapiens
tgatttgtagaatgggaggagttgaacgtgggctgaaaggcaagctgtatgtttctgtgtttgtgttcaaagttcctagaatggccatttctcctctgcatactacatctgggcttcttttgcttgtatcaccccttcccagccctgtttcccctcccctaattcttactcattcacttcattttggttaacagcccagtcatcagaaagccccttctgacctttactctcaggtggagtcagactcctcattgtttttttttttaattttttaacttttaatttttgtgagtacacagtaggtgtctgtatttatgggatacatgagatgttttggtacaggcatgcaatgtgaaataagcacattatggagaatggggtatccacatccaccccctcaaacattgatcctttgtgtgacaaataattcaattacacttttaaagtcattacaattaagttattattgactatagtcatcctcttctgctatcaagtagtcttattcattctttctaactattagaaccttcattatacataatttgtcactggttttaatcacagttctccagtaaaaacacaagcaataggatatatggaagaggagattgattacaggaattggctcatgcaatcacggaggttgagaagtcccagaatatgctgtctgccaactggagaaccaggaaacctgatggtataattcaatctgaatccagaggtccagtatccgagggcaggagaagatggatgtcccagctcacaaaaagagcaaattcacccttcctccacctttttgttctatttggaccctcaacagattgaatgatgctcaatcacattggtgaagacgacgttctttactcagtctactgattcaaatgctaatctcttctggaaatacctcacagccatgcccagaaataaggttttaccagatatctgggtatcccttagccaagtcaagttgactcaaaaaactaatgatgacacctccctactatgctttaaaataataatgaacttaataatttctgtaacttcaacattccagtctctgttggaatctcttttcaacaatccctcaggaaaggaatatatttgaatggatttccaacatcataacctatgatggtccgaagttctctcccccggatttctgagagtcccagaactcatttcttggtgcttttctctgtttctctcatgcatgaacttgaacaaccgcaaactaatgtactctgcactcatcctgcacaaaagtcagcctctcttgtggctaacacaagaggccaatgcactaccagcagcccatgctagttactggtataagttatggaaggcttgggagacacacaaggaaggtctgttaatcaccatttctgtttgtgataataagcagaccctccattacctcattgtgtcccccccaccaacctaccctatccacccccctctcatcttggcataaacagaaattcttttcttatgggaagggcagttaatccaactcctaggtgattcctgccctcaaaccggagtcatcaagtttttttaagtaaatataatactcattttttttaagcccaaaactcctttcagagttgctttgctctgggattttttttttcctcaagacagagtcttgctctcactctgtcacccaggctggggtgcagtggcccaatctcagctcactgaaacctctgccacccaggttcaagtgattctcatgcctcagcctcccaagtagctgggattacaggtgtctgtcaccacacccaactaatttttgtcttttttgtagagacagggtttcacatgttggccaagctggtctcaaactcctgacctcaagtaattggcctgcctcagcctcctaaagtgctaggattacaggcatgagtcaccatgcttggcctgctctggttttaatggtttttccaaaaagtgatgggcaaagatgttcctacttgtttgcgaaagagacagttttctctccagagtgattggtaagaggtctgtggaagactcctggccttccaagtgctacatcaatttgaaagtgccagaagctatcccctaccctacccaacatttcaaatctacatggggcaagttaactaacctctctaggcctcagtttcctcatttctcaaaaggggatgatgatgccagccttatgaggattacattccatttccttttcccagagacctcattttattctctacacaaagacagatggtaagagtgtgaggctggaaattgtccctgagtgctgtgaaaggccacgtgccaagattaacctgaatttttctttgcaaatggctttgactcaatgggacagggtgcaccaactcagagcccaggaacctggggggaagacagttgaaaagacaatgatcttcatggtgctaacccttcaaagaaaaagaaaccattgcagacagcaaagtgtcctgcccctcatttcccctgcggcgtatgatttgagcaatgatgcaagctgccatcttctctatcagaacccattcacccgttgctaagtctgaaaaagatgtctttaaccttcagttttaagaagcagcttggtgctccatcctcccacgcggaatacaagtttattctgcttttgaaaagaacagaatggtggccacactaactgggtttatggctcctccagccctcccagtaagcccagaaacactgtgaattttctgcctcctgctccagccccttccaaaccaccaggatttgagtactgctgctgtccctcaggaaacagtctttcagcctcaagcatgaattattaatttcactgctttggcagggtcatttatcaaaattccctcaaaagttcaattaggaatggcctgcctcccaaattggggttggtgttctcatctcctgtagccagcttgtggtctgcagagttgccttgaccaccctcagtttggggagtaccagatgaaatcaatcacacctcccacttatcgacttcacaattttcactgcaagaaagcaccaccgaggagatggggcagataaatgttttcccttttccacagcacacctgatttttgctcctacagaaccaaaggatgggacttcacccctacacccacagtgcccccaaccgccctgcatcccagatccagctcaccttgggaaatcaggggcgcgcggagaccttactcccggttcaagcccatatcatgttttttggttactagtgactctgcctccctcctccatgccgccccctccaaactcatttgcattcagcagcctgaggaatagttttaaatgcaaattggatcttgctgctttcctgcctaaacatcaatgactccttcttgcctgaatgagaagacccaaacacctaaacaccggggtcaagcctctttggattctaagctccacaatatctccatttcttagaacagcacatggcccgaaagaacatctccagactgaataaacctggtctctgttctctcctcacctctctctctttctacttctcattttattctcagcaacaccacctgcttaccattcctcccacaaaccatactgattctcacccactccttctttttcatatttttttccaaatttttattgtgttaaaatacacataatataaaatgcaccttcctagccatttgcaaggatgcagttcagtggtattaaatacattcacgttgttgggcaaccaatttccagaactctgaactcttttcatcttgtaacactgaaactctatatctcctaagcagtaacttccctttccccactccctccagctcctggcaaccttcattctactctctgcctctatgaatgtgactattccaagtatccccgtgtaggtggactcatacagtgtgtgtcacttatttcccttagcataatgacctcgaggttcaaccatgttgtaacatgtcagaattcccttcctttttaaagctgaatttcattccatcaatgggataaacaatatattgctaatccattcatctgtcagtggacgcttatattgattccacattttagctatcatgaatgatgctgctatgacaaccctctttaaaaaaaaaaatcgaaacttcctgcttgaagtgtctcctcttcagatagcacctgcttatcatttcattcctggccatcacctctttcagaaggttcctcctgcagtccacccaccatattgaactagggacctctcattccacaacactctgagcacagcctgatgatactgacatggacaggacgcagggaaatactaagtagaaaaagatggttccctggcaaaagccccactctcaagcctggaaaccacagccctaaataataacagttatacctgttttcctacccaaatgttgccttttatggcccaccccacccgcctatcctgtgtccatataaaccccagacctcagctagcaagtggctaaacgtcaagagaagaaggagcaactgagcgttggagactacagatagatacggcttaactacagacagcgtgacttcagagaggagaaggccaggcttcagggaaagatcaccttcctcccacaccattcccttttcagctccctttctgctgagagccacttccactgcttaataaaatcctttgcattcatcacctttcaaacatttgtgtgacctgattcttcctggatgccaaacaagaggaaggcaaggtgtaaaaggctgtcaccctgactttccactgagctggttaacacttagctgtgcagggacagcaactgctaaaacagcattaattgtaacacacccctagatgctgccgtggggctggagcccagaagcactcaccctggccctggcacctgctcagttgcatgccttcgtttctgcaagaagtttgagcatggcagtggtggcagctgagtaagcgagccccatccctgtcacaagtgccatgaaggggacaagggaacactcctctctcaatatcagggccacagcagagagcaaggaccactgtgcctcatgcagttctgtttcccagcactttgtacagtgctgatgtgcagagtttccaccaaagccttcaagtccacccgtgcctctgcagtacttctctcaaggactttgggactaatgttccttaggtgctacttcagttttccaccttcttttcaaatacaaacgacaccattttctttgtttcatagaactatgttcttatggatggtgtgctttaattttcttctttgtaaaataagttggcatgacaaggagctgtttgaattgtagggagggaggcaagatttccaaactcatggaatgaaatgagatggggggtcgtgaaaacagagtgcacaggatggtgaaatggctctatagagtgctctagctgactgcgtgtttttatttatttatttatctaattttaagttcagaggtgcatgcacaggtttgttatataggtaaacttgtgtcatggtggtgtgttgaacagattatttcatcacccaggcactaagcctaatacccatgagttattttttctgatcctctccttcttcccaccctccaccctccaataggccccagtgtgtgttgttcccctcaatgtgtgttcatgtgttctcatcatttagctgccacttaaaagtgagtacgttatccttagcaagctaaagcaggaacaatcctccacttttatagagacggccaaggagaagaaagtctcctctcaaattacttgtatttattttctcctccaaaaggcagcctgagtcctgctatgtcatagttttctttctcagaagaaacacggaccgtgttccctaggaaggaaaaactcttaaaaatgcaccctcagccggacacagtggcttactcctgtaatcccaacactttgggaggccaaggcaggaggatcacgaggtcaagagtttgataccagcctgaacaacatggtgaaaccccatatcctaaaaatacaaaaattagctgggcatggtggcacgcacctgtaatcccagctactcaggaggctgaggcagaagaatagcttgaacctgggaggcagagattgcatgagctgagattgtgccattttactccagcctgggtggcagagtgagactccatctcaaaaaaataaaataaataaaataaatgcacactctgcctctccactgaccacaaatggtgtcagacttcttccaatcttcttcaaccccagcatgagtgttcatcccttcacttaactctaccccaggagtttgggggcctttggttctctttctcagactggtgttaattagccatttaggaaatctagatgttggctccaaaatttctgtacccctttctccaggaggccctgtgagagtcctacataaacagggctctgaatgacttgtccagataatctcaccatgcagattaagccccacagtgattctcataatgatagtaatactccacacttccatgttattgcactcttagttcattcatcctttcaacagctgtttattacttatggagtgcttaccccaagcaaggcactgacattgatgatagggaagcagcaactttacaaaaagcaaaagtgttgatgcatggactcccctgctgttatgagctggtttaaagtccttggtctagaagcatctcttaactagtatcatcttgaccctttgaacttattgaccaattcagattctttaacctgaccctatgtggggctctgtagacaagtttccagtgcttgaatcctaggtcaatctactctggggaattaatttccccacttcatacaggctagcctttgaaatctgactttaccattgaccttgataaacagtgagaagagaccaaatcttcaagaaatcagtatatgaattcgctgtaattaaatagcaatttgtacatgaaattcttaaatccttgtgttatctgcttgagggcagacaccaggtctctcttatgcaccgtcatagcctagcactgcacaaagtaagtcttcagtaaatatttactgaatgaccaagcaaaggaatgaatcagtgtgttctggggcccccgccatcttagcttgactctgatgtatctcttctccgatagagtttattccattttgaccctgacagcaaagatccccacaagtttattcattgcagttcaagtcacagggctggtgcaagcagcaatgacctgtttgttggcaatgccactgcacactgatggacttccatagtaattcaacattattatgtgtcaaatatgatttatggtttaatacaatgccagttttataactgcattattgctatatatttacatctggaaaaaaaataaatcacagtgaaattttccactttgaaggacttcatctgagtcctaagtggtgagacaacccaggttgtattttctcaagctgaaattctggggcagctccacgcttgaaaatcgagcaaaatcagttaattgttttcgattgcatacagttttgcaatctatttgttatccttttatcttaaatttcctcagtgtgcaatgggcattaatcctctaccttgaggaattcaggagtccttggaaagccagcagtacttcagagaaagccattgtctcctcagtcatcacccttagtactagaaaacattcaagaaatgccgaaaacattatataaaggcctcattcataccactcaggctcttctgttagctgggctttgttgttgctgctgctgctgttgttattgttgttgatttgcttatttttcagccaaaaatttaccagggataccttttcatcacaatagaggtatatttattttaatgtaggtatttgatttatgtgcattctgtaatgtatacatattcctgtcccttattatggacactctacattgtttgtaatttctcattataaacaacactgcaaagaacatctttggacaactgtttgcacacttgtgcatttttatttcattcaggaaaacccctaaatacatttcagagtcaaggggtgaaacttttttttaaaataacattttttaaagggcatagtatgcatcagtattgattgacacaaaaacttctattaaattctgatgcccacttagatgtcacctcctctacacagccccccttgatttctccactgctatgccattggcagaattaactactactactatttagctatcttaatatgttataagtctttatgtagaaggcttgttctccagaataaattagtcacttgcacatctatccacactattgggctatgaactcttacagggaagatgtgttgcaccttgtttatctatgtaatccaaatgtctgatacataataggtgtcatatgcaatcaaaatgctgttagggaattattggaagagctaccaaattctaagtttccaatgcacagtcttttaggtgatagaaaagctccctatgagaagccactaaaaggttttaagcaggttgttctctgagataattcctgtgtgtgtgtgtgtgtgtgtgtgtgtgtgtgtgtatgtgtttcataattgattgaattatttcctcccttcctttcctttcttttctccccctctgcctttaagaactagttgtctgacctcttgaaatgaggtaacaattctcaaaagaggggagaaccagaaggtagttcccaaggtagccccatgctacagaggatccctcagcagggactggattccacagagtggccagcatagaggtggaagtggagggggctcctgagactcctcaaatgtcctgggtcccagcagtgaaagctcaccttggcctctgggacgggtaacagccgtttgactttgacaccctttctctctcttacttccctctttccatatctaatccatcaccaagtgctcccaatgtaatcttaaaatggctcaaatccatccacttctcttcaactccactgctacttcccccatccaagctgccatcatctttcacctgaatgtctttcataggctcttaattggtcttcctgcttgcccacttgcccctccagttagttccacatcatggcatcagagtaaattgacagaagagaagaagaagtgggagtggagtggaggggagggaagagcagaggagaggagaagaggtgagaaaccctggagttagcaaaataattttaaaatgtatctgctacctactgggtacaatgtacactattcagatcatggatacacgaaaagccagacttcaccactgtgcagtatatccaagtaacacaactcaattttacccctaaatccataaaaataacttaatttttaaaaaattaaaataaaataaaatgtagcttctcacctgcattttttgttccttcttcatgaaccctatttaacttaacccttaagttaacttaaccctattaacctttaagttaacttaaccctattaagggttaagttaaatagggtatatggtttattgactattaaatagttaaccctatttaactccatgtaccctatttagccatgttatccacaaagaaacacaccactacgttgggaagttcagtttcatgcttacctttcaataaataactaggataacctaccataacaattttaagtatttttactgactaaaaacatccaaccgtagaattttttatcttgcttttcagaattgatgtgttcccagaaaatatctttgggtaaatccattctctcatcaacttccactaagaaattgaagaggaattcccaaatggagatggagaaaccttcaaaagacaaagttgaaaactttcataaaggaggggtttctaataatgggcaactttgtggcacggagctccttcctttactccaggatggttctgagctgggtatgggcacttctctttcctctgtggcctcgtagaggggagtccggaaaccatggctggctcagcaattccacttcctatgctacagattaaagacataaaaagaactaggattcataagttatggaaatgtaaggtctcaattccacaaagaacaagtctagagaaggcagaagctagaaatagatgttgacattacagatcaagtttttggagaaaataaaatcatgatgggatcaaacagggtctggttctcaaatacaacttggcttcgcttatcagccaatttatttttaacttttttactctttttcaaaaaatatttttagtttccatagctttagggatacaagtagtttttgtttacataaatgaattgtacagtggtgaagtctaagattttagtgcacctgtcacctgagtcatgtacatcgtaccaaataggtagattttgatccctcacccccttcccacccttcccccttctgagtctccaatgtccattataccactctgtgtgcctgtggctacccatagcttagctactatttatgagtgagaacatgcagtatctggtttttcattcctgagttacttcacttaaaataatggctttctgttccatccaagttgctacaaaagacattatcttgttctttattttaatggctgagtagtattccattatatatatttaacattttctttatccactaattggttaataggcacttaagttgattccgtatctttgcaactgtggattacgctgcagtaaacatatgcgtccaggtgtcttttttatatagtgacttctttttggggggaggtagatacccagtagtgggattgctggatcaaatggtaaatctacttttagttctttgggaaatctccgtactgttttccacagagcttgtactaatttacattgctaccagctgtgtataattgtttccttttcacaacatgcgtgtcaatatcgattgttttttgactttttaataatggccattctggctggggtaaggtggtatcttattgtggttttaatttgcatttccctgatgattagtgactgatatggtttggctctgtgccctcactcaaatctcgtgtcgaattgtaattcccagtattggaggatggtcctggtgggaggggattggatcatggggatgggtttcctccttgctgttctcatgacagtgagtgacttctcagcagatgtggttgtttgaaagtgggaagcatttcccctttgctctctctctctccagctccaccatgtgaagatgtgctggcttccccttcaccttctgccatgattgtaagtttcctgaggcctcccagccatgcctcctatacagcctgcaaaactgtaagtcaattaaacctcttttcattataagttacccagtcttagtgaattccttatagcagtgtgagaatggactaatacagtaacagacattgtttttcatatatttgttggccatttgtatatcttctttggagaaaggtctgttcatgtcctttgcccactttttaatgagattatttgttttttcttactgatttgatttctttgagttccttgtagattctggatattagtcgtttgtcagctgcatagtttgcaaatattttctcccattctgtaggttgtctgtttactctgatggttatttcctttgctaagcataagcgttttagtttaattatatcccatgtatttgttttgttttatttattttattttatatcaaaaatgaaagtgaagttctctgtactggttttgaccattttttaaaattattactatttcaatagtttttggggaatagctagtgtttggttacatggatgaattatttagtagtgatttctgagatttgggtgcccccatcacctgaacagtgtacactgtactaaatgtgtagtctcttatccctcacctcttcccactattcacccagagtcccccaagtccattcttatgcctttgcatcatcatagcttagctcccacttacaagtgagaacatacaatgtttggttttccatttctgagttacttcacttagaataatggactccaattccatccaggttgctgcaaatgccattattttgttctgttttatggctgagtagtattccatggtatatatgtaccacattttctttatccactcgttgattgatgggcacttgggctgtttccacatatttgcaattgcaaattgttctgctgtaatcatgcatatgcaagtgtcttttttcatataatgacttcttttcctctacattgatgcccagtagtgggattgctggatcaaatggtgaatcaacttttagttcttcaaggaatcaccatactgctttccatagtgattgtaccactttacattcccacaagcagtgcaaccatgttcccttttcaccacatctgtgccaatatttattatttttttatttttaaattatgaccattcttgtagaggtaaggtgatatcacattatttatttttattttttgttgcatttgctcttgaggtcttagtcataaattatttgtgtaggccaatacccagaagagtttttcctaggttttctcaaagaatttttacagtttctcacatcttagatttaggtctttaatccaccttaagttttatatgtggttggtgataggaatccaatttcattcttctacacatgattatctagttttcccagcaccacttattgaatacagtgtcttttccctaatttatgtttttgtatgctttgtcaaatatcaatttgttgtaagtatttggctttatttccagattccctattctgttccattggtctatgtaactactttcataccagtaccatgccgttttagttactatagccttgtagtataatctgaagtcaggtaatgtaaacccttcagatttattctttttgcttataattgctctggctattcgggcttttggttccatatgaattgtttttttctaattctgtggaaaaatatcattggtattttgataggaattggactgaatctgtagattgcttttggcaatatggtcattttcatattgattcttccaatccatgagcatgggatgtatttccatttgtttgtgccatctatgatttcttttagcagtgttctgtagttgtttttacagagatctttacttccttagttaagcatattcctaggtattttattatttttggagctattgtaaaaggaatcaggttattgatttgattctcaatttggtcattgttggtggatagcagtgttacagattttttgttttgttttgtttcagacagagtctcactctgttgcccaggctggaatgtgggatctcagctcactgcaacctccaccaactgggttcaagcaattctccctgcctcagcctcccgaatagctgggattacaggtgtccgccaccatgcccagctaatttttgtattttttagtagagaaggagtttcaccatgttggccaggctggtctcaaactcctgacctcaggtgatctgctcgccttggcatctgaaagtgctaggattacagacgtgagccaccgtgcccggccctggtttttgtgtattgattttgtaacctgagactttactgaattcatttatcaaatctataaatagatagaagtctttgggaagagtctttagacttttctaggtataccagtctgttcttatgctgctaataaagtcattcccaagattggataatttacaaaggaaagagatttagctgactcacagtcccacatgactggggaggcctcacaatcatggaagaaggtaaaggaggagcaaagtcacatcttatatggtggcaggcaagagaacatctgcaggggaactctcctttataaaactatcagatctcgtaagacttattcactatcacaagaacagcatgggaaagacccacacccccatgattcaattacctcccgctgggtccctaccatgacatgtgggaattacgggagctgcaattcaagatgagatttgggtagggacacagccaaaccgtatcaccattatatcactagcaaacagcaacagtttgactttccctttactgatttggatgccctttatttctttctcttgtctgattgctctggctaggactcccaacactatggtgaatagaagtggtgaaagtgggcatccttgttttattccagttctcagaggcaatattttcaacttttccctcttcagcaggatgttggctgtgcatttgtcatatatggcttttattatttttaggtatattctttttatgcctagcttgttgagagtttttaatcataaaaggatgctggactttatcaaatgctttttctgccctctactgagaggtttttgtttttaattctgtttatgtgattagtcaaatttattgacttgtgtatgttgaaccatccatgaatccctgaaaggaaacacacttgatcatagtgaattgttattattttttatgtactgttggattcagtccgctagtattttgtggaggatctttgcatctatattcatcagggatatcgttctgtagttttcttttattttgttttgtgctttcctggctttgttatcagactgatactggcttcgtagaatgagttagagaggattccctctttctcattttttttggaatagtttcagtagaattggtactaattcctctttgaatgtttgatagaattcatctgtgaatctatctggccctaaacttttttgttagcagggttttattattattattactgattcaatctcataacttgttattggtctgttcatgatttctatttcttcctgatgcatgctagaggagatgtatgcttttaggaatttatccatttcctctagattttctagtttgtgtgcatagatgtgtttgtagaagtcttaaatgatcttttttatttctgtggtgtcagttttaatgtctttatttcatttctaagtgaacttatttaaaccttctctctttgtttttggttactctagctagtgatctatcaattttgtttgtcttttcaaaaaaccagttttttgtttcattgatcttttgtatttgtttgcttgtttgtttcagttttggttagttctgctctgatcttagttacttcttttcttcttctagccttgggtttggtttgttcttgtttctctagttccttgaggtatgatattcggttgtcaatttgtgatctttcagactttttcatgtaggtgatgagtgcaataaacttccttatgagccagtttaacagttctcaggctgaattgcaccattgaaaacattccacattctattctatggtcaaccttcttcattctagaaaggaatgcacttagccaactatataataaaatgtttctaaccaggcatggtggctcagatcctttaacccccgcactttgggaggccgatgtggaaggatgacttgaggccaggagttcaagaccatcctggcaacatagtgaaacctcatctttataaaaactaaaaaaataaaaaatcaggtaggcatgatcatgtgcacatatggtatcagctactcaaaggctgaggtagaaggataacttgagcctggaggtcaaggcagcagtgagccatgatcataccactgcactccagcctaggtgacagagcgagaccctgtctcaagaaaaaaggaaaagaaaagcttccttttcctagcttccctttaatgacctcaagtaataaaaaccacacaatatattttgggaaggtattcaatggcttaaccccccttaaaattgccaataagacaatctttcttctctagctcaaatttcccatgctgttatttaaacctgttttattatttattatgattataagttagaggaaattcaaatgtatcaccttatttcagaacatataaaaaataatctgccctgcgagaaatgtaaggtttgatcatttaatagtcttttctgcagtgtcacaaatgaattttacttaatatcctggaatttgaaagtaggaaaacacttgaaaaaaaatttctgatgcatcatacttttttcaaatgaggatacaggatcagagagggagaaacacagacttaaggacacacagcatcagcataacagaaactcattcaagtctgcctcatagcacaccattgcttttcccttctttgtctcatttctttgatagacacctaattgctaccgctgattaaaagaagtatcaatctcattttatgacaaaaaaggacagaaaggatactcattgtcattgtacaatttatgaggtcgtggttaaattcattacttgaagatcagtgggtataattagtgacccaaattcaagtagataaaacagttgggcccttgtttaaaatcttgtcttaaaattgagtaatttctcctgctctagatgcagtgcctctgagggtcatatttaatgatcatacatccctgtgtgaggtgaccccaggagaacaagaaaaggctttataaattgtactctaactaatttgctcataagctggcatttcctcttcaccttgcactttatatcaagagccgttcataaagtttcctatatttatacaatattttgtactaatcaaaatgtttctcagtgagttcatgcctgagacatgacactcaatcaataaatatttgttaaaatgacttgaattgaactatgtgagtgacatctcattttatcttaatagcaagttggagtggtggtggatagagtagatgttaaattccccattttacataaaaacaggaattgaagagtccttgggttcctgaatcttgattttcagattttaattccagcttctactttctcttcctcattttctcctgagtagtgaggttgagttcaggcttttgaattttagaagaaaaaaatgtgaaacaatgctttctccaaagaaagaacttataacccgtgcactcaaagttgttctgcaggacaaaaaacttttcaaaataattttttagggtcaagccatctgtaagtgaggaacctgtcacagtctctctctcaaacaatctacaagcaagactgaaaacagatttctagagatgatgagaagaagatgatgagaagaccttgggggcagttgcgaattcataacattttgaatggaaagagcattggagatcttctgtctccagtcttgtgatgggtgagaaccccaaggtccaccgaagttcagtgacttagccaaaaatcacactgcaaggaaatgtcagagctggactagaatcctgtctcgagacatacttctttaatataccaccccttctttcgcagatgtatctttagaccagagtttctcaaacttagcactgctgacatttggggccagaaatactgcattgtcgggggctgccctgcgcattgtagaatgtttaacagcattcctgttctctacccagtagatgccagaaggactgtcaccccagctgtgacaaccaaaaatgcctgcagactttgccaaatcttccttagggaaggcaaaatagcctgcagttgaaaaccactgggacagatcagagcatcccctagggtatgtccctttactctgagcattgtttctctttctttctttcttttctttctttcctttctttctttctttttctttctttccctccctccctctctttctttctttcctttctttcttttttcttctttttctgtttttttctttttctttctttctctttctttctttcttttgaaaggctacataatatctattctttgttaatggaaattcgggttgcttataattttttaacatttattttaagttcaagggtacatgtgcaggcttcttatgtaggtaaacttatgtcatgggggtttgttgtacagattatttcatcacccaaatattaagcctagtgccgattagttatttttatttttcctgttcctctccccacttccccctccaccctccattgggccccagtgtgtgttgtttccctccatgttattactgccatttcttaactctgtctttcatgggtccccaatgggctggttggttgatgtaatctttgcttcagagctgcaaagtgtgtctattatcactcgttccatttgaatcttacagtagtaacagatataggttacagtgcagagaccaattaactagtcaattagatagcacctggtatctaactgactagttaggcagtctcttcattgtaaactatatctgttacttttcaatggcaagaaccacaactacttttgcaccaacctaatatttttaggtccaaaagctcaactgtgagacccacagatgcctcgtctgcaaatgaccagactctttggggtttgatgtagaaaccagacgtcagtatgttcacgtgtaatgaggagtaaaactttccataccccagcactaagtgcttattaataagcaaaattaaaaatcagaaatctgtttaataaatactgagttgaagaggggcagattattaaaagtcatcttaattctttgtgttactgaactatgacagcttgacactttcaactccaatctaaaatctgcctactcgtggcctcaacatttattcattcatggatttactacatatgtgttgcactcttacaagatgcagaaaataaatatagttattagcaagacagccatagccccttgccttatgatgtccatcaagttttgttaattttttttttttttgtaagacagtctcactgttgcccaggctggagtgcaatgccatgatctcagctcactgcaacctctgcttcctgggttcaagcgattctcctgcctcagcctgccgaatggctgggaagagaggcgtgcaccaccacacctggctattttttgtatttttagtagagatgtggtttcaccatgtaggccaggctggtctcgaactcctgacctcaagtgatccacctgcctcgacctcccaaagtgctgggattacaggcgtgagtcaccatgcccagccaagtcttgttaattttaagcagcaaaatctgtctcaactcccctcatctttcctatccccactctctttactcttgctgatacttctctcacctctaatagattctcttgggactcctttccccaccctctccagtcttcccccacactagttcctgaataaccaacacaatgatctttctgcaacgcgagacctgatcatagaacgtcactcctttaaaccagcagatggcttccccttgcctgtctaaagacacaactcttgagcttccataaacactgctccatcttcctcaaacacccctccatgtctccatgacttatagaagtctatacttccagacctgactcagcatcacctgcccctccagtagtatagctaaccccacagctggcttacgtgtccctagtccgtctttccagtgaaccttctgcttacctctcggatagcatttatcacaccgacatttattcctcagattcagccctaggaatggctcttttcaagccagccgatatatacgcagaatctttgctaaagagccacgagctggtcactttaaaagcctggaaaatagatttattttagaattttttacacctcctatttcttcttcattccacccaaggtttctccttttgttaggagaccctactagcagtgaggctctttccataattcagtgtggccaaacctataaggagacttagcacttatttctgccacaatgttgctgtgatgcaggctatcacctgcaaattttggccccacctagggaaaccagaaaaatgaaaaccaggagaaaaagagaaagcaactcaagttcctaggtaagcaaccattaaacaagaatcttctaggttcccattgacagtaatgagttagacattgttccagttagttacccatatggagaaaacaagaagggagatgtgtttgagaaagagaattattctctatatatgtaactttattgttccggcttatcaatttagtaaatgtgttgtgttctgttgctaatatatgcca

SEQ ID NO: 479 - DNA, 40001 bp, Homo sapiens
catgttggccaggctggtctcaaactcctgatctcaggtgatccacccacctcgacctcccaaagtgctgggattgcaggtatgagccactgcgcccggtctgaacttgttctttgccttgagtatggggaatagcaatgtgctttagattgcacacccctctgtttatggttgcacagtgatccacgcactcattaaacaaattttattgggcatctactaggtgctcgcagtggactagagcattctgatgcttggtggagtggaaaaagacatgatttttgtgccctgaggctgagatttgggtggatgggagcaaataatatataatcacatttgcagattcaataattaattcagattgccagaaatgttcataaggcacccagcgaaagaggggataactggaggaagaagatgcctactttggataaatttttcagggaagatctttttggggcagggtaacagttaagctgaaatctaagtaagtggacaaagttggtcatgacaagaacaagctaggccaatggaacagaaagagaagaaaagggaagggagaaagatgatttaaaaattttttaatgtttttaaacagctagaagtggaagttaatcacagggcaaaggcacatcccccaaaatctctgcctggaaatgtggaaggcatacaaaggaaccagatggcaaaggaagctgtgcacaccccatgacgatctccagccttctgcctctaaacacctccactgtgcccgagagcaatgctgccggcaaaaaggggaaaagagccttcattgtctcctctcatcctactgccaggccccacttccagattagaaataaaagagagaatctccaagccaccagcgggttaaaaagagaagaaggaaaatatgatcaagcagcaacgtcaactgaacctgcacacatagacgtttatgactgtaaaagaaaaaaaatgtctagaaggacatttcaaattcctaacactgattgtctctgagaatagactcagaatatgttacagcaagcctgtattctctctacagtaattatttggtctcacatttattcaatatttcccaggtgccaggcgccatgttgaatgtctagttgatattactttgtctcatcctcacagcaactccataaagtgggtacgattattgatcagttttgccaatgaaatgatggagacttggaagttagaagacatctgaaggtctcacagcaggaggtggcacaaaattcagggctgtataactccaaaggttggtgcttttaaccaacacactgcctcctccaattcaaaaagaataaattaagcttacattaagagaatacttagcacatgctgggggctatgtacttaatccttacaacaaggatataaggctggcgctatctgggtccccctttaatagatgagaaaactaaaggacagagacacttactggctggtaagtgatgcatcctggattcaaacccaggctgtctggatccgcaattggtgcttccactactaatcaatctacagagcctctaaacttagagttgtgcctgttttgtgccaggcactggactggggataaaaaataaatgagatcatccttttattcaagcagaatcatgattaggaggaaatgctgtgctaaaaagataagtcacaaccaggatacagcatggtggaccttgtgtgcttgcaactgtgtaaaaactcgtgcatatgtaagtcttcaaaacgttcgtatacttgcagcacgtgacaagtaatttcactccttgtaacctatcctaaagaaatcagccgaaatgcggtcaaaacgcatgtgcaaaaatgctttttgtagcaaagtatatgatagctaaagctgtccccctgtggggatgttgaattaattataatacatctatttgaaggggtattgtgcagtcattaaaatattatgttgtaatatgtaatgcttttaaaatatcttttaaagcttttaattacaaggagaaatgctcatgatgcaggattaagcaaaacaagaaaatgaagattgcaattctagcacaatctcggtcatgtaaaataataagatataattaaaattactaccaataacaataataatatgtgagaataggccaaagacttaatagtggttgtctgtacgtggtgaaattatggatgatttttgttcctgcttccttgttactgtagtttcaaatctttggaaagtcatcatatattacttttacagtcaggaaaaggtgagcataaaattatgtgcgggagaaaaggctggaagaaaatatagaaatatattagcagtggttatgatggtgggagatagttggcatttttcgttcctttttcaagattttgtgtatggcagtgttgtcacatttgtaatgaaaaatacataaaattaaagatgaataatcccagcataatttataggaatgaaaagtgcctgagtgtggtggctcacgcctgtaatctcagcactttgggaggccaagacgagaggactgcttgagctcaagagtttgagaccagcctggaacatggcaacaccccgtctccacaaaaaatacgaaaattagcagggcatggtggcacatgcctgtggcagctatttgggggaggctgaggtgtgaggactgcttgcacccaggaggttgaggcttcagtgagctacgattgcaccactgcactccagcctaggtaacagagcaagaccctgtctcaaaaaaaaaaaaaagagagagaagttgaaaacaatatagaaattcaattgaagattgatcaaatgaattatggtgttacctggaaaaaaaaggatattatgcagccactggaaataacgtttgcaatgggtttttaatgatggaagggcatgtttacagtagatgtttaagccaagattttgtattaaggcatctctcaatttttgaataataacagggaaaatatttagaggaaaatacacctaagtatgtaaaccaagtaaaatgactggggcaagtcgttttgactccctttgatttctgactcatgatttagaggctgattttgctaaggttgaggatgcacccaggaaaaagagagtcaagtcacagtaggatctgtggcctgcacttttttcaaaaagtgttttaaggacttcagtatttaaatgggaaatagcaggcaggaggggaaggaggaaatttataaaaagcgagggtaggtactgagttaagtggtcatcttcttgtgaggctttgattggcgctcacttaattgacaagttacatgtgaaaatgggggtagtggaacagtcacttatgcattcatcttgcactcagcaaatctgcattttacatacaataaagtaaacatagagtagaggaagaagtcaaatatgcatttgaggtaagtggagctatgatttctattcttcctttccagcattattgtaacaacagataatacccattccatgctaagcatttctccaagcaccgaccaaagataatcatgcctatcatgtgtgttgagggaaggaggttgatgattaaataatagaaaacattaaagtgcttatctattaatacatgctagctccttttgtgtttagccacctggctacagatcaaatgcatcatttccaggatcatttgtgaaggagatgtgtcacctggctggatcctcactctccaggggaaccttagcctggatacctatgtcacaacaacagctccttccagaagcaagcgatgccatacatcgatactcaccacccacattcttgaatctgaagatttccaggtggttaagctagtagtcatcaaggaagagcacccatttttctaatctttttatccaccatggtgcatttttttttctgtcagtggcctttagaacttctgctcaataaccctaggtaaactggaattactgtgaacagtactaggtgcgctggagcagagtgggagggaaattgagacagtaagaccttattcctgaattcaaggagcttatgaggaagtagcatttgtagcatccttagaagcagtccccacagtgggtaagagcaaaagcactggagcctgacttccagctctgttgctggctatgtaagtgagcttgagcaagtttcatacattttctgtgcctccatttcctcatctgtgaaatatggataagagtagaacacacgccactgtgaataaatctaaaactttgaatagtgcctggaacagagcaagcacttcaacaaattctaaggattataataattacttatcttactgtaattatctgtgtctatgactgtccctctaccagatatcagaggatataactagtcagcagtttatctcttgaattcaagttgcaggcatcttgtattaggcagcccaagactcgtgtctaccaacatagtgattctagtacacaaaaatgcctttcttgatagatccaacagaaatattgcaagaaaggctatgactggcccagcttgggtcacatgcacatccttgtgcctgcaggtatggaccttcccatctaatgggatgagttccctaaaggaaagagaaattctagggaaaacatgataggcaggtataattacagacatccacaaagggaggtcatgataatgaagttgagatagccagctgatcccccaaatctatcttttttttttttaattttctgagcaaaacagacaggctacacttcccaatctctcttgcagtcaggatggtgattaacatgtaggccatggaatggaaggtggaaggctgaattcccttctgagcccatgctttttaagaaatgatgtggggccttcttttcactgtccttccccttacaccagctggatggagaggataagtagacactagagaatgaccaggaaacatacgtctgtcatgttgttccattacccgtctggggctatttgttactcccacctagtttatcctaactcatacaggtaataatactagaactataaatagggttcaactcataaaaagttttaaaaatcagttggaaaagaaccatgagcaaattaaacctcttttcttataaattactcagtcccagctatctctttatagcagtgcaagaatgacctaaaacacgttattatccccactgcacagatgacgaaactgaggaacaaagaattaatcaagtgcttggttaagttaagtagctgatagagctgaaactttacattattgtctgtaaagctgaaactttacaccattgtcacccacaacctatcaatagcctatgagaaagacagggaaggacccacaacaaaccctaaaactcaagctcagggaaacagagtgagtgctcaataaatgttagttgaatgattaaaacatcataatgccggcaagatccaacaaatcaaagatgcagggaaacttcactcactctaccctcccaaaagatgctggagagacactgagagatgactctgaatctctgcttttgccacattggacttgatgaaagaagctccctcaagtcagctcagatgcccatggcagtcctggggccagggaatttatctcaggaaaaaaaaaattggtgaggatatgcttgcttcattagctgcccatcgatgtggaagactgaccaaagaaagatgtatgttccaacctctccagagaaagaacccaacaggttttgacagatatccctgaagtccctgtctgcgccttttaaacagttggcttaacaactgcctttaatttcaccgaacataagttattgatcctgatcttctgttgcctggaagcccaatcttgattgctaattgagctattgatttggggctcacattaaccgttcctgaagggatgaatcctgggtaatgtgggaaggtgggctagcgaggtggagaaggtgagggctctgcaggaaagtgattttaattagtaataatagcttcatacttagccaactggcttgtaatacatgcagtgacatacccatagatcaggcagaaaaaccagtggtcatccttctataggaaaattaaattaggtcaattatctaactgttgggtgatttcagatagttacttaattcaaaacatacctcttgctgcacatgtcagatccgtagctcagcccccaaagcttactccagtttgtataattagtcaggttggcctctctcctacccctttccgatataatattttaatgctttgaaatttccaataaaaagaggtcgttaataggagaatggctatataaaagggcttacatctctgccattgaattattatggagtcacttgttgacaccaactaacttgacagagcagattccacaatagatgtatcacaagttaaaaagccatgttccagaaaggtatgtataaaaccattacagttccttaaaaaataaacaacaaccatattgattatatgagccaagagaaagacaaggaaagatccacaacaaatcctaatattggataacattgaggtgggcatggaggtgggtgaggggaacacaagtgtactatttaagatctagtaggctgggtgcaatggctctctgctgtaatcccaacactttggaaggccaagttggcaagattgcttgagcccaggagtttgagaccagcctgggcaacacagggagaccctgtatctacaaaaaaaaattaaaaagaaaaattagccaggcatagtggcacacccctgtagtaccagctactcaggaggctgaggcaggaggatcactgcagcctaggcagtgccaagaggaaagttcatggccccaaacacccacatcaaaaagtctgaaagagcacaaactgaaattgtaaggtaacatctcaaggaactagagaaacaagaacaaaccaaacccaaacacagcagaacaaaggaaataaccaagatcagagcagaactaaatgaaacaaacagataaaaatacaaaagataaataaaacaaaaaggtggttctttgaaatgataaataaaattgatggaccatagcaagattaaccaagaaaagaagagagaaaattcaaataacctcattaagaaataaaacaggagatactacaactgacaccactgaaatacaaaagatcattcatggctgctatgaacacctctatgcacataaactagaaaacctagaagagatggataaattcctggaaaaatacaaccctcctagtttaaatcaggaagaattagataccctgaacagaccaataatacgcagcaagactgaaattgtaataaaagaaattaccaacaaaaaaaagtccaggtccagacggattcacagcagaattctaccagacattcagcgaagaattggtaccaatcctactgacactattccacaagacagagaaagagggaatcctccctaaatcaatctatgaagccagtatcaccttaataccaaaaccaggaaaggacataaccaaaaaagaaaactacaaacaaatatccctgatgaacatagttgcaagaatccttaacaaaatactagctaaccaaatccaacaccgtatcaaaaagataatccatcatgattaagcaggtttcatatgagggatgcagggatggtttaatatacacaagtcaataaattatgtgatacaccacataaacataattaaaaacaaaaatcacatgatcatcttgatacagaaaaagcattcaacaaaatccagcatccctttatgattaaaactctcagcaaaataggcatacaagggacatacctcaatgtaataaaagccatctatgacaaacctacagccaacataatacggaatgggcaaacgttgaaagcattccctctgagaactggaacaaaacaaggatgcccactccaaccacttctcttcaacatagtactggaagtcttagccagagcaatcagacaagagaaagaaagaaagggcatccaagttggtaaagaaaagggttgaatcaagtgtactctcagatgcgtttccattaaactgaataacctcggcatgtcagctggttctacagagctctgggtgaatcaagagaatgtttgagatgatggaaatgctaaatatgaatttcatcattacataatgtatatacatatcaaaacaactgactatacaccataaatatgtacaattattatgtgtgaattaaaaataaataaatattttttaaagaatccagtttactatcaccatatttgctggaatcataggcattgatttttcttagtagaaaaatcttcagtaattttccagaaagaaaaatcacctggaccagagtatccatgtatgtccctgccacaatctgaggcttctccatgtaaatgtggtgtgaaatcagaaatgggttcaaatcctacctccaccagcatttgctagcttcaaaccttcttctgaaaaagaaatcaagaaagcaatcccatttataataacaacaaataaaataaaatacctgggaataagtataaccaaagaagtaaaagatttctacaatgaaaactataaaatattgatgcaagaaatcaaaaaggacacaaaaaattgaaagatatcccatgtccatggattggaagaatcaatattcttaaaatgtccatactacacaagtactttacagattcaatacaatccttatcaaaataccaataacattcttcatagaaatagaaaaaataatcctaaagttatatggaaccacaaaagacccagaatagccaaagccattctgagcaaaacgaataaaactggaggaatcacattacatagcttcaaattatactacagagttatagtaaccaaaacagcatggcactgccataaaaagagacacacagaccaatggaacataagagagaatccagaaataagttcatatatgtacagtgaactcattttcaacaaaggtgcaaagaacatacactggggaaaagacaatcacttcaataaatcttgctagtaaaactggatattcaaatacagaagaataaaagcaggcttatatttctcaacatataaaaaaatcaaatcaaaacagattaaagacttaaatctaagacctctaaccatgaaactactacaagaaaacattggggaaactctccaggatactggcctgggcaaagatttcttgagtaatacctcaaaagcacagttaaccaaagcaaaaatggacaaatgtgatcacaggaagttaaaaagcttctgcacagcaaaggaaacaatcaacaaagtgaatagacatattcccatagaatgggaaaaatgtttgcaaactacccatctgacaaaggattaataaccataatatataagaagctcgaacaactctatagaaaaaaatgaataatctgattttaaaacagataaaagatctgaatagacattcttcaaaagaagacatacaaaggacaaacagctgcatataaaagtactcaaccttaccgatcatcagagaaatacagatcaaaactacaatgagatatcatctcactccagttagaatggcttatatccaaagacaggcaataacaaatgctagggaggatgtggagaaaagggaaccttcaaaaactgttggtgggaaagtaaattagtacaaccactttggagaacagtatgaaagttcctcaaaaaactaaaaacagagctaccatacgattccaccccattccctggggacatttgacaatgcttgggaatatttttggttgttacaactgaggtatgaggcaagacttgactccagaagcagggcttggacactggaccaaattgaggactagctaaaacagggatgaggtggaagcagccttccagaagacatgcccatccctgtcccatgtcagtttaccattgccatggcaacactcaggatttaccactcctttctatggcaatgacccaatgacccaaaagctctcacctttttcctagaaatttctacataaaccaccccttaatttgcatataattagaagtaggtataaatatgactgcaaaaccgtcatcagctgctactctctgccctgctctgcaggagcagtcatgcagctataacacggatgcttcaataaagctgttttcttctaccctaccaccggctcacccttgaattctttcctggcaaagcgaagaaccttcgtgggctacgccccatgtgggggcttgcctgccctgcattacaacaggaagaggggaatgctactggagtctggggggtaaaggccaggggagctgctaacatcctacaatgcacaggacacccccctccccacaatgcagaattatcaggtccaaaatatcaatagtgctgaggttgagaaaccctgctttagaccaattcactcttcttttgctatgctaaataaagcaccaaataacctgagtccaccagtcacagacccacatcatcagcatggaaattgcacagaggatgtaccatctcacatacccacaagggccacacagctcagggaacaaccaccaggcagccaccctgaagacccataatcttcactgaaataaactgggctggggagtggccacgaacagcccagacccctttctcaaatctgagcccagagctgcagctcagcaggaagtcaagtctgtttgacaagtgtaagctccttgtcaatgctgctaaaggtttcaaagcctctctctccaagatggaggtgtcctctgaaggagaaacttcccagcagtcccagccagcacgattcaaacagcaatagcttcctggagcggagcctgaccttgtgcgggcaggagctcagtagaggggggagcaacgttgatttctgaagactgtcaagtgagagctactttgggctgagttgtaggaaactggagatctataaacctttttatgtgcggagagaaaggagccagcattgtttccaatgagtttcccaggcgagaggagacaaccagaggctgagtgacagtcggacaaggagcaagtttcccttttattaacaggctcataaagctactttaaaaaataaattaaagctagaaaaatatacttggatttactgccagaagggaaggaggatgggggctgtgctgatcagcctggcagtgacatcgcagggacacgctcttgcaagatcagctgaatgtccggaggctgcaaagcataccctagggcaagtagctcttgagctttgaccccaggtaattagcactggcagtctgcagcctcaggtgaatcctgagacaaaaagcccatccccaagtcctggctttacagtctggagcagggggcctctgagagttccttctgcaccattcagccagaccctgagatggagacctataaatcaccatcgagcttgagcccttatgcctgtcctgagactcctcactcatctagaggcaagccctggagcctggtgtcaaatggatgctccatccatttttcttgcctgtcctctgctcctcctttccccaactccagtttcctttctgttccttttccgccttccttctgttcttttttcccttctcaaagtattccaattgccactgtgtaaagtgaggcacacctcatttctcatgtgagcagatataaccatgtcatgtcactctaccatatataattctcagtggcttccccctgaggccaaccaagccccctagcatggaacacaaaacatcatagctgattccagacagctttccagtctcacccccaataccagtgcacgcaaacacacacacacacacacacacacacacatacacaaatacatcactttctgcccttcccaagcacagcatatcattttaagcctctactcacaattataataagctgacatctaataaatggtttcccctatgctggaagctttctattgattcattcattgaattttcacagaaattggatgaggttaattctgtcgtcctcatttttcagatgcagaaacaggggtttaatgaggctaaaatgaccatcaaggatgatatagtgctacagatgggatttgatcccagccaggtccagcagcacaaccacaatgacccttgctgcctccacagctatgtcactggacctgcccatctcccccttggaaactctgactctttctctaggtgaaataaaaccatttgcttttttttttttttctttataaactgactctgatatgtatgtgccctgaaactgtctttttttaaatttcccttaacgtatgtattgaatgccaaaaacgacgagagatactggcaatgcagcagtgaatagaaaccaaccttgaaaatgaggcctctggattttagattctgtgaagccaggcaccagatctgcgttgtttgctgggtccctgagacctagcacaggacttgctatggaggaggcattcaaaatccattgaatgcagaaagtggaagattgaataaatgaaggcaaatttagaaggaggtggcacctccttgctgagattccatcttgaaaataaccctgaggcaatgtccttagagggacggtcccatagccataacccatcagcactactgatgccatcattcattcattcaataaatgttaatcaaactcctgttaaaggctgtgcccaaggttagatgctggagatgacaaagaataaaacacagtccttgcccttgaaggcgttagctggcaagagagcaaaaggcaattacagtgtggtgtcctgagtctgctactgtaggagtcaaccacaggtggagattttgagagtacagggatgagttcctaatcatatgtgagagatcatgggaggcttcctggagaaagtgacatctgagcagagacttgacggatgagaaggaattagccagatctaagagggagagagagagtgtgtgtgtgtgtgtgtgtgcacacctggggatggtatcaagaaacgtgctccaggtggaggtgtcaacatacacaggatgcagaggcaagagaaaagagaagctgttcattatggcttgtgtatgtgtggaacataaaaaactggtaggcaatggccaggtgcagtggctcatgcctataatatcagtgctttggggggctgaggtgggagaatcatttgagactgggagttcgagattagcctgggcaacatagcaagaccctgtctctacaaaaaccttttttaaaaaattagccaggcttggtggtgtgtgcctgtagttccagctactcagaaggctgaggcaggaggatcccttgagcccaggaattcaaggctgcaatgagctgtgatcgtgccactgcactcccgtctgagcaacagaggaaaacccgcacctctaaaataaaaaaaataaaaaaaataaaaaaaaatgttgggcactaacactaaagaaagagttcctctcattctatgtgaaaggcttgaattttattcataaggattgttgatctcattcacacgatgttaaaataaagaaagaaaaatgcatggacctcggtttgatactctggaaggagaatggaattcccattctgccaagtacgaaaaaaaaaaaaaaactccaaaaaatatggcagcagcatagtggccctttccctatggttctgcctctgaagtttccagggaccctggttcccttcctggtacgcccgcacggaggtagggatgtggtgatcagtaactcatctgccgcagggattcctgtccaacagcctccctttcatgatattttgctatttgtcacctttgtcacacaaattcctatttttaaatctttttctttattggattttataatattgatcacattaaagcaaaattttaaaaagtggcaagtagggtgaggagagaaggtaggagattaagagaaggtacagtgtcagtcctcatatatcgcagctgagtggcagcctcttctcatctttgcactcctaggagcaataaacaccagaaatgcttgagcgaggaaaaagcaagttgaagaaaatgatgtgaagtttgactaggttattgctagagaagctgacactgttatcaccgctttgtgacttggccttcactctgcttataatatttttcctcctctctcctccactgcacttttcaaaattcaacagagttatcttcagttcagttgacattaattaagcaccaactgcatgccaagtcctgagaaatcagagaaacatgccccattcactgtcactgaggatctcaaaatcttaagccataatcaactagaattggattacaggaaatttgctttaaagagtcattacccttgataataccctttgcaacatgctttatacatgtgttatcacttctaatcctcacagcaaccccaggaggtaggtttccactgagccacgctttatgaatgaggaaacacgctcttagaggcttaaagacttgcctgagatcacccaaccaggaaagggtaaaggtgggattcttagtctaaaggttcaatcactatagtatacattttgtaagtggcagggctaagtcttgaatcattgtctgcaagaatccaaactctctgcaactaatcatcaagtaatagtactatttggaaactcggtttaatgctggtatgtagcttgaactccaataccgcatttttcccacgcaacataaagatatactctgtgtgtgagactatcaaaggagtcttcagtcattccatccgggactggaaaaggcttcacaaaggaggggacactgaaaatcagtcccagtaatagtctctaccatttagtgggcacttactgtgagcttgatgctgtaccagactttaatacatcatctcatttcacccttaaaacaacactctgtcagctccattctggctgccataacacaacaccatcgactgggtggcttacagataacagaaatgtatttcttacagttctggaagctggaagtccaagattcgggtgccaacatgatctggttctggtgaggatctttttccatgctgcagacagtgattttctcattgtctccccacccagaaaaaagagggtgagagagttatttggggtgccttttattcggtcactaataccattcacgagggctctacacttatgacctaatcacttcccaaaggccccacctccgatacgatcaccttgggctttagaatttcaaaatatgaatttgcaggggacacaaacattcaatgcataataccctccaaggtaaattcctgtgatgaagacttggtttcccacccaaccaccatgtaccccttcctccttgctaagacagctggcatcttcttcattatgctccatgaagccagtgaactttgggtgccttcccaacccatgaatcttgacttctctaagccaatgccagtgggctcactggcttaccaagcaatcttcaaagcacaagcacatgactcagctctggtcattgaaatacgatggaaattctgctgcagaacttctgggaaagctttgctcactctgaagaaaaaaaaaaacaaaacatgacgtggatgttttctttgttctgtctgggtgttgtcacctgcatatactatctagataagcagccttcatcttagacgatggaggatccagcctaagaagaaaagccagtattctgtagatgtcagcacagaaaaacagagaacaaaatcaacaaaataaaaacctgatgacttggtaacatggttgacctgctgacttagccaactctgggaccactggaccccagcctttttgtataagccacttttaattatgttttctgttttctgtagccaagaccatcgtaaataaaaacaggattactgaccccactttatggatgaccatgctgagactcacagagactaagtgtcagaaccaggattctaactcaggatttctggcttctaatattgtggtccttctgttgcacaccacaaatgagatgaaagctaagaggcagaaagtggggtgggagggggttgaacagtccaggctggggaaatagtatcagaagacttgcaaatcaaaaggagaggagagtgtgcttgtgtagaaagaaggctgatcgggctggtggggaaggtggattcattcccagtggggctgaaataccaagtcagagtggattctatttgttgtcactgatggaagggatatagaggggcttttttttttttttttttttctgagttggagtctcgctctgtcacccaggctggagtgcagtgttgcgatctcagctcactgcaacctctgcctcctggattcaagcaattctcatgcctcagcctccgcagtatctgggattacaggtgcctgccaccacacccggcaaatttttgtattttttgtagagatagggtttctccatgttgtccaggctgatctggaactcctgaccttaggtaatccacctgcctcagcctcccaaagtgctgggattacagccataagccaccgtgcctggcctatagagaggctttcatctcattgatggtgtacaacggaaggaacacaagattagaattcagaaatcctgagtttgaactctggttctgacactactgcttaagcaacgtgaatactttatataggctgaaggagatggggtggggggaccatagggagccactgtcacagccccagtttgagggattggctctagggcagtgggggtgggtatggaaagaagggaacaagagtagaaatcactattgttacacaccaatgaatttggtaagtggctgacagcagtgagtgggaaaaagtcaaagtgaccttccatcaacacccctccatcctactgggggaaacctttcctcaactatgctgacacttgttccctcatcagcaggaaggatgattcgtgtatgcatgtctgtttcagacaatgatttctccaactctctatggtccaggaacccctatcaaaagttcttcttggcggggtggaatggctcatatctgtaatcctagcaatttgggaggccaaggtaagcagattacctgagcccagaagtttaagattagactgggcaatatggtgagaaaccctgtcttgacaaaaaatacaaaaaaaaaaaaaatagccaggcatggtgatatgcacctgtagtctcagctactcgggaggctgagatgaggggatcactccaggctctccagcctgggtgacagaaggagatgccgtctcaaaaaaaaaaagttcttatgcttgcaatggcctgcacatctgccttgcttatgtgtttgatggagtcttctaccactcccctgctctcttactgtgtccagcccaacccgccttctttctggtacttaaacacagcaagagggttcccagctcatggatcttatccttgtttttccttctgccttaaattcaacttccaggttcctttaaaagtgcttatcttctcatcatgcaggtctcagctagaatttcacctccatagagaagcttcccttgaggtcctacctgcctcccccagagaactgcagagagagaaaaagggaaagagagagactgattttgtcttctgcatttgacattatgagaaaatcctgggtgctttaagaataaacattgtggatgatagaactaccaagtgcaaaatgccatttccatgtaaatgacccagacaagcaaagcactgactcaccccaagaagaatctacctgggggaaaaaaaaatgttgtttacaagaacaataccagatgttggacttggaaggccacgtcttgacatttgaaggctaccaagggagatacagggactcaagggcaggcaaagaataagcagcagaagagagttcatttagaagtgactttacatattaagttaattcccagtataattcaagagtctgatgggggatggaggaataatgggaaaaaaaaaaggagtcctttaaaagtcctgaagagggagcaagacctgtaattccatctacaagtaatggtagttgaaattggttgtccctgatttgaataatcttgatggcatcggtattttcaattgtgattagtggtcgtaatgtgctaataaataagacgagagacaaggtacaaccttgccttgtcccacaaacgagttggaattgagactgctggaggcgggcaggctctggacctgaggagcccccaccaggacaggtgcctaagaactaaaggatgatttccgtgagattttgagacaggacacttaggagaaaatttcctctactctgagatcaagccattctaccaaaaaataaggaagcactgggcttggttttccttagggcagcccttccctggaagaaagtcactcatgtctcccaagcacctcactagaaagaagcactcaaaaagcgcttttcccatcttgttaacaatatcatccgtcctagagcaaggcatgggcacagtggcccactggaaggttctcctctaaacactttgaagaaattctcagtgataggaagtttttgaggtgcttaagtaggtaggtgagaggttaacttcagaaccaagatggccaacaagccaggactccagcactggcattatatgtgtccccagtaatatcctaagggaaacatattcgtttcctagggctccaggacaaaggagaacaaagtaggagatttaaaacaacagaaatttattatctcaaagttctagaggccaggagtctgaaatcatggtgtgcacagggccacgctgtcttttagattcttcagattcttgtgggtgctgacaacccttgctgcctaacagatctctgcctccacagtcacagggccatcttccatctgtgtgtttgtgtctccacacggcactctcctctccatgtgtctgtctctgtgtctcttcccctcttcaatgacatccgtcatattggattaagggctcattctataccaagatgacctcagcttagcttacatcttaattactctgcaaagaccctatttctaaataaggtcacactgacaagtaccaggggctaagatgtcagcatgtcttttggaagaatgtaattcaacccacaacaggaagtaaataggtgtgatgagggggaaaagccgatgggaaagacagacaaagagagagagagagagacagagagagagagagagagaaagaaagaaagaaagaaagaaagaaagaaagaaagaaaggaaagaaagagggaaggaaagaaggaaggaaagaaagaaagaaaaagagaaagaagaaagaaagaaaggaaagaaaagaaagaaagaaagagaaagaagaagagaggaaagaaaggagggagagagggagggaaggagggagagagaggcagggaggaaggaaggaaggaaggaaagaaggaaggaaggaaaaagggagggagagaaagaaaaagaaggaaataaagctggtgggaaagaaagaagaggaaggaaggaagaaggaggtgagagtaaggaaggaagaagaaaggaaggagggaggaaggagaagaaggaaggagaagaaatgagggagggacggatgcgggtgggagggaggaaggaaggaagggagggagggagaaggaagtgggagtaaggaaggaaggaagaagaaagaaaggagggaggaaggagaagaagaaaggagggagggagggatgaggaaggaaggaaggaacaaagaaaggaaagagatgctgcaatatggaaaggagtctaatttatataaaatttcgtgtgaacatttacaagtttttgatgacatatctatttccatcaagtagatcgattcagtaacatttcctcaactttggcaagtcatgtgagcctctgtctacttagcgctgccctagggtccctgatcagagtcatcagggggatagataccagcagtggattcaggctaccctaattcactccacctgaggcttagaaaggttgtcacttaacccagctctcattgctggcaaatggcagatgagattttaatccaaagacatgatcttttcattgtgctgcaatacttccctgaatgttaatcttactgaatgaatctgtaaatgaattaatgaacgaacgagtgaagaaactattcagtcgcacatgtagtggcctccagtgcttctggagatgttttggggtctggaataatacaggaaggttatctcattcacccatgtgatccagagcttggtggaaatgcaaccagcattctctgtgaggatccaatctcttccaacgccgagccactggattaaaaacagcccttttgtcccgtcttcttcttctccctgaaacagatgctgaggctcagccttgccctgcaactcatcctaatttgccccttgtcattcatccactgtggctggtccacagtaatgttctacttttaggaccagaagaacctgggctgctgtcaagggaagagactatcaatatcaagttaatgtgtgtaataggctggtcaccatgttcctcattaaaagacagctgatacgaatagtagcagaagtattggtattcacatcagcaagatcatgaccatttatttggttgactgtactagtttgctagggccgccatagcaaagtccaacaagctagctggcttaaactgtagaaatttatttgcttacaactcttgaaagctagaagcctgagactgaggtgtcagcagggttggttcatttttagggccatcagagatctgtctcgtgcctctctcctgagcttgcagttgtctgtcttctccctatgtcttccctctatttctgtgtgcaaatttcctcttttatgaggacaccgccatcttgaattagctcaccctaatgacctcatttgaaatcacctctttaaagaaactacctccaaatacagtcatgttcaaaagtcctgaggattaggacttgatgatattagtttggggagggtttcaatttatcccacagcactgtttctacttgccatatggagacctaaggcaaaatctttaaaaaaaggttttgttttgctttcagaaagagattcactctgttgcccaggctggagtggagtggtacgatctcagcgcactgcaacctccacctcccaggttcaagcaattctcctgcctcacccccccaggtagctgggattacaggcacctcccaccacacccggctaatttttgtatttttggtagagatagggtttcaccatgtcagccaggctggtcttgaactcctgacctcaagtgatccacccgcctcagcctcacaaagtgctgggattacaggcgtgaaccaccgcacccagtctaaaatcgaagtagaaattacagatccctactttcaaagtacccatagtcatggacaaactgtaaactccatgttcctacctccaagtagaagattgaagtcaggagaagtgagaatgaagtggaaggatcacggctttggaagaattatctgggctttgaaaaatgggtaaaattgaggtgaatgggggcgggaggaaaaattgtgtgctagacaagggctagaacataaataacagaacagaggtataaagcccatttttacctctgtttttgagattccagtagtacacattctccactcctagatttgccaaaggaagtactcattttggggtgcgccactcagactatggtttggaattcagagccctaagagacactagctgtgtcctattttgaagcacctctccgtctttcaagagcgagtctcctctttccatgtgtctgctctggtgtattatcagacccagctaatggagaggagttagcgggaagtgtcagggagttttataaaattatcatgtcaactctcttcctgtcagcgtgcataagggaagaagacaagaaaatgatattgtcgtttaatagttcactttagatcttcatctcttatcactcatcattactccatattaattactctgtattggcaatctctggctgtctgttgttccataaaagatcttactgagcttgtgactggacagctttcattaggaagcaattcgaaccacatttaacttgagaagattaacagattaactggaaccattaccccacctgcctctctgcctccagtgaaggtgcagcatggtcttgaatcccgggcatagccactgcctgattgcatcacactgaaagtgtcacctcacctctttgatcccagtatcccaatatgcaaaatggggtagtacaatcctttttggaggactattgtaaggcttttgttttgttttgagacagggtttccctttgtactcaggctgaagtacagtggcataatcatggctcactgcagcctcagtcttctgggctcaagcaatcctcccactttggcatcccaagcagctgggacaacaggcacaaaccaccacacccagctaaattttttttatttttagtaaagacagggtctctctatgttgcccaggctggtctcgaactcctgagctcaagcaatcctctcacctcagcctcccaaagtgctgggattacaggtatgagccaccatgcccaaccaagattttaaataaacgtaaaaatatctgacacagtcattggtacagagctggtaccagtaaatgacacctgttagtatttttagtgagtataaatggaatgagagaagattcaatggacttactccaaaatgaggctacctccactttcaaaatactgccccctgctctcacttttcccatcaagaagggttcagttcagctcagcaatcatttatcaggagcctgctaagtgccagatgcaatgtccactctagggatagagagattaacctgggatatccctaagtctttgagcccagcagccacagaagtacatagtttcctctgcctggaaccagaatggggtcactctctctgagctcggtctacatgtgcctttctctatgaagccttgtgtgatgctcctgagcagcacctgccctgcatctttacagctcttatcacggtggtgctcatatacttatgatgtgaccatgggattgctagcctctcctgcggatttacaagctcccacagggcaggacatttgttctgttcattgttgaatccccagtgcctggtgtactgaaaggagggaggtttgaaagagctcatgaagaagagtcaaatacaaaaaaaagagcaaaaggatgtaattacacctgagcagaagcaacccagataccattaagacatcagcttgtcctcctctgagctatcagcttaggaaaaggcagctctaggccaggcgcagtggctcacgcctgtaatgccggcactttgggaggctgaggcgggcggatcacctgaggtcgggagttcaagaccagcctgaccaacatggagaaagcacgctctactaaaaatacaaaattagccaggcgtggtggcgcatgcctatgatcccagctactcgggaggctgaagcagcataatcacttgaactcaggaggcagaggttgtggtgagctgagatcacaccactgcactccagcctaggcaacaagagcaaaactctgtctcaaaaaaaaaaaaaaagaaagaaataaaaggcagctataccttctatttctcaatttttcttttttgggagaaggtacaagcagccccagagtcccatggaagcagttttctctcaatacttgacccactacctccccaccaccaggagagaaactccaagagagagggccctttatttctcttgttcattgccatagcttccattgcttccatttcccagcacaatgggtacttagtagttcacaaaaagttgagtgaatgaatgaatgactagctctttaccacggagtcaatggcaaactcaactactttcagccaaaagaacataaaaaagacactgtgcccacccaggagcagcagcttatgcctgtaatcccagcattttgggaggctgaggctgatggatcacttgaagccaggagtccaagaccagcctagtcaacgtagcaagacttcatctctaccaaaaaaaaaaaaaatagctgagcgtagtagcacacatctgtggtcccagctgctctgggaggctgagatgggagaatcatttgagcccaggagttggaggctgcagtgagctgtgatcatgccactggcactccagcctgaggaacagagtgagatcctgtcagaaaaaaaaaaaaaaaaaaaaaaaaaaaagacgccgtgcccaaactggggcttggcctttagagatttggggagcttctcctttgcctgccttagggaaatcctcacatcatgatactcagtcttttccagacaaacaaactgaagggcaagaaaggacttcagcattcacctccatcaccccctccacacagatgaggcacctgagactcgattcagagccaaataaggaaggagaagaagtacaaaattaagattctgaagacctgggtagaggccttggcttaaccactaagtcacagtatgatcttgggtaagtcacttcatttctctgagcctcgggttcctaagctagaaaatggaaaaaaaaataataacacataccttaaaggatggtggtgagaatgaaatacaatgaggtttgcaataatatttgaaacctcagccaggcacggtggctcacacttgtaatcccagcactttgggaggccaaggtgggtggatcacttgaggtcaggagttcgagaccagccttgccaacatggagaaaccctgtctctactgaaaatataaaaatgagctgagcgttatggcacatgcctgtagtctcagctacttgggaggctgaggcaggagaatggcttgaacccaggaggtggaggttgcagtgagccaagattgtgccattgcactccagcctgggcaacagagtgagactctggctcaaagaaaaaaaaattggaacctctaaagtctagacatctaggggaaatcttttttcatcgctattgcatcagtgcatgggtctttggaagggattttggatgggatttcaactgattttggttcaacaaacatatggtagactccttcaagtttccaagcactaggctttgccacaatggccacaaacaacaacaatagtaagagctaccatttgctgatcgctcaagggttccaggcactatgccttgtgctttcaatgcattgcttcatttattctcacaaccctattaactgtgtacaattattaatcctctctttgtagatgagaaattataccccagacagttaaagtgactcttctagggcaacacagataagtagaaggaccagaatttgatccctgaactcactgaatccagaatccacgcttttattcagtacccagaataaatagacaaataatccaatgtaaaaaacggtcagtgattttaaaacacactttccaaaaaaaaagaaaaagaaaaagtgctcaacattagtcatcactaaaacgaaaattaaatctaaacaaaataccactttacgtccaacagaataagtaatttttttaaaaaaagaagaaaattaatgaaaccaaatgtttatgaaattaaggagcaactggaactcttataagttgatttagaaatacactgcttatataactctttccaaaaatgctaacagtttttcttaaaaccatatatatacttattcgatgacccaacaatttcacttctggccgggcacagtggcttaccaggcctgttatcccagcagcgagctgtaatcatattactgcactccagcctaagcaacagagtgagatcctgtcaaaaaaaaaaagaggccgaggtaggaggatcacttgagtccagaagttcaagaacagcctgggaaacacagtgagaccacatctctaaaaaaaaatttaaaaattagccaggcatggtagcacatacctgtagtttcagctacttggtaggctgaggaaaaggagagcctgagcccaggaggttaaggctgcaatgagctgtaatctgcactgcactccagcctgggtaacagagcaagacactgtttcaaaaaaaaaaaaaatcatatatatatgtatacatttctaaatatttacccaagataaatgaaaatacaagttcacaaaaagccttgtacaaacaatgctcatagcagctttattcataatagctgatgactagaaacatcccacgtgtctacgtaaatagaagaatgaataagcaaactgtggtatatccatacaacagaatactattcagcaataaaaggaaataacctcctaatacatgcaacataaatgaacctcaaaaacattatgttgagtgagacaagtgttagacaaaacaatatacatgccatttcattcattcatgtgaaatcctagaacagtgctctattccactatgggaagaaaaatcagagcaacacttgcctttggagagtagcttgggaacctactgagaaagagcttgaggaaactctctggggtgatgataatgttctataccaagataagggcttgtaggctgggcacagtggctcacgcctatgatgccagcactttgggaggccaaggtgggcggatcagttgagatcaggagttcgagactgccctggccaacatggtgaaaccgcgtttctactaaaaaaaaatatgaaaaatagccaagcctggtggcatgcgcctgtagtcccagctactcaggaagctgaggcaggaaaatcatttgaacctgggaggcagagattgctgtgaggcaagattgcaccactgcactccagcctggagagagagcaagactccatctcaaaaaaaaaaaaaaaaaaaaagaaaagaaaaagataagggcttgcatttatcaaaatttggctaatataagtttaacattttactgtttgtaaattttacaccaaaagaaaaacctgtaaaaattttggaaataaatagtataatcaatatctttaattacggattactcagaaaagggccaatatttttacagtaccttccatagtgtgatgatagacatcaaaggactatcccaaaatgtctgcaccgacggacctgcaagaatgactacagttccagaaataaagatccatcaatttgcagtagcaagctgtaaatacctgtacaggaataaaactgtctgcaaacagagatttctttcgtgaccagcacatcttactggccctgggggttgcccatcaacccccagccaccttgtttctcttcctgagctcttggtatggctcacgagagtttccctggcagaggcagtcgccttgccctctgggtgcccagcccacaccccaagcacctgctaattgcaagaaacaacatatggcaggcagcctggttgcagaccccgcggctcccctggcttgcagcccaaccgtggaggcaggctgcatgctgagctgctgggatcgaagaggtgtcattagaaaatgattcatagccctctgccttaatgaggactcacacccgagggcttccaattacccaatcgatggctagagtgctgctcccagccagcggcctcttgctttcctttctcttctttaaaaatatttgcaagaggtttcaatgaagtctttctctcctctccttggccaacccaagcccagggaggaaactaacccagacaaccatcccaggaagttccctgggacagactgatgaatcctgcatggctcagcctagaaaacagaaaactccacatgaattccccacctagacagggccagatctgggaggtgacatgtgagctcaaagactgggaaaacagcaatgtgcaagggatcaaatgtcctgatgttggaaatatcttggcacatttgaggacttgtgagaggacagttgtgagccaggagaaagtggagagaaatgatgctggagagatggacattagctaagagtgagctgagggaagaaaatacaagagccttagactcagtctggacatagatccctgttccccaactccctgtgtgcataatatctgcatggtgaaaattactaggtgtccaccaaaattcatcattctcttctgtaataacgatatatttatagctgtgatatagctgcccagtctgaaactcactattttctagtcttccctgaaaatagacggaagatcttgcccaaaggatgtaagtgaaactgtgtgcgtgtgtgtgtgtgtgtgtgtgtgtgtgcatgtgcatgtacaacttccaagcctggcccataaaatcttgcatgtgtgatcatcctgtatttataatttactacttactgggaataacagtatgaccctagtggatgccacagccattggtaaatgtaaagaactgagaccaacaatgactgagtggagcccagtacctaccttcctggactctatcagcagagagaatcaaacttctttgttctttaagcctcttaatttggcaggtttctccattgtaccagcttagcctaatctgggtaacattatttgggaaatattttattatctgtgtatttcaattcctcatctgcaaagaataatttcttcctctcaagacttttatgaaaagtaagtgagcagacatcaagatgcccagacatcaaagggtctcggtaggacgtcttcctgtccacgcctctggccacagcaatttctacgcaggactctggtgtgtgactacaccctcttctccaacttcgcaccccaatacctgttccatagttgcttcttctggcttattgcaatggaggcagggcctgtcatctcgcacagaattctgcatcttgctgtcacctgtttttcggctgtccacagtgacagccagacgatggatctctttgttctagtactgctgtctctcaaaggctcagaactctttgttgatttctttttactgctgcgtgctggaagtcaagtggaagtcacacaactttggaggactgcctcacaagtcactttggaaactcacctgtagctcagcctaatgcggtaaaaaataaaatgtgcggagaggatagaattgttgacagtggacaccaaaagattcctattagaacatctcttccaaccctttggcaatacagatgaggaaactaagaagcaaatatgagaaaactatcccaaggtcacacagaaaattaagcaatataagtgcagaagcaatcaaaatcagatgtcaccaactttttcatttttagggcttcaacaaatgctgattcacacaaaatacctctataagacaagtaagagttgggctgatgagaccagctcccctaatttaaagagagaataagccctacttcttttgtgaggagcgttatttctggggtacctgtgtatctaaaatccagtttcaacaatttctagaaattagccctcctggatgtttacataataaacatcttttagtccctccctcctctgtgccaggcactgtgcacaatacttgagattcactggagaaaagaactagaaatcgtctcagccttgaaggactcatggctaagaagaaagcaaagaatcacacaattattaatagaaagtacttctaggggtaagtatatagaacaatgggaatttacaaaaagaggaactgagaaggttttggaggcagagaagcctttcctaaagaagagggcttttgagctgggagggcactgcatgatccatttcttagcctcacattcactcatttatccactcagtcactcaacaagtactgatcaattgcttactgaataccaggccccatgcaaggcataggagatactgcattgaacaagacaaatcaacatcctgccatgatggttttacactcttgccatatctgactcttaatttctagcctgcctccgactgctatggccaggttcttctatcatctcatctctcaggattgggcgacatctgattatattcctaaccattatcagcttgtctcggcatcagatatgcttgctgcattagaccagctccccaatgtaaatatcctaagaaaaggcaactttgcactacagtgtgaatgactgatacctagattgtgtgaagcatggctggaggaactgggagtgcctttcctgaagaagggaaaactcaactatgcggggtcaatgagttcaaatatgttaatggctgtttgggagaacagagctcaaatgtagtctataaggtaaaaggaacatggagagatttcaacatcacaccacttagagttgtctgccaatgaaaaggacttcttccaaaggtagtgagctcctcctcactgatgatatttaggcagaagctagatggacacttattgagactggatggcaagacaatttctatgtgtccttcagactcttagaatttattattctatcattgcattcttaacttaagttcaaaattagattcttttaaaaaaaaagagagagagagaaagaaagatagaaaaacagagtcttctcacttccaagatcaggttttagaaaattaaaatatttttaaaaattaaagaaaacaaaaaacagggtctttctctgtcacccaggctggagcacagtggcatgatggcggctcaagtgatcctcctaccgcagcctcccgagtagctgggactacagctgcatgccaccatacccagataattgttgtatcttttacagagacaaggtttctccatgttccccaggctggtcttgaacttctgggctcaagcgatccacccaccttgggcctcccaaagtgctgggattacaggcaagagccaccatgcccagccctcaactagatttataatcttccttccaaaacctgctcctcccacagccttttccatctcacttaaaacttcaagttgctcaagacaaaatccttggaattctccttgatgtctctccgtctttcacacttcatattcaacatgctaggaagtctgatgggctccaccttaacttacatgagcatctgaccacatcttgccatctccacggttatcacactgatggaagccatcaataaccacttaccctatttattataataccatgtgtgaagccccaaacgtgcatagacctagccctcaagcttactgcatgatagaagaaaaagaggcaaattaaatgatcacacaggtataaatgtgtaattataaatagtttagaggaggggactttggtgctatgagaaggtaacttcattaactcagtagtatcaattgcattttaactgcacccaataatctttcatatcattatggaactataaagttttcattggcttttactagctgatgcaattctcccagaaacctggtgacgtggaaaaatggatctggatgtccattttacagatgaggaaacttgggcttagagtggtaaactgagtcactgaaggccatataacaggaaaaagaatggaactgacggtcaagcaaataaccagggctctctcactgcctctaatgcaggtgtatgaacacctttaataccagggctctctcactgcctccaatgcaggtgtataaacacctttaataccagggctctctcactgcctctaatgcaggtgtataaacacctttaataccagggctctctcactgcctctaatgcaggtgtataaacacctttaataccagggctctctcactgcctccaatgcaggtgtataaacacctttaataccagggctctctcactgcctctaatgcaggtgtataaacacctttaataccagggctctctcactgcctctaatgcaggtctataaacacctttaataccagggctctctcactgcctctaatgcaggtgtataaacacctttaattcaaaggtttcccaatcccactagggaatggttaacgactttgggagaagagagctaaggataaccattaaatacacagaaaggcataatccatgttccagaggttcagattggcatggcaagcctcagccatgcacctgtgcactctcctctccctacgggtataaacatggaagagctgcttgttattttaggagggtgaataggtcataatagcaaagacatggaatcaacctaaatgcccatcaatggtagactggataaagaaaatgtggtaaatatacatcatagaatactatgcagccataacaaagaatgagatcatgtcctttgcaggaacatggatgcagctggaggccattatccttagcagactaatgcaggaatagaaaaccaaataccacatgttctcacttataagtgggagctaaatgatgaaaacacatggatactaaaagaggaccaacagatacaggccctaccggagggtggagggtgtgaggaggtagaggatcatgaaaaataactaataggtactgggcttaatacctgggtgataaaataatctgtacaacaaacctccaagacacgaatttacctatgtaacaaacagcaccccgaatttaaaacttgaaaaaaaaaagaaagaaagaaagagagaaaatagtgggccgggcacggtggctcacacctgtaatcccagcactttgcgatgccaaggtgggcagatcatgaggtcaagagatcaagaccatcctggccaacatggggaaaccccgtgtctactaaaaatacaaaaactagctgggtgtggtggtgtgcacctataataccagctactcaggaggctgagacaggagaatcacttgaacccaggaggcagagttgcagtgagccaagatcgcaccgctgcactccagcctggtgacagagcgagactccatctcaaaaaaaaagaaaaaaagaaagaagaaaacagtaaaaataaacaagtaaaagagtgaatacgaaaaaatagaaaggcagcaacatttacaatggtcaaggattatatccctgctaatacgtaaaccaaaagtcacagctcaatgattctaaaatgcattaaggtaatcaggctgctctagggataggagaaatgatttgggatagtctccatgtcattgtcaagaattttggaggagttatttcagtttggatcagagatataaattcctgatgctccaggtgtctgaactacctcctaaagttagactcttgcagaaaagacgtgagcctctgcctccaaggtgaaaaataaaaacgttcaaagcctggactccaagtacatgatatacccatcatcatggagcttgaaggtgccaatgctctaaccattttgttcgcactttatgcaatgaatgataagtatcatcaggtcaaatctcttcttcttgaacatcgtggtatgatatgcgaaataattaaacttacttacttgctctttccttctttttttccccctttattttccaggccccattccagaaaagatttaagatgaatgcacctaagtcataaagtagaaaattacgaactctaattaacatattattaattcataagatgtgagagggaaaagatcttacacgtcaagttcagagaggttaatcaagtcatcaaaagctatagaaagtcattgttcaataactattttattgaatgcctactcggtacacagtcttgtatttttataatagatttttatttcctccaatgcatatttaattgagcatatattgtacagctcaaaatcaagattagatcttgagacagaggaaataaacacattttgaatacttactatgtgccaaaaactgtaccttatgtccaattttatgtacataatgtcattgcgtcctcaccaaaacccttgggagaggtaatattggttactggttttagttcctaaccctcctgtggctgtggtcctagggtcctgcaaatgaagacggaaatgattttgcagtgaaatttacctgttattgaccagctcaccaatgcacgggaggtaggtaacattctaaaccaagcttaatgcagagagggaggttttcacaaagattttgtcaactctaaaattacagtaacttcctacgctaattcaactacctttcccaccctccctagtaactacccacatctctatagaactgtatggtgaggaaatggaaagaaccttagcagtgaagaaaagaggtaattaatctctcttcattctttcctgagaggtgttatcttattccttaaacatccaaataaactattaggttggtgcaaaagtaattgtggtttttgccattacttttaaggtactcccagcctaattctgcaacaacagaattgttctaaattctacattttatataccaaattggaaaagccaaatatctctcacgcttgttacctgtagccttactatgaaatgactgtgtgtgtattcacagctactagggaggctgaggtaggaggattgcttgaacccagtaggtttagactaaagtgattggtgactgtaccactgcactacagcctgagcaacagagggagaccctgtctcaaaaaacaaatctaaaaatgaatctaaaatagctattaggattatggtttgagtcaggcaactcttttcaagcaattaagaatgtgctggtgtgctgatgccaggcctaggtctacaggcctattagctaacaaaggtactctaactcaattcatcggacagcaaagaaacaaagaaaaagtcattatgcagacatccaggcactcgaagccaaagggccctaagataatgtcagctctctagcagtgaatggggaatacagctaggtttggacagctggcattcaaaactctttgtctttattgctcatcctcatttaatatgagaacattgcatgatccataatattttcttcatccatgtgttctccatgttacaacggatgctcagggagcttaggcaactctgaggactgacaagaagcaaaatttgattccaagttgggtctccatgtctttttttgctgtagtagatttctcccttcacttaggtctccacctgactctatggagacactgaaattcaaggaggctaaatgatcccgttgttccacagagctagaacacaggtcaagcagtgtggttgcaagtgatttttccaggacgtaacaccagcacattctttttttttttttttttagatagagtctcactctgtgatccaggctggagtgcagtggcgcgatctcggctcactgcaacctctgcctccctggttcaagtgattcttctgcctcagtctcctgagtagctggtacgacaggcgtgtgccaccacgccaggctaatttttgtatttttagtagagacagggtttcaccatactggccaggctgatctcgaactgttgaccttgtgatctgcccgcctcagcctcccaaagtgctgggattacaagcatgagccaccgcgcccagcaccagcacattcttaattgtttaaaaggagttgcctgactcaaactatgatcctaacggctaatgtagattcatttttagatttgtttttgagacagggtctccctctgttgctcaggctggtgtgcagtggtacaatcacagctcactttagcctcaacttcctgggctcaagcaatccttccgcctcagactcccaagtagctgtgagtacactcacgtgccgccacatctggctaatttttgttttgttttgtttgtagagacagggtttccccatgttgcccaagctggtctcaaactcccgggctcaagggatccatccgcctcggccccccaaagtgctgggactacaggcatggaccactgtgaatggccatatttttggattctttgtcttgggcattcttctctattggctcaacttactcctttaattggtgcctctctggtggtcctggaaaataaatgtctgactccagcttgattctattcagtcccattggccaggtcagtctgcctcttctctcccataaaggggaaattggagcatgggtccactcttagaagttaattcacttcttcaccttggggtaaattcagcatttggcagtacacactcaacaaatgagcctctgagctcagggataaaaataaataagtaaaagtcttgcccttaaaccggacagtatgaatcgtaattaaaaacccccattatgctgtttcaataggaacagtcctgccgtcattaagctgaaacagaattccttcagggagaaattatttctcgtttgatttctgtcagaatggctttgactttgaggatacatctacagaatggtgtctccaggctccacctctgaggctctgctcagacaaaggagacgtttgcttcgaacagatgaaacctgattaaagattcatttcaaattaactttccctgattatttctcttttgtaatctttattattactttaaggggagggaaaatagaaagacgaaaagcaaccctccctagatccacacgtaaatcttcacagtagccactcaacagtatcattaattccgcctgaatattcccacaatgcaaagtagcaggcacttatgcaatggctatttattgggaaatcaagcccccatccgttctttgatgttgtgttattaaactgaaaagggaacagcactggcaagatggatgaaggcgacaaagaatacagcatggactagtcccagtgctctgaagtcctgtcttcaaggtcatgatagaaacaaggtaggtggaaaacaaattaacctccaagggcccaggtggtgcccagccctggactttgtagcagggctcttggctgagcagaagctgggcttcagatcacttccagtgggtggagatgggaaacagtcctatccatttgcagctccatagaggctgaggaacaaccttggaagagagcccaaaccctggccaatataaggatctgggcatatttcaggcatatctgaggggtgagggtgtctcaacagaagttgtcttagtggaaggaacaaggggctccttagggagcaaagtgaaagagaaagcagagcctgtcattgcaagttagacgcgggggcaagacatgagcatctaagggaaggaggattctaagacaggagggaagaggctgtgtactttccatgcacttcaagaagtgacttaaaaaatgggcataactaaagactgtaatatcttgagtctcaggcagcttaataatatgacgccccaaccaagcgtaacacaaaaggtgtatttgtcatgtttcacgtgagatatcacctcagtctcagatgctggtatttcctgcctactgacattggatgtatctgcattctcttgcccctgcactgaaacaccggtgatggtaagggaacagaaccccagcctcactgtgtcacccccatgggattggcaggcccaaagcaagggatttgtaacccatcaagaaacagaaaagagtgtgagacttttattataaaacctcaacgaatcaaactgtggggctccctcactggacatagcacagaagcagcattatcttctcagttttcaagcattacgacttaaatctttagtaccagaattcaaaaaaagcatttcctggccaggtgtggtggctcatgtctgtagtcccagcactttgggaggctgaggtgggagaatcacttgagggagggagttcaataccagcctgggcaacatagaaaaactccatctctacaaacaaataaatgtaatttaatttaattagccggacatggtggcaagcacctatgttccctgcccctctggaggctgaggtgggaggattgcttgagcccaggagattgaggctgcagtgagctatgatcactccactgaattccagcctgggcaaaagagcaagaccctgtctcaaaaaaaaaaaaaaaaaaggaaaaagaaaaaaaggcttctccagtttctgcagttttgaagagggacagagtttcaactctctgaaacctaggcagtagaagttataactgagaacataggtcatgctgccacactttacctaggcttgcatagagaagaaacaagtctgatttttggacattcatgggcaccataaggattcttgaaaacagtggggtaaggagctctccctactgtcaagaactcaggttattactgtaatatagttttatttgtactcacagatgagtgaagcccaaagcatacgcatctcatcccacttaatacttagaaacatcctgagaaaagggaattattgattttttattgaaaatagggaacaagttcaaccacgttacataaactgcccaaggtcatacagctggtagcagagcccggactcacattccacattctatgcactctctctgcttccatatttccatgctgtctttcaaagtataaaagggttcatgctattgaggcaatattcagaagggaaggtcacaggtaacagatacaactggggtgggagttggggaaaagggtacccagactgcttgagagttggagcagccttaaatgaagaggtgaaaacttttcctggagaatgattgctattgcagatgatggggactagaactgatgttgagctaaagagctgtgatgacaacattaaggcccagacaggtagcctaactttcccaaagtcacacagctagtatgtggcggagccaggatctaaatccagaccacatagatttccaaagttcatgttcttgaatattatggtgcacagtctttcaggtggctgcctgtggttctttgacctaagacagaaggcaggaaaggagataggaatatcgtagagaaaggagggccagagcttagaggtggaaatctctgtggctatatttacatcgaacccagaacgagtcttaccctgacatcttccttggcgcttctcagtcccttcatctggtcatatcgctttcaccttcatcgtgacctccacagggagactgtcacacaagatacaacaagggagagtagaggtgttgaagccaagaccagaaaccaggtcatgaggagcctcaaataccagcctgacttgggactggtgggttgatggagcatgattgaagagtttaaatcaaagaacctaaaaaaccaccttccaaggtgatcctgaaatttgtcaatatttgcaaccagccagtgtagtcggcttcttaaggtgaggaagagatggctgctcagaggatgctaaagattttgtggacaatttcaatcctagctgtgatttctttgtagttattccatagccactaggttgttgaaactgactaatccctcatttatctgtcctagcatattctctctgcccccctcttatcttttagggaaggcagctaagttatgctccatggatcttaagcttactatctcccattatttactccaatcccattaaagtgccaccttataacttccatcctgaccccagaagttgtatctgcatgttaacttggaagaggttgcaggattcagggtccattttagcactatctgaatatccgctccagtctatggtaagaacagagaaagagaaaaacctaagagatccctggatccaactcattcaacttatcaattggacagaggcctgtatggttgaaaggattttcccaaaatcacccagagaggtttgaggcctcagagagcaacagctcaacacacacgacccctcctttctcaaggtaggttctcttctcttgcccagtaattcttctcttatctttcacaaaggaaataaaagcagcttgatctactggacaactgtagtttacccttgactccttctctcattcatccgcttgcggaggagggaatataagagaaataacctgatttaggtattgagattctgaaaaaagggaggggttggcttggatgcttagaaagatgatgtcaccaactataagaaaaaaaaaaagtaaaaactgttttggaagaaggtgatggtgttgacaaatacacagacattctctggagatgaggagtacacagttggctatgttattcctaagtctttaggaaggcatctaggctgaagaaatgatctaaacgttataaagagtgtaaattataaatggaatgaatgtggagtacatgaggctgctagagtgctgagtaacactgataataacacatgtagaagctgtaggagaaacatattcaaggaagagccagaaaggaactggccagagaggcatgcaaatatccaggggagtctggtgtaat

SEQ ID NO: 480 - DNA, 40001 bp, Homo sapiens
cccacaccactccacacacacacacacacacacacacacaaacacacagacacatgctctctgtctcatgatagctaaacaacagaagctattccacatctcacattctcattctcaaacgcatcttacaaaataaagaaagagtcttctgacaacttgagcacaagtctgaaaattcacttttcccattggcctgaattatataatgtgcccatccctgacccagtcactgtggccaatggtgcacaacttgctaattgccttgcaccacccactgtagcaagaatgtcaactccatccaaatcatgtggctgaaaatggctgtattaatccattctcacatggctataaagaataccaccgagactgggtaatttatgaaggaaagagatttaatggactcacagttctgcatggtgaggaggcctcaagaaacttacaatcacggcaaaagacaaagcaggcacatcttacatggcagcaggcgagagagagaatgtgcaggaagtggagagggaagagccccttataaaaccatcagatctgatgagaacttattcactatcacaagaacagtatgggggaatccacccctataacccaatcacctccaactgggtccctcccttgacatatggggattatagggattacaattctagaggagatttggattgcaacacagccaaaccacatcaatggcagagggtgaattccactaagcaaagtcaaggtcctttctgttgtggcgcaaagtggatgctggagagtcctccagtaaatgtccctaggacgtgtcttgctagggaggagctatctagccatggactacatttcccagcctatcttgtgtttaggttggacacaggactagttctcgctagtagaatgaaaatgaaagtggaattagagtactctgaggccctagaggagagaggaacagaagatagaaggaggcttcctccccgtttcactgcacagaaagctacctgcccattggaaatatccacattaaacctatttgaataagccattgatatttatgggggtttttttgttatagcagctaacatcaccctaatacataccttacaagtgtatattacttttacataaacataataataattgtggtggttaaatttatgtgtcatcttcagtgagccatgagatggccagattaaacattgtttctgggggtgtctgtgattgcttctggatgggactggcatttgaatcagtgagctcagtaaggtagatttccctccccaaagtggttgagcatcattcaatccactgacgacctgagtagaacaaaaggcaggggaagcaggaatttgccctttttttccctgcctcactgtttgagctgggacatctcatttcatctcttcctcccgttagattgggatttattccatcagctcctctggttctcaggcttcaaactcagactgaattgcaccactggtttccctgagcctccagcttgcagaaaataggttgtgggacctccctacctccataatagcataaaccaattcctccttatttatactaaccaatggtagatactattggttctattgcttctatttctctggagaaccctgactaatacaataataatttttttaaatgggtcatgtttcaggggaaaaagtcataagtttgttgtccctaatttgtgtatgcatgataggaagacataaaagaagtcataattaataggcaagctaaaataaagccaagaagctttgaatagagcctggtattaaatataccacttgtacaagcttacgggagaggagatttcaaatgctcctgtcagaagtttctcagatcaaagaacttgattgacatctagaagattaaaggctatctgatccacagataaaacaatcaatctcctaggctagagatttatataaaaacaattatgcctccatttttttaatggctgtattcctggaagagccacttattccttttcttttaccttgtattcaataactattgagtgttattgaatgtgccgtgtttggttgagtgcaaaagatccaatgagaatgagttctagttctttcaaagaatttataggcttgggacttgggtggactaatacacaggaaattatcaaaagggaaagagagagaagtgctatgattggctgatttaaaaacccatagaaaggacactcaacctactcttgatggcatagcagatacaatcttgatggtatagcagattaacaagactaatcttgttcatcctcaccaaatattctatattgccccctatattttccacctttctctgcagttacaatggagtcatgtgactaattctgaccaagagaccgtgagcagaagtaacacatgtcacttcctggtcaaagtcattaggagctgttctgcttcctcttcctctctcccctcttctctcttcagagagcttgaagtccacgtgtttcagatgccccaacagcagcatggcggtatagggctgctcaacctacatggcactttatgtgagtgagaaataagctttattgtgtttaacttttgggatttcaggtttggcccgtcatgcaactggtgtaattatcctgatacaagaggtcagagaatgcttcctgaaaaggagaactgaaagggtagaagcttaaatgaaattaggcaggcagagatatggctgcaaagagtagtccgtgaagaggaaacagtgtctgccaagctttgaagacggttgcttgtaaatagagtttgggtttaaaggggtcctttttattattattattaatttcccttggatatttacaactttactcatatccatttcttcatattcaatggcaggaatttctagcttttaattgaagcttctcagcttattgttccccatcttctccttctagcagctaatgaccagtaaataaatccacaagggcccagcctagctgctgtttaaacaaacattttatttaaacactctgcaaagaagtcctgcactccagcctaggcgacagagtgagactctgtctcaaaaaaaaaaaaacaaaacaaaggtgttagagtgttcattggaacatgttttctaatagcaaaacacaggggaaaagcatgaatgctcatcatgggggtgagtggttaaacaaaatgtggttcagtcatacaatagtgagaattacacacagtgcttacaaataatgaaccaggtctctcttatcacatggagcaatctcaaaaacattgagtgagaaaaacaagttgtagaatcacacacacacacacacacacacacgcatacacatacaaaatgataccattcacaaaattattaaaatccattaaactgtatattgttgatgtattagccacaagtttaaaaacataggtcaggagcatttacaccatcttcatgaaagtgattgcttcttatgaatgaagaaaggaacagagtggaagcggctgtcctactttgggctcttctgaaaacagagcctgaaacaaggagtctgatgcaagtagtttattggggtggcaattgcaggaagatagtaaggatgcagggaaagagagacgggaaggggagtaagtcaataaagtgtgtattaatctagggcaattgggactcaatctcagcaggaacctcctgaatagccatgcctcagaatcaatccactaagggacaaggcagctgggataattattttccaactcccttctctcattgatcgaggattgaccttggggcattgcgcctccagtcctttgggattgccctgtggacgggctaagcaagctctctcgccactagagggaaccctggggcagagaaacgtgtgctccagggcgtaagcagtcagcgtgcctggaaaccatccaccatagctgcaagaggcctaaagagattggccaagggatgtggcatgggatactaatcatatctgctacatgggaaaaactgtatcagcaatgttttgctttatttttaagaaacatctgaagtaaataaaataaaatgttaatatttgtcaattctacccagtggttgcatgggtggctgctatattattctctgttcctttttgcattttgtctttaaattttacaaattacattcacaatgttgtaaaaccaccgccactgttttgctttatttttaagaaacatctgaagtaaataaaataaaattgttaatatttgtcaattctacccagtggttgcatgggtgactgctatattattctctgttcctttttgtattttttgtttaaattttactaattacattcacagtgttgtaaaaccatcaccactgtctatttccaaaatttcaccaccctaaagagagagcaataagcaataactccttatgctcctctcccttggcctttggtaacttctaatctaccttctgtctctataaatttccctattctagatatttcatacaagtagaatcacacaatatttgtcctttttgttggcctatatcacttagcataatgctttcaaagtcaatccatgttgtaacatgtatcagaactttctttctttttatggctgaataataccccagcgtgtgtgtgtgtgtgtgtgtgtgtgtgtgtgtgtgtaccacattttgtttatttattcatctgttgatgaactcttgggttgttttcaccttttggctattgtgaataatgctacaataaacattgccatggaagtaactattggagtccgtgtttccaattttttgttgtatacctaggaacagaattgctaggtcatatggtaactctatgtttcattttttgaggaaccactatactcctttccatagcatctaaaccgtcctacattccaaccagcgcttcataagggttccaatttctccccatcctcgctaacactatcttctctttgttgttgttgttgttatagccatcctagtaggtatgaagggatatttcactgtggttttgggttgcatgtccttaatgatgatattgaacaccttttcatctacttattggccatttatgtatcttccttggagaaatgcctattcaagctttctgtattcttaaaccttttcaaaataaaaatgtaaggtcctatagcatgcagtggagcctactatttgaaaacaacttctgctttttctagtgaagttactttcttgatttttctaacaatcaaaatttttctctactttgtctctcagcagatttcagtttcaactgcatcatccattccatcaatcagcaagtttgctaagagagctttcgtgaagctactttgcaacatctaagtgacaagcaaatccaactttaggcaaaggtccaataagtcacactccaggagatagcaacaaaagtaaaatcaagtagtgatgacttgtcaacctatcctttattctggactaaagggatgtgggctttttcttttggttttaagtaggaaaatgatctcttcccatctcctaatcacagaacaagaaacgaagggaaggaagattaaaaagggtagggtagtccctccaaaaatacacaaaagcatcaattgtagtttacatcaaaattcaagtcccatgaagtttatcaaagtttgtagtataactgtatctctctactagagtttgaaccaagcattttttctctttgctggcatgtctattgttccaagttctatgggaataatggggtttatttaatattttccacatcttccctacttgtcagttatttctctcccccttcctcaaacccctgagaaactcccaaacactttctatattgtattcacgaggaggcaacactgtgggactgggtttgggcatggagtgtagcctgcagactatcaagggttggagtcttggctttgtcatttaatatcgttgttgttgatgctgctgttggtgctaacttctctaaacttcagtttccttttaaagtctgttttaaaaaggaaaactattactacaaataaccaaaatatcaattttatctagtttgaacaataaagacaatttaatatatctcatttaacaggaagtctagggatttccgagattgggcgggattcagagctggtttttttcagccactcgatgatattgttaaggacctaggttctttccatcttgctactctgccagccaaagcattagtattatcttaaaaccagtttccttgtagctgtaagaaagctgttagctataaacttctctgtatatatctcccagaaggcagcaacattctcctccaatttggtgatgggtagagaggtttttcctttagatcgattgggaagaaccaacaaaaacattactggaactaataagcaattatagcaaagttgcagagcacaaggttaatatagaaaagtccattgatttcctatataccagcaattaacaaatggaatttgaaactaaaaacacaataccatttccattagcaccccctccaaaaattaaatacttagatataaatataacaaaatatgtataagatctatataaagaaaactacaaaactaatgaaagcaatacaagaactaaataaatggaaagatattccatgttcatggatagaaagactcaatattgtcaaaatgtcagttcttccttgcttgatctatagactcaatacaatctcaatcaaaatcccagaaagtaattttgtgaatattgacaaactgactctaaggtttatatagagaggcaaaaagaaaaaaaaaagaaaaagaaaaaacagaatagctaatactgtaaagctacagtaatcaaaatagtgtagtactggtaaaagaacagacaaatacatcagtggaacagtacggagagtacagaaataggctcacatatataaactgatctttgacaaaggagtaaagtcaacataatgaagaaaagatatggtttttgacaaatggtgctgaaacaacctgacatccatgtacaaacaaaatttagacccagatcttatacccctaaaaaaaaactcaaaattgatcgtagatcgaaatgtaaaattcaaaactgtaagagtactagaaaataacataagagaaattctagatgacattgggtttgtcaatgactttttagacacaacaccaaaggcacaattcatgaaagaaccaattgataagttggacttcactaatattaaaaattccttctttgtaaaagacactatcaatagaatgaaaagccaagccaccaactgagaaaaaaatacttgcaaaagacgtgtctgacaaaggattattattcaaaacatacaaaaataactgaaaactcaacaataagaaataaaacaacctaatacaaaaaaaaaaatgtatcaaagaccttaacagacacctcatcaaaaagacatgcatatgggccgggcacggtggcttacacctgtaatcccaacactttgggaggccgaggtgggcggatcatgaggtctggagtttgagaccagcctggctaacatggtgaaaccccatctctactaaaaatacaaaaattagctgggtgtggtggtacgtgcctataatcccagctactcaggaggctgaggcaggagaattgcttgaacccaggaggcagaggttgcagtgagccgagatcacgccactacagcccagcctgagtgacagagtgagacgctgttaaaaaaaaaaaaaaaaaaaaagatatccatatggaaaacaagcatatgaaagatgctggccaggcgcagtggctcacgcctgtaatcccagcactctgggaggcagagacaggtggatcatgaggtcaagagattgagaccatcctgactaacttggcgaaaccccgtctctactaaaaaaaaaaaaaatacaaaaaaattggccaggtctggtggcacacgcctgtagtcccagctattcaggagactgaggcagaagaaatgcttgaaccgggaggcagagggtgcagtgagcagagattgcaccactgcactccagcctgggcaacagagcgagattccatctccaagaaaaaaaaaaaaaaagaaagatgctgcagatcatatgtcattaggaaaattaaagcaacaataaagtactactactaccacatacctattagaatggtcccaaatctggaacactgacgataccaaatgctggcaagaatgttgagcagcaggaactctcattcattcctggtgggaatgcaaaatggtacagacagtttggaagagagtttggcaaatttcctccaaaactaaacatactcttaccatatgacccagtaatctcactccttggtatttacccaaatgagttaaaaatttgtatccacacaaaaatctgcacacagatgcttatagcagctttattcataattgctaaaacttgtcaatcatgttctttaataggtgaatgaataaataaactgtggtacatccagttgatggaatatcactcagtcctaaaaagaaatgagctatcaaaccattaaaaaatggaggaaatgtacatgcatatttaagttaaagaagtgaaagaaaccaatacaaaaaggccacatattatgtgattctaactatatgacattctgggaaaggcaaactaaggagacaataaaatgatcagtggttgtcaggtaccagggggagggagggatgaagcacagagaacatttagggcagtgaatctactctgtatgatactctaatggtgggcacgcatttgtatgcatttgtccaagcccatagaatgtacaacatcaagagtgaactttaatgtaaactacgaactttgggtgataatgatgagtcaatgtaggttcatcagctataacaaatgaaccactctgggccgggcacagtggctcacgcctgtaatcccagcactttgggaggctgaggcgggtggatcaagagctcaggagatcgagaccatccaggctaacacggtgaaaccccgtctctactaaaaatccaaaaaaaattagccgggcgtggtcgcgggcacctgtagtcccagctactcgggaggctgaggcaggagaatggcgtgaacccgggaggcggagcttgcagtgaaccaagatcacgccactgcactccagcctgggcgacagagtgagactccgtctcaaaaaaaaacaaaaaacaaaaaaaaaacacacacacacacacacaaaaacaaatgaaccactctggtctttccactctgggggatgttgataatggggaaaactgtgtatggtggtgggaagtatttagacatctctgcgcattctgctcaattttgctgggagtctataacttctctaaaaaataaagtctaataaaataaaggttttttaaagagtaaaaagatgaaagtcaagacatgaaaacagagagatgaatagaataattatactagaaagtctaggttaagctgagcaaaacttgctctgagcatcctgacagtcaaggtaaatagaaaaataaatagatttctgttctgaaaggtatttaaagtggctcagtgggaaagaaaatttcttaaactaatttaagtttgtagaattaaaagaccaaaaataaaaaggctgaatttggtatggtccttgcccttacaaagctgtgtccaaatgtggtttaaaaggagggatgtgcaaatgttgcacaaggctacaaagaaggtgacaggtcagacaagatgccacagataaggtggcatttgagctgatggctgtccaccagagtggggcagttagaatggacatctgttgatttgcttgtccagaatttgggtaacagcatctcaattttcctttgtaaatccaccctccccttttcccaactctcagtctgcatgatttaagttgttcccatttcctggcactgccgtgataccataaccaagatctggccaaccagtacaactcttccctggtacagggattggtttctacacagaccaaaggtagtccaatgaccctccaactccaaactcttgataaaagtttcattcccctgggattgctaagcaaatagaaaggaagactggagcttctctaaaccatcacatggagatagcttgcttagaataaagaccacatgagatgagtggcagagagaaagaaatgcagccctgatgacaccatttgtgctcctggatccagctgttcctgaatgcaaattatgaatcccttgaatttatctgttacataaccaataaatcatgtatatgcactatttttttaattaaaccaactttagttgagtttctgtcacttgcaacccaaagaatcctaactaataagggggtgatggagtgaatacaagctcaagtcatgcctccataacctgcaggaatggcagaatgcagaccaagaatctgcaaaacacttgagtttaggatgaaagtagataaacctagagaagtagcaagaaaagcaggtcatgaagtgccctgagacagttaacatagttgaagtagatgtgtacatattttaaattctatgcttcaaaattctctgtgatcaagcaaaataagataagatgtttataacagaaaactataacttgtatcctagaattttctattcagtaagttaaataaatacattttctcacccctagtggtggtggtgatggtggtggtggtggtggtggtggtggtagtggtggtggtggtggtggtggtgatggtggtttgcttttgatttttgttctggctgctgttgtttttaggaaaattctcatccaaaagcctctaggctcctaagaaagcactgagtggggagtgtggcaaactcaatgaaactggaaatcctttgtctctgaagctatgacagataaaaaggagactggctcatgggaaggaccagtgcttctggcacctcctcttctctacaaggcagataagactcaagaatcccaggctagtcatggggggatgttgacttgggtggagacaggatgtgtctctcatttattgaaattatgcaaacctgaggcctgaccttcaagagaaactggaccctcagttaaagaaggtatcagatattaatcaattagaaggaaagagaagaaatccaggggaggctgagcagatgagagaaatcaaaccacagaccgggcaggtgcctctctgcttctgtaatcccttatcctggtcttagagcaaacagcaaagtagcctgaagctagagaacagggtctgtatgagcctcagtcccccagaaatccgcattgcagtgtgctaataccaaaatgcataaataaatggaatgaatagctgaagccagccagggtgggcaagcttttctgttcctcccccagccttctccctcccctaccctcttggtcctgagtgtcagtcctctatcccgtattcaggcaacatccttggcaaactcaataatatttacgtgtttggaataaaattaccacattttgttagcatggactgtaaagcaaacatggatgagagcagtggctttctatttgcatggtggtccaaggagccctctctccagccgacccagtttccaatgcaggcatcggagtgccaccttgtggtaaggaaaaaaaaaatggacattgctttccaagctaggatttctaagttcctgcctgtgcacatttttctgctatccggaaggagaacagaagtaagtacttgggctcacagtccctctctaaagtggaagcatgtctcaaagcagcccactgcacttgcctaacctagagtcccagcagctgatctttcttgagctcagctgcaggaaaggtgggagatcttagaaaattttttctatgcactcagcagagctgtctttggtgagaatagtcactgatttaacccagaaggccacagttattgggggattgaaggaagaatccaggcactggagacatttttggttgtgaaaattgggggaggggtgctcctggcattttgtagatagaggcctgagatgcggcaaacatccttccactcagaggccagcacccccaggacaaggaattatccagccccagatgtcaagtgttgagactgagaagcccagctcttgtcactttacatgttgttatcacctttaatgttctcaacactcgtagaaaataggtattataacttccattctacagatgaggaaactgaagcatccaggagttccataactcactcaagatcacacagctggcaaatgcagatgtgattaagacccaggttggctccaaagcctgggttttttaagcctccccactggggtacttccagcattctggtgttggagatgaggactaagctctgattttttaatcgtgtccaaattcctatctaaggagtctggggagtcatgccatacaaccataaattctcatcagatgggttttatttaaccctctatatcatgacttactttccaacctgaccctggcataacattacgagacaaggaagaaaatcaaaatattttaccccaaaacatgtttctttgccatattttgaaatggccctgcaaagctgtcttttgtaggggaaaatctgcatctgtaaaaaatctctattaacatagctagatatttttcttccaggccctcccaatcctgaagagagtaactaagagtttagcacctttcaaagatctgaatagaaaacatttgtcatctattgcctctaagggcagccactatgagacttcaaaagaaccttgtctccacaatcatttatcttcacccgaacattccctttccatcgatcccaggtcattagactcaaccaattgtcaaccaaaaaatgtttaaatttacctatagcctggaatcccccactttgagttgtctcgcctttctgaaccaaaccaatgtatttcttaaatgtatttgattgatgtctcatgcctccctaaaatgtataaaaccaagctgcagcccaaccaccttgggcagatgttctcaggactcctgagggctgtgtcaagggccatggtcactcatatttggctcagaataaatctcttcaaatattttacagagtttgactctttttgttgacagagacataaccctgaacctcagcttaacaacatcagttagtaaataccaaattacatgtatccaacatagaaaatacaggggagagagaattccaactctcattctaccccaatcagtagaggagaccttaaagtcttctgaaaaaatgcccctctgtatctcttaccacatcaatgggatctgaaggttctaggacaagggttggtaaacctaacaggggttagcctgcaggccagatctggcccgctgcttgtttttagaaataaagttttattggaacacagccatcgctcttcatttacatattgtctatggctcctttcgtgctccagtggcagtattaagtaatggcaacagagcctgcgtgccctgtagagtgtttactatttgatcccttacaggaagtgtgtgcctatttctgctctaggctaaataggtttcagacacctattgccaacatttgctcttgtttatgtcccaggatgagacggttttccccatgtctaactgagcatccctctaccccttggaacatcctcaacacaaacaaatctaggttagagatcaggaaatctggttcagcctgaattatctgtgttctgacctttctgcccacagataacactatcagtccaccagtaaatcatgggctatggaccataggaatgccctgaaccattctaacacacaatttccagacttctttctatgtgcctggtgtgtcccagatgacatcatagacaccatattattaatagatgccattaataaaaagtatttacttttttaaaaaaagtgaacgtttgtcaagcgttttgctgatgaagtataatctcatttaatcctcacaacaaacagagtgagtattattatccccattttacaaatggagaccataccttgaagattacccaggccaaaattgggaaagcggtctgcctgtgtcaaacaaaacttttgtcttcaccagtctggttggcgcataaaatataatcatgctcaacaaatatattaagtaagccaggcctaagtgttaacataaatacataaagcacaagctctgtcctcacacagctcaactacataaaagagactgattgtgagcaggtaatgatagagcaacaccattaactcctcacataccaggaagcctcagagtctaagagcagagagaaagggcatctaacccagcatggggcttccatgagtaaagggcatctcaaatcattcttgaagtatacacaggctgaggccgtgatgttaatattaggtgtcaactaatattgacattggattgaaggatgcctagagagctggtaaagtattgtttctgggtgtgcctgtgagggtgttgccagaggagattgacatctgagtcagtagactgggagaggaagacccaccctcaatgtgggtgggctccatccgattggctgccatcatggctagaacaaagcaggcggagtaaggtgggataagctggcttgctgagtcttcttggcttccatctttctcgcatgctggatgcttcctcccgttcctcttgcccttggacatcagagtccaggttctttgccggaggccctcaggccttcagccacagactgaaggctgcactgtcagtttccctgcttttgaggcttttggacttggactgagcccctactggcttctttcttccccagcttgcagatggcccatcgtgggacttcgctttgtgcttgtgtgagccaattctccctaataaactccatgtcctatatacatagatcctcttaggtctgtccctctggagaaccctaatatagagggcacagcctgagaaaggacagggtggcaacgaagtgtacatatgagcaagtctaggaccctaataagatcaaatcaccaaataaaccaccaccccgatcaggcgtctcaaactcatggcccctaggcagactccaacctacagacaaattttgtcttatctacacggtagtgaccacagtatatttttttacttgaaattgttgccaagagttctgcatttgcagttttctcatagaaatctagattttcagcctttctttaaaaatcctaagatctgcaatcattgatcccaggtttccctggaccaagcactggctaagatgaataatgactgcgcactttattttcctcatgccaaggcatgtcttgtcctttatcaccacacttgtgccacacacgttttctcttatgttcaggcatcctcattcattgacgtatgtgtgtcacctccaaaggcatttgagtattcagcccctggtctactccataaaatctaagcttgtgggtatggagtttcattcactggcctctgtttatcttttccaggtttttcccctatggctgctcacacacacacacacacacacacacacacacacacgcaactatcacaaactttctgaactcccctgagctcaccattttcttcctcacctccttgacttcacaaatgttgttccatctgcctggaatcttccttcttgccctagttcacctggaaaactcctattcatctttaaagatctagttaaaatgtggactcctctccaacatcttccctgaaccccacccatcctcaacagacatctctcctctggggtttcatagctagtaacaccttatatcttcctccatgactgcaggaagcaataagtagaagccaggagcctcgcggagaccgtcagggcagccagctgagaggggatgaggtcttcggccaggttggagagcagggagaagtgctgagattctaagacattttgaaagtagagcaaacaggatttactaattgatctttgtctttctttgctgttttaaagaagagaatggaccttcaaatattcaacaagctccaacatgcagaattctttctgtccttgctctttggaatgggggagggaggggaagcatattgaaagattcccaccctaccctctacttccaaccaacgcgctctctccagggttcaatttcttggctgttccctctgtgtccctgtaattcttccaataaaccaagaatataaagtttgttttcacatagagtgtgtgtattatatatgtgtgtatatatacacacatatgcctgtaaccccagtgcttttggaggccagggcagaaggattgcttgaggccaggagtttaagaccagtctgggcaacaagatgagacccccgtctctataaaaaaattaaaaaaattatctgggagtggtggtgtgagcctttagccccagctacttgggtggctgaggcaggagtaccactcaagcccaggaatttaaggctgcagtgagctatgattgtaccacgctactccagctgggacaacagagcaggaccttgtctcttaaaaaagaaaaaaagatatctatggagcgactacagtgtgtcaggtgctgctctatgcactggactacagcctgttggcctggctggtcttgaactcctgaccacaagtgatccgcctgcctcggcccctcagagccctgatattaaagcgctgatattacaggcgtgagccaccgtgcctggcctgcttttccattcaggtagttatgtggtcatatttgtatgcagttttagatttgttttttttcattaaaaattttgtcaagaacattgacttaaaacgattggaatactaaaaagcataatttttatttttatgtattttattttattttgtaagctctggggtacatgtgcaggatgtgcaggtttgttacataggtcaacatgtgcagttgtggtttcctgcacctgccaacccatcatctagatattaagcccagcatacataagctctttctcctaatgctctcccctgcctccaccctccctcgacaggtcctagtgtatgttgttcccctccctgtgtccatgtgttctcataaatacatgatttttaatcattatctaatattttactaggtaaatgaaccgacattgtaattaatactatcatttccttattgttggatgttctggttgtctttaatattgtacccttataaataatgcagccataaaatccttcatcacagcagtcttggtcttatctctgaatattttattaggacaaattcctgggagtgaggtgactgacacaaagcaaatgaatttttctttcataatgcctgaaggctcaaatatacggaagagaagttattgataccttcgcgtgaggatatttgatttgttcaaccagttgttaacagatgacttgctgttgaggtcatgattccataattttggaattattatccagctggtggcaattcctcggattgtaatcagaatactttggaggtaacatagagcatcttgtattatgtgttggacttaaactcttaagaaatgcccaatttacagctaaaagacatacaagtagaatcaacgtaaaaatatatagaagagacttaagagcattgtgtggaccttacttgtatctgacccaacaaacaattgctaataataataatgtattacatttataggacaattagaaattttaaaaggggctggattttgataatattaaggccttcttgttgactttttatatgtgatgttgaaagatgaatccttatttgaaaacactgaagacaaaatgaggctgggcgcagtggctcaagcctgtaatcccagcactttgggaggctgagatgggtggatcatttgaggtcaggagttcgagaccagcctggccaacatgttgaaaccccgtctctacaagaaatacaaaaaattagccaggtgtggtgatgcatgcctgtaatcccagttacttgggaggatgaggcagaagactagcttgaactcaggaggcagaggttgcagtgagctgagatcatgccactgcactccagcctgggtgacagagcaagactccatcaaaaaaaaaattaaataaataaataaataaataaaatgatatgatgtctgaagttttcttccgggtaatttgcggggtggttgatgggcagcactggccttgggttgatggtagttggggctggggtctgggtacgtagaggcttatttataccagaggtcggcaaaccatggctgaatggctagatctagccctctgcctgttttcgtaaataaagttgtatcagaatacagccatgcctatttgtttgcagattttctctggctggttttgcgctacaatagagtggaattgttgcaacagaaaccatctggcccacaaagcctgaaatatttcgtatctggccccttacagaaagaatttgccaatccttgacttatgctatcctacctacttctgtttatgttcaaaatcactcataatacaatattttaaaaagaattaacataaaaaagattatggtccctacaactactaccatagagtactgttcgtctacaaacactatcgcaaacatattaaaccacagctgaaatgtctgtggggttattcttttaataaacatttattattcttttttttttttaagacagagtttcgctcctgttgcccaggctggagtgcagtggtgcaacctggactcactgcaacctctgcctcccaggttcaagtgattctcctgcctcagcctcccaaatagctgggattccaggcatgcaccaccatgcccagctaattttgtatttttagtagagacggggtttcactctgttggccaggctggtctcaaattcctgacctcaggtgatccacctgccttgacctcccacagtgctgggattataggcgtgtgccaccacacttggccaaaatttattattctataaaggtgatagatacatgcatggtacaagattcttaaagcatgctctggaaagtaagcctctgtcttgcccctgactctcatctatgtagtttccttccctggaggttctttttttattcttccagggataatctctgcatggacaaacataatataaatgtctaatagcttttattagacatgcctgaagacaggcatgtcctgtcttcaatagatatctttaataaattcaaaaataatatattaagtggaaaaaacattacaatacaatacaaataatgcagtcatgtgtgtgtgtgtgtgtgtgtgtgtgtgtgtgtgtgtgtgtgtgtaggtaaatggaaaagagattgaaatcatacataacaaaagttgacactggctgcctccacatggtagaataaagagtgaacgagtggcttaattttctctcattgtttattctcttattgtttacctatatttcttaaatcagcaataacgaacgggcactactttcataccagagtgcctggtaagttgtttcttaggatgtttctgtaagagaatctgagtttgttactctggccaggtagacacaaaaagacttatagggaagaaccacttagcctcttccccaaagtcctaggtgggcaggtttcaggctcacaggcgcccaatatcctctgggggaaataatgggacccctgtgacctggcaggtgctgccccttctgatatccttgacctggcaagggtactagaaggacatggggaggacaggggcaaatttgtcaagaggaccagaagcattttgggaagagagaaatgaagagcaatccttcctctggtgatgatgatgataatggtggtggtgatgctagtacctccaggatgcattgggattgtgagtcttgggaaacggacaccaaggctacaaagcaaggaatcatgtcaccatgaggaccgctgaaccagtggcagagcctcaacaccaggccccagggttaagtgaagaaaggctggttagaccagcactggaaatcatcactgaacagaaggcagaggctagagtgatggagggggcccgcactgcaggcaggcaggatactcagaagccaacaaaagctgttccaagccaccaggtgagctagtttccaaatcattaattctctctttgcctgtatttgaaagtcaaagtatcccctttgatcagagcttaaagtcttaccctggggttcacgttcacgtataatcttcagagaggtcggagctctgaagagggaggatattggactcgttgttaacataagtatgaggggtagctaattacaaaaattaaaatattagggatatcttttaccccaagctggagaaacaattcattctctattttattccaatctggagaagtaacttgttctgttcatgcattttaagtaaataaacaggccgggcacagtaactcatgcctgtaattccagcactttgggaggccgaggcaggaggatcacttgaggccatgtgttcaagatgatcctaggcaacatagcaggaccccatctctacaaaaaaacacaaaaaattagccagatatggagatgcacacctgtagtcccagctacccaggaagctgaggaggaaagatcacttgagcccaggaggtcaaggctgtgtgattgtgccactggcactccagcctggatgacaaagcaagaccctgtctccaaaatagataaatataaataaataaatattagatacaagagataaatacatcaatagattagtacataaatttaaaactaaacaagcaagtaaagtctcaaagagaaacaaacaaaaaaaaaatccctgccctccatgtctctgaagcgttgcacgcaggctttgattgatgtaagtttttgattttcagaatgttatatgcttgagttcatgtcatgaaaaaaaggtctgcattcatcccgcagtgagagacgaatctctattctcctgctgatacatccatcagcatccttaatcatcctccttccgcggaggtttatcatccttctagttattctattactcactctgctattaagagggcaagaaccatttcatttttatgttgcctgatcatatcattcagctggaaaacatcgttaaggaaccgcagcgtaaaagccagtgtaaacaccaccacccaaccgtaatctctaatgccatactaatggaaggccactgtttctgaatggggccatattcaatgccttaagataacttcggataccgtttttctgcaaggattttaactgcaatcctgaagacgttaaatgaaagcaccaagcacatgtttatggcctatttaacaaagctagcacagggctatgtataaatacttatgtagaaatagagccgaactgggacactttgggagaaaatgatggaaaggggacggttttggagttctgcaagaaaagaggtaacacccattatttggactcatgggaaaaatagcattcactttggactccaactgggaaattactcttccagacaatagaaaaaatgttaattagcttaaaatgtaaggcacataaaaacagggtcaatattattagtcatcaaaggaatgcaaattaaaaccacaataagatatcaccatgcactcactagaatggctaaaataaaaaggactgaccataatcagagctggtgggggtacagagcagctgaaactcatggaaatgcacaatgagactgccatgctagaaaagagtttggcaattcccataaacattcccttactttacgatccaacaatttcactcctaaatacttccacaaaaataaatgaaaacatatgtccacaaaaagtcttgtaaaagaatgctaattgcaactttatttataacggtttaaaactagtagcaactccagtgttcaccagtacgagaatggataaataaggcacagtagattcatatcatggaataccactaagcaataaaaggttctaggcttcttcttttttttttttttttttttgagatggagtttcaccctcctgcccaggctgaaatgcagtggcacaatctttgctcactgcagtctccgcctcctgggttcaagcaattctcctgcctcagcctcccgagtagctgggactacaggcacacgccaccacgcccaactaattttctgtgttttaaatagagacggagtttcaccatgttgaccaggcaggctggtctcaaactcctgacctcaggttatccgcccaccttggcctcccaaagcgctggaattacaggcatgagacacagcacctggcctctgcgttttttgtttttgtttttgttttgagacagggtcaccttctgtcacccaggctggagtgcagtggcatgatcacagctcactgtggccttgatctcgctagcttaagtgatcctcccacctcagcctcccaagtacctgggactacaggtacatgccaccatgccagctaaccttttaatcttttgtagagaccgtgtctcactatgttgcccaagctggcctcgaactcccagactcaagtgatcctcccacctcagcctcccaaagttctgggatttcgatgtaagccaccgtgaccggccttcttcttcttttttttttttttttttgaggcggagtctcgctctgtcacccaggctggagtgcagtggcgccatcttggctcactgcaagctccgactcccgagttcacgccattctcctgcctcagcctcccgagtaggtgggactacaggtgcccaccaccacgccgagctaattttctgtgtttttagtagagacggggtttcaccgtgttagccaggatggtctcaatctcctgacctcgtgatccgcccgtctccacctcccaaagtgctgggattacaggcgtgagccaccctgcccagccgactggccttctaatccatgcaacaggataaatctgacagacataagactgagcaaaagaagttcaaggacatgaaaaactaatctataaggatagaaagcagagcaacagttgcctttggagggtagggcggctcaaagtgggtatgagagatcttctagggtgatgaaaatgtgctgtatcttataaggatttgagtgatatagcttaaaagatttgttaaaatttattaaactgtacatttaaattagtgcattttactctttctaattatgcatcaataaaaatttgcaaaggtgcaagccccaagtttgctaagaggctaagagctgcagagataagcaaaaggaaaaactgaaaactttcctgggcaaacagggggcattttgcagagtgaattggagggaagccacttccctggggatagagctgataaagttctgcttgctagaaatctgaattctgacaaattgacaaagcaaagactgagaatgaaggtccgaaaacaaaacaaacaagtgcaaagcactatcccaacacagatcaggagatctaaggatggtggggaaagtgcaaataagatcaacagaatgtgttgaacacgaagcaagctctaagccaacaagagtacaccctgctctcttagccacgtcagactgattaccgccacgtcttggtaatccttctgtacttcctctcatgattactgtaaatatttgacctgaactaattctatagcaaactctgttgagttttcattccatcaggtggattcaggcattcccggctaatcttagtgtagtcttccttaagtcctgagttaaacagaaataaaaactggtaattattggggatttaaccaggtgctggataccaggctaagtactcaacatgctttgattcgttgaatcttgccccacccatgaagtaggcactgacaacagaactcctgttttacagatgaagaagctgaggcttgatggaataaaaatgtgcctatagttacagaggtagaaagtgagaggtgcgattcaaactcaggccatgggaccccagaggtgatgaactaaccatagtgctctattgccccttccaggtatttttcaaagtgaatggaagctacccaaatattgtagaatcaaggagactctagaactctcatactacatgtagacatcaaagacatagagaaagaagccgtggccagccaggaccaagaaagcctactacccaggggctcatttattcattcatttgttcaacaaacatttaagagccaactgtatgttaggcgttgcttcccactgacaaaactagaactgagagccaaaagctattctactacattttggtggcaacaccttactccaaaatgtacgcatagacaacaaagcagaaaaacacaacctgaaagtcaatatcccttttagaagtctggaaacacaaatgcagtgtcagtgtagcataagctaaaaatgtgtagggtggcacccgcagacagtctggtatagggctgaacatctcatcccttctaaagaggccacctctgctccctgaacagattcatcaggctctatgattacctcgtcatgcagaaattgttaatcaatgttgcctaagcaacacatgtagaataataagtcaagacagactccttaacgacaaagctgtgggaaattgctggcatgttggcattgaccgattgctgagacattgctctcctgggctgaagggggatgcaggagggacaacaggatgcaaaaactgatactacaggataagcggaagtgatgggactgcacaaaaggcatgtagaatagatgctgtaggatggcagtgtcacgtaccgaagcagtgagggtaggattatgttctggctatgccaccactagtggcgagggtctctcatttgccctctctgaactgtttttttacctgtaaaatggagtgaaataattcctgcaatgccaaactcacgaagttattgataaatgtatgtgaaattgtcatataaactgtgaaagcacaaaaagcaaggtattgggattgggggtgtttttgtctgcccacccaaaattctgacccaattaagaactaggagattggaagtatcagaatgccaacttcattaatggtagctggacctggtccccttgcttgaaccaagggtttctgcttcttcttgcttttgctttaagcagggcagctagaaaacatagcaggggtaacagaaggaaagaaaaggggaaagcatgctccacctgcaggcagagagggcaaagaagttgaccatacacaaggagtcatcaagtcatctttctcagcacccagataagctacttctacatccatgaggaagagcatttgggccagaggaaggccattacctcccccattttaggccctccaaagggccaaaaatgttgataaaaattccaatttttaaatcaagagtcaatagattgactgtcccaatcactcttcccaacttttgccatctcctactatagagcctagagaagtccatgacttgatttcccagactcccttgcagctagagatggtgatgtgacacaacgcaggcataagttaaaaaatttacaaagagctggatttgagacatgagatggctgggctgcaatcacttgtgatcacaaaggaaagggcatgagaattgcaaagatatcaagtcggaccttactgagtcactgaactcacaccaataaccacttcccagatgtacaaccttgcaaactggcaaaccaaaagtgcatgattgattctcaccctttctttcaccttcctattcatgtttatagtagttcaaaaaataaatgtaaattttaaggggttttcctaccattatgggttttcctacaatttttgtaaaaaacaatcagacttaatttgaactgtaggtagggtttttttttctatccaactctcaccaaaagctttgtggaataaaggaatacttatgtaggattctttgagagatattcagaccatcatttctccgcaatgaggggctcaaactagtcttagaaacttccccatgaggacaaaaagattccatcattaaagaaatttgaggattgttgcctgtttcagtcatctcttgctgtataacaaataacgctacaacctcttcctgtacctgaaacctgaccttcctctgggatttttacttaagtgagccaaaaacccagcttttattttagcttaagttggttagacatgggtttctacccctcaccattgtttacaattcttcatgcccttcctgtaatagaattatacattcacacccatcgacaggacagtatctcacacaagagtgggtagggtatattgcggaatcctactgatactggcttggctatatgacctgctttggccagtgaaatttgagtgtaaatgacaacgtgccaattcccagcagaggcttccagaggcaataggtatttttgctcattatcttgcacttctgccactcaccacgagaaaaccaggacccagctagtcactgtttcaaggacacgagacacaaagagcagaactcaaacctattttttatcaattaaaattacagctattcttatgttccagaccttctcttggtggactcgaaagctacacaaacaattcaaaaacaacatctctgtatgccccaggaaatatcagcatctggtgtctgattctgctaaatcaagcctgatcatttcgttgctcatcatcgcaaataatgtgcttacagcttggaacatttgcgcattaatgaacttagaaaatagctctccccctccccccctccccctccccctcccctttctccttctccggctttccacggtctccctctgttgccgaggctggactgtactgccttgatctcggctcactgcaacctccctgcctgattctcctgcctcagcctgccgagtgcctgggattgcaggcgtgcgccgccacgcctgactggtttttgtatttttggtggagacggggtttcaccatgttggccgggctggtctccagctcctgacctccagtgatctgcctgcctcggcctcccgaggtgccgggattgcagacggagtctcgctcactcagtgctccatgttgcccaggctggagtgcagtggcatgatctcggctcgctacaacctccacctcccagccgcctgccttagcctcccaaagtgctgagattgcagcctctgcccagccgccaccccgtctaggaagtgaggagcacctctgcccggccgccccgtctgggaggtgaggagcatctctgcctggctgtcccgtctgggaagtgaggagtgcctctgcccgctgccccgactgggaagagaggagcgcctttgcccgacctcgaccccatctgggaactgaggagcgcctccacccagcagccaccccgtctgggaggtgtacccaacagctcattgagaaccggccatgatgacgatggcagttttgtctaatagaaaagagggaaatgtggggaaaagaaagagatcagattgttactgtgtctgtgtagaaagaagtagacataggagactccattttgttctgtactaagaaaaatccttctgccttgggatgctgttaatctgtaaccttacccccaaccccgtgctctctgaaacatgtgcaatgtcaactcagggttaaatggattaagggtggtgcaagatgtgctttgttaaacagatgcttgaaggcagcatgctcgttaagagtcatcaccactccctaatctcaagtacccagggacacaaactctgcagaaggccgcagggtcctctgcctaggaaaaccagagacctttgttcatgtgtttatctgctgaccttctctccactattgtcctatgaccctgccaaatccccctctccgagaaacacccaagaatgatcaataaatactaaaaaggaaaaaaaaaagaaaatatgtattaaccacccactatgtaccaggcaatattctaggcacaggagatataggagagagtaaggcctgagcagcccttaccctcatagagctaacattccagtgtgtgtagaaaggaggtaggaaagcaacaacaaacatatgaacaaatcgatataaaatatgtcagctagtgataaagactatacagaaaaaatgaacagcagaagagaatagagagtggttgataagccagggaatgataacttaaggtggtcatggaagtcctcaattctgatgagcagccatttgggcaaagatttagaagaagccaaggagacagccatgtgactatgaagagaagagcattccaggcagaaggagcagccagtgaaaaggcttaaggaaaaccaaggtcttaggattggagtgaagagagatggaggaaaataacaggaaggtggagacaggaggtggaccttgtaggcctggaaagccatggtaagaacttaaattgaaaatactgaccacttggatatatgcctttaaaagatagaagatgcgtcagacaccacagctcatgcctgcaatcttagcactttgggaggccaagaaggtaggagggtatgttgcccaagaccagcctgggcaacatagcgagacccctacaaaaataaaaaattagccaggtatggtggtgcatacttgtagtcccaactactcatgaggctgagatgggaggatcctctgagcccaggaggttgaggctgcagtgagccatgatcacaccactgcactccaacttgggctacagagggagatcccgtctagtcccaactactcaggaggctgagatgggaggatcccctgaacccaggaggttgaggctgcactgagccatgatcacaccactgaactccagcttgggctacagaaggagaccccgtctctaaaaataaaaacaaaaaataaaagccaggagagggaaagctatgtttcttacataattttgcttcctgtgatttatagatgtggaagtgccaggaactgtaccagatgccctctgtatgcttctctttagtttaaacacatgtaatgtttagtgagtgtcaatctgcatttctagaaatcaagatccactctacattccaaatcaacagtaaggcaagagaagaagaggtgtgtatttaaacttctctaacctgtcctcagttcaagatgaaattaatgcatggtttcacatgtggaacgtggagatcatataaacagtccattaaattgaatcacacacataagaaccagttttctattctacctagcagattaaaaatccaacttttaatttcaaatggcctatgcaatcatctcaattatcctattcaactgcagaggtaatttaaactgtggattgctgccccatcaaactgtctatttataatatgtaattccggcttagattccaaggataaatattatcctcccaaaaaattcaagttcaaggtaattcacaaataatagtttgaaaaggaaataaactgtgtgcagacaatatgattgaacaaccaggaaaaccaagataattagcttaggaaatactagaatacgagttctgtaagatggctaaatataagataaatacacagaaatcaatagctacttcataaaccaacaaaataaaaagatcccactcacaaaaatatatatatgtatgagtgtgtagatgtgtgtgtccaggagtgatttttacagtctggtttttatatgaagatactacaatactactgtttaacacacttgaaaaaaatgacatataaatatgcacaaaaaaaatattagctttgcgtataaggcttatgatgtgcctgacactggattaagtattttgcaggtatttcccccaaaaattttccaaaaccctgtaacagaaattttttttttttttttttttttttttgagacagagtctcgctctgtcgcccaggctggagtgcagtggtgcaatctcagctcactgcaagctctgccttccaagttcacgccattctcctgcctcagcctcctgagtagctgggactacaggcgcccaccaccatgatcggctgttttttttcttgtatttttagtagagatttaataatctatgtggcaagctctatagatgttggtcagcttttctcgccagccatcccagtgcttggatccacatgcaaactgccctgggtggcagggatggaggccatgcatggcttcaacaacatggactttccccgaccaaggctaaccaggtgccaaatctgccagcagcagagaccaacactgaagctcaccattgcatcattccctggggagaccagccaaccaccagcggcagaatgaccccttccatcacaggaaacctgaggaatcgttggaccccttccatcacagcaggggcagagattcatcctcactgaaacagacacatgttctgtatgtaggttcatcttctatctccataatgcttttgctagcaccaccatttatgaattcaaggaatgctttattcagtgtcacaacattgcccctacattgctcctgaacaagaaatgcctctcacaaaacataaatgcatcatttggctcagactcatggaattcactggctctgccacacactcaatcatctaggacgagctggcctaacagaatggaggaatagtctactgaaggcttcattacaaagcctttgaggagacagcacccagaaaggatggagttctagctacaggatgcaatctgtgctttgattcagcagccaatttctcatgctgcttatcctacagccagattacattggagggggcaagcaagatggccaatggaagcctgcaccattcgcccttcccatacccccacgagaacaccaaattttaaaaactaaccacaaacaaaaagcaccatcacaagaatcaaaaatcaggtgagtcatcacagtacctggttttaacttcggattatgtggggccaggaatcaaagggtggaagtgggtttggctcctctcactatgacatccaatgacccacttgggaggatttttttttgcttcccatcctggcaactttaagctctgctgctttggagatcttagtcctaaagggggaaatgcttgcaccaggggacacaagaatgattccattgaattagaagatgaaattaccacccaaacatttttgacttccatggaggccaaagcagttccaccttggatgctaattaaccatgttaacttctgattaattgcagttcccaaaaggcctctaagatttccagtttatctcttgttccttatgtaacagcatgcggttactataaattctagccttaggtcaaaaaaccttgatgctctcatacctcagttgtcctgcctgtcccttctgaaccaccctttccctatggtacagaagccctgcgtctggggcagtaacggcgcagggatccaccatcttgtgtcgccactgcccaagacacagacatggcttcttttcataagtccctattaaatgtttctttctaagaaactgaattgttaagccttttccttcagcctttcagctccctcagactttgggggcgggtttacatagacctgcccatcacggaccaaattcttatgctactgaattaatgagcatgcacctctactggctggggagtagccaggatgcacctctactggctagggagattgaaaccagtcattaggaggaaatagggttgctatgacaccataagagcaagaaggcttgtgtctggaccagaggtctctggagtccctctcagtacttccatggaaagctacaatcaccacacacacacacaaaaagacaggatcattgagaagcccaatccttcaggaatgaaagcttggatttcactgctgggtaatgaacccttccagctgaggtcttggctgagaacaaacatagcacaggccaggtgtagaagaaactcataatatcaactgcatacttgtgaccagttatagaagcaaggattgtagcaactgtgaataacttcttttctcaaggagtgtgtgtgtgtgtgtgtgtgtgcgtgtgtactaagtgtgctaattttttcccccaatatcttacacaagtcttggtagtagcagttaaatttacagtttagtcaccaagcgttagaatattctgctgagacaatgactgatttgggaaggtaatcagcttacgatgactattgagactttcagtcttcttactgtgggcagagggtgagagtgtcttcacttgaatgaaagatagctgtatattgttaggtggaaggctagagttgtgatcttggctgaaattcagatatgcatagaagagtgtggatgaagactgagtagctaatgagtggattgtgccagtttttgaactatttcagcttcaaacccacacatccatgctccacttggtgatgcacccgtatttgcccttcacagctgctcccatgagactctacactgagaaaatcaggaggctggaaaaggaagttttttcttatggttacttcctattctctcatcactgtcacccacagcaatgctcttttgcctcagcagtgatagtttattccagaaacagcagttgatcacaatttgcagtgttttcaatacccatgggaccagcctaattgaaccctctcaacgtcaccaaaaccagcatcaaattattccttccttggaggtctgaagtttctactctgtggggcctcttctccaaacttttaagttttaataattccaatcttttctctttgttctttctgccctagagatagcttcctgcagtatattccttcatgatatcttactgttttcttatttcttttcagggcttcaatatgtcactgtcacttcctatatccaataaggagtcagtaaactttttctgtaaaggggcagatagtaaatatttaggacctgcaggtcacacagtctctctgttgcaactactctgctctgccattttagcacagaatcaaccataaacagtgcttaaatgtagggttgtagctacgttcccataaaacttcatttacaaaaaaataggccatggactagatttggcctacctctattaaattattcatgttaaaataaccggtatggtattctgtctcctgactgaatcctgaccgacacagtggacatgagtctgaaagcctggccaattagattgccacatcctaacgatggattctgagccgggtcctgatcccaaattagaacaatcaaggccaatagagacttcaatgagggatagttgttgctggtgcctgagaaaaggtgttcttacccactatactcaaagctaaacagataagttttcatggagctgctaacagtcattctgccaccacgagggaatagtctatctgaaaatagaatcaatatatataaaagttcagtgaagagcacaagactttgttctaatgagatcactgaacccctagatcaagccatgcctgaagcccattgtttataagagccaataaattacaattttaagcattttgacttcaatttctattacttggaattgaaggagttctaactaatatagaagcacacaaatagatatgaaaacacaggggacaaaatctcttagattactatcatttatgcttttaacaaatatacatgaagtgcctatgtttgccagatactctgcagagataaaaggatcagccctgccctcagcaaataatggatcattttagaaaaatgccgctcaagccttccaacatgttgcatttttacaacaagaaaattaatcaagtccctgataactctgtgttcctggcacaccagctctagactgcctgcctctggacttctttgtgtttgtttaggccactttgtaaaccgcttaattcgcttaattaaaatatatgtatgtattttttaatcaaagcttgaacttttagatactctatccctaaagactacaactctcaatccataaactagtgtttcagaaaccaaagctttcttattttctataactctgtttaatttctatgtcaagtcccattcctacggtctgaaggattcaggtgcttctctgccccctcgcatggctgtgataaggttctattggttttacattgtcccattgcatcaaggaggatgaagggcacatggtgtctggtccatgataactgagccactgagcacacatgaacctcatcctgcttctgtcccctatcctctccagacctttgacaggcactgctagtgtctccaagtattcatctccccttcctccttagtaacacaactccattacaaaatggctaaacttctcagtctctgtttcagctagataaggccatatgactaagttctgcctagtgacattcaaataaatatgttacaggtgacttctgaggtagatctttcaaaaggagttgcttgggctgggaaaagctccctttcaaccttcgtgctgaaaagaatgcagatgtgatggctggtgcactggtagctgtatgggactatgaggtgaccttgatcttcgaagccataaagtgaggatggagatacaaagagccagaagtccctgataactttgtgttcctggcacaccagctctagactgcctgcctctggacttctttgtgtttgtttaggccacttcgtaaactgcttaagccactattttatgaaacagtagtttgttacttgcagccaaatgcaatttctgttccaaaatttgctagctccccctgctggtttggtgttagcccagaagcctaggcagttttgcaaggccccctattctaagtctagagaaaagacctctgtgctcaaaccctagtctcatcaatgggtttaggattttgaagagggagggagggaatgaatatgagttggggactgctgcaaactaatagcaaactattcctcggcttcctctgaaaacattaatacttttttctcttttaaaaaaaacccagcaacaatttccgcagaataatactgcaaggagttgtaagtttccatctaataaacactgctaatgagaaattcataatacatgaaagtaacccagaaggccatgaaatcagacacattcggaggaataccataaaccttgttttgaagaaaaacagttgtcaagttgatccttgaagtaaagaaaataataaagcaggggaacagggtgtaagaacattaaaatggattatcttccccaaaatgggataattaaatacgctaacacacagagaatgctgtctctgccctgaggcctgtgtgcatgatgacttgttctttgttttagaaaacctgtgattgtttgggagtgttttaaatgattaagaagcagagatgtgtccgatagcaaatgaagcaacaacagcttcatattttattgtgaactggacatgacttagaggtcagactgagcttctaatcaaaacatgaaatagggagagaacttgcaaatcatattaattattaatactggagtgcctaaggttatgaattcttcaagcatttcagaaaatctgcaggaatttttcagataacactgggacgctgtatatttttattttattctccctcctgtccttttaaagaaatatttaatgtagtcccagggtcaagatcttctaaaggaagtaaaatgaatttgagttgttactttataaactgctgcaggaaacaacaaataatataagcaatttgtttttaagtaactgacaatggaatggtaatttcctacccgtggctttactcgatgctgggtcactgaacactgctacactggcatcatggttaactttgactattcaaggtcaataaatgagcacacttctttagtgagaccctattttctattccccttcatggcataattctcaaatcaatgattaaaaaactccagattttgcttttatatatatcagctttgtggtagcatttttaaaagaaaaaaaaagcagagaaggaagaaaaaagtttgaatcagtgctataggaattttctcaagaagaaagaaaaaaaaattctctttccaaggggatgcatgaggttctcttcgcttcgtctgtctccttttttaataactgcatcagcttgatgtctaggataggaaatcgttaacatgtttcagatgagggcattaagaccaaaatactcacatgaagtcagatgggatggaatggggtgaaaatcagactctgccaggctgcaaatgccatgccctttccaggctcagggtaagaaatgtccttttactacactcctttgtgcctggttcagtaatgctcaaaacatgggagagagggaggaataaaaggaaagtcatttcagaggttaatttcatttttacacttcagaaagtgaaatgaggagatttgacaagtacctaattaatttgatctgggtaaacagctcaaatggatctttttcatctaaaaataactccactatgggacttggcttaatacaatcgttctcaaaatgtggtccccagaccagagttagcagcagcaccagcacctaggagaacttgttagaaatgcaaattccacactgggcagggtggctcacgcctgtaatcccaacacattgggaggccaaggtgggtggatcacttgaggtcaggagtttgagactagtctggccaaaattgttgtaaaaatacaacaattttgtatttttagtagagactgtgaaaccccacctctactaaaaatacaaaaattagctgggcatggtggcaggtgctgtagtcccagccactccggaggctgacgcatgagaattgcttgatctgggaggcagaagttgcagtgagccgatatcatgccactgcactccagcctgggcaacaaaatgagactccgtctcaaaaaaaaaaaaaaaaaaaaaaaaaaaaaaaaaaaaaaaaagagaataaagcagatcacaatgcttggatacatacaagttctcccatcacatttttattcccagagtcagtttgctgtgcatccctactcaaggcgctgctatggcctgggttcacccattgatgtgcaccattttgttaaaataaatcatcttattttatgcattaaatgcagcatgtgtgttattaccctcacctaagtttgcgtggcctctcaaacgaccaccgaatcaggtggcactgatcctacagctgctaccaagatcctggctgtgggccaggagtgctggctcacgcctctaaccccagcactttgggaggccaagtcgggcggatcacttgaggctaggagttcgagaccagcctgggcaacatcgtgaaaccctgtttctacttaaaaaatataaaaattagccaggcgtggtgacgtgagcgcctgtaatcccagctactgtaggctgaggcaggtgaatcacttgaacccaggaggtggaggttgcagggagccaaaatcacaccactgcgctacagtctggataacaaagcgagacgctgtctcaaaaaaaaaaaaaaagataaaagatcccggctgtggcagcgagtgttgtaccctattagggtaatgacagcttgcagctatcttcagagctactataaatgcctcttattgatattactagcttaatgctgaagcttaattccctcttaataaaaacactgcagtttttcacattaattacaacagtgagtaatggttactatttgcctataaacattccacacttttaaataacacaagatgtctccacaacagttacgaattacatttatcagctagtgacaaatcccaaaaagataacagtggcttcaacaaattagaggtttatttttctcacatatgaaagaagtccagaagtagacaagccaaggctagaggtagatgtatatcacaaaaattaagtttctgcagtctttctactctgctattctttctctttttttttctttttctttttttttttttttttttgagacagagtctcgttctgtcacccaggctggagtgcagtggcgtgatctcggttcgctgcaagctccgcctcctgggttcacaccattctcccgcctcagcctcccgagtagctgggactacaggcaccccccaccacgcctggctaattttttgtatttttagtagagatggggtttcaccccgttagccaggatggtctcgatctcctgacctcgtgatccgcccgcctcagcctcccaaagtgctgggattacaggtgtaagccaccactcccagcctctttttttttttttttttttttttttgagatagagtctcactccgtggtcctagctggagtgcagtagcatgatctcagctaacttcaacctccatctcctggggtcaagtgattcccctacctcagcctcccaagtagctgggattcaagtgattctcctgcctcagcctcccgagtagctgggactacaggtgcatgccaccacatgcagctaattttttgtattttttttagtagagacgaggtttcaccgtgttagccaggattgtcttgatctcctgacctcgtgatctgcccacctcggcctcccaaagtgctgggattacaggcgtgagtcactgtgcccggcttaattttcatatttttagtagagacagggtttcatcatgttggccaggctggtctcgaactcctgacctcaggtgatccgcccacctctgcctcccaaagtgccaggattacaggggtgagccaccatgccctgccctactctgctattcttaaaatatggcttccatcttcaatgttgtctcatggtcacaaaatagatgctggagctccaaatatcacatccatataccaggaggaaaaaaagagaatgaatagaagagaaaaagggtgtgcctcccagctgatttagttactcattgttttttgatgctattaatgttatttctatttaccatctaaaattatctcatgtatcatagaagatacatgctgcatactttttccataagtaagtgggtgcatgatgatcactcttgagtctgctcggctctgaaacatttatcttccccttattgcactgtcattcattctccccaaggccacaaccacaatgtgtgccggtactgtattgtgacattctgtactgaagggctgggtcagctgcagaaggaatactcaatacaagaaagaaaagtttaaagtcgtcactgctaagggtttcctctgagttgcaaaagggagtaatctaatgacacggaccagccaggtgcagtggctgacgcctgtaatcccagcactttgggaggccgaggtgggcagttcacttgaggtcaggagttcgagaccaacctggccagcatggcgaaaccccatgtctactaaaaatacaaaaattagccgggtgtggtggcgcacacctgtaatcccagctactaagaagcctgaggcaggagaatcactagaacccaggaggcaaaggttgcagtgagccaagatcgtgccactgcattccagcctgggtgacagagtgagactccatctcaaaaatagaaaagaaaagaaagacatggacccatcacaagtagtaaaatctttcctgtgccatctccctccccttaatctgcttgttcaatctcagctctgcagccctccccaaaaactcattctccaaatctcttacaaatttttacgacctccctgagaaaagggcaatgagattcctcatcttcttaaagggaaagacctcccctccctggatacacctccctctccccaacttgcaaagccctaaggctgagtcagtttgcaactactgaagagcttgctagtcacctactaattttcactttctctcccctctactaaaagaacctcatttcacggagtagtgttaccagctaaaggagtatttcctggcctctttaatcaatggggttaatcaatgttctacacgcaaaagttgttggctggagtttccagggagtttattaaaaagtctgagccaactaggagatatgccttttttctttcccctttgcctcctacttccggtctggaaaaaccaatgtgattgcaggagctccagcagccatactgagctatgaggcactttgaatataaaagcctaccttttagtggagaaaaaaaaattataaggagcctaagtctttgatgatcatgaagccaccctaccagctgttacccatctgtacaaggaaaatgaacatctatcttatgtaagccactcttattttagttttctttaatatgcagctgaatcttattataattggtacagtaatgcctagc

SEQ ID NO: 481 - DNA, 20001 bp, Homo sapiens
ttctcgtatcacaagattttattgagcagctactatgtgccaggcagtgtgctaggctttggagacttgtacaaattatcctggggtatctcagcagggaagtccttatttgtttattaatttttcctgacggtcaggtccagttagtctcactctaaacctggggcttggaatagagggacctgagacaccacattagctgcatgacattgggtgactagattacattctttgtatccattttcatattgataaagttaaatcggctcagagtgagggttataactctagcatatatagaggccacagcatatagtgttatatgctgtacaaaagacacaacacacagtaaatgattcaataagcaatggccatctttattatttacgttgttatcatattctgctgaaaggcttatgtatcaagtacaagaaaatgtataacccagtcatttgttttttatccaaggcagctgatgaagaagacacttattagcccaaagagtgaacagggtgagaggaggaggttattggctgcttctctgcggttaatttagccatcatttcagaatggagctggtatgctttgagtgtgaaagaaacctgctgcttgttgatgattagtctggttttaatgagttatcaggtgtcaataacagcagaagtgcactaacttttcacagccatcagaggatgttcaggatgttcactgggttctcacttttcagggttttctgtgggtgttagaggttgggctgaggagggcctgataggacatatctatctctgcaagtcttaggcaaagaagctttcgtgatgatgtattaggctgttcttgcattgctgtaatgaaatagctgagactgggtaatttataagagaagaggtttatttggcttacggttctgcaggctgtactggaagcatagctccagcatcagcttctagggaggcctcaagcttgtaatcatggtggaaggcaagggggaggaggcatatcagtaggtggggaggtgccacatacttgtaaatgatcatgtgtcgtgtaaactcactcactatcacaagaacagcaccaaagggatagtgctaaaccattcatgagagatccgcccccatgatcccaatacctcccaggaggccccacctccaacagtggggattaagtgagagttgggtggggctccttgctcctcttcccagttaatccttaatctccaccccaactccaggcaaccactgaacttaacctccccttccccttcctctccttcttccccttccccttcccctccctgaggtgtctgtcagttacccagactagagtgcagtggcatggtctttgctcactgcagcctctgcctcctgggctcgagcaattctcccacctcagcctcctgagcagctgggactacaggcacataccaccatgcctggctaatttgttgtatttttcaaagagatggggtttctccatgttgtccaggctggtctcgaactcctggggtcaagcaatccacccggctcaacctcccaaagttctgggattacaggcatgagtcaccaggcctggcccactgaactactttctatcccaatacattagatttttctttctaggagtttcatatgaatgaaatcatacagtatgtgctcctggcttcttttgcttagaataatgctttggttattcatctgtgctatttattgtgtgtatcagtcatgtttttctattttctcaccttgagaagtattctgttttatagtacaaaacaatgagtatgtccattcaccttgaggaagattttatttgaagaaatctttgtcatcaaaaagcttgaaaaccagggctctaccttgatttcatagtcttgagaatgatggagaactcaatttataccatgattttcattgagaaagcaggttgcatgttaagagattaggtgataggatgactgaaaggtatttgtgatcttatgaaaggtacaatgtggcaggcagcctctatgagggaccccagtgatccctgtctcctggtattcatgcctttgtgtaataccctccccttagcatgggctggacttactgactcacttgtagtgaatgcaatatggctgtcctgatgggctgtcacttctgaaattagcttatgaaaaaaccgattacaggtatatctcattttattgcacttagctttattgtgctttgcagttattacattttttacaaataaaaggtttgtgtccctcagtcaaacaaaaatgcaatgggtttctttctagtcccccacctcaattttagaaattaaaaaattttccaaacacagtgagtagtagtctatatctgaagggtgaatgaagcaatgagtgaccaagttgcccacttaaggaggcacttcacaacaataaacaaagagcctgctctttggtctcagacctgggtttgagttctaactctgctactccttgactgtgagatcctggccatgtgacttaccttctctgagcttctattttctcatctgtgaaatggggacaataattcttacatcagtgcattaagtgagagaatctagacagcacagtacctaacacaacacaatgactcaatttattattgttgttgttgcttcattcttatttgtaaacactcaactgtcttcacaaacttcaggagctcttcaatgagacactgtgtccattaacagtctcatccaatgggtaatcttgaagatagatgattctatggtaggttctgaaacatctcctcttttactctatcatggtgtcaaagaccaggatggtacagaggtccaggagtctggcctatgcagtcagagaaactgatttgaactctacctcttccacttattaaccaaggggctttgggaaaattgtgagcatcaccaggctcatggtgaagatggggttaataatagctccaaccttatggccttaattgagataattaatgcatataaaaatgaaaccatgtcttttgcagcaacatggatagaactgaaggccattatcctatgtgaaataactcagaaacaggaagtcaaatactgcatgtggtcatttataagtgggagctaaacaatgggtacacacagacatacagagtaaaataacagacactggagtctacaaaaggtgggaaggtaggaggggagtgagggttgaaaaattatctcttgggtacaatgttcgctgtttgggtgatggatacagtagaaacctagatctcatcataatgaaatgtatgcggttaagaaatctgcacctatatcccctaaatatatacaacttttaaaaaattaaaaaaatgattaatgtgggccagcacacagtgatcactcaacaaatgcaaactcttattcttgtaggagttgagggaagatgccaagaccaccccttctccaacttttaatgtcctggtattttgtcttaaacatttggaagcatctgcaggcagggattttgtcctcctgtctcccttccgatggcactggcctgtttggatcagtggaaggctctcctgcccctcctcctttcttcccagaggttttcttttgcactttggacttctattcatggatccttctgccagggacgtggaccaagaattcttcctcttttgcagatttcttcccctaattgtcctgttttgtgctgtcacccctgtgctctccctcctccccagttatcagcagctggcaggaaatgtttatagaagaagcctttctttctgtttttaatagcctcctaggctgcaacctcccaaatgagaaccttgttaaccagaaggactctaggctactgatttatatttcagtcataccgagaggaggaaaaattacaaagggagaaagaaaaatgccaatgtacacatggactagttccgacatcttctctgatgaagaatgtatatatctattcaggctctggatgctaagggattccttccagatctcagtatttgacctcttacttttgggtcacgtggattcttcgtgcctcttgtgggcttgctgaaagcaaaagtaacaatttcatactcttgccattgaaacaaggggtctattacttttaaatcataagggcacttgtttcaacagaaatgttagtatcttggtgaagatggggtctaagttcttggtggcttctgaggatggcgaagggctcaccttctgtcatcccgaaccatcactgatgggacagtgtctctccatgtgtagctatgcaaaggccacagaacaaatgggtaaaaatatttggtggtcagaattctagctcaatagtcaaggaaggcttcctggaggagaaagttcattttgaactgggctttaaaagttggtgtcacagaaaatgcaagctgtccctcagaattaagactagagttctgtgaaatagtgattgcaaaaatggccacaattattctcctctctataggcacacccctttgcaatgtgacattgtagcttctcctattagagtctatttccccacccttgaatccaggccagtcttgtgacttgctttggctaatacagtgtgatggaggtgacagtgtgccagttctgagcctaaatctcaagataacttgcacacttccactcaatctcttggaatcctgcccaaccaccatgtgaaccagccccagctagcctttgggaggatgggatgccacatggagaggagacagcccaggtaaggaccagtcagcacccgaccaaccaggcagctaactgctggtacctgagatgggcccaatcaagagcactacatttgcccagatagacccagcgcacattgccagcctgcagaatcatgtgctaaatgaatgcttattgtttaaagctgccgaatagtggtttgtgatttagcaaaactaactagtacagtttcctatgcagctgagtgtatccatgtgactaagtttctacatacaaaaacggtgtgtgtaatttctggggaatttccttccagggagaaggtatgctcttcttccactttttttcctttatattgcctggaatgggtatgtaatagctggagctccagcagccatcttggatcatgaagtaagtttaggaatggaagacactcctggcagagcaataagctgggagggtcttgttcctgtaaaaccactgattacctttccagttctattctggtacttctaaatttactaaacagaagttaataaacttttgtttaggtcattgttttgagttttgcagttactcatagctgaacctattgcaaaagaatacagatggtcaggatttaaacaagcagggatggcagagaagggcatccatgacatagggaatataacactaatgttgcagagaaagaaaaagtgtgggtaatgggtgggcaatggtgaataactacatatgcctaaggggagcagtgggtgatcaaattgggaaccatttgggaccagcttttgaaaggcagactgagaagtttggagagggtggtagacaaaaatgtgtgagtacttatgcaaatcagagtaagaaagtcatatattcatttttcccccactcattgattcatttcttctaggaagtttacactgtgtatgagggaaacatagcaaaatagaaagatgattattgattgttatgcatggtctgaactaaataaactctgtgatgtggcagagattaactgttgggcggagatggctactttaggcacagtagtcagaattttttgttttctagaaattctgttaggccctgtgcagaagtctaggaacacagggatgaataacacacacttcctgtcattgaagagatcacaatctggtgtggaatgaggttaatcaggaatattttcctagtggaggtagaatagagccaaaggaaataatgtagttttcccatatgtatctgtcagatattgctacaacaaggttgcataacaagcatccccccaaatcttgcttacaacaaaaaaatattttttccttcacaggtctgtgcataggctgtggttctgctgggctctgttggctcggcttgactccacgctgtgggttggtctgggtctgctctatatatctttttattctgggaccaatggatcccaaagatttgtacttctcagggtggatggcagaagtgcaaggggccaaaccagaccacagaggcacatataatgctttgacttgcatcacatgtactaacacaattggcattagcaagactgatatcagtgggtcaggatgtatgttccactcacagtgggaagattgcaaaggtgcaaagatgtataattctgttaagagagggaatgaagagtcgggaacaatatccagcttaccataccacccagcttacttaccattccttaccatacaaggaaataatgtatttctccatttttcaagaacactcatgtctgaatagttttattattttcttcaacaaatcttttatcttgttagatttattgcaacgagccatatttctcttttttacaaaatttatttagaaagttacatatgcacatatggtaaaaagttcaaaaagtggtaccaaaagatataacagtgaaaataaggctggttcttgtttttatccactgaggcaaatactgagtttattttcaaaggtattctgtgtgggcacaatcacgcttgcatatgttaaaaaatacaaaatggtatcatacttgttcctctgcactttcttttttttctatttaacaacatatcttagaggtagtcctatttcaatttagctagacccatttcattctgtttaatggctacatttgtttttcattgtgagactgtgccgtaatttatttaatcagtgccatattgaaagacatttggatcgtttcccagcatttgcaactataatcaaggttacattaaatatcctgttacatgcaggaagatactttattcacatgcatgggtatatcagtaggttaaaactcaaatacagaaactgccaggtcaagagatacacatcttaaagtttaatagatattgaccctgtttctaaaaagaaagattccttccagcgtgtctacacacatttgtctgctcctctgtcttctgattcttgtcccatggtgttattttaggctgaaataatggaatatggtggctcaaaaaacttattcccataggatctctgggaaagctttgggtcttgccacatggtccccagttgaacacaggaagtacttggcactgttgttgcaacccaaatcatcactttaatgagcgtgctggaggagcgtggaatgtttccacaagcatgtgtactgaagaattccatgctgcaggcgaaatgatttatatccctgggagttcccagtaaaaaaatgtgcacagtaccctttaatttgatctgctttccctgtagcacctaaatatttagggcaaatagaaaatagttctgatttacatctctataaaaattttaaacaacctaacaagacatttgatcatgaaattgcctgaaataatgttggcactagtcagccatatttcttcaaaatggcctgtaacttcagtgcaaactcccaaacatggatttttttttcctgctaataacagtcttattaataaaagaatgattttctttactgatcctcagcagctgtgttccgggtgtctttgttcaataaaggtagagataataactgtcagtggaaagaaaatgtgctgaggttcccaggagaagtggtggaaacaaatcttttattaaatcatatcaaattgtgtttctcgtttactttttccattttgtaagtcacagtcatatctgctagtttttcggaaaccttggctcacatttgtcaaaaaaacttggcttggcattcttgaggttaatgctgcgtgatcaatcggtgataaatttgacataattaactgttgtaatggcatttctgagtctgtttctcttctttactcctgctgaaatcatctgagattagttaacttctgaatatttcttcagatgtgctgtggatgcctagaaaaagagtggtaaggaagtgtcgttgatatctggagttcttatctgtccacaggttaatgatctctctgaataataacacccctatttccctaggaggatcccttcccctactctcaaggcaggtggctcagatgggcctgatttattcctggtgctaggggtgggcaaaagacccagacctgaccaatcaaaaacatcaaattgggccaaccagaacgaattagaattctgggacctttgctacaactattggaaaagataattttttttttgattggaattcctgaaagaacaagacataaacctgcttctggttatctttgctttccggggaaaggttttttttaatgtttatttttattttttctgagacagggtctcactctgtcacccaggctggagtgctgtagtgcaatcatggctcacggcaacctcggactcctaggctgcagagatcctcctgccttagccccctgagtgctggagctacaggtatgtgctaccatgcctggctaactaaatttttttttccttttttgagacagggtcttgctctgtcacctaggctggagtacaggggtatgatcgtagctcactgctccctcaacctcccatactcaagctatcctccctcgtcagcctctcaagcagttgggaccacaggcatgtgacaccatgcccagctatttttttttttaattttctctagagatggggtctcactatgttagccagtctaatctcaaacttttgggctcaactgatcctcccacttaagcctcccaaagtgttggcattacaggcgtgagccaccatgcctggccaaaaaagggcattcttgaagtcaaacaagggaaaacactgagaaatgaagggaggttcctgatcatgtcacttggataccagtgtttagccatgcctgaagtcttacccttcaattaggcaggctaatacattttcattttttgcctgagtccgtttaacttgggtttctggcacttacctcgaagaaagtcctaaatacttatgttttccaagtttcagtaaagtctcatgtatgggagagtgtggtcagcgccagcaatacccatgtccataataaaatatcagtcctctccccgtctgttattgctggtcaccactgtataatagactgtgttcaggctggagtgacagctccagtccacagttcatcagagggtctcagcccagtctcgtcaaggattctcatttctagcattcatcatggttgccctatatccatgctctgaggatatggcatttacctctgctgtgccttgtcctccccctaccttgtaccagtagatcagtagatccttatgaatgcacaaatacctctctctgcaccagagagagtccagcctgaggtttgtaggcagctagctactggaattttctcccagctttgtatctctaagatctcaggtccatttctttttcttttcttttcttttctttttctttttttttcctttttcttttcttttctttctttcttcttttttttttttttttgagacagagtttcgctcttgttgcccagactggagtgagtgcaatggtgcgattgtggctcaccgcaacctctgcctccctggttcaagcaattctccttccgcagcctcccgagtagctgggattacaggcatgcgccaccacgcctggctaactgtatatttttagtggagacggggttactccatgttggtcaggctggtcttaaactcccaacctcaggtgatccccccacctcggtctcccaaagtgttgggattacaggtgtgagccaccgttcccggcatctcaggtccatttctaggtcttgccttgccttacttgaattaggtaatgaccttatatgtgggggaagagatgatgtggacagggatatatggtctaacattcacagtgctcctactgcttatcagatactgtgcttggttcatttgtgtcatattatgttgtgttttccataacacgtaaggcattccatgtgcaagacactgtgttaagtgccttatcaagcaacatctaatttaatccttataaaaacaatagaaaggcattattatctccatatagaagctgaggctctaggttattttctttgtatcatacaatgaggaaatggcaaaagcaagatttcaactagggtctcaatgactctgaacccagttttcttacctccgacattagcacttactgtattttttttttttccaacttttattttacattcaaagggtacatgtgcaggtttgttacatgggtaaattgcatgttgcagaggtttggtgcacagataattgtgccacacagataattggcataatacccgataggtagtttttcaagcttcacccttttcccaccctcctccctcaagcaggtcccagtgtctattgttcgtttctttatgttcacgtgtactcaatgtctggctctcacttattagttagaatatgcgatattaaggccaggtgcggtggctcatgcctgtaatcccggcactttgggaggccgaggcaggcagataacctgaggtcgggagttcgagaccagcctggccaacatggtgaaaccctgtctctacaaaatataaaaattagctgggcgtggtggcaggtgcctgtaatcccagctactccagaggctgaggcaggagaattgcttaaacccaggaggtggaggttgcagtgagccgagatcgtgccactgcactccagcctgggcatcagagcgagactctgtctcaaaaaaaaaaaaaaaaaaaaaaaaaaccaagcatgtagtatttcattttttgttcctgtgttaattggcttaggagaatggcctccagctccatctatgttgctgcaaaggatacgattttattctttttttattgctgtgtagtattccatggtgtatatgtgccacattttctttatccagtccactgttgatgggcatctaggctgattctatgtctctgctattgtgactagttcacttactgtattgtctcattgatgagcatctacgtgtctctgctattgtgagcagcgcacttgctggattgtcctgttgataggcatctaggttgagtctgtgtctctgctatggtgagtagtgtacttacagtattgtcttgttggtctgtgcatccctctcacctgtgagcttcctgatctcgtgcactctgtgttatgtctggatcccgatcttcactttagaaccttgcatagagcaggttctcaaaaactgtttacagaattaaagaatctttatagcaatgtcagaaggtgagtattttctttccgttttacacatgagcaaatttaggcttaagaaagttaagcaaattacccaaggccaggaagtagaattcatgaaatataatccagaaatttccaagagaattgagaaagatattctctaagctaaagaggagggtttttgttatttttcggcattctaatataggtagtttatgtggaaacatggaagtaatttaccacctttcttaatgaaggccctactaggctgggctatcatgaagaaaacagcacagacatttttatgaaagaaaactacatctatgttactgcatctgtatttgagctccttataacatgtaagcaggcagaacattgtttaatgttgctggacaaagctcaagtgaaaatgatccagtggggaaatcttttatggaaattaaactgattgttttggaatgtaagttgcaatttttcacttcttagtttctgctctcttgagtccttgtctatgtcatgaacacatttgatacggaatcctggggactttgcccattgtaaggagcactgtagtggaaggcagtcgagctcaatgtatagagagaggcagcaaggtgggtaagtagaggcagcacctgggacccagctagatggactggtatctctaaagagtgcctcaaggaaacacatttcctggagcacttcagaacatgagagctgaggccaggatctggtgcagctcactctatctgaaagcactgagattctgttaagctaatgatgagttttctcttcatctttcctcccaacaccaagaccaagcaaaaatgcaagggaacaaagaacaagaagcagtgtccaaagtcttcagagtctctaggatagttgttgacctaagtcacactgctgtcatcctctgggctgcttgtacttttggagtagtcactggcagattaataagtttcctgaaagttaacagaaaataccagcttaaagtagtactaaagttttcaaaaaatttttttggggggaggatgagagggtgaaatatgatagtcaccctgatgtactcatggaagcatctaggttgtgttattagttaaaattcccagccatgaagacaagaatacatggaattcacccatgtgttcacccaacctcccatccatccacctatccatccatttgtcatccatccattcatccattcttccatccatctatccattaatacatctgtccgtctacctactcatctgtccatccgtccatccatccacctactcatctatctattgtccatccattcatccatccacttacccatctatccaccatccatacacccacctatccatccacccatccatctactcaccaatctatctaccatccatctatcaattatccatccacccacccatccatctacttagcaatctatccaccatccatacacttcacccatccatcaattcacccatcaatccatttacccattcacccacccaccatccatccatctatccatctatccaccatccattcatcaatttaccctatatccaccattcatatacctactctttgatccatccacctaccaatctatccattcatccatccacacacccacctattcatctatccatccatctacccatctgcttaacattaaccaagcatacataatgtgccaggcattgtctagggctaccaacacttggttcttaggaaattccaagactgcatttttttgctataaaataattttggaagtcaaatttgcctgaggagttttgttaaagtgaagcaaaatgtaatatgagtttatatagattttggctcttacataactatacttggcattgaaaactacgcaacttattcaggaataggtggtgtatggtacaagttgctgtatcatgcaaaaagatgggctgcaagaaacagtttttgtttaggctttgtttttcattaaaatctgtgaaattgttgagctcaagttgttgttttgcttggtcaggtgttgctagtcagctaaaaataagtctgtatcagtgatcgtcttagattctaagaaaactcagatgtgagggaaattaatgtgcttgcactttttgttacatgacaccatgttgaacatgcgtagagttttgtgaacagaggtggtagagcgtgttggtaagagttgcatagttggtaaaagagttttaaaatgtgtttctgattaatttacataaataatttggggccaaaaaccttctttccctccactcaacaccatatttttgaaatcccttcatgttgctctatataaatctagttaatttctgattgtgtcctaaagtcaacgtatgcataaaacacaatttgcttatccattccttgagtggttattgtataggaacatcaaagtctgtgtcgtcacaagcaaaactatggtggacatcctaatgcatgtgttgttatggccttgtgcaaatttctctagtgcacgtatatatccagatatgggattgttgggtagatgaatagttaattgcactgagtactgagaaattgttacttagaatggctgcttggtttacactttttactagcacttgatgttctctggcgttgtaatttttaccaatctgatggctgtaaagtggcatatcattgttgttttgatttgcttttctctgattattactgatgttgagtatctcttcatatacttattagccattagtgtttcctcttctattaattttattttcgtaggctttgcccatttttttctattgggtttcctgaaattttcttgctattttcaggagtttctctcaatattaatgccagtttcattttacacactgaaaatatcttctcacagtctaccaacgtgttaaacgtgtagatgatgtccttttctgagtagaaacctcaattgtaatcttgtcaaacacttcatcttttcccgttatggcttgttcttttaagtcttgctcaagaacctgctcaattctaaagtcacaaagatatttcccacattttgtttgattacttttatgatttacctttcacattcagatgtaaaggaaaaaatccaatttaatccttgtcatacagtaaaccatcctcccccaaacctaccaagttatttattctttcccaactgggttaagacaccatgtctcctatgtatgtggggatgtttctggaatctctatactgcttcaatgatctatttagctgttcctaagactgtagcacagttttttattattatactttaagttctggggtatatgcgcagaatgtgcaggtttgttacataggtatacacgtgtcatggtggtttgctgcacccatcagcctgtcgtctaaattaggtatttctcctaatgctatccctcccctagccccactgacaggccctggtgtgtgatgttcccctccctgtgtccatgtgttctcattgttcaactcccacttatgagcgagaacatgcggtgtttggctttctgttcttgtgttagtttgcagagaatgatggtttccagcttcatccatgtccctgcaaaggacatgaactcatctttttttatggccacatagtattccatggtgtacatgtgccaaattttctttatccagtttatcattgatggcatttgggttggttccaagtctttgctattgtgaacagtgctgcaataaacatatgtgtgcgtgtgtctttatagtagaatgacttataattctttgggtatatccccagtaataggattgctgggtcaaatggtatttctagttctagatccttgaggagttgccacactgtcttccacaatggttgaactaatttacactcccaccaacagtgtaaaagtgttgctatttctccacatcctctctagcatctgttgtttgctgactttttaatcgccattctaactggcatgagatggtatctcattgtggttttgatttgcatttctctgatgaccagtgatgatgagcattttttcatatgtttcttggccacatacatgccttcttttgagaagagtctgttcatatccttcgcctactttttgatggggttgtttgtgtttttcttgtaaatttgtttaagttcttcctagattctggatattagcccttcatcagatggatagattgcaaaattgtctcccattctgtaggttgcctgttcactctgatgatagtttcttttgctgtgcataaactctttagtttaattagatcccatttgtcaattttggcttttttttgccattgcttttggtgttttagtcatgaagtctttgcccatgcctatgtcctgaatggtattgcttaggttttcttctagggtttttatggttttaggtcttatgttaaagtctctaatctatcttgagttaatttttgtataaggtgtaaggaagggatccagtttcagccttctgcgtacagtagccagttatctcaacgccatttataaaatagggaatcctttccccattgcttttgtcagatttgtcaaagatcagatggttgtagatgtgtggtgttatttctgaggcctctgttctgttccattggtctatatatctgttttggtaccagtaccatgctgttttggttactgtagcgttgtagtataatttgaagtcaggtagcatgatgcctccagctttgtacttttgcttaggattgtcttggctctgcaggctcttttttggttccatatgaaatttaaagtagtttttttccaattccgtgaagaaagtcaatggtagcttgatggggatagcaatgaatctatccattactttgggcagtatggccatttccacaatactgtttctttctatccatgagcatggaatgtttttccatttgtttgtgtcctgtcttatttcgttgagcagtggttagtagttctccttgaagaggtccttcatatcccttgtaagttggattcctaggtattttattctctttgtagcaattgtgaatgggagttcactcatgatttggctctctgtttgtctgtacttggtgtataggaatgcttgtgatttttgcacattggttttgtatcctaagactttgttgaagttgcttatcagcttaaggagattttgggctgagatgatggatggggttttctaaatatacaatcatgtcatttgcaaacagacaatttgacttcctcttttcctaattgaataccctttatttctttctcttgcctgattgccctggccagaactttcaacactatgttgaataggagtggtgagagaggacatccttgtcttgtgccggttttcaaagggaatgcttccagtttttgcccattcagtatgatagtggctgtgggcttgtcataaatagctcttatgattctgagatacgttccattagtacctagtttattgacagtttttagcatgaaggggtgttgaattttgtcaaaggccttttctgcatctattgagataatcatgggatttttgtcactggttctgcttatgtgatggattatgtttatcaatttgcctgtgttgaaccagctttgcatccccgggatgaagccagcttgatcatggtggataagctttttgatgtgctgctggatttggtttcccagtattttattgaggatctttgcatcgatgttcatcagggatattgacgtgaaattttctttccttgttgtctctgtcaggtttttatatcaggatgatgctggcctcataaacgagatgggaggattccctctttttctattgtttgcaatagtttcagaaggaatggtaccagctcctctttatacctctggtagaatttggctgtgaatccatctggtcctggacttttttttggttggtaggctagaaattactgtctcaattttggaacctgtgattggtctattcagagattcaacttcttcctggtttagtctttggagggtatatgtatccaggaatttatccattttgttctagattttctagtttatttgcgtagaggtgtttatagtattatctgatggtagtttgtatttctgttggagcggtggtgctatcccctttatcattttttattgtgtctatttgatttttctctcttttctgtattagtctggctaatggtctagtttgttgatcttttaaaaaatcccgctcctggattcattgattttttttttttttgaagggtttttcgtgtctctctctccttcaggtctgctctgatcttagttatttattgtcttctgctagcttttgaatgtgtttgcccttgcttctctagttcttttaatagtgacattagggtgttgattttagatctttcctgctttctcttgtgggcatttagtgctataaatttcgctttaaacactgctttaaatgtgtcccagagattctggtacgttatgtgtttgttctcattggtttcaaagaacatctttatttctgccttaatttcgttatttacccagtagtcatttaggagcaggttgttcagtttccatgtagttgcgtggttttgactgagtttcttaatcctgagatctaatttgattacactgtgatctgagagactgtttgttttctgttcttttgcatttgctgaggaatgttttacttccaattatgtggtcaatttgagaataaatgtgatgtggtgctgagaagaatttatattctgttgatttgtggtggagagttctctagatgtctattaggtctgcttggtccagagctgagctcaagtcctggatatccttgttaatcttctgtctcattgatctgtctaatattgacagtggggtgataaagtctcctactattattttgtgggagtctaagtctctttatagatctgtaagaacttgctttatgaatctgggtgctcctgtattgggtgcatatatatttaggatagttagcttttcttgttgcgttgatccctttaccattatgtaatggccttctttgtctcttttgatctctgttggtttaaagtctgttttatcagagacaaggattgtaactcctgctttttatttttgctttccatttgattggtaagtattcctccatccctttattttgagcctatgtgtgtctttgcacatgagatgggtctcctgaatacagcacaccaatgggttttgactctttatccaatttgccagtctgtgtcttttaattggggcattttgcccgttcacatttaaggttaatgttgttatatgtgaatttgatcccgcctttatgatgctagctggttattttgcccattaggtgatggagtttcttcatagtggcaatggtctttacaatttggtatgtttttgcagtggctggtaccggttgttcctttccatgtttactgcttctttcgggaggtgttgtaaggcaggcctggtggtgacaaaatctctcagcatttgcttgtctgtaaaggattttatttctcctttgcttacgaaacttagtttaactggatatgaaattctgggttgaaaattcttttctttaagaatgttgcatattggcccccactctcttctggcttgtagggtttctgccaagagatctgctgtttgtctgatgggcttccctttgtgggtaactcgacctttctgtctggctgcccttaacattttttccttcttttcaaccttggcgaatctgacaattatgtgtcttggggttgctcttctcgaggagtatctttgtggtgttctttgtatttcctgaattgaatgttggcctgtcctgctaggttggggaagttctcctggataatatcctgaagaatgttttccaagttggttccattctccccatcacttttaggtacaccaatcaaatgtagatttggtcttttcacatagtctcatatttctcggaggctttcttcatttcttttcattcctttttctctaatcttgccttctcgctttatctcattaagttgatcttcaatatctgatatcctttcttccacttgatcaactcagctattgatcctttgaggagaagagatgttctggtttttggaattttcggtctttttatgctggtttctccccattcatggatttatttacctttggtctttgatgttggtgactttcagatggggtctctgagtagacatcctttttgttgatgttgatactattcctttctgtttgttagttttccttctaacagtcaggaccctctgctgcaggtatactggagtttgctggaggtccactccaaaccctgtttgcctgggtatcagcagcagaggctgcagaacagcaaagattgttgcctattccttcctctggaaacttcctactagaggggcacccaccaggtggcagccagagctctcctgcatgaggtgtcttttggctcctactgggaggtgtctcccagtcaggatatgtgggtgtcagggaacaacttgagggggcagtctgacccttatcagagcccagatgctgtgctgggagatccactgctctcttcagagccatcaggccaggacgtttaagtctgctgaagctgtacccatagctgccccttctcccaggtgctctgtcccagggagatgggggttttatctgtaagtccttgactggggctgctgccttttttttcagagatgcccttcccagagaggagga

SEQ ID NO: 482 - DNA, 20001 bp, Homo sapiens
tgttcctgacagccccgtcttcccgaggagaaagccttggctcagagcagtaacgcgttctgcccaaggtcaacgtgggagggacgagggggacccatgagtcctgccccgtgtccctgcagctcctggtggacgacctgcttgtgtacaatgggatcctggccatggtgagccacctggtggggggcatcctgcccacatgtgagcccaccgtgccctaccacaccatcctcttcaccgaggacagggacatccgccaccaggagaaacacaccaccatcaggtagggccccagccggccccatggcctccccaccagccctaaggaggatggatggctgggacacacggccaggagcctgatcgaatcttgtgtttccttcctaccctcagtaatcaggccgaggatcaagatgtccagatgatgaatgaaaaccaaatcattaccaacgcgaaacggaagcagagcgttgttgacccaggtcagtggcgtttctctgcccagagcattgtgccttgggagctcggtctgaatatagaaggagctggtggccttgcacccccaccctcacccctgcctgcccctagaccgctctcctctgcccaggagcctgcccaaaggcctagggagggactgaagaggatggaaccaggggagcaacatgcttccatcttcttgcaggcacctgtaacacagtggagcttcctgaatctaagtgtcgtgggcacagagtggggaagcagtcagggacagagcaccatgttaaaggggtttgccccgggccgtgggaaaccaatagaggatgcccaaggtgagggcttcccggaggaggtgatgtttgagctggatcctaaaggatgtgaggagtgtgccaggcagcctgggcaaaggctgagaggggtgttgtggcagagcctgctccaggcggagggaaggggccagcgtgccaggcgccccgagagcagggacttttccaagggccttgaatggcaacccaggctgctggatttcactggggagtgtggggcacccctccagggtttgagacttagtaactctggtccctctgttccctgtcatgacagccttacgtcccaaaacctgcatcagcgagaaggagacgagacgacggcgctgctgactggtgaaggagggagagctggtcctcccactatggtgggctccgtcagcagccccactcagtgcctgcgtccctcaccctcagtcccaggagctggaagcgaaccacagtgttgaggggagcccgctgggaagaggggactcgggaggacagccctggatactaccagagtgacagatggctgtggctgcagggcaaagagatcccctgcagttctgggttggccacagggagcccaggacacccgccttcatgcctctgctgtgagacccagcaaagcagggcccatgaccactagggcctgggctgaccctgactcagaacaggacaatgacggggtggggaggcatcccatccagcctcagagggcccagagaatggctgagcaggacagtgggagaccagaccctaccccgcaactccagtaagcagggcactgcccagggagactgccttcagaaacctgagcttcagcggccaacaccccccatcccctgcgcatccttgtctcatttggggactggtggagctggctgagaggttggggtagtttcctggttacaggggtccacaagaccctctctcatcccggtataggggcctctctcctctcatcgggcctgataagggattggccaaggctgtgtgcatcctgcagagggaaggaagtcagctgggccacccgccatccaccttggcaagagctgggcccactctggcaggccagggtatcatctgcgtgctgctgccgggccaggaagggtgggtgggtggccagcaggctggcagctccagaccccagagggccagaagaactcaccccagtgccctctggatgcaggtgttggggaacactgaggacaatcccccatctcccctcacccttgagcaggccctccctgcactctctgccacatgtccctcctggtctgatcacggctgtgctcactgatgtggctgctttctgtctctgcccctgtgcccttggaggcaggcagtgaggtgctcctttcccaggcccccaccccttctcccccttcagccacttcccagcgagttggaaatgtgccttgcacccccagccgagtgaagcccagaacgcatctatatgcatcgatgtaacaagctcggatcagggacctaattggtttcccagtagtgggtaatttctcgttgcaaatattaatccgttgtttttctggcgcccagcccggcccgccgcagtactgtactcgaggtacgttcctatgcaaccgagagccccggcaaatacttcatgagcttagcagcctgggctcgagcagctatgcaaacgcgcttttcatttggagcacggggctgatgtgaagataagaattgtttctcctggagaaagatccatcatttctccagcttccaagcccccggcacctctgctcagctcccagatgtgacgagcacctcccgccagggggagtcaggggttgatcaaaccagctcttgtgacccaaaccagtgccgctgcattaaagggaggcccagctactccttcccagctgagatgtgggtacaggtcagatttgtcagggagatggcactaacacgacacaagctcactcccagaaccgcagctgatgtttataataatcgtatgtactgtgcaatttaggaggggaaaaaaaggctgtacaagctttaactctaaaataaatttctatttttttcctcttgcaaaattaataaaagatgttattaagaatatagtccgagtcaccggatttggggtcagatggggagtccatgctgcctccaggagctgagtgacacagagaagccctcactgagctgcagatggggtcatgatctcgccctgactactcaatgagattgtcctgccgtatgagcagacaacagtagctcatccatagagagtggtgattacatgcctggctctaacttgtttaatccacgtaacacaaccctttggggtgggcactattattatcctcactttacagataagggagctgagacacagagaggttgtgcagctttcctgggacacacagctttggaagctattagccaatgcacaaatcctgagagggcccctggagagttgaggtgggggtgacaacacttgggtctttggccctggggtttcccttcaccatgtgtggatcctggaatggtggcccccagacccccagttcctggacctcctccctgcccacccccatgcccctgctgcctccaggggtgagtgttggcagcttgtggcttctggataaagcagcccttgagtggaaagagggctcagttgaggagggtcacactgcagttcaggcaccggcaatagcactggcagcaggtaggagagtcctttagaaaccctactttgcttcactgtgtgggtcagaggagagagccccctctgtccagccaggagaggcccagccccaagcatagagggaaaacagcaggggctccggccggcctgctccatgccccctgttccctctgatttcctaagagacgggcctggctgtgcccagccatgctagtgttggaaagcagtcgccctccctccttttggtggaaggatctctgggccagccctggagaccctcgagggcagcccagaccttccagcattccctctgtgagagtgggaggccggcaggggtgtcccagcctctcagctctgctgagcctctccagcccctgccagagccctggggtggagtcctgttattcaggggccagacaagtgatgtcagggagtgatgtcaacactggcctgcaaggaccgtggttgacacggcggcacaggcccttcgaaggggtcagccacacctcagatccaaggggccagcaacatccggtcttcaaggtttctttttttttttttttttttttttttttaattgagacagagtctggctctggctctgtcgcctaggctggagtacagtggtgtgatcttggctcactgcaagctctgcctcccaggttcatgccattctcctgcctcattctcccaagtagctgggactacaggcgcccgccaccacgcccggctaatttttctgtatttttagtagagacagggtttcaccatgttagccaggatggtcttgatctcctgacctcgtgatccacccgcctcagcctccgaaagtgctgggattacaggcgtgagccacctcgcccggctcggtcttcaaggtttctaagagaagccagacagccaggcgtttcttttatctttaatgtgaaatctaacttttaaatgttggctcaacttcaacaaacaggcaaacacacactgagtgagccaagtattgaataaaacccgtccgcaggcaggccccggtccgttcaccaatcctgcttgctcagcgggcctccctttctgccccacctccagcctggggttcaagaaatgtcccaggctggaatctcccagctcctcttccctctccagggaggaaaaaggagagagggctccttcctagcctgtcactcccactcctcagcccccagatgggcagagacaggacgaccatcaggtgacacctctgggtcctggaggcggcagcccccacactcagctgttgtgggtaaacagacgtcctcctttccctccacatgctgaggcttcctattctgtgcaacgccccccgacccccagcgccccaacaaacagagacataaatgactcccaggctgccactgtcaggggtcagggctcgttggctccctggcataggtgactggaaatgggcctccactgcagctgacaagagggttacggcacgggctcccagtggaggctcccacaggcctccagcccttggggacctgcctcctctgttcagcagtgggaaggacctgcttcccacccccctggaagttccaacactggcactgccaccccagaaggacccagaaggacccccccagagcctgccaaggggggcttcgcagccaggcaggtggcagctgccccatgcgaggcacgtgtgctgagatgcccgggttccctctcccagcctcacctcccgcctcacttggagccaggacagtccctttccaaggcccccaggctccacctggcctcttcacagtccacaatccagtggcccagcctcttgggtttggcggactcactaggcgatgcttaatttttttaaaatgagttgccttcctttattatcaggtttcacattaaaattcagattccctgcttctctggaaagacaggaagatctggcaacctggtcccacgttcccagctggccccagagcctgagcagtgctctccagatggtcctggtccccgccagcccctcttgtcccacccttgcctgcagtcctccctcgcatgaccatacacacacacacccagccagcgtgtgagtttgcaacccctgagatagaagcaggttaaggaatgtggaggagaagaggggacgtggggatagtgctgcggggcccagtgggcgtggagctggcaaggctggacctctcgcaatgagaccccagcctcccaggcatgcgcagtgctctctggggccctgagacttgagcctctgagggccagaggccggggagagcaagaggtggccagcctccatccagtatgttgcatatgtccccaggtgctctgggggtgcctccctgactgtgtgggcatgtcccagattgccgtgtgcagtgtggcatttatgacagcactccagtctcctagcctctctgggaaactgctccactcacagcttctgccacaggggcagcctttgacaaccatatgctgtgatgatgacaacaaaattcctaacagcggccaggcacggcagctcaggcctgtaatcccagcactttgggagactgaggcgggtggatcacttgaggtcaggagttcgagaccagcctggccaacatggtgaaactccatttctactaaaaaaaatataaaaattagccaggcatggtggtgggcgtctgtaatcccagctactcaggaggctgaggcaggagaatcgcttgtacttgggaggtgaaggttgcagtgagccgggatcgcaccactgcacttcagcctaggcaacaagagtgagactccatctcaaaaaaaaaaaaaaaaaaaaaaaaatcctaacagccaatacacactaagccctcatcctgagagcgaatgcgctgcggtttctcctgaaggcgcacagtggtgagttgcagtgagacctgggctgcaggcaccactctccccagaaagctggtgaggactcacacacagtgaccctggggccagctgccagggttccagtctaggctccaccaaccacttcctgacagtgcgaccttggcgagtgaccttacgccctgggccctaggcttccttacccaggctgcagtggtaccagcagtacctctgtcatggagcagagctctcaggcgccaggcccactggtgctcacatcaactccatccaccatcagacggaggctgggatgtgacttctgggtctggggtcttcaccagagcaacgtggcactacctcgcacccggtccctctcaaatttccagggcaccatcccagccttggcagattggtccacaaagaagggcactggccttagtgcagccagcccattggctgagcagagatcgatgtcccgatgccctgcccctcctccgccaactctttccccttccctatccattcccttccctcccctgattggcccctgggattcttcctcccttgcctcctctccctgggttcatcctgcttgcacctcccacccccaacacacatgccctagaagttctcaggagggccgggaagaaggggtaagagtgggtgtacccggctgggcatgttgcacccactcaccagcttggccccatcacagagcttctcccatgcagaggcccctcccgctccccctggagtcccaggacccctcattaccctgggtgcccgctactcctggcagctgcccactcccctgccaggcctgtggccatcagcccggccccttgccttccctaaggcagaagctcaatgtcagtccaagactacatgtggcccaaggagcaattaccagggtgacgtgagccaggcggtgctggggacagggcaggggccctgcacagcgatttcctgtctgtccatgcagtaaatccccacacggaggagactggtttttcctcatgactgatggtcccaggctgggctgaatttgtctcaatcccacggcagccaggcctggggcgggcacaatcactctgtgccccacagctcagctcccgggcgaggctcaggggccacgtcttccatgtttgggggcagggagggggcccttttctaattcatccactcagagagcagcttttcctgatttccaccaaggcctcatctggccggcagcatcccagcctgcacagcatcaaagccccagacaggagcctggcccagctctgtcactcatctccaagccccatgggtgccactgatcagacgcccacttccctccattcccggggccagcgcaccccaagccaccgccatctcccagcaggaccctgctgcagccccctctggtcaccctgcctctgccctgccgcccatttctcaggcctgccccacacacagccagaagaaacctcccaaaatgcagagcccatcatgtctgccttttaaaaccctgccttttaaatcagtgtctcctgtggccttcaggatgaagatgacggccaaactccttgccacaacccccaaagccccacagtctctgaccccagcagaccccatgtcctcgccccgagctccaagcactctgtcctgtcatgcagtgctgcacatggcgctcacggtgctcctccaaccccagggcctttgcacccacggttcctcccacctaccctgtgcctcctgcctcctttctctcccttcattctgtgctgcaatggtccttccgagaggccctccctcatcctctggtctaaatcacatctttccttggttcacctacataacacctctcactatacaaagtgattattttattatttaggagtgtgtgtgtgtgtgtgagagagagagagagagagagagaaagaaagagagagagagagagagatggagtcttgctctgtcgtccaggctggagtgcagtggcttgatctcttggctcactgcaacctctgcctcctgggttcaagagattctcctgcctcagcctcccgagtagctgggatgataggtgtgcgccaccacacccggttcatttttgaatttttagtagagacagggtttcaccatgttggccaggctggtctcgaacccttgacctgaagtgatctgcctgccttggcctcccaaagtgctgggattacaggcgtgagccaccacacccagcttatttaggattattaataatctaatctccacaagggtgaagatagtgtctgtctttcttgttcgccatggccactccagggcacagctctgttcctgtacacagcagtccctccataactatttcttggatcaatgaggcacatagcaggtctgcagtggcctcgggatttgaacccaggcctaactgcacagcctcaggggctttcttccatcctcacatcctcccaggcaggggcttgacacccttgctgcagcagctcttcacaggggatgatcctcccgcagcgtgcctcgtcttcaggcctggctgccgcagatgaatctccatgaatcaagctgacatttccattacccgagggagacgagtgtgtggccaggacggctggctttggcgggggtggcggggatgcgtgcccatcacagccaccagccaaggagggaaggcagcccagttactcacggaggcccgggcctgcccttcagcccttggccagagaagggattgtggcttcatgggtcctctgcacctgggtagagggggtgacatgggccaacaagcaacaagagaagcacagagcatgtgcagacacaggtgtgtgcccagggccacgtgtgtatcatgagcatgtttgttcagcattagcacatgtgtggcattttgtccagagccagcagaagcacgcatgagcgtgtgtgcacaaggtcaacagaacacacagtgtggatgagcagtgaacatgcagttagctcctaggtacatacaaggtgctgactcacacttgagcaatatcaacatgttgtggggggccaggggagtagggtcagcactttgagccaaagtcagcctctgatgatcatgggtatgtgtgactgggccacggtaaggttggcatgtacacacgagcccaaggcgtgtggatacagagacacgggacgcaggtgcccagggcagaacgaggtcgtgtaagcgctttgggctgtgggtcacgtcgatatatatgggtgtcaagaccaaagacacacacacagccattctctccatggttggagcctgtctgctcagggcagcgcaggggaggtgtagctgggaaagctgtctgtggaggtgggtggaggggccttttctttcccatccaggcctctgggtgctcaaacaggcaccccctgccttcaaaccagatggtgactcccaccttccagattcaggcagacactggcattcgctccctgcataaagacaactctcatacgaactcgtagtaaacccactggaattactcacccagcctgcctcttatctaaccagcagctttcttgctgcaggctccatgaaactgacagacagctggttctcagcccccgcccaggaggtgcccagaaggagaccagaggacttgaagctcagtggccctgggagcctctgacctctctcccttgccccgtgacaatggctgtcgctcaagctgtccgcatatcataaccacataccacttgcacgattatttatttaatatttttctttaagccaactctttttttcttttacttaaatgcctattttggtttcatcctaagcagtaacgtctgtgaagtcatagcactgatgtgcccactgtacatttttttctaatacacatttacataaacacaactattaaaatagattaaaattttccccatgtgtcaactacaatcatctcctggacctcctgcggtccactcgccaacttcagaaggaccctgggtgagaacaagagctcctagatgcctggtggccagggctagatccctgtcagatctgtccctgcccaggcccatatatggcagccgccctctcttgcatgaggccaaagcccaaattccttgttctgacattcaaggcctcagtagagctggaccataattgctctcccaggcccatttccagccccgccttaagccccacctagtaggtcattaatatttactgaatgaatggaaagtgaattaacaaattgttcgcttgatgaatcaatgcgtgaatgaatgagcacaaacctccagctggctgtcccctgagcccctgagactcaagacatctgaaccacgaagtctccgtcttccctatcccccaagctgaccctgtaacctgagagtcgtcaccaactttcctcttctcccactcagtctattccctcctaattggttcctgaatctgcccgcatggtcccctccccagggcaactttcctaagccagcccactttcttctctttcttgagtgtaagagggatgaggaagggagaagcatctcccacaactattctgtgcccatagttgcggtgatcttcctcaaatgtacacccaggcgcatcccagtctgctaaaagcatctcactgcccactccccattgccccagggtaaactctaagctccctaagaaggtttccagttcctcctggcctggctccactgccctctgatgcctaatttcccacaactgcctcctgacctccctgctctccacacctgccattgggactattttaaagtcctctaatgtactttctttccctgctatactcttgcctggctgatgcccagacaatcttcatgtcttggcttagacatcattttctcaaaggagcctccctagactacagctcccacagccccgatttccccttgttgtcctgttagtaaacacccacaaagtgtttacttgtgccaggctctgttctagacacttcaaatatgttagctcatttaatttgcacaacagcttgaagaggtaggtataatgattatccggatttaatggatgaggaaacaggcacagaaaggtcaagtaactcgcccaaggtcacaagtggagaaggtggaatctgaacccaggctcacgacaatagatgccctctctggatgctccagcatcccacctcaagtgcctaccacagtgcttggcacatagtaggggcacagtgaactatatcagtgaatagatggatgcacagctggatggttgagtaatgaggatgtgtgacacatggaaggaggatggatggaagtctgatacaaggaaggatgacaagcaatcaatagaagatggatagatggatggatgaatggatggataattgatggatgatggatagatgaaggaatggatggatgatagataggtgtaaggataatggatggatagatgatgaatagatgaagaaatggataaagaataaatggataatgcagaaatggataatggatggatggatggttgatggataatgggcagatggagggatgaatggatgtgtggatgacggataatggatggatggatggttgatggataatgggcagatggagggatgaatggatgagtggatgatggataatggatagatggagggatgatggctgatgaatgatggataaaggatggatggatgatggatagatggatgaatggatagatagtggatggaaagatgatggatgatggatggaaggataaataatggataaatgaagaaatgcataatggttgaatggataagggatgaatggatgatggatagatggaggaatggataatggataaatagctaacgaatgggtggatggatgatgaatggatggatgaaagcatagacaatgaatggatagatgatggatggatggatggatggatggatgatggatggatggatgatggatagatagctgatgaataggtgggtggatgatgaatggatggatgaatggatagataatggatggacagatgatggatggatggatgggtggatggatggatgaaggatggatggatggatgatgaaggatggatggttgatggactatagatggataatagatgatgagtgggtggataatggattaatgatgatggagggatgaatgaaaaatggatgaatggacaatggacaatagctggatgagtgatagatgctggatggatggatggatggatagatgatggatagctgatgaatgagtggatggatggcaaatggatggatgaatggatagatgatggatggatggaaggatggatgaatgaatgaatgatggatggatgagtggaaagatgaattatgaatgatggatggatgatgaatgatggatggataatagatgatgaatgggtggataatagatggacgaatgatgaatggatggatggataatggataatggctggatgagtgatggatgatggatggaaggatggaaggataaaggagaagaatatattctacgtggggaaaagctctagaaattcttctgggaaggaataaggcctcttgggaaatgactgaacttggagtcaggagtcctgattcaaaccccatctctgccatttgctagctctgtaatcacaggcaagttacttcattcatctctgtgaccctaattttcctcctctttataataagaatctgtttctccaggcatctaagccctgggattttctgtaaaggtggtgctaggcacagggtaaagcctcctcagggtcagggtggtgtgatgttgctgagctctgaagagaaatgtggcttcttcaccctccctgcttagggcttgggtttgggggcccacttcttgctcgccccacatctcttgcttgcctggcccctgccttgcccactctctggaatacaaggcagccctgccagcctgtgtccagcctgggctctgtgctccctccctgccaccctgcagtgtctggccctggcctctgcacagtctctgctgtcaccttcagcctccttgaggagtaatggggtggggcaatgacagggcagccacagcccacagagcaactggcctccatacaccgcaagaaaacaagttcaacaagcatttattgagcccctgctgtgtgcctgctgtgtgacacccctgcagtgcctgcgccactgccccctccttcaggaagccactctctgccccccaaagggctctgcccctctgggcacctgactggcttgtgggtgccagccattcagtggccagtggccatgtgtctcctggcatcgcagctgtgcccagcagggctcatgtgatgatggcaagagtccggggctgctgtcccaaagtcactctgtgcagccctgtgcattcccttgggcctgccctggccccatttccaaggccatgggacccaggcagcgatgggcaggacaggcctggcatctcccacgcaggctgactgagttcacggcacacaggccagggttctgggggcaccactctggtggtcttgcagcaggggctggtgccagcgatggcctgaggtccgcgggccaggttgaggtcttggtcacacccagtgccccaagacccagcactgtcggttcagctctggtgcttcctgtgcggagctccggggccaggaatccgccatgtgtggctggtgtcctgccaggagacaaggcggtcagtgctgaaagccaccttcctccacccacatcctgtctacccaccgccccccacccacacatccatcactcaccctcatttactaggccttctgcccatcatgccttttgtctaccgatccatgcccaacaccaccagctctccacccatccctcccctgtcagccacccagtcacccaccagttcaccaacacacctgtgacctagtcatgtatctgccaatatttgctgccatccacttatcaagccaccaatgtatccacgactctgctcacaccctctccaacccacagcccagaacccgctcatgcacctcacacctgccaacaggtgcaccactcccccagccatcctcctaccacccagtaacccaaccatcctcctaccacccaataacacacctttacatgtacacatccacctacacccaaaacatccccttatccaccccatgcccacctgacagccacgacagcaccccctgcagtcacgttcactcacctcacataaagccatgcccccactcctgccatctgcccacccattttccctccatccttcccttccaccacccacccctcagcaaatccacctacttgtgcagccatcatccaccaccatcctgtcatcctgcagctgtctccccaccttgccatctgcccccaagcaggcctccttgagcaccccatttgccttatatgtgttcaggagctgttgtgtacggatattagaaggggaacaagagcagatgtctcctaggtccccaagtccttgctggaccccagaaactgtgtgtgtggacatgggtgtgccctaagctgactctgagaaactctctgggcaccgaggcagggggcacctgccactgtctaccacacttagtggactggacaaggggaagggctggaaaggctcttcccctctgccactctcactccttcgtgtttttggcaatttttggaagatcactcccttgtcacccctcaagtgtctcttcaaagtctttctagcgcaccagaatcattcccatctcatgctgtggcctaaaatgtccttgtacctcccgccgaatcaaatcaagacccagctggagtttcagctctccaggaagccccctctgacatcctccccctggcactcagggatctccctcatcccagagcacccaccctcagcgcacactctgccagcatcacccccgttagaccccaagcccaggggagcaatgactgagcccagaatgtatgcacccctgtggaccagtggaggtggagctggaaggtgcaaaactaagggagagggttggtgtggtggagtggggctgggagtgaaggggggaaggaagaaaacaaacagttcctgagcatgtgcagctccagaggtagttctgcccattttacagatgagggagccgaggctctgtaaggattagtagatgctttagaagtcacagctatgatagagctggattgaattactttcctcctgattccaaatttcagcatttaaaaaaatgtgatccgtataatttcattttcctactctgattctcagacatacttgtcatactttagggtcagacaggctcttggcagaaagcccattgaggtgggaattcctagtgaagccaagctcctacttgcatgcctctaaggatggagatctccttgttccttctccatcctcaaagcagctctcattatcaggagagtctttctaataacaaggctgcaagacaagagtcaaagaggaagatggttgtgtccatagctggggtggggggtaatatttttggctttcacttttttctttctgcttttaatattccttaatgttagtgttttgcaagttttactatatttattaaggggtgggaaacattttgcaaacattttggaatcatttggcttcagaaaaacacatttgttttggcctcagtcatggaaaccattgcatactttggaagtgttggctgccaagatagaggtgtttgggttttgttttgtttttttaatctagaagcaaatatttggtgcatggaaaggtatgattgtttttctaaataagcatttaggcataattttagctgcttgtacagtggctgaaaagcagagccatggagagatcatcagaacagaaagaaagtgatagtgtattttttaaggaaaaggaaaggccacaatccctgtccttccctgagttaaaatcaggctgtctgtcccctggatgcagagggcaagatgctgaggactggggccctcctccctttctctggctacccaggaggcacttggggctcagagccatttaaggtgtgtgtatacagaggagaacactccagcagcccaccagggacccccacccacttctcttctctcccaggccttgtgctgtagattgggaatctcaactcaaaatgtcttgtgggcccaagcaggcaatgtaaatggatgaggtgagtcagagacagtgccaattgttaccaaggagaatgtgggctcagatcttcctaaactgtttttttgtttgtttgtttgtttgtttgagatggggtctcactctgtcacccaagatggagcgcagtggcgccatcatggctcactgcagcctcgagctcctaggtttaaacaatcctcttgcctcagtcttctgagtagctgtgactgcaggtgcacatcaccatccctggctaattatttatttattttttgtagagatggggtctcgctctgttccacagcctggtcttgaactcctgacctcaggttatcttcccgcctcagcctcccaaagccctggaattacaggtgtgagtcaccatgcccagctggatcttcaaaactttcttttttttttttttgaaacggagtctcgctctgttgcccaggctggagtgcagtggcgcgatctcggctcactgccagctccgcttcccgggttcacgccattctcctgcctcagcctcctaagtagctaggactacaggcacctgctaccacgcccagctaatttttttgtacttttagtagagacagggtttcaccgtgttagccaggatggtctcaatctcctgacctcgtgatccacccgcctcggcctcccaaagtgctgggattacaggcttgagccaccgcgcccggcccaaaactttcaaagaaactgaaaatctggatctcgaaacaaaacctcctggcttttaaatgatgacaattaaggtttcaaatgtattttcaacaatctgtgggccaaagagcatttctcaggctgcactcagcccacgagaggcagatcccagcctgtgtcttcgttccatgattctgttccatggctttgcataggctgatcccctaggtgggagcgcccttccctgctcttctccagctgttgactccctgattttttcaaatgctgcctgctctgggaagcattccatagccctgtagaatgcttcctagagctggcagcatttggaaaatggaggctttgctcctttccctgtgcccttcagcagcctgcataactctctccccgaactcatcactttgtgttgtaatagccaggtcagcatgggtctccccaatgaaactggggatgggagacagctttatgagcagggccagggtctgcttcatcttggagccctgattccccagcccctggcccagcacagagcaagtcccaaactgactcttttttttttctttttaaacaaatgaagaaaccatggaggaaggggagagagtgattcctgcgcttgggatgcacctgctctacctgctctgagcttctgtacagtatgaaaagggtttttgctcaaactctcctcttttgggtgaaggctcaggtgatggcagggggctggggagaccgtacttcggtctaacagccaaaggttcaaacccagcctccactgcttgcaaattgtgtgaattttttttaagccgtgtggcttctgacaagcaacttcacctctctgagcctgcaaatggatgaaagctacaaaggagttggcaggcccagcaggcaccctgcagagaaacccttcactgtccaatctcagacacagacagaagtggaaagaacacagttctggaagcactagaagcaggttgggtttgaaagcctctcttcacaaatggggaaaccaaggcccatgggtgggaaaagatttgtcaaggccccactcagagcgtggtagcaggtactgtggtttccattttctgggaacctcccaaggttagcagagtatttgaccacaggaggttccccaaaggtgtgatttctcttcccttttaaatccagatatcaaaacatgaacatatttaacatcagatctcctccagccccatctcccgcctccctcagtgaagaatcactgtcttgaaccctctctaagccaccaagatccgggaatcagacataattgctgaattgaattaaatcacatctactgttccaaaatggattcattgggttgggagggcccttcaagaccaggaacgtcaatgccaccacaaatgtacagatcgggaaactgaggcacttagagggaaactgacttgctcaaggtctctctgcagctggcagagtgagggtaacaggtggcaggtattgatgctcctgaccctacagtagcccagcttggcacagatcagctggatccctttacagggaagttccttccggccaatcacccagccgctgtccgaggtgctgaaagcctctctctataggactcacaggtccgcccaaagccaactgtctgtctgcccaaccttgacctctgccctccagaaagaaaggaagcttgaagagtggtggaaaatgaatcagggatggcgctaagaaatcgggctttggaaacctgtcagctagtgacactctcatcgctcttctaggtccacaaatctctaccatgagagggcttcagaggtgtcatcacatatgggaatatctgtttactggttttctcctcatcttgcctttgaggcatgtgtcacaggaggacaaaggccagctctgctttccctcacagttgcatccctgcatcagcatggtcccaggcacagcgttgaaagcacgtgtctgcagaatgagtgaacggtggagggctcaggaggaagggcaggcttgagtgggacggacccgtatggagggaagtttgtgtcttctggtctacctcaggcgggctgttttaggagattgaatgggggccatctatctctccactggggtcatcctcagggattccacgtttctgagccataacattctctttgtctctttcttgcccttgggatgagacaaagtccactgcacctgccacctctccccagggcccctgattcctcagtcctttatttagacatgtgttgggcatgtattgtgtgtcagcctccacactggctgctgggtttacagacgtgagtgagatgcggccctccccccgggtgctcacaggcacacatatgaagagatgacaagaccagacatgcctcccactcctgctgtgtgccaggaaccattcaatgtgcttcctgtccatggactcatttaatcctcaaaaatacgagttaggtgccattattatccccattttacaggtgaggaaaccgaggtccagataaattaagtcattgtttcaaggcctcactgctgagacttgaatctagccagcttcactccaaaggttgggctctcatcaacagatacttagatttaaaactatgcagccattaaaaaacaatgaaatctgctgggtgcagtggcagtgcctgtgatctcagcactttgggaggctgaggcaggtggattacttgaggtcaggagttcaagaccagtctggccaacatggtgaaaacctgtctctactaaaaatacataaattatcttggtgtggtagcaggtgcctgtaattccagctacttgggaggctgaggcaggagaattgtttgaactcgagaggcagagattgcagtgagccgagattgcaccactgca
